United States Patent 11,001,841 (CCCTC-BINDING FACTOR (CTCF) RNA INTERACTOME) - sequence listing, part 41

SEQ ID NO: 97884 - DNA, 5762 bp, Homo sapiens
gctgaggcgggcggatcacaaggtcaggagataatttttaatttttaaaccaatttcccaattgtgttttttttttttttgaaactggatcttgctctgtcatccaggctggagtgcagtggtgcgatcatggctcactgtagccttgacctcctgaggtcatgtaatcctcccacatcatcctccagagtagctgtgactactggtgtgcacttccatgtctcactgttttttgtagagacgagatctccctgtgttacccagcctagcctccaactcctgggctcaagtgatctgcttgccttggcctcccaaagtgctgagattacaggagtgagccatggtgcccagccccagtttccctattgttgaacataacatttcttattttaaaatgtttacctgaatactcttttactgaattatttttaggttggtcttcctgcaaaatctggagttgctgggggcattcttttagttgtccccaatgttatgggtatgatgtgctggtctcctcctctggataagatgggcaacagtgttaagggaattcacttttgtcacgtaagcatattttcttaatgtaaataatggtgttacaagttgagccatccaatgattcttttttttaacccattttccatagttcattaactcttggccctccgcctatagtgtgccagttactagggagccgtggaaatactcccagaggagcttcaagttgtctctgtcagacagctcccatttaattattcccacagattatatttgttagatgctaatattttaattttcatggttataattagtatgaattttcaaaagctcaacaaaaggtattaaacttggagaagtaatttaaaagccagtatatcttaagaattattttggtttattatatctttaatctgcatggttaaatatctttatccattgactacctttaaacatttttttgaggaaataagcactgaaaattaaaaaaagattaaaccatttttaaactgttactgctcttgatagttctgtattttgttgttacccagttcctgctaatgtttgagcttctagttttagttacattgattacttgcttgagttcatattaagtaccatactcaattaaaattgttttattttccagtcttttatattttacaaaaactagagtatgaccttggagtgcatataaaatatagtagattgtaaccagagtacttatttatattttaatgtggctttacacttatttgatagaagaattctttcatggggccggttataaaccctattttgtagaagatgaaagatgatttgattggctgagccctaggatcatgttagtaagcagtgttcttaaaacttatatccatatcttactctgattttagttctcttcttgatgcattatactactttattagcatgtagtgatgatttctaggctggacgatataagcagagtttgttaaaatatggatatatataaccaatgaatagccaatttcttatacctgctctgtataactgtttacaggatcttgtttctctgtgtaatttccataactatgataatttgagacactttgcaaaaaaacttgatcctcgaagagaaggtggtgatcaaagggtaagcaaaattcttatttagataagtatataaaatttttaagaagagaaaaagtgagatttgcctgtataaataaaatcttagtttgttagtggcctcgggtctttgctaatcataaatgagtgtaaacaaattgttgacatataaatccgggatcaccagtattaaatacttaaagattgtttaatagatagttaatagatacagatatttaaatattgctgttttgttatttaaattgaaactagttagcctagtgtcagggatttccccttccattttctgctattttaagcaagatttttagaattgattctgttaaaaaaagaacaaaacaaaacattggaatgtgctgcatgctataaagaaagcatcgttttaatatttgttcgtcctaaattgaagtttaacttcttgcatactgtgtagatggatatgtaaatggaaaaggattatcatattagtgagagaccgtatgaagcctcaaaagttttataagtcactgtagatgaaatatttttttccaccgtgtttaatgcaatattcctaataatcttacggtcctatttgtttgttacgagtttatttggcttcatactattgtacacatatattcctttttttagaagtagtattaagagtcaggacttaacttttttggtctatatagtttttcactgtaccaaggggcttgtgctgagaattttgattcagtttctttgcgtaccatattgaaaatgtttgtagtaaaattacctaattagacctcaagataatatgaagaacttctaagtagaaaatatttttaatacatactaagtacattttctgtagtgctaaactaaatttttgttagtttttatcaaattaatttctgttactatgtaagaattatgcaaaaccaacagaatagaaacttccatgggagtcgacctgagtaacatgaagcaaaatgtcagaggtggtggtttaaaatgttaacattttaataatgctcattgaaaaataccattttatagcttggacctttcttcactcaagtgcactaataaattatgtatgttgcttgaacaactagcattcctttggaccattggactatgaaagtctccaacaagaacttgctttaaaagagacagtatggaaaaaagtgtcacctgagtcaaatgaggacatctctacaactgtagtatatagaatggaaagtctgggagagaaaagctaaagaaatgggttctagtttcagaatgtttcttcatttaatctttcaaacatctttagcttttttttgcaagttataaatatttatttgaggtattttttgttctcaatcttgggtgctggagccataaagcttttttttccttttaatctttgtataaaggcagtagattaagaagtgcatttgttggtctttaaaaagtatttacaagtacataaatttgctttatttttaaaaatacaaaaaggaaaaatttaaattttttttgatgtaattaaaatgttaactatgtggtcagataatcccattttacaatagtaacagaaaattgtaattcttagttctaaaattcacaaattaaactcataagttttgttgcattttgttttttcttttccatttttaaaactaatgtgatgtctttagtggcaatagaaggtacttctatgctaaatacaaaactaaaaaggcaaaataatgaaccccaaattattttatttaaaatagcagtggattataaaattagcttgtgtttacatttatgccatttttggtgatagattggctttacattttaaaaaatttatttaaaaatttatcaaatgctttaaaatatgactcctactttttttattttgcaactcctctgttctgtcagagttgttatatacaggagtgtcttatgttactaaaacattccagccaaagaatttcagatgtgagataatgatgtttcatcaataaaaagctataatggttagttactcagaaggagaaacagtgagtgtcttcaagtgaattgttcacctaaacaattttattttcatattatccacataactttttctatgttatatttaaatatgaatggcaaattttggtttttagcttttacattttattatcttaattttataaatgctaatatttcttttgtgataagttatagcatctcataaagtttgttctatttgaagttttttagagtacttgagaaatgaatttagtctgcaggtagtaagtatgctactaaaatacgttagatctaaatccttttatttggtataaaaatgcaatattgagaatcaaaacttgtttttaagagaactatagattctacacaacctgatttcaagtaattattcatagtatttatagttgtcttggcaaagtgattgtaaaattctgtaggacctattcacacttcttccttcttccatatacttctctggttttccccatagttcccctataatttcaagtttgttgaaacctgttaattttagtgggggattagaagaaaaacttggtggtttcttagcatgatggtgtatgtatgtggtaatggaaagtctgtaaaagtaaatatagtgtagcaaaaaagatttcactgagtattttagatactagtgcaaataaagatagaaaatcttgatcataatgtcttaagtttgggaactgtgatattaagaaaagaaattcccttctagaggtgctggccaaaaagccttttgggctaacttaagtattaaatttatatatttaaataattatattttaagttgtagaggattttcccaaggattttatgcttacttgaatgttctttgaatgttcagatgcatatcctaactggatgcttctcaaggccttactgcatatttgtgttgcatatttatgttagttgcaccagggccatttgtagtttgggcaaccgaatgccttaattggaaaaaaggcattgtggtttcccctatgatctaaattgttacattttaccatttcattccgaagttggttttactttattaaatgaagatttagttttcatatcgtatacatagctgtatagatttcaaaattaggttgttaatttgtgtcacttactatttttgtgttggtaatgctttaaatgcatacttaaaaatgaagtactgttatctaagctactgtgtttagaaaatgttaagaatgagcagaaatttttatagaaaagtataaacggaagaagagataagatactgcgaataggccctcaaacttaaaaaagaaaaaactttgccagttttaaggacatattttgattctttcagtattcttaacacctttttaaacaaagttcttgatagtacccactattattgggtttgttttatgccattattgattcttgatattcaagcatttacaatgtagcatatttgattttcttttttctttctttttttggcatcattaacatttcatttgaaatgcatattgttcttgaagtactttgtttttagcataaatgttgtgcattttatcttagtgtttggatgaaaacatttgtgttgtttagctttcatttgctttgtatatttaataatgtacctttattttccagtatgcctacattttgtattgcacaataaatttattttaagctgattttattgttttttttgttttgttttgttttgtttttataaaagcaacttcaacattttaagtacaaatacagttgggattttaacttagaaaaaattattctttatgaagatactgttaaagtgtttgctattctgaagctgcctcaaagtaaactagaaatattcaaaagggctttatttgattttttaaaatgcaatatagcattagtggtttttttgggaggaggacttttcttattggttgtactagaagtatttgaataaaaacttttctctcaatttttttggtggtttttccatttggtaactttaaaaaaagtgcaaccctatttgtaggttatttctgctttctgaggaggaatattgttgttattcactatgtaactctcattttatctgttgttgcctaaataataggaaaaacattgctaaaccaaatgaagagtatcatcatattgctttagaataaaactgt

SEQ ID NO: 97885 - DNA, 1019 bp, Homo sapiens
tctggagattcctgaatatattgtagaagttttaaaactatttgaaaggggaaatactgttgtttacatgaatttgtattaatctgtgggatttttaaatgaagttcttttagaattagttaataaggagttccagtataatgatatattcaatatatgtaacagtttatgattacttgcttttaaagatttttttaaaaaatttatttgaagtaaagagagaggagacttaaaatacctggtgatcttgatctgacagtgtatatttaataggcatatatttatgtggaaagaactgctgaaatatactgatatgtcagcctatatcctgataatttatatataatgtgtgggttgcatatgtttgtgcatatgtatatacgtttgtgcatacatatatatgatttccttatctatgtaccttaatctacccattcatattctgaaaatgatgagcagttcttttcacattgtgtactatgtataaattattcattgatctattcctgttccaagctttgacacaaaagaacccctaaaatttttgctgccctagaattggtaaagtataacatactttacttcttcaatttgactttaaagatttgtggtttctgttaccattcccattcactaccaggactgccagggtaagagagtaactaacaatattgggggaactctggaaaagtgaaaccaagaatattagatttcatgtggaatttaaagcactttccaaaatgtattataaggaaggattgtattttttaaattgtttttgacttaaaagaagtaatgcacttatattgagcagtttatggaacagttttatttagttactgtggtacagtttttagttttaagaatctgttttactattcatctgtaaaaagtttggtttttctcctacatggccttgaaaatgctagaaagcattttttaaaggtatacgatcagaatacttaacgtgtgatttcttctcaattacttctctaccattttatatttaatgttgtatt

SEQ ID NO: 97886 - DNA, 1061 bp, Homo sapiens
cttattctttatttattattttacttagatccttgaagtatatgcatcattgatccaggtctatgcacaagatttataatgtaaataaagaatgaactaaataatactgtttgagatgaatatttgaattgagatgaataaacgttgcatctaatgcacaatgaaacttcattgacatctgatgaaattacagtacaagtgattttgttaacattctatggtgactaatactattaatcctttttaatcataccaataaaatatttctgccttaatgtctctttttactggactatgaagaaacaattctgctgttaaaggataaccaaaaaaataacttccacctatctgaatgcccttattctggcaaattagcagttttattgtagacgtacccactttaagttgctctgcttctcttctagaattgcttttgtaataagtgtaaatttgtagtcagataactcattgcttttatgaagttgctttcccacttgtgtgaccttaagaaagtggctgaagtccaggattcttctggcttcctggtttccatttcaatattttcaatccctgttttacttagttagcaaacttttttttttttttaatgccttctaaataggaattttgttctcctcatgttgttttcttctcttcatttctggtacccaaccaatatccaagattagatccctctatataaatgaaaatgtataacctttaaaattattttcttttggtctttttttctaccaagtaagaactaaaaaagattaccatccccctcagcatttcactagtttttgttcaaacagcacacaaacagaattatttcaagatatttagctaattaaatttgattgtgcaattcagatctatataaattaaccttagcattattcctgtgctttattattcactgataggttcttattcaactaatgtttatttcttgcctaatatgtgccagaaaccgtgaagtgtttaggatatgcagtgagtggttaatgagacaagtatgatccaacttgtgtttgcaattaagcagggatacaggtact

SEQ ID NO: 97887 - DNA, 1001 bp, Homo sapiens
gatgaggctttattgcttagaagtaccaacatagttttaaaaataataactgggtaattaatatattaatggtatatacaggggaatttggatttttcttagtggtgggggaagtaagacacacaaatgctccatgtggtcatgtgttatagtgccatagtgcagcaaaggtagacggagattacttttgatttaagagattggagcagagttcacaggaatgggtaagaataacatatcagtgagaaatgggtggggaaaaatgatttcaggagaatagtatgcactgtgggaggaagcaggaggtagatccagggttgtggtgggagtggaggtatctaattgactctgtccctagcacatgctgtcacagggcactgtgtgggcagctggcaataagctacatagataatgaatgctgggctgggatggcctggggaagactgacagcaaggaagggactttcgggctagtctttgagggaagggaaggatttgattaggaatctgggtgttcttaagagcatagacaccaagacaaaaacaagggcagtaagaccaattttgctctattgaggttgagaagaaaaattaagttagctggactgaagaaccttgaatacaaggctgaagaacttaaatgttatcaggaatgattttgggtttcttgatactccgctgcttagaaacctgtagtgattagagcaatgttttgagaatatgattagaagtatgtggagaggttttggagggtggaagaaggaccagaagcagaggcatcagttaatgattgaataaatcttgtaatgatattcaaagatgtaaaagttaaggtagatgggctgggcacaggggctcacacctgtaatccctacactttgggaggctgaggcaggcagatcgcttgaggtcgggagtttgggaccagcctggccaacctagtgaaaccccgtctctaccaaaaactacaaaaattagattagtggtggcacatgcctgtaa

SEQ ID NO: 97888 - DNA, 1010 bp, Homo sapiens
ccttgggagtagtatttggcagtggaaagtgggtaatgaatctgcaaagcagcaaacaggaggaagattagggtgatggagcagcatggaaggcaagtcgtgagagggtggagggtgctggggggatctgaaggaatcagggcttaggaagctgctggagctttggagagcgctgtttagaggtaacaatgagtgtgaaggtaattttcagggaattaaaaatatactttcaggaaataagcgctgaagggagaacaatagggtcaagtgttgctttttaaaaataggatgaaattgtgtctgttttaaggtaaactgagagaaccaatgaaagaggaaaagttaaagatgctagaaacaaaggggatcagtgagggaacaagaacagggcatctagaggataagtgtttgaaggaatagataaaaagtagtctcaaaaatgaggaagctttttactttgagcgatgaaaacagtttttatctttttagcaaagttgtagttaggatcttctgtctgtttttaggggtctccactggtattaaaggcctgaagaaagtatggcgggaaccaacaagaaaaaaaaattgtcaagcagtaatgagagaccaggtggaaatatggagaataatctgtaatagccagtcagtattctgtggtccaagagcaaaaagggaattgagaattcagagttgaccccattaaaaaagaaagacattaaggacacctgaaacagtggtttataacccagaaaagtgcatatcaaagtcacctggagactttaaacaaaattatgggctgagcatgttggctcatgcctgtaatcccaacagtttgggaggccaaggcagaaggattgcttaaggcccggagttcaagaccagcctggccaacatagtgagaccccatctctataaaaaacaacaaactctatgcatttacctcctttccctaaaatgtatcggattgaggtgtaggagtaggacaacaagaaatgggagagatgtttatg

SEQ ID NO: 97889 - DNA, 1075 bp, Homo sapiens
tctgcagtacaggaacttaactagctgagcacacccccaaaatactactattactatttgtgttgataccacttcaaaaaactttccacttagtcctttagcttcccttccagccatccttttctattcctgcccagagtccagaacagttttcttaatggggaatgggggtggaacaaagaactgaagaacatcacccagaatgttctaaaaacatacataaacatctctcccatttcttgttgtcctactcctacacctcaatccgatacattttagggaaaggaggtaaatgcatagagtttgttgttttttatagagatggggtctcactatgttggccaggctggtcttgaactccgggccttaagcaatccttctgccttggcctcccaaactgttgggattacaggcatgagccaacatgctcagcccataattttgtttaaagtctccaggtgactttgatatgcacttttctgggttataaaccactgtttcaggtgtccttaatgtctttcttttttaatggggtcaactctgaattctcaattccctttttgctcttggaccacagaatactgactggctattacagattattctccatatttccacctggtctctcattactgcttgacaatttttttttcttgttggttcccgccatactttcttcaggcctttaataccagtggagacccctaaaaacagacagaagatcctaactacaactttgctaaaaagataaaaactgttttcatcgctcaaagtaaaaagcttcctcatttttgagactactttttatctattccttcaaacacttatcctctagatgccctgttcttgttccctcactgatcccctttgtttctagcatctttaacttttcctctttcattggttctctcagtttaccttaaaacagacacaatttcatcctatttttaaaaagcaacacttgaccctattgttctcccttcagcgcttatttcctgaaagtatatttttaattccctgaaaattaccttcacactcattgttacctctaaacagcgctctccaaagctccagc

SEQ ID NO: 97890 - DNA, 1029 bp, Homo sapiens
cttcagttgatgcagtttcttcatagtgtcaatggtctttacaattttgtatgtttttgcagttgctggttacccctcgtggagtttttaacaacccagggtagacaagacaaacctttagagaagcataaactttaagatgataattaacactgaatgttctctcttaggatttgcaaagaagccagtgattggtgaggacagtgattgctggcagggattcgacatttatgcagcctgatgttgtttttaataataatgtgaattttatcagcatacaaacttgctcacaatattgagacatacaaaatgggaaggcttctaaacaagctaaaatgtataagaaaactgttaactctaaaatgaatatattggagtttgttgaaatttctgcatttggttggaatcagtttcagaaggcttcatgaagttaaattttaatcagtgctttagggaagagacgagactgaaggcacagaatgaaaagaagggcattctatctatagtgggaaaaatatgcctagaatatattctgctcctctcctctctctcctggtcgacatagcaaactgctattcatcctgcaacaaatgatgtcaacaaagtggtcagggaagggataagaatgcagcttacacatatacatgtacagtaaactctagattcatatccttggacattatgtactggagtagagtatatgagtcaatgagtaatgagaataaaagtttagaatgggaaaaaaacgcatacttgatggtggtttgatatgtattaggagtttggattcatttgagaactgggagctgtattaagtttggagcaagttgattactctttagctgtattgtgtttctgtttattaagcttcaattttttttttttttttttttttgagactgggtcttgccttgccactcaggctgaagtgcaagtggcatgatcatagttcactgcagccttaacttcccaggctcaagcgatcctcccacctcaacctcctgagtagctgcaatcacaggcaaacac

SEQ ID NO: 97891 - DNA, 1035 bp, Homo sapiens
ctacgtgtttaggtggaataacactcccatggatgaagcactgcactttggacaccatgatgtatttaaaattctccaagaataccaagtccagtacacacctcaaggagattctgacaacgggaaggaaaatcaaaccgtccataagaatcttgatggattgttgtaatggtctcaaatcccaagatttaaatcacttacctatttaattgtggaaaatgattatgaagaacatgtgtatttctatctggtagtgatgtatattttacatttgtcatttcagtgttactggagttttcttcattgtgcacacaggacaaatctgatctctttgggaaaaaatagaaataaaacaatctccctccataatgtgagcaatattacctcgtgcattgtataatttgatgtaaaagaaatagttaccaatgctagcttgtgtggtcttccatgatttatttgtgttttgtgaattttcaatttatggtgatgatctgctgatatgcatttataaagtaagctctgttgtacagtctgtccaaatgggtcaaggttgcctttagaagcaaatagtgtgattttcaagacttcaaatacaaatttagtttaagtgtttgaacaactatatgcacttacggttgtgtgtttaaaatgtctctctcaccccctagcttcatgatgtgactcttaaaaaactataatagttaacaactgttagtaagatagaccaattctgattagactttatcagggaatctgtttaagatatgtttggtgaccaaaacgtatgtgtgaatgtagttataatgcttttgaaaaattttcctttttctatatccccttagtccagcctctcttctcagacatttagctatctgcctctttcctttagctgggaaagtgagagctggcatactatgcagtttttatgttttccatagtaagtcagaaaatgcctcctatttctggcatcagaactttgccatttgtctacagaagacgaaccagagacaaaattactaagtataaattagtcaa

SEQ ID NO: 97892 - DNA, 1001 bp, Homo sapiens
agctgcaccaggcccgaagctgttcccatgcttgagcttccatggggaggatgctgagtgagcagtttcctaccccgtggatctagcaagccatggagacaggtagcatttgtaagatgctgcacaggagcagcattatccccaaagatattacagggtagacacgttttaactgaaatcaatcaagataactttattcaaagagcagcccgctttgtgtgactaaaatgaaacaagacagttgaattgtgtgacttgaagattaccaatgattttgaggcttttctataataaaaagaggttctaaccattatttgggaacaaagagagttttcatcttttttcagatcaaaaccattctgtaaaatctttgttgtttaattaaatgtgccgttatttacccctgatgttatttatgactatgtgccgattcctgctcgggctgtttgctgttggctggtaataatatatttgatttaaatgctgttgactgtgctattaactgctgccgtcagtaaactccaaagatctttttgttttggctttagtatcatatgtgctttttctgtatcctgagcgctctatatgatcatgttaatttaaagctttatacacattgttgtttttgctggtctcatctttggtaatatgctataccccactgctgcccgacactgccctttagctgcagagctggattagctgttgaccatttgatgctgttgtctgtctggcagggactgaatgacctgatgtcagatttagattcttcctggggattacacagctatgaatgtatttgcttctaaaacctcccaaagtgaatctaatcttaaaactacaagttgtaagtattctgaaattgggaaacatttattttaaatgcaatcaggtagtgttgctttttacagcataataaatatatgtatcaaaaaaaaaactgtgtggaaaaaatgaattttcttaaaacaattaagagccaggaactccactgagcatac

SEQ ID NO: 97893 - DNA, 1018 bp, Homo sapiens
acccccacgattagatgagttattactgagaagttattgcacccacaaaaaagctgccatttttttccaaagatgtcaaaagctagaaggccaggtcttctcaaagtaaaatacactgtgtattggggaaaaaagggtaagaggcataattaccaagttaggcatagtctgtcaagttgtatttagctattatcatggaatagtgttattccctgataatgaatgttggcatcataaccagaatgattattctcatctccatatcttcgtatttacatctaggaaatataaagcttatttatagtgaacactgagagtggtctctctccaaggagtaaagtaaatatgccctggctaactagtgtaagtttgtattctacataattaaccattataagaagtcactgagtagatcctaacttaagggatatttgtttgtgtttgagtatttctcgtgtggtgtttctaagtttgaaaagtgttttataagcatagagcttatgtgtgctactggggacaaatgtctcattttaaaggaaagagggttttctgagatggcatgaaatgagtgaaatctatttattgcctgaaagctaaagtggaatatgaaggcaagtctttctgaacagagcagtcctgtcactgactaacccagggaaaggacaggaaaaagctagaaagtgttttgaaaactcttctgcttaccttttgaattgggacattaacaaagtaaggaccatttatgtgactggcttcctttggttagttatgattcattcattaattaattcatcagatttatatagagcacctgccatgagccaggcattatactagatgtttgggaaacattggtaaacaaaagcaaagatccctgcttttatggaacttaagatattctgagacactggatcatacattctagtgcagtcaccttattaaaacttaagattttgtgatgcaaacaaacagccagaagctacaaataatgtaaatgttatatttaaaaaatacaatt

SEQ ID NO: 97894 - DNA, 1094 bp, Homo sapiens
agcatttcctcacccgtttcacatgagcagatttgacacgttgctctgtccccagacttgcataacagcaaaaagctttatgcagtctggatggattcacaaaattaagccagtgggcagcagagtaataatccgtcagcttaggtgatataaaaggtcttgattagcccaggataatacatagtacatgctgaaggccctcttattccacggtatttatttgccattgcaagtatcttcctactacttcattctagaatagacaagcaatgtttaatgtatgagtctgcatttcacaagatcagtgtaataaacttaaccacattttgtctttttacagatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaa

SEQ ID NO: 97895 - DNA, 1050 bp, Homo sapiens
cagggaaatgtagcaaataggatcatttttaatttgaaatgttgttttctatatatcataatttattttaataaaaaattagatttttcaatatgaaaagaaaaacaaagtgagtttatctctagtaatttaaatctgtggcttaagccaagatgatccacttagtagtaagttatttatgtgcctatgggcagcacatcattgaagatgcaggcttttaaaggtttttaataaatcttttttgcccagatttataaatctaagcaaataatggcaaatagaatgttattgagaataatacctccctttattttccctgagacagtattataatttatttagaaataaagcagtctactgtatatgttataatgcttagattgtgattagttcttatgaggttcactcaaatccatcaactctgcagtgttttatttctctgtcctctttcattttgggatgttctatgggatttacttagcttttctcctttttagaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaaggtaagtggggcaagcaggtggtaacagcgtggcacagtctttcctgatgagggggtgattattctgaaactccacccatgcagtgttttgctttcgaattggtaagagtaggctttcaaaagatggcataaactcagtgcaggtgaaacataatgcattatttggcctgatacagctagtaagaaatgaatggacaatttcctattttaggaatgttggaaaagtccattgctggtcttgtgtatttgttactatcactgtttccacatgaaaagggtttaaataaggaactgtggtaaaccaacagaaggcatcttgctcacgttaaagttgaggaaactgaggcctgggagaagtgaagtggttc

SEQ ID NO: 97896 - DNA, 1929 bp, Homo sapiens
ctgaccagccagacgagtttaacggcctgctcgagcagaggggcccactgcggggaacatttagattctgctggagtcaccagacagtgcggaccagcttgcactgctggattttgctagtgtggggcagcttgtgtttccgtgagtcacgctggaggtcacccccaggctagcttgctactgtttggaaagggaagcagagcccggcccagggaagtggagagctctggagagctcctggtctgaatgctgataagagcggggagggaacttgatattccctgccaggggagggatcccattgctgtgctgaatgggacagttccatccttggcacctggggagtctttgcaaatgatggtgggaggggccatggtaagtcattgttttagatttttgttcataatgtctgcatttgtatactttcaggaaaatataaatgataaaaattttcccttctggctttggattgaaagcatcctagaactcattaaaaaacacctgctccctctctggaatgatgggtaagggccaccgatagatgtattttgaaacatatttttagtgctgcgaggttgagacaaggcctgagtccagcttcagtatttgactaggcgtgtgtgaatctcacaggagtgcgcatttataggctgccccttcagggcttcagaagagtagaacctcataacattaaccttacactttcttagtacaagtatatgtattggcaaagctaaattaaaaaaaaaaaacaactcttgagtgccattcatgcattcattcactcaacaaaaattttttgagcacctactatgtggcccctaggaaggaagaaaaacccttttaactgggtaaatcatttctatcttgacttattgccaggatcggctgatatttcaacagaagctttaacttgatcagaagggctaaaatatgaaaatatattgcctaggtcttcctctccagtaaaaaagatgtatacattcagacattgttatggcctttaaaataataaaggaacaataaaaggctcattaatcccacacgtgttattgagcatctgtagcatcctactgacaccatgttcatatcgctttttttaaaaccttagtatatacatgtataagtgaaatgcttccttaagtgtcaactgaacagattttaaaatagtctacgttttttaccgtaggttttttttctcacattccagccattttcttggtttgtaagttagcatgaaaatggaaatcatgattgaactaaaagcccatccgtccatctcttcgatatccaggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcggtgagtgggagtttgagcacatagtcccaccattccatgtgtgtgaagtccctcttcatcgccgccagtcagctcatacagatagtgcgtttgggacatgaaattgcagatcttatacttaccccaaatgagcccccgataggatttaataaaccaccacaaatgtttgtggttgtggttcactctctggaacatattgtggaaatgatggttttgaaaagacaatgccaattctttcctttgcatcaggtttgttatctgcagatcaaggatgtgagtcaatgtaatctgcaacccgttcttggaaggaatcacatttcccacaggagtaagcatccacattctcttagggtcatcccagagtagagtgtgcagatgagacaggcttcgggagaagacttcatacacatcatcagccagggagttgatgcaggacctgttgggacgagtggcagcctctaccctgccttcaaacagagcagctgcaaa

SEQ ID NO: 97897 - DNA, 1050 bp, Homo sapiens
agtatacctctggatcacccggaattgtgttaaaatagggttttctgattgcctaatcatattagcccttgagattttccaacaagatcctaggtggtgagatgctgctggtctgaggaccacactttgaatcagaaagctttaagataaataaggactgagttaatgagagtaatcttgtgtatagtatctgagaaaccgtgaactaaattccagcgtggtaccatgcaactgtatgaattaatggaaactcccagaaatactgtttattttagacatgaattgagcctagtttttttgtaaccttgttaacagtttgccagcattttccagggccttgggaaaaatttcatattgacacataagcaggaagcctgtagtacatgtcagaagatctggaaggcaagtggggacttgactttggagtgtaaccagcaagtacacaccctgaagaaaacgatggctataatcatgcccttcccattacaggctcagtcggggaatattcagagcacagtgatgttagacaaacagaaagagcttgacagtaaagtcagaaatgtgaaggacaaggttatggtgagtattgagtaaacacatgcatttattctgaaactttctgtaggggaaaaaaggtttcaattgcttggggtgtaaacctcgtaactgagttcagtcttttaagtagttgggaagaaaaattttgcagaagtctcaagctataagtaaacaaattggcaaaatcaatgaccagatagactttttgaatggcctcttataactgccaaacattgagtttagctttttcttccctgaaagatcatgcagtaaatgttgactttgcccagtacccagtaaatgagatgttgctgctctaaatgggcctttatgtccacacctctcaaatcacagtgccccaggataaacatggcccatccttcccagtcatctgttttatcctaagacttggaagaggaacaaaaatacattttattgaaagaaatttggatacatttctgattaagacatccacagcaattttaggataca

SEQ ID NO: 97898 - DNA, 1050 bp, Homo sapiens
attgctattggtagtgttttgcaaactagctttgacaatggcaacagaaaaccctagatgaatatctttggtctagttcaaagcttagaccaacagatgcattcattgaggaatgtcatgtatagtttttatatcatttgcattgtctcgggatcctaaccaaagataattggccttaagaaatatggaaagatattaaagtaaaaatattatgtgaaccatatgtgaaaatacttgtttttaaatcaaaaagtacgttaggtacctgcacttagaaagttaaagcaatttttgtcataattcgtgaaagaaatattttgattttaacaaacatagcttatatagaatttaatagatgagagatgaggtttcccggagaatataaacaaattcatatcaacttacaatacacaataaagtaaacattctgcattttaatttatttttgttctaaccactcaaatctaggataattttcaggaagacccaatccagatgtctatgatcatttacagctgtctgaaggaagaaaggaaaattctggaaaacgcccagagatttaatcaggtacttttttctcattgaacacataaactgtaataaaataaaaatgtattcattcatcaaatactattagggcccatgtcaaagcaatgatgaatatctctctaattttatagccccaagaagtgggagaatcagatttagagattttatagaaccaggctttaagaaagatcctaatctaatggaattaagttctaacgaggagagagaacatataaacaagatacttctgggtagcataaagtgctgagaagataacatgctgaattcatggagtggctgggagtggggttgttcctttagatcagggtcaggaaaggcctctgagttgctggcacaggaatggaagcaggcagatagagggttcttgcagctgtccaaggtagaggcagtggaagcttgcgctcagtagaatcagtggaggtaggaagaggtggacagattcaggttatgctttggatgtgataccaatatagaaggatc

SEQ ID NO: 97899 - DNA, 1028 bp, Homo sapiens
cagaaaagcgttccctgggtttagcaacacggaggtcagttgctaaagggagcttctagaatgacgacgtcgccaaatctgtcctctgcctggattctcggcgatgaaactactacagagacctccaagtttgggcttctgcaaacacagcacgtccttctgatcgttctctaagatatgtaaacagaacgccagttcccagcgtggcaacacgggactgggctgcagctcacccagccggcggcccccgccggaagccggcggaaataccccagcgcgtgggcggagcagcggcccgcagagggaggcggtggcgcccacggaacagccgcgtctaattggctgagcgcggagccgcccggtgattggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagagtgagtggccgtgaggttccgggtgccgggggtgggacgcgcagggacagagtcctcgggccgtgcagttggacgccgggcgaggacgggccgtctgtgctgacccgcgaatagtgatcccagaggaagaacgcgtcctgagtattccaagtgcgagcagtgccacctgttctcggagatggcactgctcagcacgattgtccttgccagtcgtgctctggcagtgaagaggacttgtgaaatataattttcctctagaaggcactgcaccttcccatttaccgtcactttctcccgtttccacccctttccatcagtcacgttttcttcttttcgcagaaagtttcatttgctgtatgccatcctcgagagctgtctaggttaacgttcgcactctgtgtatataacctcgacagtcttggcacctaacgtgctgtgcgtagctgctcctttg

SEQ ID NO: 97900 - DNA, 1389 bp, Homo sapiens
ctgtaggaacatttacctggtaaatcatttaccttttggacatggcttgaagcaatattggatctaattaagaaacacattcttcccctttggattgatgggtaagttataggctatatttttcatatgagttaattatgttctttttttctgttgttattggttttcttctttctttttctcttaagcatgtttagtaccacagaaaaaaatagttgcaatttcttattctttgtggagtggcactatgtatattaatctatatatgagtatttcaggtaagaatgacttttgattacactcaaaacaaactgtaggtctttgtaaatgcaataagtgaaaatccaataatgatcagatgaaataatgcatgttctatttttaggtatgtcatgggctttgttagcaaagagaaggaacggctgttgctaaaggataaaatgcctggcacctttttattaagattcagtgaaagccatctcggaggaataactttcacctgggtggaccattctgaaagtggtatatactcactaatgtttattcatgtgaaattagttttcttaaatttggttactgggatttcagtttttggaagtgtatggtgtgttgatctgtctgtgatgtattcagtgggcttgaatattagtagttgcagttgtctcagaacagggtacctatgaattccaaaaagtctatcgtatgcacaatctatactgtccagacagcagaaggtctgacattgaagtgacatgaactgacaagtcactccagtggcatgaagataatgtgggcagggaagaaatggtcacaaggaatgtgtacaggaacctgtatatttctccaatttctgtttttcaaggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaaggttaggtttttctgtttgtttttgtttttttttccttaagattttggaaaataacctcatattggagcaaagtaaatgaagttccccttcttgtttactctgatttctgtaagatctaagggcatgtggaggtcaaagccttagaaatgaagtggtatgtcagcagttcctgaaaagggaccgctgggctttctaacactagcgagtaataagcagctgtaactaaacttcaccatggccatgggggcctctcatagccacttggagagcttcagttttctcctttgtaagacagaagtggtgcaggcttcatgtctatgactgagggaaaggaa

SEQ ID NO: 97901 - DNA, 1036 bp, Homo sapiens
tcctgcctcagcctcctgagtagctgggactacaagcgcccgccaccatgcccagctaattgtttgcattttttttttttttggtagagacggggtttcaccatgttggccaggctggtcttgaactcctgacctcagatgatccacccacctcaacctcccaaagtgctgggattacaggcgtgagccactgtgcccggccctaatggtgcatcttatctatgatgtttttccattctgtgaggaatggaacctgcgaatgtgagactgaatagtgttctagcttagactacactgatgaaataatgaagactatgacagtcatgcaagctgtgaaaattaataatgctttatttggtcagagcgtctttcctccagtcttgtgtatagtatgtcagcttccttgctggattttgttctaaatgtgcctcacaattgcatcagagatttaaagtaaacattagacattattttgaatcactgagaaaataatcaccctctcaccacccacatttcagttcagtaaagtattatataaagcgtaaagtctttttccaaaggtaatggacaacactgagtgtcattgctctgtctgtggaatcctggtttctcacacttttaagaccctgatatttggtggtgaacacacaggttccataactcaaagagctgaggaagctatcagtactgaattatcgtatgtatatttattcatagaaattaaactatagaccaggcgtgttggctcatgcctgtaatcccagcactttgggagtccgagacaggcagatcacttgagctcaggagttcaagaccagcctggccaatatgataaaaccctgtccctactaaaaatacaaaaattagctgggcataatggcgcacgcccatagtcccagctactcaggaggctgaggcaggagaatcgcttgaacccgggaggtggaggttgcagtgagccaagatcatgccactgcactcctgcctgggtgacagagcaagactctgtctcaaaaagaaaaaaagaaattaaact

SEQ ID NO: 97902 - DNA, 1108 bp, Homo sapiens
caccaagatttaagaactgaaaacaaaaggcagaggccaggttcctttttaaattgcactgttggccaggcatggtggctcacgcctataatcccagcactttgggagcctgaggaaggcagatcacctgaggtcaggagttcaagaccagcctggacaacatggcaataccccatctctactaaaaatagaaaaattagctgagcatgttggctcatgcctgtaatcccagctacttaagaggctgaggcaggagaatcgcttgaacccagtaggtagaggttgcagtacactgcactcacgccactgcacttcaggctgggcaacaacagcaagactccatctcaaaaaataaaacagaataataaagtaaaataaaaaataagcattcttctcaaaaattgttccttcctcattccgacatctctgtataactcggaggagagtgaaataagatggagaagtggtggacattctacttttccttgagacactcctatagatgatatagtaagtctaagatgctctctgggacaaaaggggagatgagtagggattgcctagcaaaaaaattctaagtggaagaggcactctgaatcagcaccacttgcatgttgtgtgaactgatggccagggacatagaacattagcccctggttgaaggctctgtcttcctcttctacctattgggtacccatcctcctcctctgcaccctattccccaccatcttgataggtgatcctttactcaaggttttcctaaaacccctctttgccatacttttgcatcctcctgtttcaaaaggaagaatgaccttggactccatggcacttgtcagcatcttgcagtgaatcagatccttcctgaagtggtataaaaaggaaggtggagaggaaaaacatctggcctgattttatgtgactatgcccccttctcaccattcaccaccaatgactgcacactcaacatactccagatcctgaaccaatcttgtgccttgtacaggacttttaaagagcctttgcaacattctacccacccttttgtttgggctgcccatgagctatgatttcatttctctaatgccagtgagctgcttatcgccat

SEQ ID NO: 97903 - DNA, 1051 bp, Homo sapiens
attttacaactcactgtactctgttgtgaaaacaataataaagggagcaataaagatcttaacctataatggagctcataccccaaatcagcagggattcaaccactcttgccatagtcttatatgtggaatacttaaagtagaaagagttactgtatggcgaggtggactttccaagtctgataagatgttctgtctcctgtggttggaagtcccttccgtgtccatttcaatcttactctttcctaggcttctggcccacactgccacctccgtttctgaggtgagatcaccacatagtgaataaaattccaagcagttatcagaggcaagcatttctaaatataccttactctaaagagagtcattgatcacttttggctagtacttaggacttgtaaaaatatatattgtgtgggaagatcggttacatatgtttttctttcagtatgcttacataagaaaacattaatcatggcatttttttatggctttaaatttgctctttttttgccctttagtgagcgccacatttttaacatatagatgcttaataagcttaaacaaagaatgattaaaagggatttagttccaaatgttgataaaatttcataaatgatgacatatataattgaaggtttaaataagaaaacattgaaaacatttaacatatgcatattcaagaaaaaaatgggttaggaaaataaaaataaaaactgtctctaacctaaatcaaattaagtgattcatttaattaatttaataattacttaataatttaatgtttattaactatgacccattgttacaatgcttttttattattaagtggaaaaactatctttgattttcattttctgttcaatagctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaagtaagtgaagtgctatcaatggca

SEQ ID NO: 97904 - DNA, 1396 bp, Homo sapiens
tctgtaatgttctctgctactcttgggagtactccctgtacaaaaagtgtacttttaaaaaataaggaattttcacagattttctttatactggtttccgtaattattttttctctatcctatttccctgctccttttgatgaaactccaactcggaacactctctaaatttcatctttaacctttttaatctttcttccgcatgatgacaaaagacaaatttggccctaatggtacctaattgccttcttacatctccctgtgaagccaaaagtttccttgaatctcttaaaccaattcagccttcttcaagtttgactaccttgtataagtttctgagcatatttatatccaatgctgtttcattctgtcaaattcagcacttttccttctcttcaatccaataaatttgaaaaagtgctttctcctgtgtcccaagctctgaactataaccctgttggagctctcaagatcaaaggaacaactgtaatataggtactaagagacaagttcagatgcaaagaaggaaaaaataggagagataatgcttgttcggtgtgattactcacagcagtgagatcagtgcctggcaataattgctgttcagtacaaatttgtggaacaaatgaatgagtggcaccagtaatgtctgccagcactggctgtaattgtatgggcaggatcttcataagcaaaggtgtgagcaggtgttacaagtgggcaacaccatgtaggcaaagacacagaggcaggaaagcaatgagacatggggagcttagaccagcacaactgatgggcccacttgccctactcgtgtgagtattcccagatgggcaagaacagcagagagctatgggaatgcccttcctgctagggagcaaagtgaactggtagtacagtgcagggctaaaagattctttttcttaatatatttgctctattataggactgaacgttgtatgtttaattctgagtcacagaataattattgctttcaagaaattatcctgaattttccttctgtagtttgtccaaagagctctagacttgaagacagagcgtcattgttctgcttccacatctaccatttgtaactgggcgaccttcccctccctaggcttcagtgttcctcactgcagaaatggagtaataataacacctcacaaagttgtcaaaaatgaggtcgtacttgggaaagtaataacagtaataacaaaagcttcttttttcttagattgattcattgcttcttttggtttcatcactatcctatactacatatagattgtgccacagggcatgttttagtaaaaaatatatatgcatacatatacccatatgtattcatccatttgcatatatgtggcttagaacaatgatgaccatttactactag

SEQ ID NO: 97905 - DNA, 1087 bp, Homo sapiens
tcctatgttttgctttttaaattatgggaacttctatggctattcctcaaaacgtagtgttaggaaagtagagggaacaggccatcttgtctgatattagaaaaataaaaaaatctctatcaattagaaagctctgctcagcgttttggtgttaactctgtggttagtaatctcactgcctatacagtatttttcacaagccagggtaatgactattagtgagagttttaaactcagtgagtgagggggcatgggtgtcacctgcacctcacatattctactctctgaaccaccatggcctatttcttaggggtcatttgggtatggctgaacgaaaatatgttagagctgaaagtacctcaaaaatcaagccataagtgagttccttcttgtttagtctgtaaaaaatgtcttttcagttctgaatatcccacgaagtgagatttttaatgacaaggtaaagcattagaaacacattttgcaataccaaagaggaaagaaaagtggcttgaaacgcggagctgctctgagtctgtcagatcctctcttctaactcatgttgctttctcagttccctcctcttccttcccctctatacaccacacacaaagagaaaaaaagagatgacctcaacctgagacctgagaagaatgtgtagccactctgtgttaactctgaaggagttctcaattgagggatcaatattcatgccattttgccacacatgggtagcagtcaattcgtcaagcactccacagttatttccccaattccccaacgcacaccctcaaaatctgtctccctttaagataataccatgatgtcaatatcataacactcatatttcgaaaggttagtgctgtttaagacgaaatgtgaattagttgtcaagactttgtttgatgcctaatatgggatcatcaacagaaggtggatggtgtgcatcacaatttgtgcatatcgcactaagttgaaatccaatatgatcaacggaagactccaaccacctgaaatttcattcgtgagtcattttgtgcatatccctccaagcctttattttatcctaggttgatcttcctcttgatta

SEQ ID NO: 97906 - DNA, 1050 bp, Homo sapiens
aatagacggggtcctttaaggtcaggtcaggtcaggtcggaagaagactgctctgcccttcctgggaggggtggtgagcagggccttctatgttttttccagtgtctcagccttctccactctccctccttcactgtctcttaaacacacactgagggctcaggcatgacaatgggatgggatccaaactgagttacacacctgcctagaatctgtgctctgtttggtcattgaagcattgctctggggcaggcatgactgagcttagttgagataagtcctctgtatagtgaaaagctatgtggtgcagtggttatgggctgggctctggagacaatactggtttttgaaacttgactcttctccttagtagcccccggaccctgggcttgtagcttaaacggtctgcctccattttctcatctgcgcaatgtgggtaattttgcagagctgccttctttgggttatagtaaggattaaatgaatcaacacatgtgcagctcctagaacagtgtcaggcacagagcaagcacttggtgtagatgttagttactactattcagcctttcctgcaatgctttcctggggttcctcctcccccacaccagatatttaaatctgtttgaatcctagcagtgcacataatttaggatttcatacgagggacccctttggaaaatatggggagaaagatggcaaaaaaagaaaccaaaatgttaagtgattgtgttacgataatagattggggtgacttttacttttaactctctattttctaaatcttctataacctggttatgttacctctgtactaataatataataaaattatttgaagaaagaaaagtcaggctggcggtctccagttggtttgctaaaaagggacaggagagagtgagaagccaggggtaggcctgctctagtggcattcacaggtgaagtaccttcccatttgtgcttatagttgcagaaactaggtaacggtgttgaatagtctttagcagaagtatccccaaaagttagaagatggggctattccttgtgaatccc

SEQ ID NO: 97907 - DNA, 1003 bp, Homo sapiens
tccttgatatactgtcttgtatagggcctgtatgcagtgagaaaaaggcactctttggggcagacacaatcccacaggagctcaactttattttagtcaccttattctgccgccccccctcctccccagctggcccacttttatgcagtacacaaactgaacaactgcacagagcagtcctcctccctgcatttagtcgctttgccaacaaattcagactgcccatcctctgcttaagcctcctttaaatttgttgtctctattgtgctcaaaatcattttggtggctccctgtcatctgtatgtagtggctgacctcagttttatcttccatgggaccatcaccagtgactctgagccttagttgttgccatcttgatgtgtgacataagtaatgactgtagcacagatgcgctggttaggctatgtaatgcttctctctccccgcccacccattcccaccactctaacacctgtgagctccttaggtctgactcctagtctagccttggcttacctttcatcccagcttcattgttcatcaggctcctataccggccgtcctctgctaccattctgccaggtcaccgtcttctgaatatgttttttattcttgctttaaacttcttttctgcttaatcacatccaactcacctttcatggtcgagtttcacctcttcagctatccttctgtgattctcctgctgtatgatagtagctgtacctctaaacagaaatgttcatctctatattcctccttttgaggtgaatcgcctgccctatatgaacatattatactggttatcttactcttaagtattctttcctcagttagattgcacatgcatgagaagcagtagatgtgtctctcattctttcttctttcattgcctgctaagtactgtttgtataccagtagcatgggtcagagtgggaggttgtcaacagaagagtccagcatgtatccatgatggactctcgatcaactttatatgattaactca

SEQ ID NO: 97908 - DNA, 1041 bp, Homo sapiens
gaggtgaaaacctcacttctggacaatatgattggagttggggatatggttcttttagaacctctcaatgaggagaccttcatcaacaacctcaagaagcgctttgaccacagtgaaatatacgtaagtacacacgaaggtcatctgtaatgtttagactttgtattttgtgccagagagctgtcttttcttcctcagactcttctttcttttttctctctgtttgagtccagcagtatttgctttataccctcagaaagagttgagtttttactgatttagcccatgagtaatgtgggttagacaagtcagtctgctttctgtgatcaactgtgtgcaagtattgtagtgggtgttgggggcattctaaagcaagcagaatactgccctctgaggaatttagaaggaattttgaaatccataggcatcttcttggataccttcataagattaacaaagtctaatcagggagaagctactcattgaaatgcaaggcagtaaactgtcaaaaaagacatgaactttctcgacatttgtagttagtagggacaggagcagattatcagataaaaatatgtaattggtccctgaagatttggctatagtcatgtcctactgtacaaaagtctaatgccatatacataaacagaagcataaatatgtatatgctataataggagaaaatttcctgttgtaaaaagtctttataaaggatttcacagggtcaagttctctaaatattttaaaaacatgaataaaaaatacatttatatgcagcttttctggagtttgcataaagcatctgcagaagtaaaggtgtactgttaactaaaccaaagaaatgaggcattgattccctgtacctgcagctgagaaggaaacagaatgttttggatgggagtagttttagtggactctgcctcacttcctgagttctctttcctcctttttaaaatgtgcatctgtgcatggagaagaactggattattgggcatgcttaatatttttctgtttatcattctagggaggaagtataaataa

SEQ ID NO: 97909 - DNA, 1132 bp, Homo sapiens
gttggttgatgcagcataacatcttttatgcaataaactgttgaatgcagatttagaatatttgtgaactgctgctgaacgtgggctgggaataacgtatgcaaaagtgccttggaaggtgtcaagcattctacaaagttatgttgttcgttattaccaccattgctattactttttcgcagtagcatcatcctctctctctcaaaacagatgatatgctgaaaacaaccccaaattgtcatgaaatgcacataaatacatgtgcatgtagatattgatgaggaaatgttcagtaaatgtcttggttgcggaaaagatttattggtcattggcatattggtagcggggcatttgaaaatggttaagctggcaatttgggtcactttagagttgagacattttcagtctttttaccgaaagcagtagtactcaaaatggggcagtttaaaaccccaggggacagttgacaatgtctggagacatttttgattgtgaaactgggggtaggagggtgcttgctgccagtgggtcagggatgctgctaagcacccttcaaagcatatgcagcccttcacagtaaagcgttgtctgttagccgtgtccatagtgccaaggttgagaaaccctgaaatgaagtgaaagaacctgcagaaagtctcattatgtcctagcagaaaggattttctctgtatgattaaagattggctttattaattttgacagaacataaaatctaataattaaggaacatatatataccactgtccagatgcttgttttagtttctcttgataatgcagcatgcagcgatatatttgggctgtttggaactaaagattatttattatttaaatgtatgaaaatggttattaatgaataaatctgctggtatattttaccagtcaagcaaattctgatcattttgttttcttctagaagtagatattgcaagtgttcttgtttcattttgccttaagacaaataatatctgaaatttgttttataaagttatcctgatagttaagcccctgtgatgaaatactttatttgatacctgaatattttaaattctagtcctcaaagccccacttctcaaagtatggtgcttggaccaattgtatcagaattcccc

SEQ ID NO: 97910 - DNA, 1159 bp, Homo sapiens
cctttttaggccatgtagggtaacttccagatgttgccatagcatttgtagattgtcatggtgctggtgggagtagcttttagcatgctaatgcattataattagtgtgtaatgagcagtaaggaggaccagaggtctctttcattgccatcttggttttggtgagttttggctggcttttttttaaccacatactattttatcagcagggtctttatgacttgtatcttgtgctgacctcttatctcatccagtgactaagaatgcctgacctcttgggaatgcagcccaataggtcccagctttattttacccagtccctattcaagatggagttgctctgttttgaaggtgtcttacacagggatttctagtttttaaaacatcgtaacacatgtgaaccattttatatacacataacattcagatagtatgattttcttccttagtggttacatttgactgccaggattaaagtatatttttgagtgacccattttaaaaaatgtgaaacgtggtatatgttgaggctgacctaagtaatctatgaaatttcacaaaaatattgtgagatctgtgttttgaaaacaagtatgattctaaaggaagaagaaactaaaatgcatattcatcatatcttattttaaagcctgactttcaagctttatttgatggtttactgttgtcattctaaaacagatgtcatcttcaaatgacttatcttgatgatattatttttgttttgtagccagtaaaaacaatccttttccggttatgtagccaaaggaaagcaacatggccacttatgtttaggatataagaatgtaaatgaaattagaaaattacatgttgataaaacagtcttggaaaaaaaatgattgtagctcattttctaagataattttcacctgcattctgccatctgtcatgctatggcatagcatctttgttatattgggatggcaactagggacttctttgagattagatgtataaaaataaaagtgcagtgccttaaaaaaaataagttgttgttgtatggtatgtctttttctattttatttcctttcaacctatctatgattttatattttaaatgtcattcctgtaggcacatatagttgactcttgtttttatattcattcttacattctctgc

SEQ ID NO: 97911 - DNA, 1035 bp, Homo sapiens
ttgacggagaactcctgaaagaaggggtcaagcattaattgtctctacactccagctttttcttgacacatagtagactctcaacaaatacttgttaataaatgaagtgaggactttacctattttaaatacattgtcttattgtcagaatcattttttcaattagctagaaggggcaaaatttactttagtaaattttgaagtggggaagagcaacaggaccactgctctggccttacttgatagaggccctttgtcatcctaaggcagggttagaattttgggaggcttgggctggacaaaaaccctggcaaacccaattttgcctctgatggatcttagagttgcagtcatttgtttgtaaaggcagtagttctgtatttaagttattgtagtaacatcagctatttggtatttgataatatttttcaaatgtttgaaaagatttttttccctcatattgaaacttcagtgtatggtcctgaaaaatctcaacgttatccaattttagacatgtggtgtaacattttctccttgtttgtctgagttacctggattttagtttaacaacccataaatgtagcttgctgggtttataaataaataaattatttatataaataatttcatataaattttatataaatttattaaataaatttatataaattatttatttatataaatagtaaatattatataaaaaataaagcatatcattagagtacaataaaacagtactattttggttaatagagaatacatggaagaaggtaacgtgtcacaatggatgggtttatttatttatggattttaagaattcaaaggaaataaaaggtgatagcttgctttccaaaagcatatcacagtggccctttaaggagcttgtagttccatctgataaacacataataatgatctgaagtctaaggaatttttttccattatcccctgcagctttgccctttcggatgaagcatacagatccctacgagatcaagataaggaccaatgtattctcattactggggaaag

SEQ ID NO: 97912 - DNA, 2089 bp, Homo sapiens
tgggcaacagaggaagactctgtctcaaacaaacaaagaaaaaaaacttgttttatattgtaagcgacagagggagactctgtctcaaaaaaaaaaatgctttatattgtaagcatgtctttactgtcacttaacatatttgttatggtggagtaaggtttctcagcctcagcagtgttggactgcttacatgttgctgtggaagggtgtcctgtgcattgtaggatggcctgtcctgtgcatctctgacctctgttagctgccagttgcacccctgcccctagttgttacagttgaaagtatctccagacattgtcagatgtcccctagggagtcagaaccacccttgattagaatctctaggctagataggtagtttggtggaaacttttggttcaagtcatagaagtaaagtcatggaaggatgagattcaacacggattaaagcagaactgctttggggtagttttttcccagtatgaagggttaaaaccctgccctgttgtcgtttgtactcaggctcagcctctcctgccctttcagagaggctcccgaacactgagtattcactgtgaccccaagacacacttcccatgcttcagtttcaccattacaaggacacaccatgcatctgtatccccagttagtagcataagagagaaatgaaggcaaatcatctattatgctgtttttgatctttcctccattgcaatatcttaataacgaagctattatggaaagcgatatctctcaattttattgttccaatatttgactttttgtttattgtcttttgcttttaagttggggtgctatacatttgctgtatttctgcatatgtttattttaagagtgctgtgatgtaaaggagaaatgctgaggaatgctgtagcctgcatctgtgactggaatctggctctttattcagtggtatttggaactaggctccagtgcaggaaatagaagaaatgtctactgtgggcatgcattatcttttatgggaatgctttactttttagctggagctgctactgtaaatgaacatttagaacaatgaactttaaaaaaaccaattgaggaatgtgtctcaagtgttctataatggaacacttgctttttattctgtggctcacaataaaaggctttagtgtttagggttgtgtttagtaatgtgcaactcagatttgtttgatgaaaagatggtttatggcttgcaaatagcaccctgaataaagtttctttgaagcaattccttcacttgcccctgaccttcaagccacaataaactgtcctttatgcatcaacatctctagtcggacttggggctgtgcaagttagctaacttggcagccctgcatgttcacacccaccacaaaagactagcctgtgaaaacacaagaaatgtcatcgtcttcatgataactaggtcaatacacaccattatcaaggttacattcatgaaagccttttaactggtggtggacatgagataagaatgggaacctctccagcaagcatccttttttgaatatttttaggtgcaaatttcttcattctgtatagcatttcagctcatcttctgttgaagacagaatttgctgccagggacctaccaaaccatactcagcccaagcagcatctctaaggcaaagaactttgcctgtgttgactttgtaaatgttgtcttaaccaagcttgggcaactatctttttaagaatcaaaaacacagccgggcgtggtggctcacgcctgtaatcccagcactttgggaggccgaggggggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccgctgcactccagcctgggcgacagagcgagactccgtctcaaaaaaaaaaaaaaaaaaaaaagaatcaaaaacacgaaaaagccactccacacaaaatataatgcatcaagtgtggctgc

SEQ ID NO: 97913 - DNA, 2218 bp, Homo sapiens
taacatggctaatctcattacataaatagaattagaagtgaagtgtgggcgatagaagtaattctaatgaccaagcttctttatgtgatagagattttatttttgctgtttgcaaattacatacacacacagtatttaatatttgcaaatatatttagtctatagatcacaaaaatgtaaaaacccatattgcttaaaaggctattactactcagtgatatttgaaatctagtgaaaggcttggcaggtgatttggcttattaagtaacttcagagaaatcctattataacacgggtattaggatatgagattaatacctgattatgggctaaatcatttcatgcccagtttttagcagtttctctgctttgtggtctgtgacttgactagtaatatacccatgttttaattttataggaggactctactgtatttaaagttactactgtacctaacagtggtttatgtacttgtactccggggaaattgcaatgtcttcgacttgcaaaccagtctgtgttggtctggttaacctggaatgaattccttgacctcttcactgagtagtctgatagaccctgctatgttgtagttaatgcttgctcatcgtagctcacattttgaaccagtattcccatggagatgcctcacagtgtccgctccccaccacagcagctgtagtttgacatattgagctacgagttatttctgagtggactagtgacatgatcagaacccagcttttggcgagtaatcaggaagtggcttagtgggaatagtgtcattccactatcaactgaattctcagggctggccactcattggtttatccctggttgtcttccttttccattctctccagtgtttattctactctcctcaaacatcctatttttttactctcagctcatgatgttacgcctacttcacagaaatcaccatcatcatcatacaggccttcaaactgagttaatcctgcttcctggtgcctgacctatatgtatgtctatgtacactccttttacctaggctctagattctgtcgcctcctgtggccagggaccaccttctgtcaaaaggatcccctcttacatggtcaacctctgactcctttgacagagtaaccattctttccctcctttgtagctgcttcacctccttggtcccccaccttcttggaggtcctccctgtacactgagtggcctgggccacatgactggacttttttttttcctctctcatctcctgcatccaacctgggcctgttcctgtgactctccgggtagctctcaattctgtttactttttctctttgactacttctacttaaagccaccaacatttctccactaatcactgtagccacctcctgtcagctacatcttctcttgcttctttcctgttcattccatgctagccagggaaatcttgtaaataggcaggtttgatcatggcatccttgtttaggagcctttaaggacatggctttggtgtgacgagaatatctcaaagtaatcatgtgctccaacttccctctccagccttgtttcccactcatcctcacggttgccaattcttatgcctactccttcctggtctcccacctccttgcccacctgacttctgctgatactttgcaattaagatggggcagatttcctactctccctttgttcccgcttctttggcatagcaccaggacccactgtaggacatatcctcctagactggaatatccagttaacctgtctcaattcccccgctagacagtaagctccttgaaggcaggagccatgccatgctttcgcttgtgcctacttcagctttaaggaaatggttgagggacatatccttatgaataagtgcagacctaaaagggtagaggacccatgatgatgaaaaaagagaaggtgcaggagcatgcataagccgataaaaaggcacaaattgcattgttgactgagttccatgtgattgtatttcttctcccttaccctcattttgaaaattaatgagttaaagtaattcttaggacatgaaacaaaactaaagactttacttattagatcaacacacacttttccaaacaagaaacagctgtcacagttactctgttatacttgttactctttaggcaattatagaccagttcttttaacaatcagaatattaaactctatgtgtgtttctgtgtgtttaagatactatctataaag

SEQ ID NO: 97914 - DNA, 1092 bp, Homo sapiens
tagcttcttgtagcgtagaaaagaagacaaaatttgccattttgtaggaagtatattttgcctccttttccagcagctgcttagtgaaagcatagattgtcattggctaaaactcttaaccttgaaaaaggcacaatatcccttgagccaattgtgtacccaggaagtggaaaggaaagcccggtaactcctctctctttttctaaaagagacaaattaagtctgggactcacttgaaaactacatatccctgaggttagtgtcattaagagaggtattaaaatagaagatggtaaaacatttgtttcaatagagaagataaaatatagaagcacatccaaatgtttaggtgatgttaaataatatttctcctagtttgttaaggtttgttggtctgataacatttatgtttttgtatttggggattttgcatctagtgttatgaactggaagcttttggaaactagtttttaaaattaacatcacaggcatttggtggcagtttagacagtggagaacatatggtacaagtcgcaagggattctgtcttctagaagaagaatagcacagagaaatatacgctatgaagaaactattatttcagatgtgcatacacctgagcgaactatggactagacaggtcgtcttgttcacattaccttatcaagagtctagtgtaatacctgacacagcaggtgtgtaagtgcaaatacgggcaggctcttttttccttatccattatttggggcatacccgtgagcctacttttgcaactcttgttggtttatcatgtggtttccagtgtctaaacaaaagacggcaaattacttcattctctgtgcctccatttcttcactttgaaatgagaataacaataggactgattgcataggttgtcctgaggtataaattatgtattagtatctaaagcacttgtaatagtgcctggtacatagtgagcactcaataaatatttgcttttttcactatagttatttgtttattgtctctagcctttcaccaaatacatgctctataaggatagagccttagtctggttcattactgagtgaccagcaactaaaatagtgt

SEQ ID NO: 97915 - DNA, 1589 bp, Homo sapiens
ccatcatgtgaatgagcttgggttagctgctggatgaggagagacacatggaatgaactgctagacatatgagtgaggacatcttagcccagacggctgccagccagtcgccagcagacaaccaacccatgagcaagcccagcagagatgagccaagctggctcaggccagaaatatccagctggcgcccacaatcgtgagctaataaatggtattgttttaagctgctgagttttggggtgatttgttatgcagcaaaaactaactgatacaggggtgtgattgataatatatcctttccctcacccagtttggaagcacttgtaaaataggcacaagaatcaagctggagaggaagtggctttattactgttaaaggcaaggttgaggaaagtggcttttggtttatcacccaagtagatgtgttagtagtcctctggcactttggtagtgaggcagtgattgacaacgctaagcaactgctggcctctccttgtgtgcattgccccatctgtcttacagcactgaggagtagagccagatgtgtgcacagtgtggggaacccagagagctgagccctctgtgcacggccgtttccttctgcaaatctcactgctcagcaaagtattttttctcgtcctggggaggagtgagtaaggggccagcacgctgggggagttactctaaggagatgcttccacatggaaatgtaaagcaaaaggaaatggccaccctcctcacaatggagatggaggatggaacagattactctggattgctttgtttttttcacatttctttttaatttacgacacaattggcttataccttcatgtgctatctcgtggcacattgtttaatctgtgtgtgtgctgcattcatgccattttgtatggaacgtggttttactcttttaaattgtttgagatttacagctttgttcttccttttatatcatatatttgattttattgatggaaagtcatcaataaaaggcatgaaactgcctgttagaacacttcctaaaggaatctctgatcagttttctgggaatatatgtattgaggtgaaatagaagacttcctgtctatgggtcagttctcagtagtgagtggatattcgttaataaagtgtctgtttttaatctgcctttttagggtcacaaatcaaaaactaagagaatacattgcctaatttataatacatacaaggctgggcttcttttttttttttttttttttgagttttgagttttgagttttaaagctcctgaagaagacagaagtagtcaatcattggttgtgaagtatctgtagcaatacaactgaaatttcaaaagagcaatgctgtgacttcgtaatgggtggctttatatgaaagtagatgctttctctttatctcagttttactttgttgttcttcatacaaacatacgtttaccatgaaaaaagactgtatttatcatgaaaggagactatatacaaatattgaagaaaccaggtgctgaaatagatctaaattaacctcagattaatgaattaatttattcattcgttaattggtgtttattagggtagtaaatcaagata

SEQ ID NO: 97916 - DNA, 1067 bp, Homo sapiens
cacgggctttttgatggtgttattttgtgtcttgacctactacagtttgcttttgtaatgtgattgtggaagtgctgccaaacaatcgcttgtcatcattataaggtgccactgtaaggtgagaggacagcagctcacctcgtcctcactcacaagggccttggcatctcactgtgaagagagctgctgctgtttgtttgggtggcaagagcagccaagaacatgtgtgacttttgtagaccaagtggaaggtcatcacgtgtccagctggtgctaaacttcttcccaaatcgctggcacatagtgcgttagcagtagatgacctgtttgaaggaattcgtgcatgaatggatgaagtcaaatgtagcatttgtttatattttttatgtaatcaagccactttcttctaaacttgaggaatttcctataaaaattagcttttcaatgaagaatctgcccatgccctgtgggttttttcttctaaaactgttacaggatcccatagaagctcagtcacatgataagtaaaatcgtactgcatgtttaacattacttatttagtctatcttgtgctttgcatgtcagtttttacttattaattgactgaaacattccattttttagagatggtaactattacacaatccttttttccctaagttatatcccacttgtacttttcaacctttggggttttttttttttttcatgttttctaaatatgaagccttcattattttccatctatgatttgaggacattggcagtcttccaagtcatatgagagctggagaacatgaaaaatctgcagcatcctgcgcctaataatttttgtacttacatatttttgttctttttcagttggctcaattttatgttttcttatgctgcatctctttattcttacaatcttatgtatttggagcacgctaggacttctcattcatcaaatatatatcctttcactctacctaaactcctccacaaatgctggtgtaggttccagaaatacaaattaaaaagtttaatgatcgttcctagattaaatggcacatcattctctccct

SEQ ID NO: 97917 - DNA, 1037 bp, Homo sapiens
cataaggagctttcttattctattatcctggggtttgactcctttaaggttatttttaaattccaagtgtttttatggcaaaagttaatttccaactgcccttggatcatgttaaatcaaaactatttttgagacagaaaaaaatctttttatatagtttcagaaactcatatataaacccgagcgattagcattccacattcattagaaaagatgattttaaataacactatactctgttttctgtcttaatgtgtgatacacttgacatgatatggtaactgggatttacttgcaagtgagacagctgtggtgatggggaaaggggagagtaggatgaattatagataaaacaaaattggcatctgttaattgttgagggtgagtgaaaggacatgcgggttctttccctgctctctctacttttgtatatgtttgacaacaataacaaaaacttacattactcccattgctgtgtagcctagtcatttttaaaaagccagctgttctcaaaaagaaagtatctcttacagtatgtcgttttaaaaaactgtataaacatcttcatatggaagcaatagtctgttgatccctggacatgattttgtttaaaccttgagtccaagactggttttagaaccactttgcctggcacgtaattggcactccgtaaaaatttatgaatgaacagatgcctcctgttacccagtatcttgggctgggctcttcacctttgcaaaccacagtttttctgatatgtaaaatgaatgaggagcttttctttgtatggagttgtgcaagttggttttgtttctagtagcaaaacctcagtgtaaaaaaaacgacatacatacaaactgagctgctgtggttgaagtggaagtagggacccaaggctctgctcccagcctcctgtttcttctgtcttcctctttatgtgccctgcaacccccgccacagcaccagaggtacccccagggttcctcgaatcacagttggaaaccactgaagatatagctttgtcttttatgggtttt

SEQ ID NO: 97918 - DNA, 1126 bp, Homo sapiens
tcccaggttttggcctggctcacctggtaactagtggtacacactttgctgaaaaggtcactttacttcactaggtcatgatctaatcattactaaaatgagagtgttggactaggtgattttgaaaggcaccactaatgccttctttaaatatatcacctattattaaaatttctaaaagagttctataccaatgcctcatctcatacattttttaaaaaacaactaaattagttattttcttacttaagaaacataattaatttgtaatatatatctatgttccttggatgcttgtagtgttatatttcatgccttaattaaccctttaatttgaaactttttaaaggcacaaacaaaagtgagaaagaaggtcatgggtgttctggacatttatggctttgagattttcgaggtaagatttaaaattttttttgtattgtctttagtagagtggaatggttggaaattaaatcctgtattatgtagacattataagtaactgtaactttgaatctacaaataatccttgtgtagatgtaacacactatcactttgaatctgccaacaaatctttgtgtagatgtaacaaaatttggttgtgtattcctgcatgtgtgcctgagtgtgtgtgtgtgtgtgtgtgtgtggtgtgcgtatgctgagagccagcattttggagacagtactgcttaaaaagaactcgtattagtacctgacttttgaaattgcgtatttaaatttctaaccgtgaggcttccaacaagctacaatgagtatgtctgtggccatttgtgtgttgttagaaagtgtggcaggttggtgccataaagaaagccacaggagggctggacataggttctggccttgccagggctggtcatttcatctgtgagactcagagaaagaggatttggattaggtgatgtgttgagtctcattactgtgatcttatgataatgaattctgctgcagaggttgaaataatttctgctgaagctcatggtgaattttttaaaatgattctatgcttgttacagattaaatatttaaaccatttgtgcttggttaagcaacacatatacctaaaattagaatgatatagagaagatgagcatggcccctg

SEQ ID NO: 97919 - DNA, 1028 bp, Homo sapiens
tcctggcaaacatggtgaaaccctgtctctactaaaaaatacaaaaattagctgggcgtggtagcttgcgcctgtagtcccagctacttgggaggctgaggcaggaaaatcgcttgaacctgggaggcggtttttactccgtttaaacagaactttcagccaaggccaaatccaatcagttatatgtctatagcaaatcttataatggccatcaaattataaaaatttaactttccttctacatgcagtaaataatttttctttttttccccccagttccttgagagaatcaagatttgttttttcattatatttaattgttacctccattttcctttttaagccttctcagattaatcttcagttttgatttttaataacttttttaaataaatttatttgtggggaggttagattagcgatttggttggggatttttaggtacttttacctgctttttaatacagagttacagacgtgtttttcttcttttaataaattattcacatacattcccagatgccagcctatattttcctggattctcagcaatgttagaacacatggagacatcaggaagctcagagtgttaggaaaccaagaaaattaagaactttaaagtactgcaagttgaagtacaaggggtcagagtatggaagaagtattcagatccacatcaaggcaaaaatgaaaatttctgtgatattttccacccaagtgaaaagaaactgctggagtatagataacatgtatttttttatttgttctgttgttcttcaattgactgtaggaattaagagttctgccttttagaataccctgggcatctctttaaaaactggacactaaagggcgagacttttttaaaaaaatgcgtctagttgtcccatggccctgcagttcccatgaaaatgccttttttagctgagctggtggaaacctttcattccctgtggtctgtctctgaacggaagagggaaactgatgcattaaaccatgggttgatgacacatggatttgactgcaaa

SEQ ID NO: 97920 - DNA, 1138 bp, Homo sapiens
tgtgacctaatagaaaatgtgagtacttaggtacagttttctaaagaatgttttagtcctataattcacccttataaatgttctcagtgcctcaatgttaagcattagtattttcactgttttttatatatatatatatatatatatatacacacacacatatatatgtgtatatatatatatatacacgtacacacacacacacacacacacacacacacacatatatatatatgttaaggaactgcagagttctagagattttattgtagccctaagagatcatacacagttcttgaacacatacatagacagctggatgttttgatacttagccaggatccccagtggccatatcacaacacccttttatgaccttcagacaccaggccttaaaggtaccagcctttcttgtatggttggagcccaggtctattccatgactcctgggcatgtgagtactgatcagagtaggctctgagcagccatccagttttttgccaaatcaaaatatccatttcattcccaaaactctaatgacctcttaacatactattcaccgggtattatattaagtttaagtgacataaagggacaacctctggagctgaattaagtgggaccccagaagtggcttaagtgcagctgtagcattgattcagatcatacatgcagagggcattgcatgtgtgactgcaggtggccagggacctggaatttttcggatgacccaagtatgtgcatatgcaaaaaggcttaaagtgtgaaaaattattggataatttcgagtaagctttctgagtccaagatttttgtttttagatcatattccgtagtttattgtaaatgaattaaatgtaggaagactgattttgtgtgtggaaaacaggaaactaatttatgcttaggattactaatacctgactttgaataagtaatttgaaacagtgtataagccttattatcctgcagtctttttagcaagaccagtttagtgagatgagtgctgtgtttcaggaatacagtcacatgctctgaatgaatattaaatcattttctactcatcttttacaaagctttttgggaaatatgtaattagccagtattttttttcctcagtattcaagatattcctaaa

SEQ ID NO: 97921 - DNA, 1090 bp, Homo sapiens
atataatgcatatggtttttcagttctttttttcaatgtaattgactccaacatgatggcattttgtctcctgaaaattcctttcctgtatgctgtgaggtttcagaggatttttgataagtccatctatcatttcttattagttattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcggtaagagtctcagtcattttaaatcagtaataacaatgctaatttgccaacatttattatgtacttaccatgtatgtgatttttacatacttaattctcccaacaacctcatgagataatggatgttcttaatggttcttttttttaaagatgagaaaactaagacacaaagctgttaagtaatttgcccacagccacatagctataagtggtagagctgggatttgaatccaagacagtattagagctcaagttcagtgtgccataccgcctttcactgatctagctgtatttggttggaaatacatttttaatttggtcatcagattggaagagacaatatcctttaagcttttgatttggttgggctagtttttcaaagtaattggctattctttggctattctttattgtagcagctttgaaagtggctttaattccagaaagctaatgccatgtttttgtagatttctggttttggttaaaggattgcattctctttagtccttaggtatctggctctattaactatagggaaagattcaataataaataatgtttacctagttaatatgaaatttctttttggcatttccttcctcatttgattgtagagattttgttgaaggcataccacaggtatgagagaagcctgaaggtttgcctcagggttaattgaaacttgggctgtgttctcacaaaatgaattaagtttgcactcacatctcctttcttatattcttcctctttttcagccataaagagactttgctatagggctgtatataatcaagaca

SEQ ID NO: 97922 - DNA, 1471 bp, Homo sapiens
aggagaatcaggcagggaggttgcagtgagctgagatggcagcagtaccatccagctttggctcggcatcagagggagaccgtggaaggagaccgtggggagagggagagggagagggagagggagagggagagggagagggaggaagatgatttcatgacatatgaaaagtatatggaatagagatttcagtgtacataaataaagttttattggaacacagccacattcatttatttcacagattgtctggctgctgtagcactacagtggtagagtcaagtagtagcgatagactgtgtgaccttcagagccaaaagcagttaccatctggcattttacagaaaaagtttactgatccctgatctaggtcaacgatacttcagagcctgttctgaccactttcctgtgaggagactttgtggtatggtctggatccagaggggtagtgcccaggcctggagccctttcagagggtagacgctgggtcccgagtccagcaacactgactgaccttgcccaggccctcgacaacttaagggcttagcagttgtctcacagcaaatggcaaaacacaaatctgaacatgtagagtaagtgaaactgctgcctgcaggctcttccttggcctcatggctggaccttggggccccgtttataggcgagagaccttagaggaaggacccaaagtccaccttgaaaccaggtgtcctcctggcccccataaaatcagtttccagcaactaatggaaagaagtcactggtttgggatcaatgagatcattttggttttggagttttaaaaatatcttgaataaaaaggacagctacagttacattccaggcaataataatgaaagagatacagtggcctttagaggatcattggaatcctctggcccctttctgagaactgtttcatcccacagatgtgtgccagcttgtggtgctgtagtcagatttttcccattgtgtatcagggtacgggaggctgctgttccaatcaagtggaaacccatgcttaatgatgtcttcattgtccaccttctcatagtcagtttggggctagtcaccttcgccttctttaacctgttgatttatcacaatagcatgggtgttaggacgatcatctcttcaggtttttttttcaagtcactgtcaattcctttatttttaaacattctctcttttgggtgattctgccctttaggctcgaaaaattctgcgggaactgaagcatcaaaagcgctgtaaggaagcagtcacgaccattgctgcatattggcatgggacccaggtaggcccgagaccccaaggaaggcggtgggtcagcagtaacgtcatgtggaaccatgaaccctcggcttcaggggcagaaaatgtttcactggcttgagctactgagcacgtgtttgcttcttgctctttccaacattttgttgtggggtggtggcacatgcttttgcgttta

SEQ ID NO: 97923 - DNA, 1005 bp, Homo sapiens
gtcttttgtggtatattttcctcatgtagtattttctgtcaacccaacacaggtgcaaaaatacttcttggaaatgaaaaataagatgccttccttatctccaatagacaagaattggccctcaagaccttacttattcttggattctactcacaaggagctaaaaaggattttccacttgtggagggtaaaaaatgtcatattacatcttttcggagactttcttatttattttgagtgtttaaaaacacataaaatcaaaactgttaacacattcttcctttgcctcaaagaggattacttgaggactttggtgattttcccccatgcaccatattgagtttctacgagagcccctgcagcggcccaggcgttccctgtgcggtcgcctctcggccctggctggaacggggagcacagggctgcattttctttccattccaggttccagctgctctcaagtagttcagttttttgttcatttgtttctctctttgtctaaaggaatactgtaggacagagaaatcataaaatttggacaccttcaggcaacatagttaaatcctgcaaattgaagagtttactttatcagatgtacagaacagataatcagataatacatgtgaacacacacactttgatgggtgggaaaaaaggctttttcctgtccctaaagatagtaacacattctctatctaaattacagggaagctggaaatctgttttatactgccttttattttagctctcttattttgtataagaggacatggcatgtaatttagatgttgcccagcatggaacacgtggggcacttgtatagatgttgaccttacttcgataacctagtcagttgatatgtggaatgttaaatatatgcagttatcagatgtaataaaatcatgagatggaagggcatgtatttagtaaatgaatgctcagtacacacatcctccaggaaactttcctgcccagcacggtgggcttgtttttttgttagaatca

SEQ ID NO: 97924 - DNA, 1054 bp, Homo sapiens
acttctgtggcctgtacagcacgttcagttcctttattttagacaccgtggactcagaaaaagaaggaacaccaatcccaagttcagcaagtgaagtccttggtaaagactgtttatcccaatagtcttacatctcctgcattcatcacttcctcccagcaatctaatcccattttcatctggtgtttataaaaaagtagattgtacaatttcaagccaaatctgtaacaactttaagcttcttccaatgaatggccaaagaaagaatgtattatatgctgagtatattcacatttattacgtaaattatgtttatattctctgtgactttatacacatttaaaatatcttccttttaaaggattaaaggaatatacattgccagactcactgggtttaaatattttaaattgtacaacttcattggttagctgatgtggctacttgaggtgatacatactcccttaagtcaaacacagtgtctaaatccaaagttgtccaaagtgcctgttatataaagcatattcaaacaggagaatttgtctgtatgcttgcttcagcaactaattttattcagctttttttttatacatttttaaattagggaataaccttcttaatgaacatttcctgtggatgactcttcagaaactacaggctggaaaatacatctttgaggaaacaatttaaaagcctgttagcatttttataatttaaaacacagttgaataggaaccaaaaaaagttaacttcaagccaagtcctttttgggtagtcttatcagttttcagggatagtggcacactcaccccacagcagtgagagaggtggaataatttagcctcccaccaccctgcaaagtggcagctcttatgggagttggccttttatatcctgagagctgtgaaacgctgaccacctacgtggatttttcttcccttatcctccacccacaacataagcatttaaatttgtatttgcaaattgccagaactttgtagctcaaaatgaagcttatagattccttgaagcagcagtttttccttggtgcctt

SEQ ID NO: 97925 - DNA, 1117 bp, Homo sapiens
agttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttgtgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaagtctttgtgtttattggtgcaggtagaggatgtaattacttagattcttcttgccttgtgcctaaagtggtagattaatagttcctgatactggtgagtagaaatttgggaatgagagggtgtggtgttttaaataacatgcagtatgttcacattgttcagcatgtaagtaagtgttaaaatatatacattacaaattctccatcctatcaaccagctatctgcttagttcccaccctccccgaaacattaaccattgttgttagttgcttttgtattactttgtccatatgtttgcaaaaggaaatcaaaatagattcttacgttcttctgctttagtagacaaaagctagtatattatattgtagccattgttctttatcttgcctttttcacctagcagaatatcatgaagagctgctcattcttccgttgtatggatgtgctgtggtggatttacctggtctcctactcattatcattgggttgcttcctaaatggaacttgaggatggaagactaggatggaaaggagaaatatcccataggtctacttgttagatttttccaaataccttatttgcagattgttcaatcagtcttgtcactgaagtattcaataatttttggtcatggaacccattcttcatgggt

SEQ ID NO: 97926 - DNA, 1054 bp, Homo sapiens
tgcctgtaatcccagcaactccagaggctgaggcaggagaatcgcttgaatccgggaggcagaggttgcagtgagccgagattgcaccattgcactctagcctgggcaataagagcgaaactcggtctcaaaaaaaagcttctccctaagccttcagttggaaatatttcttattttacttcattatttttctctttcaattactaatattattattttcaagtacatatcattgcaaacatgaggtgtttcagccacagtatatgaataaatttgagatgagcaagggaaccaaaccatcttttagaacagtttttatggcaaaagatattcatggtctctaacaatgcactaaattaacttttgaaatatagtctatctatggtgagagggaatttcagcacaggcaaaacaccatgaactgctgaaagaggaattgcagagtgttaatagcttggctcttaaaaaaaaaaaaaagatgtaaatatttcatctactcattcacccaacatcattatcaagagggagaactcaatcatggtcctgcaatgtgttagtgctatctccttcccagctgagggcccattacacaggcttctcccatttcaaagggaaaaaaaccaaacaaacaaaatagctgtcatctctattgatctgggaagactatttgccaactagaaaaggcaggcaaatcttttcagcaagtcacgtgaattcttgtgaggtattaaagttaaaaggcatattgtgagaaactccttccaatataaatactattttgctttttttttttttttttaagacggagtttcgctcttgttgcccaggctggagtgcaatggcgcgatctcagctcactgcaacctctgcctcacaggttcaagtgattctcctgcctcagcctcccaagtagctgggattacaagcatgcaccaccatgcccagctaatttttctatttttagtagagaaggagtttcaccatgttgatcaggctggatggtcttgaactcctgacctcaggtggtctacccgcctcggcctctcagagtgct

SEQ ID NO: 97927 - DNA, 1076 bp, Homo sapiens
aggagacaaaggcactctttgttaaactggagctagtcttacctttaaggatgggatcatttctttgaccacagatctcttccttaccaaaggatatgccctcacgtcagaccagaaaagaataggaagcccatagggaaccttctgattttcaacttggtcttttgatgttgcctttgaaatataccctggagcttgctccaaaactagaactggaagatgacacttttcataggggatcaaccaggagttagggagatagaaactttggacagaagcctgtgatattgttccagtcctaggggacaacaataaactacttttttttttttttttgcctatcaaattggcaaactggcaaaaaaattaggatgtacatactgttctaatttggagtacttaggaaataatgggcctgagaccctaatctgggtggcttaatttgtttcttgcaatacctctacagaatgtttcgccctggtggtttagttctgccctgtagctgcagctacctttccgttttcacgtctttgactcccttgtttatacctgatttttttaagggtgtattcacccttctattttgtttagcttgatttttttttattgtggtaagaacacttaccataagatacaccctcctgataaatttttaagtgcacaatacagtgttgttaattacaaggcactatgttgtacggtagttctctagaacttattcatcttgaataactgaaactttatacctgttcaacaataacttcccgtttctcccttcccccagcccctggcaactaccattctactttccgtttctgagtctattttagatacctactgcaagtggaatcatgcggtatttgggcttccatgactggtttatttcacttagcataatgtcctctaggtacatccatgttgttgcatatggcaggctttccttttcataaaggctgaataatattccattgtatgtatataccacattttctttatccattcctccatcaagggacatgtaggttgtttccttatcttggccataaataatgaatgtgggaatacagatatttctt

SEQ ID NO: 97928 - DNA, 1032 bp, Homo sapiens
tgccttcgcccctgtcccgggagggtgggaagctttgaccccgccctgcccactcgcgtctccgcagccgtagccgcgcctgtcccaatatgaatagggtcaacgacccacttatttttataagagatattaagcccggactgaaaaacttaaatgtcgtctttattgtcctggagataggtaagtggggtttgcagcctactccaccgcccgctgtgcctcccggggcgggagacaggggcgccggccgctgcgcgcccggggctcccctcctcctccctcccctcccccacccacgtggctctagtggcctccgcccgagatcggatcctacctgaggcgggagccctgggcttggtcacttcccaccttccagatgtattaaaataccggaggaggagttagcctttctggatgtcctcattatctaacaacccctccctttgatttttaaatcctcacaggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtaggtgtgcaaaaaagtcgggggacctaacagtctgcagaatcgggattggccggctcctgggatcttggcaagccctgaagtcccccgccttttctgtgggccactcttgaggagttttgaactcctttggtgttaactttgggtggtgggcagcgctgggatgtaacagacctttgcagtgaaaggcagtcggtttcagctgggaaatccgcgcctctaccccggtttacaggttaagtagatttttaattattattattttttgggaccgagtctcgctctgtcgccaagctggagtgcagtggcgtgatctctcctcactgcagcctccgcctcgcgggttcaagagattctcgtgcctcagcctcccaagtagctgggactacaggcgtgtgccaccacgcccagctaagttttgtattttta

SEQ ID NO: 97929 - DNA, 1047 bp, Homo sapiens
aagttgttttctctagtgtagttgccactcagttgtttcccaccccttctccatttttaatgacttgaaatcctggccagtattttacatatgttatttagaaatgtggacataaatgaaaattataggtaaaggatttagcatattctgtgatatgtcaaatttgtacttggaaaaagagggaaactttacagtatctggaaggctcattctccaaaatgatttcttgtgtcttctgctgtaaggtggatgttgcgcaaaaaccaaagggatacacagaaaatgtttggcagaaaggcatctacaataccttcatccaaaagagtcagttggcggataggtggctttaaaaaatactagaactttttttttaaaaaatagattgcttttagaaatttaccaaatttttatcttaggaagataaaagggcagaaaaggatcttaaaaacagaatttggaagcttttgagatcaataaaattgtaataatttatcattaactgcagggaaagtggtggagattgatgttggcctaataagtagaatcttagaagtattggaaagcactgagagtaggagcttagagctccttggtgttaccttgcaggcttacaacatcttcaggaagtgaggtaaagtgtcatcaaagcaggaagtgagagtcaggacttagacattttcttctcatacactgactcatgacagtaatttaaacttccacatctttaaaaaacaaaagagaattccttcttagggaagtatggtgaggattgattagtataattggagtttttggctccccaaatatttttcacccaatgattgaaagtattttttacgctaaaaacggcatcttatttcaagtatttcatgttctgtagtgacagtcataggtgtttccatcaaaaaaattattggaaaattaaacttattagttaggtactatagaattttaaggggaacaattacctgggagtacaatttaaacgaaaattaaaaactatagaaactctatttactacttcagtatgaccttgagaagttacta

SEQ ID NO: 97930 - DNA, 1020 bp, Homo sapiens
tggtgtgctgagtaattatcaggaaataggatgtaacagagctctgaaaggtttgggaaacgtttcttaacattataacctttaatgacctaggaaaaatctttaaaaaatttgttaattaaaaaaaaaaaaaaagccaaacccaaaactttaaaaaagaaaggatataataatgttgtaataatataattgtgtttttattctcgtttggttaaattaaaaacttttttttaggcacagagtgaacagaagaataattccatgaatagtaatatgggtacaggtacatttggaccagtgggtaagattttgtttgtgtgtttcatttgtgatcaggtataagaatgaagagagctgtaaagattcacgtgaaaagcaacgtctttaggcataaattagtgataaaggtgaactaccagtaaacagggaatccccaaagggctgattttctagaaagttgataaacttaagccagtttattgagaattctaagtttttgtgatgtccgtgaagagataccatgctattttttttttattgattcctataaaatttctataatctagtgattacttatagtagatgcagaattactggttattttggtgcactgaaagcgttttatctttagagtcatagttcaccttaatttttcacatacaagtagctgctgctttaaaagatgagctgagccgtttaaaggctagtgaccctcagatgtcatttaacatgacccccagacatcatgttcatgatccttgtagctctgttaaaggtcttctgaagtcttttttcttaaatatatgaggaaaagtcagtcttttgtgattagagttcattaggatggctcatgttttggttttgttttgtttttgagacagggtcttacgctgttgcccagactggagtgcagtggcgtgatcttggctcatcgcaacctccacctcgcaggctcaagtgattctcctgcctcagcctcccaagtagctgggattacagatgtgcaccactaccacccag

SEQ ID NO: 97931 - DNA, 1030 bp, Homo sapiens
tgtgggaaacgctgcctttgcctttaaaaagttagaataacattgtctgttttgagatattaatcatatttgagccaaattccaatattcactattttgccctttctttttcttttatagtgtaggcaatgcatttttttactctattaatttctaattttgatgcccaagttggcttttttctctctattaatacagcatcaagttagcatatttatagcaatacatttggaaaaacttagagcccacattgttttttttttctgtataaaaataaaagtgtgtgctttaatatttttaagcattaataacatgttggcacttaagatagttctacttctatagactacctctgaaaatagtgatgaatttttgtattcttttttaggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcgg

SEQ ID NO: 97932 - DNA, 1044 bp, Homo sapiens
gtggtacccacttcccctttttactgtagggtggataactcttaggatttaactctttgaatattatctcttgaataaagcatgtgttaatgttaacaaacctacgtaatttttgccctttcaatgacttacagtggagagccagtacatcttaactactgttgtagtgatggtatcaacctcatggttacttagctctgcatttgttgctttgttttttttccacttcaaatcacaaaataagtagattttgttttctgaaaactccatagcatttgaatacaaaaagttgtgccagattgtttgccctaattcactgtgtttaacaaatatttcagtacacactatgtattaggcactgtgtggaaagtgttaaggggtagacaaaataccgaataatctccacaagtttatttgtggtctatagtacttttgtaactggggttacaaaaattatagaaatttttttcctttgttcatatgcatattcatgattataatttggctttgtttgtgattaatgttttcttaagattttcacattatagaatacctcaaaagaagttgtctaaggactgggatagagagtatgtttcataaaattgtagatgtttagaatttttaaaaaccctacaaattagtatatgattgttttatataagtaagataggagcaacactttaaattatttgtgggagaatacagcattaaaggtgattttaaaagaaaaaaatttggaattttagaaaatttaaatgctgtcaggtatggaatgctgggcttccaatcctggcctcattgtctcctcacctgtgatgttggatgagttattacacttgaaatgtctttaagccttaggttccacaagtatgaaaacaagtaagtaacagtatcctttctagacttgtttaagatttccatgtaagtaattataatgacttctgacacataataatgtcgtcttataccccaacagtaggaaaaaaatgcagaattcagtatgaaagtattgttaccctttaacacagtggtccccaacctttt

SEQ ID NO: 97933 - DNA, 1096 bp, Homo sapiens
tttgctgggttgagtaatgccaagggaatgatgctaaaaacaaatagatgtgaggttagtaaaagattaaagttacaatttatgatacgagaacttcttaactataggaaagtaggtaaatgaccctaaaaggttttctcagaaggtaaaagttttacatcagtctgaagacatataactctaacatttcagtttagttactgaaatgactttttctggtgtcattgagatactggctgtttgttccaagccattttaggctgagaatgactcttaaggtcttctaatgcatttcagagggttctagaaacaacaaactgaacatgatatgaaactaacaacatagaatgccccccaaacaaattcctctaacctcactgagtttacttgccctattactattttttttttttaagatcttctgtctcttgtttttgttttatcccttacctgatgaaagtgaacatttctagtggagaaagaagatcacagttctctaatatgggcattaagagaggggtacagctagaggggaggtgaaaacctgcctccactggggtgaaaaacagtgtgctgaggtttcagccagtgattacactgggtaatcaaccagtcccatgtttcacaaaggagttgtaatgattaacagttcaggtatgcttctgaggaaatctaattgagacctttggaaaatagcattgttatgaatggtgtggtgttacgccctgagggaaaagctagaaaaacattttacttttcaagtgtatttaaattacatccaaatgtttcagtgtgctttactggagactgcctgagtttggaattcaaatattgtaaccaaattactccaggtttctgaactaaaatgatctattgatgtttctcaaagtatagatcacagagtaagaaaagaggaaatcaagtctggtttatgacaaacttttttccatgttaacattggacccaaagatgttactaagagctttttactactgtgagagaaccagcgtgatgtgaagacaacgaacattttaagaagtttgactagtagacatttcgtttaagtcttttggagggtcttggttgacaacccaca

SEQ ID NO: 97934 - DNA, 1154 bp, Homo sapiens
tctaccacaggaagcatttatatagaggtaataattaaatttaactttttattattctctatgcccaagagaatgtgggtaaaaagagaagtccagagtgctaaagaacaagactttctcatcgtgttttcccatatcctcttcctgtttctcttttcagtatcagggttaattcttgtcacccactgtatttccctccccactcttttaactgctctccagtgtcttatcaacaaaggcttcaactctggtgctaaaagagagtgatttcatttttttaagttaatttttacctgtatacttgcaaagcactagaattttcttttaaatgcaaagggagtccttatttttatttttctagtcttagtgttatcttcagtcatatctgcttaggttgaatttcatacaataacattgtagttgcactactgctaagtcactcacatatagttcatccttttcctccacttaaataatgagaaactaattatgttttcaatagtaggactaaactgctgtgctattgacaaagtcttgattgatttgaaatatgagaaagctgatgcccttcactgaaataattggcttagactctggggagtccacctgaatttaactgttgaaaatgcttattgagtgctggcttcccagtgggtcctgtgcttggtgctgctacacacttgatctaagaggcggtgtgctgtaggctgagataccacttaacctgtggcagcagggtgtgtgagctttggagtctgcatccactcatttgaccattgatttttttcttcagtaaacattggagtccctctgatgtgctaggcatcatattaaacctgagggaatagaatattgaatagaccatagtccctagtaatcaagatacttcagtgattggggtgagtggaagagacccacaaggaaataggcaactatattacaccatgataagtgcagtgctgtgacagagggtggtatacctagagtatcatggggacagatacaagaagaatccaatccagatgtggggttccagggaaggcttcctatagaaggtaatatctaagttagtcctccaaggccagtaagagttattcaagcaaatacaaagatgtggagagggcattatgatccttcctgagagaagtgctttc

SEQ ID NO: 97935 - DNA, 1025 bp, Homo sapiens
cctaatttatactagtaatgtacaaaaatgatattaggctggtccaaaacaatattcctttccattacatatcagatattaacagttggttcattctctggtttgataggatttaaactcataacattgaaaagtcaatataacattcattcttaggacatttgaaatataaaattgttgaagacctttaaagtgagataaaatgggcccatgacttgcttgattgcattgtgctgagtcattctttgtgccttaatgagtaagcagttaaggacaaagtaaatgtcttcctcttcaacttctgcctgtgttcaattcccaacaaaaatttaaagacaactgcacagaaaagcaaaataataacttttccaaaataatccaagcttctactaatgataaattctttcatctgaaatattttaataatttgcttaatccacatctttattctgtgattgtagggccaaactttaggtaatagcattggactgagatttgtaaactttccaaccttccaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgagaaaaaattggcattcttaaatttgcggtatctcataactgtaaatataatcagactagtacaatctgtacagctaccaatatttcatgtttcttctcatcttgagacagcacattagttcgt

SEQ ID NO: 97936 - DNA, 1033 bp, Homo sapiens
ttatgtgtacttcagtaacacttcataaaatatgtatataatcaacctctctatctcatgaacattgaaataatttggggaaaaaacacagctttgtgtcactttagagtaggtcaaatgaaaagagtatgttgcccaacattactacatcaattaaactttatatgaatatttaaaggattctggtaataattcatgtgacaaaattcaaaagcagccttttcaataaatgaaaagtttccaggtcaaatctcttcccgacattcatacatattttcttgtcttgcgttaacatgagataacagtcagggttacaattttacctataactaacttaaagaaataagacaggtaaaaagaaaagaactgatttcatgacacaaatatagaattaaactgtcaagattcgaaatgttcaatatacctcatttagagtaagaattttaaattcaaataattttctttgaatatgataggaaatgaatgtattggccagaaatttgtgacaattaattgcagaatggctgaattgtaatgaaaggctctaaggaaaaaaaaatgatgaaatgaatgtgctgtttgctttcaaatcatttacagttgaataatttatgttatctttaattcatccagttaaattatccaagatgaatacaatatgaatagaagaggtttaaaattgtcaggtttttgcattaaaatgtttgccagtaaccactttctattttttattaccattttaatggtttcatatattgcaatatgagttagaagactaagctggagtatacaatgtaatgagtttccagggttataaatatttgacctatgtcttgagacattaaaagaaaacctcttatgtagataggttatgtattcactcaaagaaaactaacctaagtggaaattactctgatctgccccctaaaatttcacccaccatattctttccctttctctgaataacagcattcttcagttgtttatgccaaaaactttggagtcaacctgattttctctaaacgctacttct

SEQ ID NO: 97937 - DNA, 1117 bp, Homo sapiens
tgtttgaactaggtaagataattgatcacatataacgaacgactagctatctggttacacttttttctattcagtgccagaacaaaagaaagaaatttagtttataacacattgtcattatgaagttatgacagaaattatctgttttctaaaaaaaaaaacagttatattgtttctatctttgtatagaattagaattagagagatagttttgtaaggcagatagaggatgaataggatgaccttttaatttcccattttgccttgtgatttcttgattgttctgcactactgacatactgagtcaattttattgggatacaggaattttcattcttactgcagtgtatatactcacattgccatacgtggagaaaacacttgaattattatatttgggaaactaacaaagacttcagtgtcttataaacataggaagaatatcttgtgaatgcatatacattttccaagtctataaaaaactttagctccttgttttgatagactatcagcatatgagattctagagattgtataaattgggcagttctgctttaaaaaagctatttttttcctaatactatatcttcatttcctacaaattattttatctagcatagcatttacactgacgttcatggtaagatataaaaacattctccttggtaaatttaagaatctttttaaaatgtctgaagtagaagagaacataaagttttccaggttctctagctgaaagaaagaaggaagctctggaaattttctttttcttttgtgctaatccatgacaatatcaagattcttcatcagtaagtgatgctgaagcacccagaatccagggttcagttcatgggtattgaatcagtagtgccttaatcctatgtgcatttaacattaatattattcatgctttatcataatgtaattctctaactgaaaaagttttaataactccacagtaaatagagaataaagtacaaacacttttagtcttttttctcagaatatttggaactcattttaactctcttttcagccttatatttcactattactcatcaaatactcagggtataaaataaaccgtacattttactctgccttactccctacatgc

SEQ ID NO: 97938 - DNA, 1018 bp, Homo sapiens
ctattaaacatgctggtaaaatgtgtcagagtatactgctttctactcttataaaataacccgtgggttatattttcaagatgacaaaagctatttaaatgagatagttagtggacatttttaaaaaactgaaaatcaatccagaatatgtgcttgaggaactctcagggaaccaattcgaagatttgcacgaggatcccaggattcctagtcattttttcagccttgggccatgtaggtacacagaaacataaactggcaccagagctagaatacctaatttaggggccccaggccagggggtgttaagattgctgggtgctcaacactctcctatggggcacccaggcatgtcccagaggaaatgtgtggctactgaaaagtgcactgtggttgtatacatcagatgcacaagtaacacaaaaggcaccacatgtgccacacactggagagttttgctacctccccgggggaagccaaaatgcgccgctgcagcacttggaatgaaaatgcattttctgtgagcaacagcctcctttgaagaaactgctttctctttcaacatttggaagctgcttggcaacccacaatcaaggttttcgttatgttgttttaaacaggcccattatcagtgtctcatctctctgaaagcttcagacttcatcatactgtttttaaagattaacatattatacctgataagcttctaaaacttgcagccttactaaagctgactgttccagcactttcttcctattaaaagtgagttgcacaagaattaaaatagatactgtttgtctactcttttcttgcgataagaaggcaacacttcacttgttctgatgttcattttctatccgtacattcaggaattcatttttaagatgtcctttcttttgtcaaaatgttagatctgtgcaagaatttataaaggaaaatcatttcagacatgtttgtaataggcaatattaaaagtaaatttgaaggctacagtgacttattgcaatattttgtttgt

SEQ ID NO: 97939 - DNA, 1150 bp, Homo sapiens
atttagttttgtttagggaagtatataagatgagagagagagagagagaaactttaaaagtttgatctaatgtacttactaccaaataaagattttacctatagattgaaactaaattgtaaatgtcccaaatacttttcccgatgaaattcaaacaaaattagacttttatacacacaaagcaaaacaaaacacaacctatatataatttcaagattaagaaaaacaaaacaaataaaagcattctctcaagaccttgcttcagttgtgtaaaataattaaatgtgctattccaagttgattttagtttttaaatacagaatttgataaaagataagtaaaagaaggccttgggttcagggtggcagatatttagtgcaccctttatctagttcaggaaacacttgaaagatttatcaagtttccttatgtaatgaaagacttaactagttcaaataagcaatacccacagaacataattagagcagcatattggagcacaatttttttttcataaagactaaaactgaacagcagcagattgaaacacaatttttttcctaaagactaaaactgaacagcagtcaagactcaagcatagaatatgtttcaatgtcccatgatgttggacagtcctttgatgtctggacagtctttctctacttctaataaaagttttcctagctgattaatatagtattcccaagaaagcgtccctagaggttttgaaaataagaccttagaatagcatattaaatcttaaagaaaaaaaaaagacaggaaaaaaggcagttcctttagtagatgttttaccatgggaatattattaataagaaatcaattaattttttaaaatgttgcttttgtaaggaaacagtttctatgcaaaattctgtatattttctagctgtttagttttatatgtagactacctaattttgcaaatattgtgctgagactgaactgttccactgtttacccaccagtcttgttaattttctagcatctttaaagacaaaataaaacataccaagaatgtcttcatttctctttctgttaaagcatcatcatttacttttttctgcttgactatcctaccatactgtacttcatatctttatttttctaacaataagatgtgaactttgtt

SEQ ID NO: 97940 - DNA, 1045 bp, Homo sapiens
tataagatagatcataattttatcaaccacttaaaaaaagatgttgccaattatacaatgacaacatattttacaacttggaatttatactttatacttactgaaggaactcttctacacctaataagatgcagatttttaatcatgtataagtgttttgcatcttttgcatacataaaaaggaagaaataagttaaataaattggacaagacatttcaaaacttcttaccatacggggtttgactcgtgaatgttttgggttagtatcatcaatgtctacttgttttcagccatatttctcttgcagccgtcaaagacattaccaatgccacttttcttcagagtggtccatatccctgggatttcttccgtaccacttacattgattgtgcaaatgttagtgctggcatttccttaatttctccaggtggtgtcaacacaacatttcagacacaaacaggatttatattctctttttaaatggtacttgaagagttgtaatcatgcagttattctgttcaaaataacaaccaagttaaccatgacaaagcattgacaactatcattcctgatgcttgtccagcagcaatcttaaaacatcattgattattagaggcactattagatctcagagacattaaaatgtgaaaaaaaagaggctgtttagaatgaaggaattctctattacaactctcacctctttttaccctttcttttgtttcatccctggagattagaggaggattgatttatctgatgagtcaatttgggaaaaataaactggttatgacccgttcaactactttcttttctcctaaaagcacagatgctctgctgtccctctcagggccaggctcaccatttgggtgagaccatcccaggaccagctatgccattgcctggattggtaaatctgccaactgcacatttgctacatttcacagtttgtatttcaacttagcccttatcagttatattttatttatttactgattgatttgtctttctttcagtttttatttatcctccttctctcactcactg

SEQ ID NO: 97941 - DNA, 1051 bp, Homo sapiens
tagctgtgtaaataacaacaattttatatatttaatctgggcttctccttatcttgaatgatataaaaatctactttctagattaatttagttccatataactttgtattgctttgactgtactgataataaagtttgaaagtgttaaatttacattgtgagcttttttttaaaattcgaatttattttctatgacttttatagaatgattcttaaaaaatagtttcaaggacctcttcatagccacaagatttccttttttatatcattaatattattttatgtgaatactataatgaaacccaagtattcagtttacacacagatattataacacaatataccactacacaaaggcaatgaacagataacattctacaaaatctactttacagaaaggattttctgtagtcaatgcaaactcttaaggttttaggttttatttagattattgcaatatcagtatttcaaactcttttttttctttttattatcccttataagttctatggataggccacaggataacttttagctttttctaaaatatccaaacatattctcaataaaaaattagtggaatgcttaaaagtatagtaggtatgaagaaatatagaatcaaaattacagttttaaataatagtatgtatttatttatatagagacaaggatcttgccatgttgtccaggctggtcacaaactcttgggctcaggcaatcctcccatcttggcctcccaaagtgctgggattacaggcatgagccaccgtgcccagccagtaatactaaattatttccaaattaactgcttaggagaccacatacaatgttcagacatgttaaaacaggacacaattcattgtatcacatcagtaattctgtgtcgaatactgttttcctatcagaacgtaagggtttttttggattgccagatacaaggagtggttatttaatagatttttaatggtagatatttttatgttaaaagatgttagaataggatgctactggtgatacaggtttgcaggcttgtacaagtataaggacaaaa

SEQ ID NO: 97942 - DNA, 1036 bp, Homo sapiens
aaaataccacatttaatggatatacgagaagtagggacagaactcaatttatattattaatagcttgcacttaaataacatttaaatattgcaaataatgtaggaaaattaacaaatattttacaaaaatatgtacgtaattttattttgttcttatagttaccataaaatagaacagaaattaacagtcccactttataagtagtaataagacttaaagtggttaagggacttgctcaaggactcatagctaataaatggcagagtcagatctctaacatctttgactcctaggctaatctatcttcactatgcacacagcctcactgcttctctgttactctgtgtgtgccattactgaatcacagaaggaaactaaattgatatttgactacctacattgctgtcaagataaagtttgataaagccattcagtcatatagataccagctgtgtttatatgattgaggctataaaactgatttcaaccatttaaagtagtcctgtaatgaaacttttaaaaaatgaagtcctttatgaaattaggaaactgtatatacatttattgaatagattttcacattaagtttacttaaaacatggtatattatccaggatgagggttttagtgattaatcttttggtttctaccttatttaccttcagaatagcaatctggaacactgaaaaagcttgctttaaaaccttgctaagcaacttatagtatctttccccatcattattagcatattttgtgtgtttgtgtgcatgtgcacatgtgcatacacacatgggtatgaaagaaagaattgcgatacagataataacttctcattcttttatttggtcttcattttcctttaaaaaaatactccctagagtaaaaagaggtttttgttgttgttgttgtttgtttgttttttggttgttggttttggttttagtgaaatgagttaagtagattacacacaggcaataagtactaaattgatcgggccgggtactgtcgctcgcacccagcactttgggtcacatc

SEQ ID NO: 97943 - DNA, 1561 bp, Homo sapiens
atatatttattatgtacaacatgtattttgagacatgtatacattgtggaatgtctaaattgagctaacaaatacattatctcacataccatgtttttttgtggtgacaacattcaacaatatagaccatttcacaaatttgcatgttatctttgtgcaggggctatgccaatcttctctgtattttttcaatcttggtgtatgtgctgctgaagcacacaccctaattcctttcatttaaggatctagttaacctttctcttaagtataaccatgtattttgttaagcaatatctttttattacaaaaatgccatttttttctggttagaaaattgattttctattacaatattttttagagtgtgtgtaaaacctgatgaaatttgaataaggttcgtagttaatagtatcgatgtcagtttcttggttttgaacatgtactacagttatgttagatgttattgggaaaagttggggaaagagtacatggaaactctgaactaattttacaacttcttgtgaatcttaaattatttcaaaataagttaaaaaaagcacatttccctttgcgtattattaagtatggatgtgtttctagaaattatgtgttactgattttactaattgaaggttggaataaacttcatgtggggaataaaaattaagttttggatgaaatataacacagctacagaaaagtactcaaatgttaagtgtaaaattcaagcagttttcatgaagtgaagtgcaaccatgtacccagcacccaggtaaggaaataggacattaataggaacccagaattcctctcatgattctgcccagtcactccccacaccaaagtataatcacttcactacatatttagttctggttttagtcttaaatacaagagaatattagtgaacttcattttttctttgcatccaaagcaaaatatttgcattcaaaatagtataataattagcacaatgattaagttcctaactgtaaattagccccactcttaatgcagaaattatacagtgatagaatacttaggcttttaactgtggttatgtattggaaatcaacagcaaaagatgaaaataaatttgttgtggcactgctagttatttaccggaatcccttttcccatttcttgtcagtagcctcatccattgatgttgacagcacctagcagaactcttcagtagatgtaactcagctgaactgaaaaaatattatcaattataaaactaacatattcttaatgcataaaacttggaaaactccaaaacacaagagacataatagaatattttggcttgggcaaagctgtgtcctataaatgtcagtttttagggttgagtggtatatgggcttctaccatttcccccattcctgtctccatctcagagatcctctttgtgctgtcgatggaaaagattgttaacatctactggaatgcttgggaaactctgtaagttggtgagaccctggcctcctagccaattgagatcatgtgactaaccccttgccaatggaatgtgatgagaagtgatgcctgcaacttctac

SEQ ID NO: 97944 - DNA, 2252 bp, Homo sapiens
ttaaaattagtctcccaaatcttcaagatctgcgctttccagtacagtagccagtagccacacgtctgttgagcacttgaaatacagttagactgaattaggatgtgctgtaagtgtaaaatacatgacagatttcaaagacatagtattaaaaagaatgtaaaatattttaataatttttatattgattagatgttgaaattataatattttggatataatgggttaaatagaatagtatgaaattagtttcatctattctggaaaacttcagaattacataattggctcttattatatttctagattcttgaagtatgcttgtccaatagaactttctataatgatggacatgttctgcgtctacgttgtccaacatactagccatttgctacatgtggctgttgagcaattaaaacatagtcagggtgactgagaggctgcattttaaatttaattttagttcatttaagtacccgtatgtgactagtggtggctaccattgaattggacagttctggacactttatcattttagcatttcttgtttcagatttatgttcaggagctattagcaattgatttttgtaatgatgtgtgaggtaagggtcagattttatttattattttcttttgtgtggaaacctaattgaccaagcaccaaggaaaagaccatcctttccggtttttagcttttgtcttctgttcctttagtctgtttgttattgcaccaaataccacagcatctttgataattcatagagtaaatgcttcaattttgttcctcaaggaatacatcttagccgttcttggccctttctatttccacatcaatattaaaaacagttaatcagttttcacaaaattctgagattttgactggggttgtattggatacatagcttatccagtcataacatgatatagccatccgtttatttaggtcttttatttctctcagtaattttctgtcaataatatttctctcaataatttctctcttttctatgtaaagttcttgtatgtctttggttagatacattcctagctatttgctactgttgtaaatgttactatttttgagttttattttctaattattgctgatatataggaatataatttattactgtccttatattcagtaactgtactaaactaacttattcttaaagattctttaaggcatgctgcataattaattctaccatttgtgaataatgacagtttcacttttctctggttcttaacatattttatcatgaaggaaatggagtaaaactttttttagtggattggcaacttccagagaattagattgttttgaatgtgtctaggtagaaactaatacttgtctctctctttaaatctctttaggaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcat

SEQ ID NO: 97945 - DNA, 1032 bp, Homo sapiens
gtggcgggcgcctgtagccccagctactcgggaggctgaggtggagaatcacttgaacccgggaggcagaggttgcagtgagccgagatcatgccactgcactccagcctgggcgacaaagtgagtctccatctcaaaaaaagaaagaaaaaagatttttaaaatctgaatttcacttgtatttgtttgtttcttatattctcaaatttggtttcctcaaatccaaacgtatttttaagaaatttttttttgtagcacgtatctgaagacttaagtgttttaatgttgttagaaaatgtattccttatgaattatttgaccctccaagctagtctcttactgttattattgttagccatgttctaggtatttgaaaattaaaattttttaattgttgttcaacttgtcctcttgggaagtaactagaacagtttctagttcataaattgttaatttattgaattaactattgagtggttccaagtcattggtgtagctccaaagtcaggtattttgcacatatggctagcttgttttctctgtgtcactttatgataaggcctacttactcatgataattgtttttgtctcaggcctttcacagacttaggatgaatataaaaaggtataataataagaaactaatagtaatgggatgtcctgttttcctttaaaattttcatactcttgggtacttacacatttggttgactccttgattttctttttaactattcaccttaagcacattcattttagtttcattaaagggatgttgattccttgtttattctatttttagcattcttattaaagtttagaaaaacttgttgagtttgttgttcatatgtatagaaagtagcaccatcaactgtggaaaatgaccacatccttttctgtcactgtcgttgagatatgttttatgtctaggtaaagatctttgtgtttcttcccttgataaatcatcagctatttggttttcagcagttataaacactgattttaaaataacatatattaagatcttagtat

SEQ ID NO: 97946 - DNA, 1165 bp, Homo sapiens
ctagaattttccaaaacaatatgcttttagagtgcatttggcaatgaaaatgtctatataagccattaaagtactctaaatctatttaatctgtttcacagataaggatcttgagtcaccgatgattgcaatttgatagggaaatgatttttctcatcatcctacgagagtcttggggatatagttgtgagtcatccttatccatgacagaaagtcattatctttcatgtgttggagtagaaaaattattaaagtccatgaaaagttttgggtaatatagttgagtgtatccctattacaaattcttattaaaaagttttatttgtaatagatatctatgtattacagattatttgcaagtaatatttagagtatttcttaggcagtaatttatttttttgcataatctccttaaagacactcttatttaatttgttttatcactttccttgcagtgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcaggtaagagagattttaagttttttctccttaaaatagtacctgtacttactttttaaactatagttgaattagaaaagaatcctaaattattgactttcttttgttgtcagactttaaatatattttaatcaggtttagatatgcatatttaaaagaaactgggggaagacgggggcacaatgtgttttatttatctcttctggtatattacaaagggatattttgctatggacggagaactagattaaaaatgaaatatagatttgtgataagttgattatttttgatgagcaaatataaataatgggaccccctaaataaagttatttgttcttctaattacttaacatttatcagggtgcctctgttgaaaagcaaagatgattaaaattttaaagacataaaaagggaagctactgtgtgtaaactccaggaatgtctgggaaatgcctaacaaacttgacatgtgaactttattatgggtatttctagagagcttcaa

SEQ ID NO: 97947 - DNA, 1094 bp, Homo sapiens
gaaggcttctgaaaagattcttattctttgttgttatgttacctgtggattatgacttttaatgagagttgtctgtattgtaatattgccataatcaatatattgtaatgaagctgttgacagatgcttgactatagcaatactgaaagttacagcttattcaatctgaaaagccttagaggaaattgtacttgctttgaaaacaaatatgttactaatagtgaatattgattagttgtttgcaggtggttattagcattgtcagaaatgcagcttgaattaattatgtgctgatagatgctaataattgttagagataatgccctgctagtaattagttttaatgactactgcaccattaagaaaggttaacttgttctatataaatctcccatagtggcacagctactacctcattaactttgttcaaagactgctgtaaacctaatatgctatatactgtgtatggtagaaatcgtttgtttcacaagattggctcatttagtcctagagttgaccctagcttaattaccaaggggggatgtgaataggctgctaagcattttgtgtcaattaaaatgctgaagcagtgtagaaaactgccatcttgcacatgctttgaaccaagttaattagaaagtttccacagatgagcgcttctttttaaaagaatgcattttctctctagataatgagaaagggagtcagtgaataactaagcttgaagacctttagcattttaagcaacccaatttgcagaataagtgaagcttgtttcagacatttggcgcttttttattgcatatggtatcttgggtacatataaagaaaacatttattagtggtatttaatagtttgtatattgttttatataaggtttttaaaagataccttttgtttagtttttgctttataccaaatgaattgtgattaaaaagcacaacaatttggttagaaatcaaaacaattttattaccaccattggttttttttcctacgtgtaggaaattaggatagagtttatgtaagcttaaatttaaatgttataaattctacaaataaagtatttaaataacatgggaaagtattttag

SEQ ID NO: 97948 - DNA, 1023 bp, Homo sapiens
atctcatcatatgaatatatttccatttggggctatgttacatttcttaaactctgtattagaaagatttacaaagattgtaacacgttaaatagatacttggcttttttaatgttctcaggtgagttttataattatattctttaaataaacagctttattgttgtggctctgcctttagacttgggaaatttttatttatagtttagctattaagtgaatcacagccttcagtcattttaagtcactggttcttatctcgtgggccattgaaggtactatttataacttgatctgagtgtcttaattctttttaaaaatgtttaagttagttatatgtcatatttttgttttgtttttaaacaatgccttaaagctttcataatctgggtaaaatagtctaccttctacgattcatttatcttatatttttattctttttggtagtctgttggtttaaattgttatactaatgttgactcttaatttcttttctacagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccatgtaagaaatgtttttaatgtttttaaaaatttaaaataaaaatatttaagctgaaagggtccttcattagcaagctatagcacagtaatctagtatttgtattgttttatttgcttataggatgaagtatttttttctccattttcagagttttaatagcaatatttttttaaataaattgaatcattaggtcaactttgctttcaatagtctttaaaaaaaactcattggattaaaatttgcaatatcagtagcagtgagtggtcttttttatctgtgtagcatatcaggttagcctttaggagaaatgcataagatatgttgtaatgattatgcctgtaggtggtatgcca

SEQ ID NO: 97949 - DNA, 1033 bp, Homo sapiens
atgccaccatgcccagctaacttgtatgtatgtatgtatgtatgtatgtatgtatgtatgtatgtatgtatgtattttgagacagattctcgctatgtggcccaggctagaatgcagtgacatgatctccactcacagcaacctccacctcttaggttcaagcaattcttgtgcctcggcctcctaagtgggtaggaccatagctgcgcaccaccatgcctggctagtttttgtatttttagtagagacagggttttgccatgttggccagggtggtcttgaactcctggcttcaagtgatccacctgccttagcctcccaaagtgctgggattacagacatgagccaccatgcctggtgccctctaactattaaaaattatttgtagagacagagttctcagtatgttgcccaggctggtcttgaactcctgggttcaagtgatcctctcaccttagtctctcaaagacttgggattacaggcatgaggcaccacaccctacatgactttgatctttgccatttttgttactacatttattttggcatttataatcaagatacagcagtctcagtttcagttattttgtgttacatcatacctaattgacttaaataggatggcaaaagatattttctaattaagtttattataaaaatgtgaaagtatgtaaagagaagcaagtttcatccgtcttcttaggtaatatttttaatcatgtgacttttattgtagtattttttaatgaaaatgttttcacacaaaaagtgttttcacacttcttactggaggtaagaagtcagattaagggggctttgtaggaagaaaataaaatgaaatgatggaaatggtgactcttttcaagaatgatgcaccactttggagatgatgcttgacgcttggttgaactgttgcttaaatactctgatggtgatgcagctgtctgtttcacctcacatttatgagaatacaaaaaatatctaagaagaattatcctccaagaaagtaaattcagggctgctgccattcact

SEQ ID NO: 97950 - DNA, 1038 bp, Homo sapiens
aaaaagagttggaaaattcattttgttagttaattccagataccttttttgggatggtcaagatcttaaagatgtgcagtctacttttaagatacaattttatactatttttgtttctgttttgtttgcatatgtgtgtgttttgtatatattcctttcatgatttggaacagatctctgaactgggattcatgggagtgattctggtttacataaaacttatttgtgtgactatgactcactcctcatgatttccagtagttatctaaatcatgagaaagaaatcttacttctcatctgtattttcgtatcttatttcaaattgtatattttagttatatttagtcaggacatcatcacatttgtttgcctccaaaggagaggtgattaagatagcctagaaaagaagaatgataaaaggaactgggaaagttcaacttagagaaaagtaaaagagagctaacagtatttagattttgaaggggcttgtggaaggtgaagtaattaattctgatggacgagtagagaataaaatatggtgggagggatgccaacacagaaggggctgcagggaaacaagagttggctaagtagatgactgcagaataattcaaaagaggtggtggggcttgagtgagggtcatggcagaagaaataggagaggaaaagatgattaagggaattatttagatgggagaatcaagaagacttcttagttgattagatgtaagacatataagtatttaaaagttcatcactacaataaattagatattgcaaagtttgtaaagaagttttagaattgccaattgagcatctctaatgtgacaatctaagatctgaaatgctccagtgagctttccctttaaccatcacgtcagtactcaagtttcagattttggaacatttcagatttcagataaacaagttttttgttttttataatttgatctttttaatctcattttgaacctaagcttactggtgcttatacatttatttttgcaaagaaaactgatacaagaatggagtcaccaa

SEQ ID NO: 97951 - DNA, 1032 bp, Homo sapiens
aagtacaattctgctctttatcattattgtagcttctaatttgccagctacagttaataaagttctcagtaggctgctgcaataagggaggagggggtctagagggagtaattttttttaaaaaaggctttctatccaaagatgaactctttccgaacttttatcttcatgctttccagtttttctcctcactttgcctgcttttgatttcagttccctcccgttgacctcatccggagcatcttttaaatctccccccaaacccaatttcttctttgtgtgtgtatgtttgttttgttttgttttgcttattttttaatttaactccagaaatcatttttctattagaatggcttctaaataattttaggaaattatttaagaattctaaaagacattcacttaagaaatgttcattgcactgctattctgtttaaattagcaaatatccatgcatttaattattgataaagcatatcctttgctataaatacaggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtaagtggactggaaaccactgtctatgctaatcttatggactataatatgtatgattaaatttggctggagcttaacaaatatatggttatgtatcactctggtcagttgatttttcccaaaggctacagttttgtgttcagttgttacatttggaggtgtaaggg

SEQ ID NO: 97952 - DNA, 1028 bp, Homo sapiens
aaaatactgttattaaaagtgtgtatctttttaatgctgattttatttgttttctcctttcagatttgtgttttaaatcctgtggttttaaaacattcccattgtttcttaattgcaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatggtaagatattttatatttttttgtggtactaaacctgcaaatgaaagaaatccttggaagtggtttgaagccaaactatttttgaaaatataactcattttaaagacataatatcctaaataatctcttaaggaaggacatttaagtaggaggtttccttttatggaaaccagttgagttgctgaaaatgtctgtccatcatgttactatttaaataatcattagtagtagagttataattacagaattattatactactttaaagactttgtaatattggtgtagaagtgttttatttttgttagcaaaattaattttttgagtttgttttatggcaaacaggagagaaatactattcctgttaggtaagccagtcttctggaaggaagtggtatatattccataggatttatgtaatttctcttatttctaaatttagcttaaagttaaatgtaaatgctaacaatttgttttattttgattttactttaataccccaaatatgttagacagtgtatttacagaactagcaattaggtttttatgtttgtttgtttgactagataggacatttacttttttttttctggtaagatcacagtcttatttcaaaattatgcagccttttttttttttttatgagatagggtcttgctctgttgcctaggctggagtacagtggcatgaatatggctcactgcagccttgacctcctggg

SEQ ID NO: 97953 - DNA, 2308 bp, Homo sapiens
tttttggagtgtcttattggtaataagttgctttatgctttagcataaagtaaaatgtcagaatttataaggtcagtggatagtaactgtttgaaaaatgactaatgtgcatattttaagtgtttgttgtgggggatgaggaggagggaacagagttagtatttcctagcaaaagcataaaatttcttcagtatttgactaaaatacatctggtgggtagcattgtgttcaataaaataattattttgtctgtagttacacttcagtcactaattttcttaagtaggaaaatgtttttaaaaactgttttgagcagaagtattatacaaagtttaatgtgaagatttatttttctagcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactatttttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgattttttttttttttttttggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaa

SEQ ID NO: 97954 - DNA, 1050 bp, Homo sapiens
gttttatttactcttttgtatctgatttattttcttacaggagttaagcccagagtcaacacatccagatttccgaatgtggctaacgagttacccatctccaaatttccctgtgtcagtactgcagaatggagtgaaaatgaccaatgaagcaccaaaaggtttacgggctaatatcattcgatcatacctcatggacccgatctctgatccggagttctttggcagctgcaaaaagcctgttagtaatggttaagtcttgttacctcggccctgtaaagcacttcaagtggcccctggtgatcatggatgtgtgcactgagtaaaactaaaaattaaataggcctcctgcaccgcagtgcagtaggttttgataactgattattgactgtgctgaagtcaattttgttaatattttattttaattttagcaccagcctcattcctgctcagctgagatcttatggggtgtcattaataatgtagctttctatttagaaagtcagctgtaagccattcccagtacaaatctgcaaggttggagaatcttgtttcaggatattaactgagccttgtgctatttagagccatgtctctaaattaaaacataaaaatatttccttcatataactataatgagagccaaaatgattttacttcttgattgatgggactcataagggtcttttttagcgtcaccaggcaagcagggaaaccacccactgctttcatgattagaattgtgtacgtgaatgtctgtgacctaaaattgtttcacagcgttttgccataattaaaaatggaagagtttctttttaagaggggttatgaactttaggaagtttttgctgttaaaaagctcacacgcttgatgtctgaatttgttttaagtgcacatcaaaggaaaacattaaaaataaagaagtactttcattaaacaaaagtcttgggtactaaaaaataaaagggggcctatatttaaaactaagtcaaaccatctcttaagcttctaagatctgccataggactagcttttgtattgattagggc

SEQ ID NO: 97955 - DNA, 1024 bp, Homo sapiens
ctggggaggggaagaggagggagggggatggtgggagggaggaaaatgacaaggaaatgggaatctcctgcctctgagagttgatgagcttcagcgaggctcttaaactctctctagctggaaattacagagcaagaatgtttaatttctgctttgggagatgctgaccaaaggtcttttagaatgactttggccctggagcaaatgtagggaaatagggttgatagttctcttgatgttgaagatataacaaaaaatcttgaggcagaagtttagctcaaggtacagatttggaaaatggactttaaaaccatgttaatgtagattacctaaagaaaaaatccagagaaaaaaagaagagagcaagagatagactcacaggtacatgagtgacttagacaagagagaggaaagagggaagaacatctgaaggaagtgatgtgtcttccaccctgctctttcaagaagtttggctgtaactgaaatatgttgtagatacgaagtaatcatgtttcaaaaacagttaacatatatgaactgaagtcataataaaataagtttcagggcctttatggggttttttttccagcattgtcagagaatttagataatacaaataataaacgaattttctatgtaactgaaacatcctttctataggaaagcatgacacttataatgcaagctttttaaaatgtgctgtgcacttctgttatttcttgaagaaattaggaatgcctgttatttactatgtagtaataagtatctgttttatttgtaatgataactatttgtattttagtgttgcatcagtaatacttagtcccacacttagaaactcagctgtcatttctgatgtttctactggggtggcaactgaacatgaagtcacctgcctctaatcttcagggagtctgtctcagagagttaatttttacttgttaatcaccaaacaatgtgacttggcaattggaagagagctgcgtggggagaagacaaacgcctatgagaacttgctatatgc

SEQ ID NO: 97956 - DNA, 1029 bp, Homo sapiens
tggcttttgagattgaaggtgaatggacagtgagatagcagaggattgaagaaggaaagctggcagatggtaaagagtggaaggtggatggctaatgtttttaggctcatctgtgtctcatgctgttgctgtgaatccctcagtgtctcctggcctgctcatgtggactatgaccctccatgaagcaatccagttaaccttgaacttttgccaagaatctgaaactccttctaaacacctcggaactgctgggactagttcttttggcatcaggttggcagctgctaaacgtagtacacctttatatctgttggttattgcctgtggagtaaacccttgaggcaatcttttttttcttaagtgctttttgcttctaattggctgactgaaccccctagtactttactgactttcaacgcttatcactgtacccttaggctatgaaacaaaactacatcttcaacccattctgagaactctattcttatctccaggtctttaatgaaatttgtctctccctcaagcctatttctgtttaggcttttccattcttccaagtttgggatatggggtctgcaacatttatcttctgttttccactatgaattcttactaatcttaggctcatagcatctcctctccttgactcagcttcattcgttgaagacatcggctcacagttctcccctacgctatgctacttcagcatccatgcgaacagccatagcttgaggaacttagttccttgaccttccatggcaaagtcctttacttcagtccccacttctgtggccacactggggacattctcaacacctggaatagctctacttctgaaatcacagagacaataccctcactgcttcactttgtgttttgagagttagtttctctcactatgtcaccctttctgagaccctctccatcccattccctttctccacagttaacagtcctttcttcctctactcattattttagtttctgtgattttttatttcaacttcactcttatcagattctctattc

SEQ ID NO: 97957 - DNA, 1030 bp, Homo sapiens
gtagaaaaaaatggatgagtcagcttgaagttagagaagttagcttaggggctctggctttcagaagcccttcacggacttggttcacttgtaaccaaaggttgtggtacactatgtacatagatacgggatctgggcaagctgattggcaaggtcagccctaaaggatctgccacctgttttcttattgtactttttgtgatgatcacgtaatttttcttttttaatttgttaaccagtgaagtgtctttccaataattccttgattctctgacagcaactgggtgtcctataatgtagttcagttctgacacaacccagaatgagtgcagattccacaggttaagggctcagtcccccaagaccaccctcatttcagacactggtggtaagacctggaggttatgcatacttctgactgaccagctatccatttggggttccctatgacctccgctcaggtttaataagtcactagaatgactcacagagcttaggaaagctttataattatgattatggttttattataaagaatacaattcagaaacagccaaatggaagacaggagtagggccaggtattgagtgtgtgtaggtggggccagggaagacacagagcttacatgtgctctgtgtgcaccatcatcccagcacattgatgtgttcccccacctggaggcttccagagcctcttgttcaaagtgtttaatcaaggtttcattacatacacatgattgactaaatcattggccagtggcgattcaacaatctccagcctccctctcctccccaaaagtggggcggctgagtgggtgagtgtgtaaggctgaaagttgtaacgctcagatcccaagctttgtctttctgatgataagctcccatcctgaagctatctaggggccctgccttgagtcacctcagcatgaactcaggtatgatggaaacaagctcgttatgaataacaaaagacactctgtccctcaggaaaatccaagggttttaggagctctgtgctagtaatctgagac

SEQ ID NO: 97958 - DNA, 1095 bp, Homo sapiens
gtgctgtgtgctgcacacctcactctcttgccgctttccctggtctccatcaggactttaccaaaacactcaagtgctgtggcatctgagaatgtccctctatgcactgtctgtccatatagtgagataagggaggtgctggaaacaattgttctcttcctctatgattcctgcaagtattgttttgcaattgtgctgcccgccttgaaaatcacatggtgccccactggcagctttatgatcatttctctaaatgaaagtgagaggttatcgaatttgtctagtttagtgtgagtcacttatatgcctgggaaatgaagtcctatcctgtgttattgatactggaagctgcacaaaaggaatgagtctctggagtttggaactcacctcatgaatctcacaccaaccagtgctgtcctggcttttcattgggatggaatgagaatcaagtccccatggtggaggttatcgtgaaaaccccagattttaatagagaggtaatttgagtacataacatattgaacttgaatattatgcacttgaaggaaaaatatttcctttgtagtgggcagcctctattatgttttggaggaattttccagtaaatcatctaacagctgctttactgtataggccttgaaattttatctgttcattggttacagacacttttgcttttggaaacttcacatgcttctctttaccagtaatattttgttcccaaaatatcggctcctggggaggatttaataaaggctgacccaacaagacatgtttttgagcaaaccttttggatgtctttggctaggaaccatgtcctatgtaagtgtattctatgtaagattattactaaaaatccaaaaagcaacctacagattttgtgacaaaaagaaaatgttaaccatctctgaacataaaggcattttgcatctgtgaatgtagaaacagtgattatagtgggtgctagtagaggtatagaatgtatgtgtgtgttttggaggagtggcaaggaagaaacaatgggacaagcattggcaaaaatatggctggtggagattctttccttcagactgcagattgaagacacccttcaca

SEQ ID NO: 97959 - DNA, 1028 bp, Homo sapiens
ttttgcatatcaacaaaaaaagtggcttgagttttattatagttggtgtaaactgaacacagtgaagacattggaatttaataggttctctctctaaggtgactcttataccatgcctctatcaacataatttgtttaggaaagcagtatgaagtttaagccaaaataatttctactttatagatgctcaagagacattttacaattgaaaatgtctttcaattacaaatattttgaaacttcgtaagattttcattctctgtggtctgttatatgagagagatcctttaactagagcaaagagggagttagaaacctgatcagggatattctttacaagttggagcagaggaaagagtagcatgccttcgtattttaacgcaaatgtctttttcctcctcccaacctacttgagatctgataaggtctggaagatggagatatttggtatgcaagtgtagagttttttaatcctccagaatttctagagtagaagatacttaggtatagttaaatattctgtatttttagtcaaacatatttattaattgaatatagaagaaaatgttgacacactcagacagcttactgaattttagatgtcttctgcatcttagaatacaagccagtcattcagagttctaaaagtatgcataaaaaattacagcaccggtaggtctattaacacagtgcccgagtcagcggtagcaagactgatgtgatcataaaacatgacatcaggctcgtctgaagttcttgtgtgaaattcctagtgagtgaggaggctcagcttaaagccatctgcagagtggcccctcattgtggtcttttgctgggaccaatgcaagagactagggagagcaaaatgtttgcttatggctagagactatatccagccctaatgatggggaaagttagtccttttcgggtaatcttttatgaattttcacctgatgaccgttatattggtctgttatcatgttacgataactgtgatctcatgaccatgttgctgtatcagaagaaat

SEQ ID NO: 97960 - DNA, 1059 bp, Homo sapiens
atttgcctgcccagctttgtgcttcgccaaacttgcagcctctatttgtgcagaacctctctttacatctcacaagtcattactttgccattggaaaccacttaggaaatgctgcagcagctttgtgtactccacggcaggtatctgtgtgaaggatagacggtagcaataatatatattgaatacattgtatttatataacacgtgcattcccttgtgttctctttctgtgaggcacactttgagatcattattttagttttaataatataggaactttgaaaagcaatgtaaatctgtagtttaaccgtaccagttttgaggagaggagtatgttgaatgtcgattgtactttgtataaatgtttaaaaattaacatacattttaagttcccctcccttgtttttcaggaatattggtataatagcatatatgttgttaactcacacatcaccatttgtgggagaagataatcaagaaacatacctcaatatttctcaagttaatgtagattattcggaagaaactttttcatcagtttcacagctggccacagactttattcagagccttttagtaaaaaatccagagtaagtaataatttgtttaaatactattacaaatttaatttgtttaaatactattacagaataaataatatatacctattaagaaagtatattctaaaatagtataaaattattagaaatatgtacaagttctaggtaaaataggtggtatgagcaatcattaacaaatacataacttcagatataaaatatacaacaggggattttgaagtaaagaaaagatttgagttacttctctcacaaaccactactaatccctgaaattacctaaaataattagtcatagaaatttacaatacacatggctggttatgataagactttattgtaaatgatttacagtttaatgattttacggccgggcgcggtggctcacgcctgtaatcccagcactttgggaggctgaggcagatggatcacgaggtcaggagattgagaccctcctggctaacacggtgaaaccccatct

SEQ ID NO: 97961 - DNA, 1039 bp, Homo sapiens
cttgggaacagtgttttaaaaccagcgagagatcaagacgggctacagctgtttccgtgattttcagcgatctgatttttgctttgatgccttgtgacccacttagtgtgcacgactcatcctcaaactataccactactggatgccaacgatttttgacatttacccaggctctttgttttattgtagggaaaagcgtttcatttgaatttcctccgagggagaagtagagacaaagttgaaagaggctttatagcagctggtagctggcattagtttctgtctggactagaggcactctgacatcaatttggaaattggaattaagaaaatacgtttttaaaatcgtaatacttatcagatttcactaatatttaaacacatgaggactgtgtatcacattcaccgattgttttgtcgacgtaatgtttacatctgtggtgctaatgataagcagaaccttgccagggacgtttgacgtggtgtggccactttacgttttcaagtctatgagaatgtctgcgcggagacagcatagctctgtagaaatgagtggcagcgtatgtaacctggcattttgaacccaggagcacaattttattaaaggaaaataaacctactttctcattgataacactgttttttagttttatggtgaactgttcggaagtaattttcaacaagtgcttattttataaatattagaccgtgtacccctaggattgtgtattttttaagaaaactggtccatagaagcggtgcaaaagttttaaactcatctgcctcggatcctcctcctctgagcagatgctcaattaaactttttctagtatcttaataattggaggtattaatagatgttttatttttgagatacatattgtacattttagatctttttttttttctaaagtagggatccaaaattgaggtgaaatatatttgcttacatggcaagactttttaaaagtagaatttctgtaattgaagaccatccttttttgtgtgtgaatagaatggttgcggtttctcttgggat

SEQ ID NO: 97962 - DNA, 1073 bp, Homo sapiens
agaaggtattcatgaggatattagataaattatgaatattttaaaaattctaacaagttttaccattagttgtgttaataaagctacccaggctaacaaaactataactggattcctttaatggaattcgatcactctatttaattggtaactttggatttctcatgctgatttcacgcccttgaattcatcatctgtccctctacccatttcctatattccctgccttatttaaagatacctctgccaacccacttttctttctttcatccatgaaataactggaaaaggtttttgcaagaacactcctggcttcctgatgtgtccctgcctccccatctggcctcaggtccaaccttgcctcctgtcccttaggcgcttgcccctctcaggtttcctgatgatgcaatgtcatgttccatctgctgggaacatccttctccttgttgttgattcagagaaaacctgcacacctacaaatctttcaagccttggcacagatagtgtcctctatgaaccttccttggctctgctgagcaaacttgtaactcatagtattattaactgtttgtatgcagggccactaatagcccatctttgggactaatgaaacaaaggtgtctcctagccttttggagaaatgcagcctgcagctagggctcacaatttggcaagcagagccaaaggaaggctggatttcagttcctgcttgccccagagcacaggatacacaaactttagagggtctttttgcctgtatattttgctgccacagtgtaaactccttgaggacagaaaccagacttttcatcctcatctctcagaggacagctgaatccctggcatggagtatatgcttagtaagtacttattcagcgagtgaaggaataaatgaaatataatgcaaattggaaaattaagtacattcacatacagagagagaaattaatcaacaaaccaatctatggaaatggaaatgtaactgatacttttggctcactggatttatctaattgacttgtctatctgtagggaaaaagggagggtaagcatgtgacctcctgattaacatt

SEQ ID NO: 97963 - DNA, 1074 bp, Homo sapiens
aaaaataactaatgggtactaggcttaatacctgagtgacaaaataatctgtaaaacaaacccccagtgacacaggtttacctctataacaaacttgcacaagtacccctgaacttaaaattaaaaaaaaaattacattgcacacatgggagaaaaatggatagatgtccttcttacttaaaaaatgaatcctggctgggcatggtggctcacacctgtaatcccagcactttgggaggccaaggcggacggattgcctgaggtcaggagtttgagaccagcctggctaacatggtgaaaccctgtctctactaaaaatacaaaaattacctgggcgtggtggcatacgcctatagtcccagctactcgggaggcaggagaatcgcttgaacccaggaggcagaggttgcagtgagccgagatggcaatgctgcactccagcctgggcgacagagcaagactctgtctcaaaaagaaaaaaaaagaatcctctaagaagtctggcatggtcttgtgtcgggcatgggagtttctgccctggagggttggaggggctgtaaaggatgagggcagtcctggcaaccggagcaatgagggagagaatcttagtctttctagacaaggatgatggagggcctttcaattttcaagcaggcaaatgtgagtctcattcttttctcagatttcctagtctcactttgcggtagcagtggatagcgctgctcacagtatgagtcaaggagtatataaaagtatatatggttgtctctgcagccagtgcaagttgaatccatggctcttttttcctcttgtggttatgaagtgactagagacccagatgataaataaggatgtagacagaagggtgtctccatggagacctacagcctgagcacatgactgcacttcctctgcttcgcggtcggtggttagctctgtattttgcatttctgtggaagacttcatacccctggtgctctgatggactttatgaaaagagagtacattcactttgtggcaattgctctcaaacagtccaaaaaatgcgctgctaagatgccagcctgaaaactg

SEQ ID NO: 97964 - DNA, 1037 bp, Homo sapiens
atttgagtgttaaaccaacactttgcaagggacctggtggtaacccagagttaaggttttattaaataattttaagcaaagaatacattttctgaaaattatcaccatgttaggaagccttcagaaattcatgacaaataccagttgttttctcctttgggttttgttttttaactcaaagtataagagattagaagtagttctgaacttggagaatgaaaactacaaacctaacatcactgaattaatcacttagcagagtaaattgagagctgaacagttctctagttatctctaagttgaagcagagattttttttaaaaaaggtagttttaaaagtttgtagtaaaaaaatgccttaacatttgctaaattgcttttggttatgcctgtgcttgcctgttccagctcatccctgcaccatgggctggccttgctcacacatttaatctgaaaggctgtatttaattgcagtttccattgcttctatttctgaagtccaattgctgaaataagtattttccagttggcccaagtataatccatgtatctctttggttattataatgttgttaacccatcgatttttactgagagcacaatttctctgacatgctacataagttatattttaccataaatattattagctcattctttccttccaggagatgaattttttttttcagacagagggtgtatgccaccatacctggctaatttttgtatttttagtagagatggggtttcaccatgttggccagtctggtctcgaattcctggcctcaagcgatctcctgccttggcctcccaaagtgctgggattacatgtgtaagccaccacgcccggacccaggagattctaatagcaatgcattaatagaatcagccatttttgtattttcatggcataaaattttattcactaaatctgactaatcaaggacctatttatatggttattgtaaatcttatcaaatgaaatctttgggagggggaagaaaaatgctgagaacctcagctgccatgtttgctca

SEQ ID NO: 97965 - DNA, 1049 bp, Homo sapiens
tcactctctcaaactccttgcccaggcttatctcaaactccttgactcaatggatcttcccgccttggcttcccaaagtgctgggattacaggcatgagccaacatgccctgcctaggatctgttttttcctccttcacacaatcctatcactgaacaagactcagatttttttttcattaaaaaaatgcaatgatgcccacaaaaaaaaaattcaaaaagaagaaaaaataagatagagggagaaaagaggaagaaggagaagaaaagtctttcacaatccctcctccaccccagcttctcagttgccttcattcccttttcagcattccttccctatctttgagcccacgtgtatactttttatcatagggtcgatgtactttatatttttcattttaaatttagcacatcacattgctttactgcaaactcctccttactttgcattttttactctcgtcatttttggccacttgtcattcctcagacctaacacaatcttttcttacacttcagtttgaccctgacatctttgtaagtaaagtagaatttatactgtagctcaggtgttagagtttcagcctctttctccaaatgccttccttaggaagctttaggcaccctcatttttcttgtctgtaattttcctttgtgttttatcatttaaaacatttgcaccttatcactccattttttgctactgagctccctaatgggacttgtatctgtaatgtcttaatcttgaattcatggaagtatctttcttctcccatttaaaaatatttcagatatccatgaggactccatgtcctgtgagcatatgtaactgattccccctggttttaccctgtttaaataaagctttctcgttgtgctccctttttgtataagcttgctcctgacattcgaaagatttacctctttatacatgtttacataatcaaaatattagcatattgcctattgtatgtattagaatgttgcctattgtatgcctgttgtatgatgtgtggcttagttttaggtatgctccacataaatgtccat

SEQ ID NO: 97966 - DNA, 1048 bp, Homo sapiens
caaattaaatcctaagcccttcgaaggctgagaccctattgtttatttcttggaatgaggatatagaacatactttgtatatttatgatgggttctcaataaacattttctattttgtgttggaatcctgtttccaaatctgaaaacccaggtatgattttcaaacaaacatgtacactcaaactcatatgttgaaatagtaaaataaagtcacgttgtccaaagttggtaggaaaacagggaaatagccacagggttcacaaaaagcaccacagccagccattttgtaccaagaattacctgcaagagaaagggggcggatgctctctttgggatataaaccggatcttggatggaatattctactcctttgggatttaggcttttccccactactttggctgaagtgcccgttttgtttcttgtctttccccagcttatttgaagaagagataatgtcgtatgtgcctccacatgccttactccaccccagctactgtcagtccccacgtggctctcccgtgtcatctcctcagaactcgccaggtgagtccacctgctgctcacagtgaattctctgaggagtgaaccttcaagccagatgttctatcctccctaaagacagaacagtaagggaacacttcaggtacatctttggtgttagcacagatacacgtgtgcatttcctgtctcgtaagagtggcttatttccatgaggattcattttgacaaacataatgaataggaggattagtggtatgacatactcagatatagaatttacttttcatgatgttatatcatacaatatcaggacacaaaatattaggttgctttttgactttagaaagttctagtgaagagaacttttttgatatacaatgaagataaagtctctactctcaagaaataatatggaattgaaattgttcagtttaatggacttggacattcctgcaattcattaattgcattagatagaacagaaatggattggcagatagaagatgttgataggtaacctgaaatgtgtacattcaatctcttt

SEQ ID NO: 97967 - DNA, 1043 bp, Homo sapiens
attatattggtgattaggtttcaacatatgaactctgggggacacaaacatcggacccataacaggaggatttaaaggattattccacgagtctccgagggctgagggagtggcttactgaagatagtaattaaaggaaggtcattttaactgcacatgaagtgatttagaatgagggaaacattggccatagaagtctagcaggatataatccattcatcatggcatgtgttgataggaacctgtactaggatataagaaaatagacaaaaaggattcagcatgagaggaatcgcagacagggagttgacaagatttggtgggtaagtaggcagaatagaaactgaagaagttgaccttgagtattaataataataatacataaataatgaacaatacataattaataatactaggaaaattcgaatgagggacttgttaaaggaattgaaggagaacatattgaatttaacaagacatatcctacactttcagaaaaacagagtagatcatagagaaaaataaaagtcaacatagtcctatcaccaggagtatgtggtgaggtaattagtatatattaatacatatttacttatgttaatatttttctgccttctttagctttgctttacaagtataaacatctgtctgcctttcctcatcattgtctcctggtttacaggtttagcttggagcagagaagacttgggaggagagtaagcaacgaataacatgctagctatcctcatatattatgagagaggggttagatttactgagcactcagcttcgcaagtttgttgatgattatgtgctaggcactgagctaagacctagggatacagagatgacagcaactgtgggccctggcatcccagacttgagagcaattataatgtcataaccagaattacaagtgcaataatggatggctatagaagatacactgctggagtggacgattaactccaaagggaaggcacatggaaggggccatagacaggtttggatttgagattagttttaaaggctgattaagagct

SEQ ID NO: 97968 - DNA, 1062 bp, Homo sapiens
tcctaggttctcaagccaacggccaccagccactgcgatcactaccttcagtgcgccaggatgttagccggtaccagagggtggacgaggctctcccaccaagtgaggacctgttagttaaaagggcccaccttaatcaaacggtgaaaggtgacaggcagacccattcccatgagtctcaaaagatggatacatggtcttcaagcggaaggaatctgggggttgccacttgacatagcaggtgtagtccgggacgtgctaggccaatgactcttctctggcaccattatgctgaaagaaagggcagctgtaaatcctgtgttgcccatggggtaaataataatggaggtagatccagatattttgggaaattgggtgcataatagaattgttttaaattatgcctaaccacagcatgaatgttctttcagctaatagacaaattggtacactctcttagaaaaacctcactctatgtaatatactgcctttttgttcacttacagcatttaaaatcattaagcacaaggttctgattttttttcttagggatatgcgagaagtattgttaatttcagaaattagtctactagttatttgggataggacaattagctggggacttgaaagacatttcatttatttcactttcagaaaacacttagcacttaaggagaaatggtggaggattagggatgctgggatatagttacataatctgtattcaaaggtatgagtgatacccttagccaatcataatccaaatgaagtgtaaactctatttaaatttcgacagtcctttaaagagatgtagctctatgagagcaatgcattttgatgaatattgataaagcctggtaaacattgctttaaaaaaaacactggaaggtatacccttttgccttaccgctttcccttcttgctcaccccctccacttacccatcttatatgtgaccatgacaacaggctgatgctttggttcctctgttttaaaaatggtggaacataaagaagggaggggacgcgtttaaagggttacaattctgagtgattagtctggc

SEQ ID NO: 97969 - DNA, 1041 bp, Homo sapiens
cgcacacacacacacacacacgtttcacttttctatttagagaaaatgtgtagccaactagacttgtaagagaatgaagaagtcgtgagacacaaagggacaagcttaatataaagcctaccaaacaaaattagatttagaaggtatttgggtatatatgtattaacatctccaatgtccctttctttgtaattatatttccactaggaagtaacctaagaatctagaatatatactcctgtaatatagactgttttgtaacaaaaaaacagacactttaatcctagtacgagaggaaataggaatgaggatgggaaagaaggcaaggaaggtaatagtcaaagaacaaagacaaaagcaggagaatatgcctcatggaagctgacaggtgtctaggttgagtggaaggtccctctagagaaaaaggttaaatattaagatgacagaaagtgactggtggagaagagggtgccgcaggcaccactgtaagggggagtagaaccctgggcaagaaggcaagaagtaggcacagatacagaggagatagtagtagggagatggagaaatcaagggagatcaggcctaatgtcctcttggatgccacagaatgcatgagtttagggacacagagttcacacagagttccagtgagggtggaaattaggtaggggatgtgaggacagagacagatttggaattgttaagagaaacgagaaagggaagtggccaagtataacttggttttaaagaccagtggcattctatgatttgtcggaacctttactcagttaaaggaagaaataaagttataattacttctatattacacatgtgggggatttagaattgtttctttgatatacctttttatattcagttattgttcttttttttgagttagggtcttgctctgtcatctgggctacagtgcagtggtgcaatcgtggctcactgcagcctcaaactcctgggctcaagggacacccctgtctcagccttctgagtaactagggctacaggtgcatgccaccatgcccagct

SEQ ID NO: 97970 - DNA, 1063 bp, Homo sapiens
ccaccacgcctggctaattttttgtatttttagtagagacagggtttcaccatgttagccaggatgcatttttacagagtaataagtgtggttattttaaagcttaggatgaaaatattcacaaaagagactctgaaaggaaagaatgaagttttcttcagggatggggacaatggaggaggaatgaaagaaaggaatgggggtgctcatcccctgctaagatgcctttaggggatgaagtgatggaggaaaaagagagagtggaggaaggttggggagccccaatgggagtgatttgcatacttcacagatattagtgggaggctgggatgaaggaattaaatccgctaaagaaccaaaatactgttctttcttattatacccccacctactcatcctacacacaactctctgcacacactgaagctttttataatccgtgaactttgaaagtcaaacatttcctgctcatcagcttcagcgagcatccagtagctttctttgaccagctcttaaatggtgatcttgaagaaaatgtttaatggttttgttttccaatttgtattttagctgcaccacagggaaagatggaaatactcagcctgtttgtcttgagcatacccagagattgatggattcaggtttctatatttgacacagatggtttattaactgttcttttctcccttctgcagttgtagtaaagaagtcaaaaacagtttagaaaaagtaggtcaagagtgttagctgaagaaaagtagtgtatttatgtctcctaacttttgtttttcagaaagcagtactcttttaaagacagttgcagagggataaaaatacttgtttcaagtaatccaatccccctaccatacataagttgtataaatggcataagaaaacaatatttaaaacacactagcctattataaaaatttccagaacagtttgaaacaatggacccctgcttccagagcatattggggttgaagaggagtgttaatgtcacaggagaaaaaattagctgcacaaatgctttggtggactgctcttaaaccatctgaccatt

SEQ ID NO: 97971 - DNA, 1003 bp, Homo sapiens
gaggtgggcagatcacctgaggtcaggagtttgagaccagcctggctaacatggtgaaaccccgtctctactaaaaatacaaaaattagctgggcatggtgatgggtacctgtaatcccagctacttgggaggctgaggcaggagaatcacttgaacctgggaggtggaggttgcagtgagccgagatcgcgccattgcactccaacctgggcaacaagagtgagacctttgctgttaaagggtggtccctgcagcagcaacatcatcagggtgcttcatagaaatacagactctcaggccctaatccagccctgttgaatcaaaatctgcattttgacaccatctccaggtgattcatatacaaattaggtttgagaagctctggaaatcattttcatgggaccgtccctctctgcaagtgaactggtagagagataaagactcatcttgtgaagtacctgcagatactaaatagcataattaggaaaatccttttagagtgaaaggaattcagatatttattgtacattgttggctcaatacaattgtttaatattgaccttcccacactgtaccttgtgagatttaagatgtatgcaaatacaatgactattattttcaaaaaatgatttttgtagtcattttactagccataagccagagtgctcaaaacctttccccctttttctgctttctgtattctttctaaaggtggctaaattgtcgaagttataattcagcatgaagagaaaactccaagaaaaaaggctttagctggggccatgcctctgttgtttgcatcctaactttgttagagctccttaagcacagtagagcctcgtctgttccatgacactgcaggcttgtcgcataaccctatgagcagtaatcaactggactccagatgttgctgtctcacattagcccaacgttagcttcaataatgttgatggcagcttgatatatatcagggtttcctagctttcttagatgtcttactta

SEQ ID NO: 97972 - DNA, 1054 bp, Homo sapiens
tggaacatatccaccttgtaaatactgattctgagattcaaatatgtccctaataagttctagcctatcattatctcttttccttcttcttacacttgccttgacaaaatccgttatttgcatcattttgaaatatttgatgtatcataactttgttgaagagtcttcagccattttccttcctgtataagtggaaaacatttttattcttagatgattgaaaactggattgactgatgaatccaatggtttatttttatttctacatccatttcctttttttctaataaacctttttccagctttattgaggtataactgacaaatagaaattatatatttataatgtgtataatttggtgttttgatatgtgtatacattgtgaaatgatcaccacaatgcttgttaacatttgttatctcacatggttatcttttttttgtggtgagaacacttaagatctatcatcttagcaaatttgaagtatacaattagtgttgccaactatagatatcatgcggtatgttagatttcttgaacctattcatcttgcataactgaaactttgtatgtttgacgaatatatccccattttccccaccttcccaattcctggcaaccactattctactctgtgcgtctgagttggactgttttcgattccacatataagtgagatcatgcagtacttgtctttctggactatttcacttagcataatgtcttccaggttcattcatgttgtcacaaatggcaggatttccttcttttttaagactaaataatatttcattgtacatacatgtacagtcatgcatcacttaatgatggggataatttctatgaaatgtgtcattaggcaatttagtcattgtgtgaacatcaaagtatgtatgtacacaaacttagatggtatagcctactacacacttaggctatatggtatatatggtatagcttattgctcttggggtacaaacctgtacagcaggtttgtactgaatactgtagacaattataacacaatggtaagtatttgtctatctaaacata

SEQ ID NO: 97973 - DNA, 1101 bp, Homo sapiens
aagaaatcaaaatcattctgaacatttgagataaaccagctggagcttttctgcgcctaccactgttgtggattatctatgtgttgtgtagattgcaaccagatcacaaagctagttttccctctttatgaatgtgaaggaaaatattccagtaaattaacatttgccagccacaggactaaatttaatgaagattatgagcaatgtttgacccctctgaacaggagacaaaaaataaaagtaagcactggttctgtttcacttgggcaatgtgatcttgggagaaaaacctatattttcttactcttttaaaaggcttttgcaacactgatttcagccaaaggcaaagaaaccaaggttgttacctgtagttgaggacagatgctttggcgttttctcctagatgaatgtgttttgcaggagaggtggcttttgggatcttcccagttttaatatgtgcctacacatcaatgaaatgatcttgcattcaaaatgcttgttaagtctatatggttggtatctgtgtaacctctaaccaggtggctttctctgttgtgaagtgttcctttaagagaaaccagaggcttctcgcctggggcttgctgtgggcctggcctggatccacattcttgtgcattgctgactactttcttgggaaaaactggaaccagttttgcttggtgtgttggatagggaatggcagcattgggtgaaaacctttccagctctgttatcaaaagccaggcctggcctgaaagagggaggactatgtttgaagtttgattgatttaacagaggcagaggttgcttcattacacacaggatgccttttgtatcaggatatgaatgagagattagaaaggtgacgagatgccctgctttgcttgtgacagtgccagtttactcctgttggtttatcttaattatcaaaagcaccccctttcacatgtaaaagtgtcctggtttgggtgataattatctggtcaccctagatattaaggaatcctgaatttttttcatcacccctcttccgacaccagattttgagtcttgccttatttcagtcttttatttattaaatgcaaagctagaaaatcagaa

SEQ ID NO: 97974 - DNA, 1063 bp, Homo sapiens
cgccccggcgcggtcattcatttgccatttcggtttccgctgcccaggatgtgttggatggtttggttctccagggaaactgggactttggggtctatttgagcatcagttgagggagaggacgcttcatttcctttttggttgggaatgtgccgtgaacatcctctgctggagcttggggcctggagcaaactggggctgcagatttagacgtagacgtttccgaggacgcgagactgcagaggtctgactctctcatgccttgtcttcactattagcagcgctcgggtgcttttcgtcgtttattattattaatttagagaacatctttacaggcacatttcttttagagttagaagtctttggagtcagtacagagagctcacaattagagttacaagggttcaatcgatattaaacttcaggaaggaaaacatttgtgatcattacagatagaggtggacagcatgcaaacttcgggggcctttagcttttgggttatgatttctgctttcactgtcctagactcacgcaaactgttttcgtatatatatacctttgtgaaagtgtgaaacttgtcttttctggagtagtgttctatagtttgtcatttagaagaagaatattttagtgtaattagtagagctctccatgtgtttgtcttataaatatgattttctttttactatttctcctattccctcgagggttcatttcttctgttgctttgagagagctttttttctttctcttcccaacagatggctgtatgttccaagaggttatctttaaaatgacacacacattatctacaaagaaagaaagatcagttattgactttatctttggagttattaaaataaaaggcctaatctggatggggatattattaatggcgtgaaaatctggagtttgctaatctgtttggtcatcagaagattcctgcggggattgtttatatagcgtgggagacagatggcatccctagcagactagagaagccaggcataaagggtcattgtattcttcagaaattatccacttcactattagaggtggggta

SEQ ID NO: 97975 - DNA, 1050 bp, Homo sapiens
cattaagacagtaacctctcccagtcttgtcaaactggccctcatgtaggagatcttaccaattcgtacagccagaaattataatgtatctctcaaatctctgtgtacaatctgatatctctgtttttggtggccccagaaggttaagatgtgccaagtcttgttagtaccatgagagcagtaagacagtagccacgctctctagatgcagctgaaaatattagggtgttagatgcatgttccagttccttctatcctcagggtgaagctgagagcaggtatttatcccttactgcgctaaagcaggcattatttatctgcactaaggcaggcatttatctctctctactctaagccagggagaagctctgtggcaaatacctatactactgtcattcagactacatcctctgagggtatggccactgggagtgggcccgttttatatctacctctttgttttctgtggtctagagagacttggaaatgcagagccaaatcagctcccagagctgggtggctaaggaggtagtccttatatgagagctgtagaagttatgtcactagataagtggacaaactacttttaggaagcttctgtagacttggagttatcgctggggcaagctaggggagaagtcttggcaagtaccaagctctcatttaggctgccagaggtgtattgtttggctgccccattaactccctgatgcaagttagttagaagccagaccatcgagtattcactggaagaatgtacaaagaaatcctttttagtgaaaaatagaactgtgtgtttcagcactttctctgcactgcttccaagaggtgtagtccctggaactgcttgcactcctgtttaaaaccacctcttaggattgtgatctggggagattcttatatgagactcttgtattcctaatcctttctattcctagagctaggaggtttaagatgcagtccctcaagtagaagttataaaagttggggtgcttgatgcatggaaaaactttttccaggaggaattggtagactggagttattgatgga

SEQ ID NO: 97976 - DNA, 1004 bp, Homo sapiens
tctttatctcacagaaaaagagtttttcttatacaatttcaggtgcacattttgcagcaaaactgcattgctctacgtgattctatacagagcgctcaagaactactggcccaggaacaaaaaaaaaaagaagagttggagattgctacttcacagctcaaatctgatctaagtatgaaaatagatgctagaaatcaccctcttgttagtttttggagatttcatggaaaaactcttaagatcccaaattcttaaagtggccagtgttattggtatttcccacagtgctgtatgtaaaacattgcagatttcccttctacctgcagtactgagatacagaaggattgttgttaataatatatttgaccctgttaattgtaaactattccttatttgtttttttccagcttgtttgtggacctgggaatatttggtttctagacatctggcttgaatattgggcaaaaaaagtaaaacaatagattgaatatttgataatagaatattagtaaggtagtaaggccatgaatccttgatgacttatggattctgtcagttcatcatgtcagattctccattcttcatgttatcaatctattttggttaacctatatttgtagagatggatagttgtaaggtacctttaagagagcttagattaatctcctctttttatagatgagtcctcaaagatgacagagctaggaaaggaaggagcctagacttgatcccaaggtgttcggtcatatttcttctaacccatcagccttttatcatactactgttgctagtacttcattataaagcagtttccaggtagtctcaatgacagaggtcacagagttacagggcagtgcttcatgtgattaatacatcatggtttacactgaactttcacataaactatttcattcagtactcaaagctatccttccagagttacaaaaggaaaaaatggcaaagtaagacctagacctggatcttctaactccaagccgagtgta

SEQ ID NO: 97977 - DNA, 1058 bp, Homo sapiens
tatagttgcagtaaaattagggaagcacctctggaggagtaagtcacattcccataaatggctcattcgcataaatcagttaaactcttttctcctactttgccctagtacttccagcagagccatgttaagaaccaggcatacctgagcaccagcaggtaatagctggctagagcatgatcatttgactctccttctcagctcttccttcatccactatctagctgctgctttactcaaaggttaaatcaaaacttaaagaatattgattagaagggacgttcacatgtttctatgaaggcttttctattaacagcttatatgtcctttaaaggcagatttagacaagaaaaaacatcagcctgggtggaatgactccatctaagcagatgttaagccattaaatgttttcagttttgacctgagattacttagatcagacttatccagttcaggtcaaatgactaaagttttgccttaaattatacctcggtaaatatttagataataatagcatcccatgaaaatttatacttaagggaaatgcagtgtgcacgtacatctttattcctttttatttatttatttatctgagactgggtctcgccctgttgcccaggctggagttcagtggtgtgatcatggctcactgcagcctctacttcctgggctcatgcagttctcccacctgagcctcctgagtagctggaactacaggcatgcatcaccacacctggctaatttttttttttttttaagagatagggtttctccatgttgcccagggtggtctcaaaactcctgggctcaaacaatccacctgcctggcctcccaaagtgctgggattacaggcatgagccactgttctcagcctagatatttattattttcaattagtgagcatgttgatacaggaaagaggtacaagctaaagcagagatggtattttccagatatatgatctctgcaaattttatattcagctgaaatgttactgccttaagactgttccatattgtgtttatgtagtcgttggcagcatcatttaaaactctcc

SEQ ID NO: 97978 - DNA, 1002 bp, Homo sapiens
gcttttccttgttggaggatggtacatttcagtgctggtaggacagcactgaagggtttcatttttagaaatcaggaagatttttacattattttctccctcaccctcttcctgcaattttaggataatggtaatggaaaatgtcaataaaccccagctctggaacattttcaatcaagttaccatgcactcccaagatgtacgacatcatcgcttctgtctccgtttgatgctgaaaaacccagaaaatcatgccctatgtgtcttaaatggacacaatgcatttgtatctggtagttttaagcatgcgcttggtaagtgtcctggcacgtgactttgtcaagcataaatagtgtggtgaagagcctagcctctggattggaactgtctgggttaattatcagcctcactgtgacaaattattctacctcctcctgcctcagtttcttgatctctaaaatggagataataattggacctactttgtagataattgtgaaaattaaatgaatcaatataaagaacttaaaacagtgcctggcacatatagtaagtggatataatagcaaaaatgataattactaatattaatatttgttattcttactaagctttggttgtaaaaggctgacacaggtcttataaaattcattttaacggtcaacaattctccctgcttaggcctatttatttttaaaatgattttcattaattatggatgcttttgccacctgattttaatttgccataatgcaaaacattcaagatttgctgaaagttcattccttcaggagctaaatctatattaagatttatttatgtggtggttactaattctaattaaactcaaggaaacttcattaatcatttataataaggaatttctgtaataaggaatcagaagtaaacaagtattacttgcagagtctccttttaaaaaaaaattaaagaagaagcaaacaagtagaaaaacatctaactaactaaatgtttaaacttaaa

SEQ ID NO: 97979 - DNA, 1077 bp, Homo sapiens
aaaattgccttgcatgaaactggtccttggtgccaaaaaggttggggactgcttccctatgggattacagtcatagaaagtatacttgttctaccctggaggagatatatcttagctagcaaggagaaatgcagatggaactagctggaacttgtagagaccaagtccgaatcaggtgcctgggaatgcagattgttaaactggcagagaagaagcggatagtattgaaggagtgtaagcaagcaactaccccttctcatctttgtccggagagcactggcaacaatttaggctcatggttattaaacttgtcttaaaattgatgatgtgaatttttctaatactgctatttctggaaatacagtgtcctaactggttttcattggtctcattttagcaatatttgctgtgctcacaagcgtcttgacaaaggatgactggtggaatcttctgttgaaggccatatactccttatgtgacctatcccgatttcaagaggctgagttgcttgtagattcctcattggaatattactcattttatgatgacaggcaaaaacgcaaagaactagaatactttggtctgtctgctgcaattctggacaaaaatttcagaaaggcatacaactatatcaggtgatttcccagttatttattttaattagattctttaatagagtaagtacatgtactttgatttagaagctactttacttttggctctcccattaaacaataaactggttaattggtgattcccagaggcagtatataagaagatgcactctaggaccagactttctgggttcaaatcccagccctgacgcctactggctgcgtgaccttaggctagttaggtaatctctagtgccacagtcttcccacttataaaaggatatcataatactgccatctcatagggttatgatgaaggttaaaggagttgttatgcctttttaataatgcctggcaattattattattataattattattattatttgagatggagttttgctcctattgcccaggctggagtgcaatgacacagtctcggctcaccgcaacctccgcctcc

SEQ ID NO: 97980 - DNA, 1047 bp, Homo sapiens
caagtttgtttgatatccagttccaagtctggagagaggcatctttatcttattaaagtatcgagagacaaaatatcagacagcaatgaccaagagtcagcaaattgtgatgcaaaaggtaataacttcatttgcattatgttatataaaatttggctgaattgaaaaagactcatgaagtaacactggacagcaatctaattgaaaatatacttttcaaataaaatgaaattttccaatctaaatctctcaagtgtaataaactcattcgatgttaaaaaggaaaggctaaatgtaaatactttaaattaaaaaaaattaaaaggaaagcatctgcttggatctgtgaaagaagtaaaacaaaactttgactttttaaaaagaaaatatattttaagaaatttgtgaagattagatgacagtatagatgatttgtccagacttcacttatatatattccattctctatgaaataatttttaacaaatgtagcaatagtcatagaaactctttgaaaataagttgctgtgacctagtctcaagtaatataactttaaaagactacagattctacctctgcagcttgtgtttttaaccatgtttccttatgttgtatttttctccctgtgtgatctgcctgttttctttcagtgattcctcactggaggtccatggttagtttttcttaggctcataaggttttgttgttttgttttgtaaattttatcatggtgaggatcacattacactggtgtaccaggataggatgaactaagcctttttatgttacatgcaactttgtactgtgatcttttcactttacattttctcatagacattttatcatgttgctctgttctcttcatagttatatttaaggaatgtgtagtattccattggatagtggttccataatttaatcattttcttattttttggcatatggtcacttttggcagttttataagcagtaatgtagtaagcattttcatacatacagatttgtccatattttgtttaggatagattctcagaaggaaaattatt

SEQ ID NO: 97981 - DNA, 1061 bp, Homo sapiens
atttattagactttgcaaactactttaaatgtggataaaaattcctgtaatttcccagggctttaaaaattattttgttgtaatgaggttttagaaaataacacagtattattttatccttttcttagcctgtttctagtgaacactaaaaagagacttttcaattcaagaaaaaaaagagagagggttcatatatcctcattatttttgtctttttagttctccgtagtttagtagaaggtgtgaaagtaagttttggataagtacataaggtattagaaatcgaataggaagcatacttgctaccaaaggacagactgagagagatataagaacttattaatagagttggccacactaagaattgactgtggaatcatttgctttgaatgaaataaatgagatcttacatagaagatacacatctcaagcttgcatatagtaactgcttcttgtctgtgtattctccagctcctgagaatgttacctgcactatacctgatggcgtgccaatagatatcacagtgaagttgatggtctgccttgtacatctcaacattcttgaaccacttaatgtatgtaacaagatctgcacttgagatacttcagatcaaatgcaccatctcttttctttagatgtcaagaaattataacttgaccctagagtttcacatttcttaataaccaaggaggtaacaataagcatcaaataattttgtatgaatatcttataaaaactaaaattgttttgcaattgggcttacagtaatttatttttcttttaaaataacaatctaaagatcataatttgagattgtctttagaccatttgagattgtcattagataattggtaataattctgacagctattcttttttgcggactttggaccaagtatattattgaaaaaaaaaaagtacttagcatctactttgtaaaccttaggataagatattgagtaaaatatacaaatccataccctcatgggttgggatgcttttttgttttaatgggattagataataaaataaatacataacatatacgggacattggctg

SEQ ID NO: 97982 - DNA, 1067 bp, Homo sapiens
gcatttggagagtgagatgcttgaaattatgacactgttttactgactttgcacattttttctggatcagttctgattacgattttaaggaaatacacattcctctcaaattctaagaaaatgaaaatcactgttcattgttagatagcctaagcaaggaaatgagttttataattggaattaagtaaatattcatccattttgccacttttttttaggagttactatgaagccaatgatgttacttctgctattaacataattgatgaagctttctcaaaacaccagggcctagtctccatggaagatgttaacatagcagctgaactatatatttctaacaaacagtatgacaaagctttggaggtaggaatgcttatgtgtttctctgttaagttttgcatgtgtttctgtgttctggaaattcttaaaaattggcagttcttcgttttagttaaattatgtatatatttaaagtctatatggaaacaagtgatttctagattctgtagcaattcagtatgaaatatgaagtgtagttacataataaaaaatattgccattgtcacaggtgctaagtatgtacttcagggtagtaggactcaacagtcagatgaattgctgtgatttagttcttaagctggttgggggaaagtaggttggtttgatataaagaagttatatacattgagtttgcattagttaataggatattaaaatgttaatgtgtcacagggtttctcatttttaaaagactctttctttttatagcccaactttatattagggattatttgaaataactgtacaaatctttgcattatgaaatggtttttcacacatattttatttcctttcttctttcccattcttttagataattacagatttttctggaattgtgctggaaaaaaaaacttcagaagaaggcacctcagaagagaataaaggttgtagtttcctctgcttaggaaagtgtatataatcctctcttggtcataaggtggcgttttatggtgaaaatttatttcatactgtggtgagttgatagttaatgttctcataat

SEQ ID NO: 97983 - DNA, 3115 bp, Homo sapiens
ttgtataattctgctagagtgatttgaagagtttaggtatttaaaaaaaagacatacagtttgaaccatgggatggacatcaactcaagcctcttctctcagccaatggaatttatttttttaatttgttatagctcctctggcttatgagccattctctactctagccatgatatatgaggaccaaggtgacatggaaaaatcattgcagtttgagttgattgctgcgcatttaaatcccagtgacacagaagaatgggttagactggcagaaatgtctctggaacaagacaatattaagcaggctattttttgctatacaaaaggtaattaaaattttttttttttttcacttttacaagctgttacataataggttttttgatcattgtatttgctattctggggtgtgatattggctgagataaatttgtttctattgtgtgttgctctagaggtaagtatttggggttcctctgttctcatgtttatcagggactttttgaatgttgtgagataatacaacacgaaagttggtagatgaacagtaccttcagtttctcactaagatcagtgttggttctaagctgttccttgaggattaacatcagactagattgaccacattaagaagattactgttgagattcagattctatctgctcttacatcaaacctagtcaagagttcctgtgaatatagatttattcagaataactcccttggttccatttgatggattagtttgcttattaaattttctgagatgatggatcacacccaggtaccatgcacccctttttgtggtaaataatttgtatttctttctttttagctcttaaatatgaacctactaatgtccgttatctgtgggagcgatcaagcctttatgaacagatgggtgatcataaaatggccatggatggttataggcgtattttaaaccttttgtctccatctgatggcgaacgttttatgcagctggctagagatatggcaaagtaagtttggagtgaaacagatctacttgctcctgttaatcttgttttgcaaatcaaagcatatatttggaatagaatgtacttttcattgaagttcaagaagtgttttgccttatgtgttttattgttttgtttattgagacagggtcttgctctgtcacccaggctggagtataatggcatgtttatagttcactgcagccgtgaacttctgagctcaagtgatcctctcacccagcctcccaaatagctgggattgtaggtgcacgccaccacacccggctaatttttaatttttttttgtagagacagggtcttgctgtgttgttcaggctggtctcgaactcctgacctcaagcatttcttttgctttggcctcccaaaatgctaggattacacatatgagccaccgtgcccagccctgtattttagattgtaccgaattttcagtacttttctgtttccaagtcaactgtgtcattgcttagaaaattgtgtatataaggttacatttcaagtgctcagaggcttaaaaatgggacatgtcctaaaaggaagagtaggttctcaggtttccaaacttagtcaaaagtgtgtatatttgcaataattaaaaaattattttttattgcagatgtgccagtgaaatgttaatgatttgggatcttctattattttatcttgagccagtatataatattttaagactataaaaattctcttttacagttggcacattattgactgtggtatatattttattctaaaatatgccctactgcatttacttctctggtatgctgcgcagcaaaacaaagtaggaaacatttttgctgagtaatgccttgtgatatgctttccattctagagataccatatgatattttgttctaggagtaaccatctccatcagggtacattaggggtgaccctattaattccatggcctttatcacaatgatgcttagctgtgaaactgtcccttaccctcccaggggtgggttacataggactactagaaaacatttctaggaaatttgttgaggcaaggcaaccctaagttgatctctgatggaatacaatgagcactgagggtcttcccaggttatttgctgttagttaaatctatagctgtcacagtggttagtccagtagcctttgactttgtgaaatgttaggtggcctatgatagtaaattggttttccacttctattagatataatacttttttgggaaagagtgatgattgtcagttctgccactgccattgaggtctttcctatgtggaattctatcactgtaacttctgtttaggctttccctttggtccctgctttccctccagaaatattattgaatatatctttggcactaggtactatacaggagaccagggtatccactattgaacaagttttaaaaatcccctactcttgtaaagcttacatttcagtgggagacataggcaataaataaacagctaaatatatagtacatcagatgttgataagtgatatgaagaaaaacaaagcaggaaaaagggataggaatttgaggtatgtggtgggggtgtgttattttaagatagactggttagagaaggacataattctctgtattatggtcatactgactaaaggtgaactgaagtaggtacgagaacagatattcagggaagagtatcacaggtaaaggaaacaggaagtgcaaagtatggttagggaagctgaagaattaaggggagcagtgcagagaggtatcaggaatagatcatttagcccttttgggctattgtaagggctttggcttttattctgaatgagtatggaagtcactggaagattttgagtagaaaagtgacatggtctgacttaaattttaagtgcatcaattctggctgctcttttgagaatagattgaacagtggaagggcagaagcatggagaccagttaggaaattactgtagtgatacatagaagggaaaatggtaacgtggaccaggatggaagcagcaggaactggtacgaagtaatcagattatgtatgtattttgaaggctgagctctcaagattttctgatgtattgaatatgaggggtgggttggggaggtg

SEQ ID NO: 97984 - DNA, 1763 bp, Homo sapiens
gctattaaaaggtccatactggtgaggcacagtggctcatgtctgtaatggcagcagttcgggaggctgaggcaggaggattgcttgtgctcaggagttggagaccagcctgagcaacatagtgaggctctgtctctacaaaaaactttttaaaaaactagcgaggtgtggtagtgcactcctgttgtcctagctactctggaggctgaggtgggaggatgcttgagcacgggaagtcgaggctgcagtgagctgagatcactccactgcactgcagcctgggcaacagagtgagaccctgtcttaaaaaatatgtctgtgtccatactataaccctttgatacttttttaaacaagttcattttgagtggataaatttgaaagaagggggatcttcagtaaattacatcataattctggaatataaatgcattttgcagcatccagctctacatttgttattattctaattagtaatttagtaacttctgaccactttttttttttcctgcaattgagttttagactttttttttttttttaaatgagacagtcttgatctgtcacccaggctagagtgcagtggcgtgatcttggctcactgtaacctccgcctcccaggttcaagtgattctcatgcctcagcctaccaagtagctgagattgtgggtgtgcaccatcatgcctggctaatttttttgtattttcagtatagacgggtttcactctgttggccaggctggtctccaactcctggcctcaggtgatccgcctgcttcagcctcccaaagtgctgggattacaagaatgagtcaccatgtatggccaattttagactcgataaactttaatgttaaagagtcaattagaattgcaactatttagttctgggttgcaaaaactgaaaatttttaaaggaaaatttcagtttcattatatgctatatttattaatatggctggaattgaaatctaagacttcactatattttaatctaaatgtcatttttcttccatacaggagaaaaggcctcggagtaaacttcccagagctctgagaggtctcatgggtgaagccaacattcgttttgctcgaggagaacgtgaagaggcgatattgatgtgcatggaaatcataagacaaggtgttttctgtggggactttgttaataatagcagtttaatagtctgacttaaaacaaatgggggagcacttcacagtactatttggaaaatatgttcagaagcttaagggtgattgtggtaatggtaattgccacttttcacaagaaaatgaaaatctcagagtatgagtcaatgagatgtcattaatatttgttgaatttcactgttactttttttttctaatgtttcagttgagagatttagacttttgaattgtcagtatggcaaatatattatgttaaagccacttgaagagctttcttttttccttttcttttctagatcatgcagtactagattatgttactctatttttttggtaaaagacagtttaaacttgtcatcttatctctcagttaaatggtgtatcttggacatattaaatgatatcttcagtgtgatttttttttaactaattacttatatttattgttttgtttccttgatgttttgccaaattatgctctgcagagtggtttggatagctgtaatacagtgaacttttatcttttcaatagtttggcatttctttttggttagactagggtccttttagaagtcttattataatttcctgga

SEQ ID NO: 97985 - DNA, 1053 bp, Homo sapiens
aatttcccctaggttgcacagctagtgatagatggagatgaagtttggaaccaggcagcttggctctagagccctcacttttaaccactatcgtataccaccagggctccgtactgctaggcttgtttagttcttaggtctatgtcttataattcttctattttttttcttctgtattattgtgtgtgcttctgatttttcagttaattttgcctgtaaatctggatgaggcctaaaggatgagtcagctgttcctatataataaaatacatggctttgtgataactttcttctttggtttggtttttgagggtgttcatttgctattttttactttcaaatttggtgttactggggtaaaaatttatacttagaaaatacttgtttttcactgagaattctgcagcttccccacccctcccccatcaatgtctcttttctcaggagaaacatcagatggagtgaggaagtcagttcacaaggtctttgcttccatgcttggagagaatgaagatgatgaggaggaagaggaagaagaggaggaggaggaggaggaggaagaaacacctgagcaacccactgcgggcgatgtatttgtattggagatggttctcaatcgtgaaaccaagaaaatgatgaaagtaaatttttacttattttggtatttataaacaatgaagaaagtgacatagtaattgaagtctgtaagttatacctgggaaacaattcaaactgtacgaaaggaaatactatgacacaactattgttatttgtttattatgtttcctattagataatgtttatgtaaaaccttaattatagccgggcatggtggtgtgcctgtagcccagctgctccggaggctgaggtaggatcagctgagcctggggaagtcaaggctgcagcacttcagcctaggtgtcagaacaagaccctgtctcaaaaaattaaatacagtacaacacaataaataaataaagtcaaagcaaagtggctcatttaaaccaattgggccatttattttttaaaaaatgctagaaaggtagaatctaa

SEQ ID NO: 97986 - DNA, 1966 bp, Homo sapiens
atagaggacaacctatgtgttatgctgagatagactcagtaatcatttgtttgcaaattgattatttttttctcatccatccagaaagtacagtgcataacaacaacacttaacaagtgcagaggaacctgtcctgtagtatataataaaaaatgattgtcaccttgctgatctttccatttaaacatgcatgatctccagtactttgtacaatgtatagtatattaaatacatttatgtgtaattttgtgtgtatttttatatggtataattaaaattattacatttatgtgattgtaattcacaaaaagtactacttactatattctgtagagtgtgttgtgaatgtttttacctgtgtttgagcattatggtgtaggtttaatagatgaatatttgccttcagtctctgctcaggtattaatgtgtagtaatttttggtgctttctttttaatctgtgataatctggtgttctgaatgttcaaaaataaatttggttgaatacgcacatggtaaaaagattgcttaccaattgacatactctctataataccatcttggtaaaaactctttaaaaaggatttattggccgggcgtggtggtttatgcctgtaatcccagcactttgggaggccaaggcgggcagatcacgaggtcaggagattgagaccatcccggctaacacggtgaaaccccgtctctactaaaaaaaaaaaaaaaaaaaaaaaaaaaaaaattagccaggcatggtagcgggtgcctgtagtcccagctacacaggaggctgaggcggggtaatggcgtgaacctgggaggcagagcttgcagtgagccaagatcatgccactgcactccagcctgggcaacagagcgagactcctcaaaaaaaaaaaaaaaaaaggatttatttacatatctaccatttcagaaattagaatgcataagcctgggacatgacacatcacaggtaaacattgaagcaagacaaattcttgtattttcccactttgtattttgtagttttccacacacatgcatttgtatgaacatttcatggttcacattctgttttaaagaattgtagatatttttctcccagagactatgcttttcacatttcttttttctttttttttttttttggagacggagtctggctctgtctcccaggctggagtgctggagtgtagtggcgcgatctcagctcactgcaagctccgcctcccgggttcacgccattctcctgcctcagcctcccaagtagctgggactacaggtgcccgccaccaggcccagctaattttttgtattttttttttttagtagagacggggtttcactgtgttagccaggatggtctcgatctcctgaccttgtgatccgcctgcctcggcctcccagagtgctgggattacaggcatgagccactgcgcctggcgcttttcacatttcttatgctaacttgatatatttctgacgtgagaaaaaattttaaatggtccattttcaaggcatgataaatctaagtactggcagccagcctgcaaatgtaacaaaccacatggctcatgcaccaaaaggccacgataagtgaacagaatgtagaggaggggtcagcccataaaagggaagaaagttttgttattgggaaatcaaaagttaagtggggaaggggacgggttataaccttataagggggataatgaaactcaggcgatgtctgggaagattgtaaccccatagtactccgccagtgaggaactggggaagggacttgtgtgctaggagataaattatctcttgtgactgccccaggtgtgcctgcccaccggacgcccaatcttgcaagaccattattaaaagtctcactttcgctgttctttgtccctctaagtccattctttgggtttggacaggtgagcatgtctctcacaacctggggacccatccggggtctctatgcct

SEQ ID NO: 97987 - DNA, 1770 bp, Homo sapiens
ttgccaccaaaggtaaatgaaactgtaaaatacctctggatatttgtgccaatgaacttttcttagcatattaggattaaagcaaaaataatcttttcagtatgtttcatctaggacttacaataaatgtttaaaccatgaaaacttatatttcataccctaatttttctttgaaaatattcaagatttgtagcctagtgtgttctattttgtgtgattgcttgaatgttttctgattttattgggtaaaagtttgcctagtaatgatctttcagcaattcattgaaataattatttgaagtaatcttgcttcagatttaatttgtgatgtacattgttgtacaagccattttagtacaggtgtctcatttatgtagttgaaaggtgactgtggaatttcttttgttttttatgtatttccattcagtctctttatatagtcacatgtttcacaggggaacttgtccactggaacctaacatagtacaaccttttaatatgcgtatcttaaaggaaaatattataaaacaagatattaatactaaagtgttaacattaatatgttgttctcatggaagaaaagtagaaaatgtgataggcttagaaattattttttatcagcattaagtgcttcaatttctccccataaagattctaaggaaatttcagttcctcatattatagttttccccataatttaatattactaagtatttctctgcccagtaatgttgatgcagtttgcataaatagccttggaagtaaggaggcaggacagaaagccaaatatcgaaatctctggccttgatttagtgacagtttattctaatggggaccataggtgttattagtaaaaagatagtgtacaaggcctaagttcagtttacattgttctttgaaatgagttcatcttttgtgttgaataattgtattctaagtaggagatgcctgtatttaacataatcatgctttctatataatcaaatatgtatttgttggaatactggtagaaataaccttcccttcctccactgtgcagtggaaaaaaaactcccgatttatactgtatataaattaggaaattatgttacatatttacatttttaaaaatataaaaatgacatattattttgaagtgattgtattatagtttctgaagcttatgactggctataaatataacaacatacccatgagaaaccagaccaaaattgaatatatatcatcactgtgaccttgaacttatagtcatttgggataaaacagagtgtgccttgaaatgataaagagtgccctgcaattttataactgtacattttattatgggtggtcctctcaaattggccccaaatccttgtcttcgaggttggtgaaataaaagtttaaaataaaagttgactggtatttcctttagtatttccagaactattgctgtagaggcctcccttaattttcagagttctcattttgaattaaagtagacttacgctacatagatgtagaaaattaggtttggcttaggtttctgaaaaaatattctaggagaaggtggtagcattgttctgaacttaccacacttggaaaaactaatcttcaaatgtaattttttgtcttattaatgagtaatctgtcaaagacatgaattctttgacttgtgctcattctttctgaacttattgaggcttatatatatcaaataaggttaatttacacaataattatttttaataattaataaactcattcatgtagtatattttaaaacattat

SEQ ID NO: 97988 - DNA, 1086 bp, Homo sapiens
aataaaaggtggtaaaattcagttttcagtttagttcttgaaagctctgggaaatggaggaaacacaaaactatgaattaaactagggctgttgatttctgaacccccagataaatcagttgacccacattttcattttaggtgttaggtccaaattagcataatgtcttgcattattattaggttcagtgtgaaactttacagtgctgcatttgaagtttagtaactggttattattaatcatttgggaaaaatgaaaatgtgttgggactttctatgactaggcatttgttgattatttttcatgattgctttttgttttctcattgtgtaggatttgtgaacttgtatattacaggaaacaagatactttgtaaaatttactggggaaaatccatttggagtgcatgacatttgccaggataagaaagcagtaatatgtttgtattataaaattacaccctgccagaaaactttctttcctagtaaggtaaatgtagaagggacttttacagcatagtaagttgattaggagccaaaattttattccagtttttttttgaactaagaatgttttaaattctgtaatgaacttttatgtttacccattactcatgcattctttcacaatatgtttaatagcctgaggaaataggaaagctgtgaagctactaccattctttacttttaataagaataataggaaagaaaagtcaggtcagtaatccaaatccaaatatgtatactgcaaatgctcaagaagtcacattttttgataaattgtattgagtacagaagaacttatatgaatttattatctgttaataacttagttttgacaacagaataacatttggaaattgtgagaataatcaagctgtttttccattaacagtgtaaattcataacatgtccttcaaaaggtgatattctaagctgtcttaattgtctacggttgataacttttaaataaagtacaggactttctgaaagtgtttggcatgttatgctgccaaaaacaatctgtgttttgaaataccaattaatcagttaatttctgaagactttgtataggacttgatatat

SEQ ID NO: 97989 - DNA, 2819 bp, Homo sapiens
gagactccatctcaaaaataaaaaaagaaattatgaataggtaaattcatatcattaaaaattcatttaaattcacttagaatatttatctttccaaaactgtataaaagattgatataattttggctcacaatgtagttcacataagtaatgtatatttctctgtctctttacagtaaattgttgaagactacttcacaatttccacttcctctggctgttggtgtgattgcttttgggtcagcacatttatataggcttccatgctttgtcttcattcctcttttactccatgcattatgcaactttatgtaagattggacttaaggaatgatgaagataatttatgtgtttagggccagtgataagagggaacacacagatccatcagtatggacagcaagatcctttggagaagacaagtctatttttacaatattgaaaataggaaattagttttgtaatgtttgagggaagtagttgaagcatggttttgttttgtggtgtggaatccatgtagtaatcatttttgaaaaattcatgaagggatatatggtgatcactatcattgaggactcctgtgcatataaaatagtctgttttatcaactgtacgagaagtctgatatgagagatttagtagatgcagcattatttgcagtctcactgcaagcattctgctcatttcatcaaactttttttcacaaaagtaggttattttgaatttgctatagtttacctattaagaaataagtctttaaataactgatgaaatttatagctgtttggtttctcaaaggttaaatagccacagaaagcctttggttagtttttggcagccaccatgaacaaagtggatcttgtcttcttacatctatgaaaatagagctttgaatggtaaggagatatgttttcttggtaaccaatgcaagattgatgggtggaaacatgattcaaacttacacaatttttcttgctatttttcaaatatgaatcttactatatattctcggtgaacatcaggagactattaaagaggtctgctgttaaatgtaaagaaaaaatgctcgtagctatttgcttcctggtattggagcagttcagttgtttagtttataccattggattcaattcattgcaccatggttgccaaaagtgcctgaggtcataatggattgttaaaataactaaattccagtggttggaaactctaggtttgtaccattttttctgctgtgggaaaaaacaacaacaacaacatgatcaaggtaacatcacatttgatgtataatattatactattaatggaatatcagtagacaactgttaacccattagtagcatgagtataaacagtacacctgaataaattggagacattagccactaggtttaacagtggaatcttgatttgcctaggtgacttctgggattactgtttgacaaataagagtaacattttatttcatttcagaatttacgtcacttttagctacaagagtaggaagaaggtaatcggcaaggcagaagagtatactctttgccttaggatagcgtaaactcaggctgagacatacccggcttatagagttcttctagatgtgtagactgtaaatgcccaaatcctctcaactaaagttttagtgattccacaaagcctctcatgtaaatttccagtgattccaccattgcacttgtgaatatgtatccttgttagtacccagggatgtcctcgagcaccagttttattttatctgccattgcatctggattccattacagcctctcagctgttactgcctgtggacagttacttctgcttactgcctgtagagagttacctaacttctcttctcagttcttcctcaggtcctggctattttggcctcagttgaagggagtcttgctctcatctctgagggttttaagtttgtttgatcccattgttgtcttttctagctttgagcatgtttttcagtattcatattttaacttactgagaacattaaagggaaatgataaactcgtggtggggatatggcagacaggtgcttgtttgtttgagagaagtagcagaagagataaaatacaaagtgctatatgtttcagctggagaggaaagagagagaatttattagattatatacttgtcccatggcataccacgtatatgtttaaatagggacacatctccctatgtttaactatacttataaacaactttgatacacattgcgtcttttattctgtcacctgatattttagtgtatctcaagttacagattacatgtgtccttaaactatttctgaatttggacttagttccatatacagaaagaactttagaaaattcattaatttggatcttctattgatagccataaatattatgtttatgtattctaaaacctctttgtttagttagtactgttcatgaatgtaacaagcttcaatttctcatttgtgagtagtacatttgctttttgtttgtttgtttgtttgtttttgagatggagtctcacgctgtcaccaggctggagtgcagtggcgcgatttcagctcactgcaacctccacctcccaggtgcaagtgatgcccctgcctcagcctcccgagtagctgggactacagacacccgccaccacacctggctaatttttgtatttttagtagagacggggtttcaccatgttggctaggctggtctcaaactcttgacctcgtgatttgcccgcctctgcctccccaaagtgctgggattacaggcgtgagccaccacgcccagccgtacatttactttttaaagcagcagactaggta

SEQ ID NO: 97990 - DNA, 1027 bp, Homo sapiens
tttttgttcatttgtttgttgcttttgtttgttttttaatccatgatagccagcatgtgtagttgttgttttgtataagaatgtttttaaatgtttaaatgactttttggtttacattttaaacatttcagattacagtgcttctcatttttaataccaaaaggcttatatgttttgtttcaaaataaaagtaaaattaaagagcaatttatttttcttaggttgttcatctgcaagccagcttaacaacttttaagaatagccagcctgtggtaagttttattttcaaaactctacataaatttaaaatgaaagaacatggggaaatataagagtttttttttttaaggttagtatttcatagtgcttaaaagatacagtattatgaatttaagtaaagtgaacctaatgaatattttaaaagacttataagttcatcttttgtcagtacccatgtcatttttttacaagtttattgtctattaaattttattttgaataattacttagatatattcttagcagtagaactagcaagtcaaaagaataaaggttttataacaattttaaagtatttttaagcaaagtaatttcaggattttatgtcagtttggtaatggaaagatgtacttatttagttgataagtaatgagtatgattctaaataaagtaatatacttttgtttagtgtcttgatatttctactttattgttttatagaatcccaaacactctagaagaagtgaaaagaaatccaatcatcataaagactcctcaatacaccatcttcgtttatctgccaacgatgctgaagatagccttcgcatgcacagtactgtgattaacttactaacatggattgtattactcagcatgccttctctaatttattggctaaagaatcttaggtgcgttttattgatataattattgtttatgtggttcaaacaataaatatccctaagtagagacttgctagattcctaatggttaatgaaaattcctcaggaacaggaagctatacatt

SEQ ID NO: 97991 - DNA, 1006 bp, Homo sapiens
ttttttccatcattacaactaacttggctttctaaaaaaaaaaaaaaaaagaacatattactttctactagtatcaatatagattagtaaagctatactgaaatgcagatcttcaaagatcagtaggctcacttggaaaataaatgacttgttccatacaaagaattaaaaatttgtttttcagtataattataaattaagtatcatggaactttagagactctcttgaatagtcagacacctcaaatattaagtccttaaatttcagttgttgggttttttgcttttatattttcttttctccacaggtataaatggtttaaagaattgtgggatgtattattgttaccagaattagatgccgtcattttaacttgtcagagtatgtgtttccccctgatatccttgattctctttctgtttggaacgtgtactgcctactggagtggcctactgtcttctgcatctgtgagacttctttcttcattgtggctagctttgaaaaggtaaagaatgaatgattaacagctttcttattgctttaagaagaaatatatattctgataaggaacctgaaattaattatttttactaaactattttctaaggaaaaatatataactagcgaaagtatgggttagtgttcaaagttatgtctgtgaaagctaatcatttattaagagttaaatgttacatttgattttgaccttagcgctcaagagttaataagaaaagtttgacaaattacgcagatagttttacatttcgtggttgtgaatctttcccaggagggattgtttctcccataatattgcttttatatgctgacttctatattgaaaccagggggcaagagactgtaaaccagatattaggatcagattagatgagatatataaaagctccaaaaacattgcctagagttttattatgggcccaatgacacagtttgaatctgaagttactggtaggctttcctggtaaatcatcaatctagtgcccattg

SEQ ID NO: 97992 - DNA, 1050 bp, Homo sapiens
cctagctaacacggtgaaaccccgtctctactaaaaaaaaaaaaaaatacaaaaaaattagccaggcgtggtggcacgtgcctgtagtcccagctactcggaaggctgaggcaggagaatggcatgaacccgggaggcagaggttgccgtgagccaagatcgtgccactgcactccagcctggtgacagaatgagactctttataaaaaaaaaaaaaaaaaaaaaattattctgacactatgacatcaaccagaaccagacttaagtataaatgtctatcttgttttgaaagtctgaaaaaggtctcgtttttcttggtttcaactgacttgataattgattctcagacatatagaatgtacatctaggggatatttgatgctggttaatctagaggctttaagtactggattatgtatccagccaattaaatatgtagttctgaaccaaggatgcttatcaaaaatcacctgtggattatacccactagaacgactataattttaaaaagacaaataataagttttaatgaggatgtggaaaacctggaaccctcatacactgctggtaggagtgtaaaatagtgtcgctactgtgaaaaacagtctgacaattcctcaaatggctaaatacagagttattgcataactcagcatctgcattcctaggaatataaccaagaaaaatgaaagcatatattcatacaaaaacttatatgcaaatgttcataggagtattattcataacagccaaaaagcagaaacaacccaaatgtctgtcaattgatgaatggaaaaataaaatgtagtataatcatacaatggaataaaaggaatttgattaaaaagaaattaaatgaaatactggtatatgttacaacatggatgaatcttgaaaaaagtggaaggagaccatcacaaaagaccacatattatgattccatgtatgtgaagtgttcagaataggcctatctttagagaaggaaagtagattactggttgccaaaggatgggaatttggggggtaatagttaaaagaaaactttctttt

SEQ ID NO: 97993 - DNA, 1021 bp, Homo sapiens
gtaacatttagggtaacatgttgttaataatacattttttaaatgttttaacagaagaaataaccagtatctatagacttcatattccttggtcttatgaagattcactaaccattgcacagtaagtatttgaaagaatttactttaaactttggtgtttttgaataatagatattctgcttagtttatttatttaaatcatgaattattaaaatgcatcagtaaaatgtatgtatcctttatgtagcattgttcctataatttaatatatagtattcttatgaaatgatagagaacttaaactttacttccttggaacctgaacccccttccaccctctcgcaactcctgtgtcctagagggagcattcaaacaattgtgatatcattgaaaaagtgcccatccacaattatgtgtctggcacctagcttcctctacattattcagttgtattgtgctgaggattaacttagccatggctctttaccagcattttgtatttgagaattgatatttaagttatctcttcagggctccatcttccacagaaatttctctgaaactccatattgctcaaccagaaaacaatacccatgtggcattatttaaaatgtacacgtcatcagactgtcggtacgaggtaagttgtatgtttgattaatttttaagatttagttgtagaataagctagaaatgttctttttatataagcttcagatatatggtggcatggaagccaatgcatataaaaaataggcatttaaaatattttaaatattcttcatttttcctattaacaccaccttagcatctccatagctgggccatttgcaaatgtatacatcttaataagtaatagaagataaagcaaaaaaatgagactgtagattaaccttctaaatttggaagccccaagtccagaatcttttttataaattgaagaacatcatgaggtcagctgacatgggcttactgcagtaactgacatgatacttaatggtgtatagctctactggttgtt

SEQ ID NO: 97994 - DNA, 1048 bp, Homo sapiens
atacattttataaattttattcatattaatatctcaataaaagtaatgtcagatgagaattatatcattgttaggcatttctgtggactgaacttttaataaatagatggagccctccatcaaagcacgtataaattcaacacttggccattgttgagaataaatacttaaaagccattagagtggatagctgcacagattatccaagttcttcctaattaatgtttcatattagctaccatttgtctggtgggtcttagctgcctgtagctgtggcttatgtggcccttttaaggctctttaatttacattagaacatatgagtctgtcacagggactttgctaagtcggggtgaagcccaggagtttatgtttgataaacatcccacatgaatctggtcagattgttagaaggctactcattaatggttctttagcttgagcatctctgtcctccttgcccacattggtgcttctcaagaagattggggaaagctaagtgtctttagaaatgtttagtgcaaacatattgttagaacatataactactcccaccccacacatacttccagaacaaaactcgattaaaaactgtatttgggtgattcatcacataaatagaactaaagacaaaagccacatcattatctcaatagatgcagaaaaggcttttgataaaattcaacacccattcatgttaaaaactctcagtagactaggtattgaaggaacatatctcaaagtaataagagccatctaatgacaaacccacagccaacatcatactgaatgggcaaaagctggaagcattccccttgaaaaccagcacaagacaaggatgccctctctcaccgctcctattcagcatagtactggaagacctggccagggcaatcaggcaagagaaagaaataaggggcatccaaataggaagagaggaagtcaaattatctttgtttgcaaatgacatgatcctatatctagaacactccatcgtctcagcccaaaagctccttaagctgataagcaacttcagcaaattatcatg

SEQ ID NO: 97995 - DNA, 1081 bp, Homo sapiens
tgttttctttgacgttcagtttgtttacatcaggatccaaacaaggcctatacgttgttattgattaatgtcttattcctttttaatctggaagactttctcttaccaccactctccccttttttttcttgaaacttatttgttgaaaaaaataccaagtcatttgtcctctagagtttcacagtcttgattttactgattgcattcctgtagtcattcaacatgttcctttgcctgttgtggtcctgtgatttagtagctggatctagctgctttttcatattcagatttttgttttgtttttgtttttgctagactttctctctttttgtgatgttagccactgttgatgaggaatgcctggagttattaattgattaaggaggatgcaaaaattatgatgtttaattttattatttattaactagaatagtattctagttaattctatatacttacagaaaaactgcttatctactaaatttatcaaaagtagaataaatcatatgggaaaagagtgataattgtgtggatctttggatcttaccttatatttactcattatcagaatggtgagttggctcacaagcttcctcttattagtgaccattagtgggtttattcctccagtattattatgcactcatgcatttaaatatgttttctttcagtctgttgatactaaaatcgttccatatttggtcagtgcaaaccatttcaagttaagttcctgagctttgttgatacagctctttagttgtctttaacagtttcctcactcttgagtaggacaagatattttagcttattttgtacatttcctgccccaaaccgtgaatcagctatttctttaaggaactattccttttctttgggaagtggtatctcaaaaccataatctggtactagaaatgcttgtgactattgggttggcatttctaggccttttcaatggccagagctaagaactgcataaaatcttaactagaagagcaaaaaacccacaataaaacaacaacaaaaaagtacattcacactgatacttccaggacaaactggggactacagagtttatacctaa

SEQ ID NO: 97996 - DNA, 1033 bp, Homo sapiens
ccatgaaactaacaccacaaatgtctacaactctagcatggtaaattcttatctttcgaagaatattagaattttctcttttagctatactgtgtgactcataaataagcatcatccttgtggaatgtagaaatgtgtttgcttatggatccaaagctagtaaaatttgtttttttttaattgatacctttagtaactcttagtatttatacttttatttaatcgggaagtaggaatatgtgtaaagatactgattttactgaaaatagggaaatgtgaataactcaactgtttatagatgaaatgacttaagcaaaaattcagttacatattaatattactgtatagatatcttattgtttcagggaatggctactgttttttaatgtctcttttttattccccaccagatttttatacgactgtaaacaactattggattctaaatgctcgacacataaatttaaccacactttctgtagctggaggattccgggattaccaagttcgttcaggattgacttttctaccaaaattaagccatcataccagtgccttatctgttgtggtaatctttttttaagattctattgaaatagtaatgtaatagacccagtggagcatgaaagaagaaataatatatagctgcatggtaatgactgctgagttagtggtgttggactgctgtgtgggcatgcatgtgtgtaagagagagagggaaagagagaaagagagaaaatgaatgaatgaatgaatatgaatgtgttgggagggcagaattgtggatgcttatgtccatagggagtaaaaaggatggccaggaaccatggcttatgcctataattctagtgctttgtgaggccaaggcaggaggactgcttgaggccaggagttcaagatcagcctaggcaacatagggagacccccaactctacaaaatacaaaaaatctttaaaattagccaggctaatttggcatggtggtaagtgcctatagtccgagctactcaggaggttgaggcaagagaatcact

SEQ ID NO: 97997 - DNA, 1100 bp, Homo sapiens
ctacatggttcaaaatatacacaattcaagactgattctctatatgaataaactacaagtagaacttgttttgtgtatgaagtgtggttttaatatcagtaatatttttatattgcactatttcaaatttgcgtaattcagaattgcatatggtgaggctgaattgtattaataaaactgattaaagtgaaactacttttttttaaatgtagaaaatagaacttccaaagaaactggcaaaacgctatcccgcatatgagttgtatctttatggagagggatcctatgctgaagaacacaaaattctccctttgacgggtattccagttctctttcttcctggtaatgctggaagttataagcaaggtaagtcttactggaagtaaattttgaaagctataaaattcaactcaagaatttgaatcatatccatactcggtgaatcaaataaagtaaatgaaatgcatgctgtgtgtgaagtgctgtgctgggcttacagagagaccaaaatataatattttctctgagagagaataatgtgagaaatacttagaaaagttgaagaccactttgcaaagagaggggtacaaagaataagatagagtaggatgggataagtagatgataaaggggaaccccttggggaatcagcagaggaaacacatttatgttggaaatggagggtaaagagaacagaaccttaagcattgattagggaagtaaatcagtgactaatgttatgcagaacaagagagattcgttttcttcttttggagttatttaagttagagagatttggaagtactggggggaacatagaaaggtgagatagggaagttacgtgtacagattccaaattgatgctggcttggagatacagcagttatttctggcgtaacagccaaataacctggaattaatttcgttttaaactaaaacctgctttcttgttatttgatggactagaattgttatgtaatgagactagaattgtttcaacatgtgcaattatttacgtgtttattcatctagcacgtgtctacaggtatctaccatgagccaggctgtattccaggtattagggatccagagcatatcaa

SEQ ID NO: 97998 - DNA, 1002 bp, Homo sapiens
gaagtaaactatcacatcattttcatttttgattgtattctgtgcacaatcagtattgggactaatttgaattgaagtacatataccaaatataaaacgaatagtggggttagtatttctgtattttgagtatttggggagataactaagattgctagtatcttaataagcttacagtctctgcagatgtttctgtggtgttattggcataaattgtttacaaagggatatttaggaaggtgcacaaatgatcagaattttgttgttttgtgtgtgtgtgttttttttttttttagaacaacgagggttttcattagtcattagcaacatttacaggttttgaaattcactccatagttaaattcttttatcaagcacatgccacatgtacagcactgctagatctatgtatacctaaatagacattaccgtccaatgtaattggtttcactcttaatggtttctctcctttaaaataaaaaaagaaaaggagcaaaagggtgtatgtatactttactaccacagatgtctacctttgaggatgacattaagagataatttatactaagctgaaaaaaatgtaggtgaactactgactcagtagttaggtgagctgctgtattattggtatacaataatatgaagtgcagggtagtttaaagtttgccagcaaatcatgcacctggcccatgaaaactgaaatagatactaattcactggaatgtttatggtaagaagagtgtacatgtcttgaccaagacatggctataaggttaagattaatttgttacacatattgtaggccaaagcatattaagttgagaagtcagaaagctgcattataaaacaacttactttcttttgaagatataacaactgaaatagatagttgggtctgagtaaaaggagagacattacaaaatagttaaaaatggaaaaaaagaattgatttgatgatggaaagcctttatcatttctaagtataattgatacttatccaat

SEQ ID NO: 97999 - DNA, 1033 bp, Homo sapiens
aaaaatacattttaaagcatgtcatgtgtaagttataagaaggtaggtaagggcgggatgaggtggctcacacctgtaatcctagcactttgggaggccaaggcgggcagatcacttgagcccaggagttcaagaccagcctggataacatggcgaaaccctgtctctgctaaaaaaaaaattcaaaaaattagccaagtgtgatggcatgtgctgcctgtagtcccagctactcaggagactgaggtaggaggatcacttgagcccgggaagtcgaagctacagtgagctgagattgtgccactgcactgcagcctgagcaacaagagtgggaccctgtctcaaaaaaaaaaaaaaaaaaaaaaaaagtaggtaagaataattagagccagattttaaaggatgtctctctcttaagctttgttgtgtgtgtgtgtgtgtgtgtgtgtgtgtgtgtgtgtgtctgtgtgtgtgtgtgttagcagtatgaactatggattatagaagggagacgaaggcaaggatagagacaagtctgaaaaattcagttgtccttaaggccttttttttttttttaatggagcccctataactattcttatgggggatggtgagcaaaggccttactgagacctctttgtgagaacttaaaaactatgtgaagttaaaaactatgtgtattcatctagatcaaaatcttttttctttttggttagttatggaaataaaactttatttttcagtttaagtttacaattaagtaatatcataaaatagatattttagtttcttaaatcagcatttttctattacctgggagtttattagaatttttaccttttgagtttatgtagagatgagaagaacctgaactaaggcagagtcaaggaaggaggacagcagaggcaggattgtggagataatatttaaatacaaaggtaattgatcttaatatggtagaggggttgctcatttaaaataaactacatagaataaaaaatttatattggagtcctgctcctgtaagtatttt

SEQ ID NO: 98000 - DNA, 1069 bp, Homo sapiens
ctctactaaatatgatttattgcttctgcaaatgataaagaagctatggaagatcactgtgctccatgacatcattttcagccttggttctgcacatttatttgcataaattacaaagacagggaaatacagttgttttattttctattaaggagtatctgggttgaaagtggttatcatggtgaattcattctgctgtgatagaaggtaacgcccatccactctggctcattgtttaaaggtgacatgaaattattataggtttaagtggttgtttcataaactcttgacggttttggaaaaagaattttaggataaatgatgaaaccatcactggagggtttaatcatgtaataatcattaaatttcttagtcatggaattaaaaatattccaccaagctctttaatctattgatttattagctttgaaaaaggaatcataggaactttagatccttacaatatgtcattactctagtatgttcaggtttttattagcggaatttagaccaggagctatcttttcatctggtcctgtactctgcagaaaatagctcttgctgaagataggccagtaattgatctcttccatcttaatgatgttttccctgtctttctagtaatgtggaatgtataaaactcttgcagagcagcggagcagatttccataaaaaggacaagtgtgggaggtatgtaatcagagagttgtgcttcaagtgcttaaataagaggaactgggagtggtctatgtagtaatcaagttaggttgaaatggtaaaccgggaagttagctggggggattccatcctcctcggaaggaagtcccttctcatagaggttgccaacaaagcaaataacaagtcacaaagaaagcatctccactcacagctgctgtttagatgtgccaattgtctcccttttttttttcagttaaaagacaaaacaaaactcctacatggatatagtttggaaaattctgtttctagcagagtggaacacataaatcctagtcttaagatctagaatattttattatatgtattgaacatttcatcttgggatgaattt

SEQ ID NO: 98001 - DNA, 1034 bp, Homo sapiens
tcaagtgggaatactgccaaaaagattcttccgtgcagtagatagttcccatttatccaggttaaggtggatctataccattatactaaatacaaattaaattttaaataaattaagtgccttttaatgacagaggcaaagaagaaccaattttattttttagcttcatccaaatgaggtctatttcagtggttttaattaaggaaacttgaactttattcgtaacttttctttctaatattcttctgtccttcccaatgcttcatattaaacaggaaaaataaaacctaactgagccaatttagaatgtattcagattgcttgctcagctttaatgatatggttatagagtacaattgagtcaatctgctatgtagggaagggggaacctgacttcattttgaacttcaattccacaaaaatacataaagcatctatgctgggtgctatgggagatttcagaagatgtaagttacctagtttcaaggcgctcataattttgttcagggcccaagacccacttaagtcaaagaaccatgcaagatcatatatcataaagttctaaatgaaacagacttaagtggcaaatgtttggtgtagacaatctgtgtcacagaatatagacagggaggagagagctcaaaggtggccagtgttttctgaaaaggcttcaaggagaagatgaattttagctaggctttaggggctgagaattatctgagtacagcagagggtggcaaccatcccaagcagggaggaaagcgggaacaaaagaggcaaagactccacaccagggaagagcttggcctgacagagtagagaatgtgatgatgctgtgcaccaccgaggggcaggacccagggtggttgggagcccaggctttggtgggtgctcccttgatgccaatccaagctgcttcccttgtgagctatgtgactttgagccccttgcctaattggaaatattgtagtaatactagtaatactagtacttatctgtaggtttgttatgaggattaagtgacttaattacta

SEQ ID NO: 98002 - DNA, 2000 bp, Homo sapiens
ttatggtttcatattaagagaaaacactggagcaaaatttaaagaaatagcaccacctagggacaagttaatgccaactccacaatttctgccttctctcgccttagttattttgaagtgtcatcactttttaattggaagggggtgttttaaatccttattccaaagtagttcccaggtgtttcagtccttggaactgtgtgcagtcccgacaactaaggcctagctctggaatcagataacttttaggagctctccttcccagtatgtctcatggtcagcgatggttttgtatctcattctcttgattgctccagtttttcctctaaaagtattatcaagcttcagctctcctttctcagtctgttctgattcagattatactcatagaagatggagaaaagatcctattatttcttttcttcccacatctacctgagaatattgaattataatgatacatgtttttttttttcaattaagatgaacttaccgttctaattaacttttttttcttggcacagactatgtgtaattccttttttatttctaaggaatagacttatagaatataataaaatgcttgtgttaaaaccttggttttataacctattttagcccacagtccaaagcaggggttaaaaatgggaccctcttaccccaattctgtagttcagggttaaggtacagaattcatatttctttttctttctttctttttttttcttttctttttttctttttttttttttttgagacggagtctcgctctgtcgcccaggctggagtgcagtggcacgatttcggctcactgcaaactccgcctcccgggttcacgccattctcctgcctcagcctcccaagcagctaggactacaggccccgccaccacacctggctaattttttgtatttttagtagagacggggtttcaccgtgctagccaagatgggctctatctcctgacctcttgatcctcccgcctcggcctcccaaagtgctgggattacaggcgtgagccactgcgcctggcccagaattcatatttctaacaagaatcctgggtgattcagacgtgggcagtccttggtccactctaagaaatacttacctaaattattatttgttttccaagatggagtttttaaaacagtcattttaaaatacaggcatttggatttcatcacaaaatgaacatgcatttttaaaacctcgtattttaatctcagacttagagaaatttttcctctgagacttataaaaataagtgttacatagatttttttgataacaatacttggatgaaaatacattctctctattggggatacttttattctaaaataacagtaatattttcttttgggcctattttcagaagaaattctgtaaattactatttcttagttacatatggtatcttggtatttagtataatgatgattggtatatagctgttgtacattttctgtgttttggcttaatctgtgtcaggaaatttcataatttcgatcatgaatagtaacaaatatatgaattcagcacacattcccagctggtcattcaaaaggcagtttcctaaacagttgcatgccttagtcctgtgacttctaatgagttaagtaaagtaagagattctcttttggaacaataaaaaattatggttttgtttttttctgtttttttctttttctttattcttttgtttaaattttttcttttttgttttattttattttaaaagtgattttttttttaaatggaattataatggagggaatagtagagggttccagatcagttttcttttcttttttttttttgagacagagtctcactctgtcacccaggctggagtgcagtggcacgatcttggctcactgcaacctccgcctcctggattcaagcaattctcccaccttagcatccccagtagctgggattacaggcatgcgccaccatgcctggctaatttttgtatttttggtagagatggggtt

SEQ ID NO: 98003 - DNA, 1056 bp, Homo sapiens
tcttggtagattcctgagaatttgcctttgtctaggcaacaatggactgactagataaccattaaatacataggggttcaaatatttagtgcagaagcattttgggttctcgaatagggactgtgtgatacaagtggtttctttgaaaattatccatgatctaagctcacacacttactggctcataaaagccagtttcagaggccagatgactttcgtgtttggtgccagtgtgctcccactggatccctatctgcctggttgcaaactcttggctctagtactgcctgatctctagcatactttgatccaccagaaagtccctccttgttccagttccaaaactctagctctgcaatatctcctctccttcccccaaagtggtgctgtggggtgtgtgtgtgtgtgtgtgtgtgagagagagagagactgagagagagagagaggctcagtgaagggaattcccgtgcatgagcttactgttgattactagcccttcatcaccggagtgttggtcacaaacctgaggagggcaaagtgattggagtcccgaggtgcttgtgttcctttggctctgttggtctggatctgtcgatcacctttcttggggcttctttgtgctgcgtcgtctcctgcttgctgccccccactattcctcttctctgagttatggtttataacctgctgcatctcctaatgaacacctggaacctccaagttgggaaaagaaggagcatctcatggtgcctggggcagcaggatggtgtggccctgacttggcccaagattcttgtgcccctcgaggtggtacccctgagaaatgtactcatgggattagcgtgatttcacagatggttaatttttttaagttagttaactaaagacattatttttccattgaaatgaacatggatatcttaaggcagcactagactgtaaaattcatgtgaatgttaagttaaaaacgtatttttcaggcagacatgtagggaaagacgttcactcttgtcttctgttacaggtactttggtggaagtacctggttgatcctggctc

SEQ ID NO: 98004 - DNA, 1041 bp, Homo sapiens
gataggtcattttgctagaacacggagatacatagctaaacagaaaattagcatcactgcttgagatgtagagtcagctctctttaaaagattgtcaaaccacagcctggcattagttagatttgatagggtagaaggtgaataatcgtaagctgagctgtctttgtaaatgttgtgatttttcccatcttccatttttctatctcccctgcaacagtttcaactggtagatgagttctgacacatgaaacacatggtattttgtaccaattctatcccaacatgtggttggtgaccataaatagacatgatattagcaaataatattaggaacactgtaaatggatgtttgggtgatcattcagaaagacaggaaggtaaacaaaaaatactgcctgctgcttatatactgaccagtctggaggctgatgacacattcttctttgctaaattaataagaaggtgggaagtggctttcttctattgccattgtattctgtgatgcacaaatttaactcaattttcccattacactatacgtagttgcttaatagagtcttgtccaagcatttaaaaaatcactgtaccttttgtgttgctgctgacatgagctattaagaaagttgaaactttagtagcagctgcttcctctgccagttatagctacctaagttgggttgaatttctttgtgctttgagatgggtctcccagttgtgaggagtatttggttttgatacttttgttttggatgacagcgatgagtgttcgctaacttttatccatatgtcatcttatgtttgcattcctgggtggaagaataatagttcaatgtctattcataatactatacgatttcttaactcccctgattggagcccacacatatgtcctatgtccttccttgctatggtttgaatgtttgaatgtttgtgtccccaccaaaattcatatgttgaaacttaatccccagtgtgatcatgttaggaggtggagcctttgggagtgattaggtcatgaaggctcaggcctcatgaatggga

SEQ ID NO: 98005 - DNA, 1049 bp, Homo sapiens
atttataaatgtttgtgaatgattaggaactacacagaactaggatgactatatcatttttatccgtttgagaatcataggtgatactactcaatatgaagccacaaatagacgtgagccaggactgtcctgggtaaacctggatatgtggtcatcatatattcacatagactccatgtttgctcaccacaggcttgacagtgacagtaaactagtttgactagcagactactctgtctcttttgagtcaggtctacagtggtgcaggtattacaaagattgttttatgaccttgtgcagagttgggaaacagcttccatgtcacacatgagttctgatcggtccaggacttgcaggtgtaatgtgatagaaacattctgactcttgcagtcaaggatccgagaaagtgtgattgattaccagtgtttgctatgggtacacgggaagggagaagtgacatatgttgtacattagccaacccttggcaagacatgttaacctctgtaggcttcaggtttctctttgtaaaatgaagaggttggactggatgcctttatggtgcctcagctctgccctctcccttctgtgacttggtgcctgtaatggagaccgatgctcttcacatggtttgtgttatagcatttcttacaaatgtgcctatgaagggtgtatttgcagatgagctctaataaggctttccaggtaacaaagtcaaacagcttcaagttccagagaaggattttaacccatgtcaatgacttaggactaattcctattctccaccctacttcaattcatagataatctaagattacccattttatttattctgtatttttatttttttgggacagagtctcgctctgtttcccaggctggagtatagtggtgcaatcttggctcattgcaacccccgccgaccccctcctggggttcaagtgattcttgagcctcagactcccgggtagctgggattacaggcttgcaccactacgcccagctaatttttgtatttttagtagagatgaggtttcaccatgtcggccagg

SEQ ID NO: 98006 - DNA, 4128 bp, Homo sapiens
acaaggtcaagagatcgagaccatcctggccaacatggtgaaaccctgtctctactaaaaatacaaaaattaggcaggcgtggtggcacacacctgtaattccagctactcaggaggctgaggcaggcgaattgcttgaacctgggaggcagaggttgcagtgagccaagatcacaccactgcactccagtctgggtgacagagtaagactccgtctcaaaaaaaaaaaaaaagttaattagaaaatatggcttaattgttgagccatagtgaatcttgagtaattaaagcaaaagtcctcaagtggaagctattctaaaggatatattagatatatgaaatgttagatgacttcacatctattcagtgcactgaattagtaatttagtttctaatgggccggtgaatatttcctgtaaaactaagactgtatctttaaggatttttccccctttcttataagaccgcatcttaaaggacttttttcccttccgttgtagagaccttgtacacagacagacggctagtgcagtggtacagcacatgtcacttggggtttatggatttggttgtgaagattcgctgaatcacttgttgaactatgtatggcccaatgtatttgagacatctcctcatgtaattcaggcagttatgggagccctagagggcctgagagttgctattggaccatgtagaatgttgcaatattgtttacaggtaagttaaagattttttttttaatcggtgattttttttttttaaataatactttaagttctgggatacttgtgctgaacgtgcaggtttgttacataggtatatatgtgccatggtggtttgctgcacctatcaacctgtcatctaggttttaagccctgcatgcattaggtatttgtcctaatgctctccctcccctttccccccactgcctgtaagttaaagatttttaaaagattacttagcaagaaaagtagtgtattgaattaagttacttttcctgattatcattagggtatattgtgccatatggtagaacaattgtgtggtgacaggggagtgagttttgtctcttccattgcagcttaagagcagtgtaattagtaggttcccccccccccaactccccaagggaaataattttgaatcatatctttatgttttcttaattttgttaaggttatgtatgttcttaaaaattgaaataatgtaaccgttcaattattttagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaatttgtgtgtgttttttgaacatgacttgtaaaatgcggaactttgataaagtattggtttatgtggaataagtggcttaatttcattttctgtcacatggtttatagaaagtagttagctgaataaaaactatataaagtgatggcatctttgtcaaaattccattgttgtgttaataatgacagcaagaagagtagcctcaggggatgttcccctcaaactagcacaaccattccatcatcgtagaaaagtagcacttttgctaaactgtcttgaatattttgtacttacatagcgcctttcatctcttgatttctcaaaatgctttatgaacacatttaaagaaagtggtttaagtcttgtccaacacttgacaggtctgctgtgtttagcaagtgaggaatttaactttacttcaaaactgctttctgcctattaggagtgaggatacctaagtaatgctgatagaacaggacaatgttgggcttttctccatgttataagccactactcagcaatgcatcagtaaatacctattcacccactgtatgccagccactgtgcttatatgcaggggatgcaaaggtgcatgagacctgccctctacctttaagaacagtataatggagaaggggagacaaaccttgtgacagattccttatgtactgtgataatacacagtggcagcagctaaaatgtctaggtttgcttagctttgtattcagtaataataagttgatctaagagttcagcataaactgaatgaaatgccatttaatggtagaggaaccaagcattaaggcagtactacacttaattttttaagcaaatatgtaaagtatattttcaaacttttctaatgttatggccccaaatttcttagttttggcctttttactacctatactatttttactgttttgttttgtctccatgtggtagtacttctgtgaactctaaagggaaaaaaaattctgcaagcagcattagtatataactactactgtaagtaaaactgcctattgacactttaggagttcctgcttcagaagcttagttaagaaacagcttgtggccgggtgtggtggctcatgcctgtaatcccagcactttgggaggctgaggcgggcggatcacgaggtcaggagatcgagaccatcctggctaacgcggtgaagtcccgtctactaaaaatacaaaaattagccaggcgtggtggcgggcgcctgtagtcccagctactagggaggctgaggcaggagaatggcttgaacccgggaggcggagcttgcagtgagccgagatagcgctgctacactccagcctgggcgacagagactccgtctcaaaaaaaaaaaaaaaattgactttcaacaaattgatagtgagcattaagggtttccaagttggatttgtaactcctcatcattccttgtatgacaactttctgaatatatgtcactatgtagtaaaattaaacactccaaactcatctttctgttgttagaagttttcagcggtacttccatgcaactttaaatctcactgctctctatggttgatgtcaaatgaccttcagtaatgactgagaattgaatacaaatagattacaaagccaaaatttgatgttaaatgactcaggaaattttagttgtattttcaattcaagtacttagtagcctacgtttgcttggcctctggttctttatggaaaataggctttgtagtggcattgtggagcaaaggagactgttacaccttaattaactttttttactgatgcaaataatttgaggatagagaggagggaagtagtgaaagctatgacctaaaacattgggaccaaatagaggctcacagatatttggattattttatgtgcttattattaaataaggaaagcattttgtgatatgtggaagacgctatgtgaagttttacctatcttctcaaagaccttttcttttgtattttcttttggtgtttcttaaagccaaacaaagaaatgttcttaaggagacagggtgggtttttctgtgggcctttgttggtttttctgtgggccatcgccctctaatggaattgatctctggctgtttgatttttttcatattgtatttttaaaatttgttgtacagtgccctgtgagcaccaagtaccactagatgaataaaacgtattatatctaaagtcttagtagaccaatttttaatcttagttgactctgtattgttatcacactgcactctgttgtggttgtgccatttttgcaaaattgagctctttcggttgttttcgaaataagggaacttagtgttgaaaaaccagagaactttttctttaataagaaactaaaaaagttgcagccacataggttcagtttggctctttggtttccagtggctctcaaatc

SEQ ID NO: 98007 - DNA, 2864 bp, Homo sapiens
gatagtttattgacttctattaaataggtatgcataagatgactccaccaattaaagatctgctgcctagactcacccccatcttaaagaacagacatgaaaaagtacaagagaattgtattgatcttgttggtcgtattgctgacaggtaagcagattacccacacatttttataagcagtatcaattttcaaatttggccactttgtattcaattagcaaaatttccttaatgtcactaatataagtgtaaaagattaggctatccagtattaatattttcagtcaaatttcaatttggatggtaatgggggtggcaatgtaattttaggactaaacctgtaagactaactcttcagcctttctgaagagtagtaagttttatttaatgcttaaaatgagttaatcatgtttttagaactgaatttgcaaatttatccttaaaacttttcttaatgtcacaataattaatatgtgtattttttaaattaggggagctgaatatgtatctgcaagagagtggatgaggatttgctttgagcttttagagctcttaaaagcccacaaaaaggctattcgtagagccacagtcaacacatttggttatattgcaaaggccattgggtgagtgttatttacttccattaaaaaaaaattactttataataaatgcattgtggtattggaaaatacttccatgtagaaatctcttttgaggcatggtctgaataatgcagttgagaaagctcttcatttaaccactgaccttctgattattggaatgtattgttaaattctttttttttttttttgagacggagtctcgctctgtcaccctggctggaatgcagtgattcaatctcggctcactgcaaccaccgcctcccaggtgcaggcgattctcctgcctcagcctccccagtagctgggactacaggcatgcaccatcacgcctaggtaatttttgtattttttagtagagatgaggtttcaccatgtgggccaggctgttctcgaactcctggcctcaagtgagccacctatcttggcctccaaaagtgctgagattacaggcgtgagccactgcgcacagcctgtagtcttaaattcttaattaaaatagatggaagggtttaagacttactttaattacactttaggtgttttcagggagggaaacagtaccattttcagaaaaatttaaaatgtgtgctggtcttctaggatattgcttaaactattaaggcaagtttttagtctcacaacatcatttaagtctcatattaatgctttatatgttttaaaaatcttattatggattgtttgagcccaggagttcaaggttacagtgagctgtgattgtgccactgcactccaacctgggcatctgggcacctgggcgacagggcgagaccctgtctctaaaaaaaacaacaaaaatgctattctaacattactccacggatttaactgaattatagctgctttgtgagataatctgtggtggtttgcttccactccatcacaactaaaataggaaaaaacagtcattgtagaaaacgagacaccacatgtccatgtggcttaagaaaatgttttcaaggaatatgacatgtgaatgtctgattaattaggtagaattataccagacaacaccccctcccctaacacatactcattcctctcctattttggtagcataatatttatttcagtggtgatggagtcaagacatttgcaagaatagcttttgtgcaagcttttagccccaatgtccctctaagtttatgtcaaagaagaggcaaatagatgcagcaaattgtgtggaggaaagataaaaggaaaagagattttatatggtttataatgggagactacaattcggatattcccctcaccactcctacctagttctagtgcccattttgacaactcagagaattactcactttaaacatttagttaaatttctttatatttcagaaagtttaagaactgaaaattacatttgaaaattgagttaacttaaaatgtttagaatttgtacagctatgacctctgatcttctcagagtcaacttttttaaactgaccttttaatttatatgaaatttttatatagaaacaacaatgccagtgacttgaaagtattgcattttataaaattactgagttccctgtaattattaatacttaaaagttttcatctttatgcatttttttcttccataaatttttgacttataatgtaacagcttgttgacccatttgtttttttcagccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggataggtaagtgacttgaactaaatacaagaaaataattataactcttccttcattttagaacatcgtgaaatagttattagatgactttttactgtaacatagttaaagaaaaaattgctagcctggagtcttaggacattgtaaatatgacttattattttaaaataatgtgcacgctgtagtgattccccagactttctttcaagttctcccatcccctttaaatctcttttcttatctattgaattaaataaattttgaaaagggttgattgataatcttttgttttcaaaattggtcaaatatagttagag

SEQ ID NO: 98008 - DNA, 1874 bp, Homo sapiens
caggatggctttggatagaagaaattaccgacaggtaagcttttattgtaaaagaatattctcaaaagtcctttcaactcattctttagtcaacttgaatgcatgttgtatattattttttgccttgattatctcacagtttatatgtgcttgattatgaaaggagatggattttagtcagccagttaacttccattttgattttggattcgaggattaatacttaactgtgaattgatgtttttgtctggtacattcagtgctttatctggctagatgaaacatggacacagttttaccttgaatcatgttaacttatactcatttttcgatgtttggtcacttttctcttcaactttaataagtagcaatgaatcattcttaccatgtttattagctaaataagtagtatatttagagtatttggttttcatgatgttgctttatttccttggaaaagcagtctaaaaggttttttgtttttctgttctttttagttagttgatactactgtggagttggcaaacaaagtaggtgcagcagaaattatatccaggattgtggatgatctgaaagatgaagccgaacagtacagaaaaatggtgatggagacaattgagaaaattatgggtaatttgggagcagcagatattgatcataaacttgaagaacaactgattgatggtattctttatgctttccaagaacagactacagaggtaatgaaaactattatggcacattgctactaactttaatatttgtagaaaagcatattagttgtcaagcaaatttttctagaatgcaattgaatttgaagtaatttttaaaatgctcagggggttaccaaacgatattattctacctcaagttttaagatttgatgtaaaaaaacagcaacagatgtttgggtggttagaaaaggttgactcttagtgtatttcaactgtgcagtcataaaccaaatgaatatgtcttttttttaaatttattttttaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggtaaacttttgcatcaaattcttacttcttccccaaatagtttaatgtaaatagtaacattttaacattatttgttttattataggaaaaattgatgggacacttgggtgttgtattgtatgagtatttgggtgaagagtaccctgaagtattgggcagcattcttggagcactgaaggccattgtaaatgtcataggtatggaatttgctggttacataagactttttcttgttttaactttctttttcttttttttttcgtaagtaaaatcttatttaggagttgggaggtttttgttagctttttaaaagcacttcaagattgtagttaagtcgggggatgtcacaaaagtcttgtttcccaaaacccatttatattttactttaaagagaaaaaaagggtaagtttaggacctacatgagaggtgggagtagtcacagctcaaaaagctttgaagtcatggaatacaggaccctagtagaaatagtgtgtcaggtgaaatatattctgccatgttctgctgcggggtgaaaaggcaatcctaaagttttaatttagttttagaacaatatatatatatttaaaccttgaattagcgattatgacaggttttttgcttgtgatcagtttcaaggaatataatcagagaaaagtgaactgatcaaattattgtctttatttacataccca

SEQ ID NO: 98009 - DNA, 2722 bp, Homo sapiens
gatcctcctgcctcagtctccgaaagtgttgggattacaggtgtgagccaccgtgcccagctggagttagcacaaaattctttggttaaaaaagctaataaaaatgctgaaaaatgagattctcctttttgttcttaaggcctttaaaatatgcttaaagcttgaagataattagtgaaattatgtgagggattatgttaacactatatgtgccttggaaatggaagatacttcagggaaatgaaggcatttagtacatacctctgtggttcgttctattaaattactcttttgagttaacataaaatttctatcacaggaattgaaattccagagtaatttggatggaaatgaactcatgctgtctatgtaaaatgtgtgtaaaagtaaacactaaaatattaaagtatggaaaatcttctttgagtaatttgctcattcaaaatgtttgattataaagaaaccacacctattactctgctctttttcccaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataaggtttgttctccttaatagtgtttctgatagtttaaagttttaactttttcagttaatcaatgttaaatttacatattctcctagaccttttcctttgcacaagtacacaccatacatgtacaaatacagttttatacagatgtacagatgttagtttttgtcatctttgccgtaagaggttcatattatttaattttttcatttgcttttattaaaattagattaggatgagaacatatgagaactaacgccagttagtattaagaaccagttttttcaccgatggtaattatggtgcagtatgttcatagggtgtataagttatttctttaaaaaatattgaatattagtgtgtcactaatagctctcttaaattttcatctctgtctggagtttgaacttgtataattaaaattcttaaacagttcgtcccttgattaacaaaagtcctgataattctaaatttcttatgtatgtttaattctgtacatgagcatttcatcagtaattgatgtgaaagtgtagcttcttctcttttctctttttcagatcctcgtggtcattgaaccgctattgattgatgaagattactatgctagagtggaaggccgagagatcatttctaatttggcaaaggtatttacatttaatttctagagaagaaaatttatatctgtttatggaattgattatggaaagaaatggttgaagattaatattaccaactcatgactgtcctttctttgtttacattttaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtaagttgtaatgtaactttgtctttttttttttttctttaggagacagggtcttactatgttgcccagactggactcaaacctttgggctcaagtgatcctcctgctcagcctccttagtagttgggactagaggtacacacacagcctgtccatgtttaataggacagctgtcctaaaatttgggctactgatttggggagataaatggaaaggcatagctctacaaactatagattttatgatgggtttgttatattatctgctgacaggctatggttcatgttttgcttttacctaattttgtttaatgtgaacatattctgcagtttggctgaatagttgatatattgagagaatctggatgatattgtgtaacttaggtaatgttggggcatagttaaaacctgtgtttggttttgtaggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaaggtaaatccaccaattaccttttgatttatcttcattaaagttaaggcgacataaatctaaattactaaagtacatatattttttatttaaaaatagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtaattattccagatttgttaatgtaaactggatatgtttcatggttctaacagaattttaaagtgtttttaaaaatcaacaaaaaaaactgtatgttacacgaatactgtttgatttgtttttaaattttattttttaaaatcacgtaatcagcaatgagtattctcttcatttcaggtcagttgatttattattactatttctt

SEQ ID NO: 98010 - DNA, 1049 bp, Homo sapiens
gttttatgccccatatgagcttatttccattttatataaatcttatgaaacattatttgctcgactacagcattttttggaattgctgactcagattttataattttcaaatttttaataatttgacattttgacccacaacatgtttgaatgtgattagtattttctaagctcttctcttgtgtttcctcagttccctacaccacggatataatcagttagtggatgagaagtatatattttaagtttctaattaagatagaaaagcaagatagatgttgtctccaagcaaataaaaaccttattagctaataaactaaaatattttaagtgcaaatattgttcattatgctgttttttaagttaagaaaatcctaaactgtcttataacttttattaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggtaagtgatactagcagaaataaactattaattgtgttccagaattataaatcataacatttcaacttcccttaacatttttttctttttactataggttgatgttgatgaatcaacacttagtccagaagagcaaaaagagagaaaaataatgaagttgcttttaaaaattaagaatggaacaccaccaatgagaaaggtaagtcccagtttgttaaattgtcatgtttgttgcttatttatttaattaaaaaaaatttgtagtttttgtagagacagggttttgccatgttgcccaggctggtctcaagtgatcctcctgctttggcctacctcccaaagtgctgggattacaggtgtgaggctctgcacctggccatgtttatatttttaaaaatgtttttaattttttcaccaggaaatgtagaccacaaaatagtagtgaactatt

SEQ ID NO: 98011 - DNA, 1041 bp, Homo sapiens
gtgatcctcctgcctcagcctcctgagtagctggggctacaggcatgcactaccatacctggctaatttttttattttttgtagatacgggagtctcactgtgttgccaggctggtctcaaactcctaggctcaaagtacccacattggcctcccacactgctggggattataggcatgagccactgtgtccagccttgttttgtttttgatcccctgttatttgtgttagagtatttgtttcaagtttgcatgaagttttgccttaaagctttttgtagcctccacataatgctgtgggtatagatagaactgtgggtatagatagacagaacttactgttgactgcctgcatgtctttctcagtcgtagtcattgatttccttagtgtcactaggaggaaaagtctcccttagtgaatcctactaataagcaacgtccttactagtgaatataaaaatatagtagacctttaaatccttaatggcaagtgatgcctgtggacttgacattgatttctctaggcctcacatctttagagtatccactttatccaaaatgcttagtggtctgtgctggtgcagacgttaactagcaacaaaaaatatctgtgcaaagtacagatagcatcaatataaatttaacataatttaatctttaatagacaaaacaattttaggctcactggagaagacgtgtataggtttattgacctctccaagaagttgtattttttttcttttactatatattaaattatataaaatagagatggggtcttgccatgttgccaaggctggtctcaaactcctgggctcaagcgttcctcccatctcagcctcccaaagtgctgtaatcctggcctgtccagaagttgttttttttttttgaagtctgttaccagctttaaaaaaaaaaaaaaaaatttctttgtgattttcagcctgcattttttgaaattttactcgttttgcaaaaggtttgatcaggtggtgtgtattttatagggctttggcaaacattttggttttagtttttatgc

SEQ ID NO: 98012 - DNA, 1251 bp, Homo sapiens
ctggctaatttttaaattttttgtagagacaatgtcttgcttcattgcccagcctggtgttgaactcctggtttcaagtgatctgccaaagtgttggaattacaggcatgaaccactgtgcctgacttaccctttgttttttattatggaaaaatgtacataacatcaaatttactttttttgttgttgttgttgagatggagtcttgctctgtcacccaagctagagtgcagtggtgcgctctcggctgactgcaacctctgcctccccagttcaagtgattcttttgcttcagcctcctgagtagctgggattacaagcgcccaccaccacacctggctactttttgtatttttagtagagacagagtttcatcatgttgatcaggctggtctcaaacaactttaaatgggtcaccattttaggaatattctattttagaacttgatagttttgagtataactgtttgagaataaagaatattattttaacagtgattaaaattgtggttttactcactctttctttttaaagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtagaactgtctcattggacataattgtttttttctccataaattatttaattttttcctttgtggtattctgtgtactattaatgtcaacttctagtaagaataaggagatatacaaatttaagtcttggtttgcgtttataatataaaagcaaataataggattgatcttaactgtcttttatctcaatgtatgtaataatacagtcttgtactatagattatataaaaatttgcttttcttggtaggtcacataatgagtatgactcctgaacagcttcaggcttggcggtgggaaagagaaattgatgagagaaatcgcccactttctgatgaggaattagatgctatgttcccagaaggatataaggtagtacatcaaatttgaatgaggtggtatttaggatatacatttattttaaatagtgaaaaaaattgattaagcttgcattggctttgcccaaatttactattgtcattccattctcttagctatttccag

SEQ ID NO: 98013 - DNA, 1314 bp, Homo sapiens
aaaaccccattttaacagtacagagtgaattaaatgtgcatccattatcactatgcatatttacataatttgtcagtataaataaaacaattttattatttttatcttttaccatttttctatcttgttccatagtcttaattgctatttatatgagttttgaagaaaaccctatttttcagtggaagcattatggttctccattgttgactgaagattttacttcacctccagtatataaactacagtgtgctatgttacgaattctgaacttgcttatcttttgtttagaaaggcattatgtaaaacgaaataaagacgcacagactatggaaccagcgagcgtagaaaggagatcaccagtacatagaaaagagaatgagcaaagtataaaataggatgttaagtggaagtgattgcgctaatggtagaaaaatacattgaaagcattttaaaggtaaatactcactgtttttttcagcgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagaggtaatttctttttgttttttgttattactgttaaaaaatttttttctgttatggactgtattagtctgcttgggttgccatagcaagataccacagactgggtgccttaaacaacagacattgatttttttcgcagttctggaggcttgaaatccaagatcagagtgccaacagggttggtgtttgttgagggctttcttgctgtgtcctcacatggcctttctctgtgccagcaagctctgttgtccatgctcttcctatgaggacatcagtcttactagattagggccccaccctcatgaccccatttgaccttaatttacctccctaaaggcccagtctccaaatacagtcacactgggggttaggacttcaacatacagattttgaggggcatgcaatttagtccatattatggaataaggaaagttctttttagaatattaaatacagacctgtaggtatgttacattgtggaggttgagtatgatatagtggtcttccttatcttctggatagataacttaagcccctcactactggcagcaaatagtcaatgctactcctttctcttggccagtctactctcctacctttttttttttttaaacatttgttttggaggctgaatgcattggctcatgcctataatctcagcactt

SEQ ID NO: 98014 - DNA, 2998 bp, Homo sapiens
ttaaaagcatagtttattcagctaaagaaaagtgaatgtctgagttcccatagaaatccataaattttaggatgctttaaggataattataaataataacttattttgtaaaggtgtaatctttttctttttgacacaaggttttgctgtcttgctcaggctgatcccaaactcctgggctcaaggattcctcctgtctcaacctcccaagtagttgagattatacacacaggctgtcatgcctggctgtaatcatttaatgaagcattgaactatggaaatgtggatatgtatattaccttgtttccatgtgccttatttttttatatttaacatttatctgtgaaacggtacagaatattagtaggcatgtattaaacatttgtgctttatggtgttctgatttttgtttatgatattctgttttgttattttaataaagtggatattaagtgagacatacctcttttcagtatgatccatttgctgagcacagacctccaaagattgcagaccgggaagatgaatacaaaaagcataggcggaccatgataatttccccagagcgtcttgatccttttgcagatggtaattctttcccacttttctataagtattcagaaatttatttgtattaagttgtctttagccctttgattttttttggcatgcttctgaatttgcttttctttttaaaaatcccccttactatagatttgtatagatgtggttgaagtcacagatgccatattcttcatctttataatgcaagttttctttccaggtagaaggacaagaaaaaaatgagccaatgccatagaaacgcaaagggttaaaggttttacttttacttttgttttgggtacgctttctatacttggatcaaatgtatttttctgctcaaaatactttcaaattattgaaagttttcattccaaatcctagatttttaggattgttacccttgagaaactgtttctcacactagagctccccccatagtgctctaaatatagcttagtaaaggcacctactttgctctaagcatacttaaagttaaaacaaaagtatgtatacgaagagtttgatatttttaatagttggagtctgttttgctaattttagtgtgcaagtcagcacaaggggcatagtgagcctgatggaagctttcctcaggtgagtgagtttcacaatcaaaattaggtgcctgtttcttaaaattagattctgctgcaggtttacatactagacttttcagcctgcatgaattagtagggatattctttttttacttgcataattgtaattgatttaaacatgtatgccagaattcacaggcccatactaactgtccttaatttctttcctacagcagtactgctatatgccagtcctgtctgcattcttaagggtgcagttcaacacatcctctctagattatggtgaaaaagtattccaaaggaagtcttatcagagctagtgtcagaaagaatgacactaccaattgggcatgatcttcagcataggaaatgtcttagaattttattattttttcctaaattgtgatgctatactacttgtatagctagttaccacatttctaaagcatagtgtgcctctgtgaatcttgttatatactgtttgggcttctgtaagatattttgaagtttgaaaagcaaatactgaaactttaaccaagagactgacacatctctttgtacaccacgttgcttctgtgtgcatcataataactggtagaagtaatatatttaaagtaatatgtttccagttttaatttatgctttctaagaaataaaaatatgttttctgggtcaacaaaacttaaagcatgaagccctttttagtaacgtgacatcagaataagattataggtatatttttaaaatcagattttctaaactacaattgttttagaacactgtatgaagaacttatctagtcatagttatttgtagtcaggattttaacagcttgcaacaggtaatgttttgaatataaatatctttccaaagtgttactaatggtaaagagataattttctaggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaactgctgtagatgtttgtgttcaaacaggttaaattgatcagcaaactcaataaaaagtaagatgtataattattaaagttttccatcaaaaaataatttaaatgattatggaataacataatatttagagcagggcagataaatcagttgaacctgcttattttttatttattgtactctttttcctgttgctgttcttttctgcaggagggaaaacccctgatcctaaaatgaatgctaggacttacatggatgtaatgcgagaacaacacttgactaaagaagaagtatgtaaacctgtctcctgttttaatggttgtgaaagaatataaatacagttgtgattgagagactgttaggtttcttttttgctatttgctgcacaaataatagtattaataaaaattaactgagaaagaatcttacccccaaattataccaccttccaagtaaaacttttcatttctatatccttttctagtcctgggccccttggctgtatatgtttgtatgtatgtgtctcacaagggattttttttttttttttttttttttttttttggacacagtctcactctgtcatccaggctagagtgcagtggcgtgatctcatctcactgcaatctctgcttcccaggttcaagttatcctcccacttcagcctcccgagtagctgggaacacaagtgtgtgtcaccatgcctagctaatttttgtatttttagtagagatggggtttcaccatgttggccaggctggtctcaaactcctgacctcag

SEQ ID NO: 98015 - DNA, 1156 bp, Homo sapiens
tgtcacccaggttggagtgcagtggtgtgatctgcaacctccgcctcccgggttaaagtgattctcctgcctcaacttcccaaatacctgggactacaggtgcatgcccccacgcccagctactttttgtattttttagtagagacggggtttcgctatatgttggccaggttggtctcgaactcctgacctcaagtgatcgcccacctcctcctcccaaagtgttgggattataggcgtgagccacagcacccagatctgcccacctcatcctcccaaagtgttgggattgtaggcgtgagccacatgcccagcctatcatggtttaatttctagagcttgcttacgctgttgtgattactagtctcttatatggtgcaattattgtacattttctgtatttaagagagtattttgataattacctagtaaagaaatgcattgtgttgggagttcttttggaaagtgaaattaagaaagtctgtgttatctttttatagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgtaagttacaaattatgtacaagaggcagttatttttttgagagagcaagaaatatgaataacttttgttgcagccatctggtttaatctggagaaacatttttgggatcttttagaggataaaactactggaggtatcctctctaaggttcagaaacttcactggaaatgctttgttctgagaatttatggtaaagactagtttgtttatccagtgaagcacctgccagccattacctttataaagttaagagtaaagtaaatccctaccattacttatcagctctatctagagtagcctgtgtgagaagtgacttaattgtaaatagccatctgtccttgtgatttgattactgacttgtacttgatactgtttttctcctcttggtatcttaatgtgaatggattttcttttcttatctttttttttttttttttgagacagtctcacctgtcatccaggcttgagtgcagtggactgcaacctcc

SEQ ID NO: 98016 - DNA, 2043 bp, Homo sapiens
tcttccagctctgaaaccgcagcgtttcgtacagtgttcatttttttttaatgggaggggtctcggggtcttgctctgtcgcccggtctggaggcttgagtacagtggcgcgacacgattacggctcacggctgcctcgaactcctgggctcaagcgatgctcccgcctcagcctccagagttgctgggactcagtgtctgttcttaactcccttcgtagaatccactttcctccagggcaaagttactcacttaaggaccttacggctcggctcggggatttcctgggtcaccacgcaggcgacttcagggcccaaccgtgtctcctcccccacccacaatgcacctcgcggttccctctaggtggcagttctgtcacgtgtcacccgacggagcgcgctcccgtttggcgcacgcgcagagtgcagcccccagctatttttctccgtggcggcggcgacgagcggaagttcttgggagcgccagttccgtctgtgtgttcgagtggacaaaatggcgaagatcgccaagactcacgaaggtaagcggtctttccctgcttacgtgttttcttcgttgctagcctaataaaagccttttttcctaggattctgcctttttctatggtttctttcgtaggagctgagcccgcgtttcggggccaagggtcgtctcctccgcgccagcggcgcaggccactgccccgcgtaatggcgtcctcctcttacacccccgacaggcgctttgttcagtgtttgggacctgctacttcagagtagcttctcttctctgaccagagggcctcgtttaagcggcttcctcagtaggattcgtgggcaagggatcggggaagcgggcgtggggagaaggtctcactcgcctctcgacactgtcgtccccatagtttgtgcagaagagggtcagaaaagcactgaaatacggcagccgcttttccggcagactgaatcgaatttggttaaaccgagattccgttactcctacccttgtgtgtcttcaagcgtcagttacttgtttatttttcttgcacgaaacgatttggggataaaatctggtagttgttttccctcccttagtcacttttagtataatattgatctttttctttggagactggttattggaggagcagatggaagaggaaaacataaattactttcattaatggccgaagctttcaagctagttgatcgttttatggaatacagagtgtgcaaattaggaaaacgttgggaatagactggagttcattaggaagtatccagagatgacagaaaatgggatcacttttcagaaaagacgaggcatgagaagttggaactgcattctttgatttctgacttggaatccgagattttcactgagaacgagacttctaagtcacttttgtttcatatgttctttctgggtatttggctcggtattagtctgtgagaggtaagagactgaggccatccaaaattttacagtctgataggagaaacagatgtgtatgttctcattctctcatgaggccagatgcatgcttaagtagaagaaaaagcagcatgttctgggaacctgggtaacggaatgattatgtttagggttgtttcactgaggaggttacatgaccgtgttttaaaaggatcagtcagttttaaatcgggaaggacatctgagcctgagaacatcttgtaacaaggtattgaatcgtgaaaggtgtgtttgagtagtagtccactgtagcaggaacagagggtgcaagtagagaagaaataaatgaatctggaaaggttggattaggaccagaatgtgaatggctttgaatagttgggtcacccagaggacctgaagtccagctttctgctatttatcaaacatgctaatgaattgtcaatgactttaatattagtataccattttaggtatttaggatttaaatgctctcttagtattcctaggctttattattttgtctttagactatctcaaatataaccttttgcaaagtaagtagaaaatataaagttgtgctgtttttgt

SEQ ID NO: 98017 - DNA, 3486 bp, Homo sapiens
ccgcctcccaaagtcctgggattacaggcatgagctaccgagctcagttttgaaaggtagaagtgtatgctacaagggatgtaggacttgagagtcaaggcctatggtcttgtcctggctctaccagtaagtgtgaccttcgatgtttttttctcaagtaaggctggtaataattaccacagttgtgagaattgagaatttggaaatgcagtgaaagagactatactcaagtcttgttctggactaacagtgatcttaaaatctctcatttcaaagaaataaagtattttgatgattctcttgcatggtgtattaataaacttggtataatggcagaaactgtaacctacaacaggtttacgtttaactctttttgtaggtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggtaacattcattattatgaataagtttcttgggttctgagtccaagaatgattttgcttctgtagtattccccagtagtaccatagaactaaacgaatacttgaggaattaacttcatagtggaattttgtttgttttgttttgagctcttcgtcacccaggctgggatgcagtggtgcgatctcggcgcactgcaacctccgcctcttgggttcaagcgaatctcctgccttggcctcccgagtagctgggattacaggcacttgccaccatgcctggctaattttgtatttttagtggagacagggcttcaccatgttggtcaggctggtctcaaactcctgacctcaagtgatccactcacctcagcctcccaaagtgctaggattacaggtgtgagccaccacgcccacctcaggattgctttttaagtaaactgcttttaaatgacttggcaattagcatcttgaatgaagaggccatactaactggaattcttttcgtctttaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtaaaaagttaccttttaaatgagtttgtggcctgattttagtttttcttagaataataatgttgcagtcccctaaatggaatagcacattcatttcctgaataacagaagtagaatagtgctaatgtcagagctaaacatgcatcacatctttttcagaggaaatgatttgatctgtagtaggattgggatttccctacatcaatatcctcacaacttataaatgtgttacaatatttacaaatgaaagtattaaaattttgctgaaatttctctgtaggtatagaaattattaaaagaacactcaaaattccagcaatgaccattgctaagaatgcaggtgttgaaggatctttgatagttgagaaaattatgcaaagttcctcagaagttggttatgatgctatggctggagattttgtgaatatggtggaaaaaggaatcattgacccaacaaaggtaaatggttgaacactttctaaaaattcttttgttgttcattttgttaatgtatcctcacatcccaaatctttgattttgtcaccagaaaaatagtctaatagcagtagcaacagcaatagctcttgtgcccatcaacaattctcatgtacatttccagcacctagatatttaatactccactaaaaggaagcaggatcccttgagtagcagttgagtccatgcctggaggcaggaaaaaatcaggatggatctggaacaccctgttcctgcctggcagtaagaatactttccaagatacgcagaacagggttttgttttgttttgaagacagagtcgctgtgtcgcccaggctggagtgcaggcagtgacaacctccacctcctgggttcaagcgattctcctgcctcaggctcctgagtagctgggattacaggcatgcaccaccatgcctggctaatttttgtatttttagtagagacggggtctcatcatgttggccaggctggtcttgaactcctaacctcaagtcatctacctgcctcagcctcccaaagtgctggattacaggtgtgagccaccatgcccagacagaaattttcaataagtcttgctcatattttactaagggaaaactaattaattaaatttttttctaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaaagttaataattgtgttagcatttccatgattagaagatactgaaaattgaaagccagttgaagggcaggctggcatgtgtgtaaaacattatcctatctatgatattttcatgtttctctttgttgcagactgaactacattattccattgataatggggaaagacagtttctattttccccggtgcaaggatgtaatctctcttggagctgtaaaatctgggaggttggagggaactccagctcctcagcatggcctttgggctgctgctgcaagcaaggcattgaggcaaatatttttgctgtccttaccttggacagaagtagaggggagaaataaagtccatcatcacatgaaaagtcagtcacttgaaatcctgtacctagaatacctttggctttggtaatttcgttgtgtttggggtacaaaaaaaaggatctatttgatag

SEQ ID NO: 98018 - DNA, 1006 bp, Homo sapiens
ttatcactgtatcctataacttactgtgatgtgatttttgctgctcggcctcctgagtagtggggattacaggtgcctgctaccacatttggctgatttttgttattttcagtagagacagggtttcaccatcttggccaggctggtctcgaactcctgacctcgtgatccacctgcctgggccttgcaaagtgccgggattacaggcctgagtcaccacgcccggccaggccaacagtttattaagaaggtaaacggatatggacaagtataattaatagaaaatagcctaaactgtctcagatacttcctgtcttaatttgatcaaaaattgctaggaagcaaaaaaaaaacaaaaaaacacaaaaaccaaaccagattacttagggagtcctaagtaatctagtaacagcttgaggggaattaaacagataggcatttttatttcatttaaatcttactatcaactattcttaacaggctaaaggttggtcttcaggttgtggcagtcaaggctccagggtttggtgacaatagaaagaaccagcttaaagatatggctattgctactggtggtgcagtaagtaaaataaatgtgataatggtttgctgaatgtttatacttgtctggaatttatagatagtttaacatttcacaattagatactacaactatctgtttcttttggctctttggaaggtaggggttggattaaattcccgttaatttgccacaagtctggcctaagaatgagcttactgactattctatattgactaaatcttattgactgaataagggggtttccttttttttgttttttttggagacagtgtcttgatctgtcttgactattcttgacttgatctatattgactattcttattgacttaaatctgtggggtttctttttttttttgagacagggtgtcttgatctgtcacccaggctggaatgcagtggcacgatcttggcttactgcaacctccaccttctgggttcaag

SEQ ID NO: 98019 - DNA, 2202 bp, Homo sapiens
gcataagttttgtcagtttgtaatgaagtcagcatttttaaactttttgttacaagaatagttttatgtatcatattcttcaaaacaatgtagtcaaataatgaatcggaaaagagcaaagaaccagtacttcatgaaaactaccataacgtaaattccccttctctcccctggatggaagtatcaatttggaagttactaggaaaaggtaagggaactgactgaggacactaggcttaccttttaatttcgaagagtaactggattatttcaggttgctacgatttctgcaaacggagacaaagaaattggcaatatcatctctgatgcaatgaaaaaagttggaagaaagggtgtcatcacagtaaaggcaagtgtgtttgtatttttaaagataattttgagttatcttatgatcaaaagtttgagttatctgatgatcaaaactgaatttttcaaacagaaaaattctgttttaaaaactgctttttttattccttcatatgtagtctcagcacatgtatagaataaagtacttactgtgttttatgtgaattagcctttgctgcatgaaatgaatccatcctaacttaaatgattattcaaataagcacttttgggattttttgcagaagtgtaattggatgtcctgggctgtttcatactctaccctgcatctcttatggccagaggggtctgtttttattaatctggcctgtaattccatgttttgtgttcaatgaaatccatatacctaattctttgacttttcataggatggaaaaacactgaatgatgaattagaaattattgaaggcatgaagtttgatcgaggctatatttctccatactttattaatacatcaaaaggtaagaacaaatcaataactgaattattattatttttattattttagacagagtctcattctctgttgccccggctggagtgcagtggcatgatgtggtggcgcgttgctcactgcaacctccgccttccgggttcaagtgattctcttgcctcagtctcccaagtagctgggattacagtcacacgccaccatgccaggctgatttttgtatttttagtagagatggggtttcaccatgttggccaggctggtctcttaactcctgacctcaggtgatccacccaccttggcctcccaaagtgctgggattataggtatgaggctctgtgcctggccaatttttgaattttttaatagagacaaggtttagccatgttggccaggctggttttgaattcctggcctcaagtcatctgcctgctttggcctcctgaagtttttaaaatatactttctaatatgtgtcaaactataggtattagttggtgtcatcctctaaaaaataaatgtatatattccaaaagttaatgcatatgagaaatgaaggaggaaaaccaactcactggtgaattttaaagtgtattggaaccttggtttcgcttttcatttaaatgtattgcagtcattttttgtatatttttgaaatcttcattatttttacaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggtaataagcagtggtatttgttgatttatatttctcggtgaaagacagaattatttgtattgctgtttgcagtttccatcatgtgtacctccacatttgatccagttgggtttgtatctagaattgtaattgtgtaaatcaggtgtgctctaatgtatccttatggttgtgtttttgaaggaaccccaaagtctttactattttgatcagctttctcatagaatagactaatttagcacatgggtacctttctgtattttgcaagtgtttacagttgttttgaaggcacatgactgaatcttgtattttttttttttgagacagagtctcactccctggcccaggctggagtgcagtggcataatcttggctcactgcaatctccatctcctaggttcaaacagttctgcctcagcctcccaagcagctgggactacaggtgcgtgccaccacacctgactaatttttgtatttttagtagagacagggtttcaccata

SEQ ID NO: 98020 - DNA, 3350 bp, Homo sapiens
cgaggcccgggaactagactaagccggccggagagggctgagcgcgctagcacaccctgcgcgggtagggaggggcggggctcgcgcgcagggtgtgcagattgcagggcccgggctgacgggaagtgggtgggagctgcctgcacacgcggtgccgcggggcgggagtagaggcggagggaggggacacgggctcattgcggtgtgcgccctgcactctgtccctcactcgccgccgacgacctgtctcgccgagcgcacgccttgccgccgccccgcaggtacgcggccttcccgcaccacctccccccggctcctgcgacccccgagtgggccttcctcctctgcggtccagctggagggtgcgggcggcgacaacctggagttccgcaccgcgccgcaccgcaggcccaggcctgcgggtccaggcctcgcgggtccatgcgggttccatcacgtgcgacgcggatcctggacctcggctgggcgcgggagggacaactcgtggggtttgaatttgggggattgtaaccacttaggcccgctggtgcaacctgcgcctggccgacttcagggaaccggggagggtggtgtacgtgagggaaccgcttttttcccccgcaggcagctgggataccgcgcctccagtcttgaccttgctgggggcgttcggaaagaaggacacgtgggctcgcgccgagtgggccgggccgccgcccccagcatcgcggccttgctggttgctctgatacagtagccttgggtggatccatggagacactttgctgagcggctttttgcaccgtcaggaatacttttaacttccctggtcacttggatttgtaacttgcctctctccggctgacttggtttctcaggggccacagttggagtgggtctgcccacaaggccgttttcgcggtgaaagattaactcgtttttggcggcagggataggtggccgtggggaaggagccgcatgtgctttgtgctggtgctataggtcaggcgccggccggggcggcctctttagcttgcgctagtggctgatgttccgaagctgcggcgccttccgtcattcaggcgtagtggctggcggaggtcagccaggctcagcatctcacgttgcttgctctgttgcacaggtgggcatgtttgttctgcagcgcaccacgggtggtagttctgatgatctttttgcttccatccccagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaaggtaccagtatttttattttattgtaattacggtattattaatagcattttactcacaaatagtcgcactgaactattcaacagtactttcatctccatttttgagagaactcagtttacatgtaagaattctgaagtattggttagcctttttttcttagacatgatcttaaagcttaaactgcttcagccagattttcgaaactattttgttcaatgtgtgatgtaatcaggtagtaacttacagctcaaggtggattcttaaactcgaggtagaatttcgctggcttaagttaaaatttggatcctttcccagtagttcatgccaagtgtagagagaagagtttaacttatcttccataattccttaggtatgtgcttgtagatgctaaatttttttttggtttattgtagtaaaatgtacacaacataaaattaccattaagtgtgcactttggggacatcaattacatttatgttgtgcagtcatcaccaccatccatctccaaaactttttatatggaaaaattgtaactttgtactcattagacagtagcttcccattctctcctccaccccaagatgctagttttacccatcggttttctgctgttctcttgttccaaagcatatttaaaataagtctcatttaataggggtaatgttttgaggaggcctttgaaggtggtgtgcagtcaagtggtgcttcatttcagtttgaagacagttcagatatcaagtgatccaacaactgcctaaaatacaacatttgcacacctcacaaatagaaagtagcagctttagttcaaatccaaaggatggccaataattgtgccatggttgaagttttatgttgcgtgaacctggaagagcacgctacttgccttgatggttaatattttagttaaacggattttaaaacaagtcacattactttaaaagataacaggcactaactaaagtataagtgataggaagattgttttattctttgtcttgtgttcttgttcattttataagatgacaagttttagtccctaggattttaatctcctaaattacctagttcaaaattatgctcttggcagagaatcaggtcattttgtctgtagacaaagaatgtcgataaacttgcccttgaggttcatgctgcaagactgataaaaatgacacaacttacgttgagactttgaagtagttgctttattatgaagactgctcatttttaaaaatgtaaatcatccttagggtatgtctgatcctgttacatttttttcttctagggaagaacagtgattattgagcagagttggggaagtcccaaagtaacaaaagatggtgtgactgttgcaaagtcaattgacttaaaagataaatacaaaaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtaggaatgtctgttgtcaccacagtgttctaaacttcagtgtgctttaaggcattgattccttggacctaaggaaagtgttaacttgaggaaattaatccttctctcattcctcctcttggcctggagaaatcttaaactgggttttcctttagcaagcttggctgtatggtgggtaggtactgttaggtaattttgatattttacttagttggtttcttttgtttttagagacagggtcttgctctgtagcccaggctggactgcactggaactcctgggctcaagcaatcctcctgcctcagcctccaagtagctgggactactacaggcactcaccaccattcctggctaatttttagtttagttttgtagaaagtaagactaaatacactggatcattcagaatgtcagaaagtaatgtttt

SEQ ID NO: 98021 - DNA, 1752 bp, Homo sapiens
tcccgccccgcggcaccgcgtgtgcaggcagctcccacccacttcccgtcagcccgggccctgcaatctgcacaccctgcgcgcgagccccgcccctccctacccgcgcagggtgtgctagcgcgctcagccctctccggccggcttagtctagttcccgggcctcgctcggttccagaactttccagaaaatgccgcgctccctacggctcaagggtcaaatcgcgtcatttccgggaggggacgaaggggtagttctttcacctcggctgggcgcctagaaaagcctagaaacagctccttttttcttccgcctccgagtcttcgcgtcagcgtcctgcgcagggcccttggggcgaatcgcggtgcgcgtcggggcgaccgccctccctccctgggaggggcgagggggctagcggcgaccgctggggcgagcgcgcctgcgcgctgggtgattttttcacgtgtcgccagggccggactgcgagtctctttgcggcgctacactagagcagagtacgagtctgaggcggagggagtaatggtgagtcccgcgtggccccgaggcctgcaggcccgggcctgtctgaggcgtacggggatccctgacgcccctcttttgttgggctgggcgggagggattggtggccactcagtgaccagcgcccgatggcaccttggagcggcaaggcccgcccgacccttttctcccccagggctctttgcacgcgcgtgtgctgccggtgtgtaaggcaggggggcgagaacccgggcgcacgcgcagcgtctcacctgcttctgcagggcctttgtggatgtgtaatatcttgggtaaaaatcatggtgccaggcagggagcttgacccagcgtttcctgaaaatttctggaaaaacctgaagaaggaaaacatttgaccttggaataaactaaggttgaccttaaagctggtctggttgctcaccggaggagcgacaacgacccctaacagacgtaaggaatcgggaattaaacttggaatattggttagtacattcaaatgcgcttccttaacgaataagctgaggtttggtgttaactttcaaagccaaaacgtgttgagatgtatagcacggtggcgttgcctgttgataatgtgattacatttagtttttgtttcaaaacatttctcttcctacaggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaaggtaaatgggagctgcagtggaactattttttatagtgtgcagtggagggaaaagaagtaattctggagtattaaaagtcgcttattaagtagagtttatgtcgttttcaagatcattaactgctttggttctaatctgtttcttaaagggaaatgactaatataaagttgcttattttatatgaccaatgctatgatgcttattttatgtgatagtttcagagtattaaaaattgtcctcaataggccgggtgcggtggctctcgcctgtaatctcagcactttgggaggccgaggtgtgcggatcacaaggtcaggagttcaagaccagcctgaccaacatggtgaaaccccgtctctactaaagatacaaaaattagccgggtgtggtggcatgcgcctgtaatccc

SEQ ID NO: 98022 - DNA, 1271 bp, Homo sapiens
taactaaagttagcttttccagaatattttcttgaacttttacgttggagtcaggttttagtttaagccactgtgtattatttcaaagtgtaactacagtggtatttttgagtgaagatctgtaattctagtatgagtcgtatcacttagccacgaaatatatttttaatataattggatttgagtgaccatgtttcattagttgtagtgatttaaaagttaactgtttatgttgggtgaactagatatctttgctaataaacatccttccttttttaagggtggagagattcaaccagttagcgtgaaagttggagataaagttcttctcccagaatatggaggcaccaaagtagttctagatgacaaggtgtgtaaacttaataattctaaaaagaagtcagatatttgcaattagttgtcttaactaatggtttttttcacttgcaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaaaatatgtaaatgagtggttaatctttagttattttaagatgattttagggttttctagtttatgctttttttctgtttttcaagtaacctgcagagaattttgggaaacaggattttctacgtaggtgcattttcacactgaatttagctttattaatacatgattgatactgataccaagccatggatttactttttttttttttttttctgagacggattctcactctgtcacccaggctggagtgcagtggttcaatcttggcttactgcaacctccgccttctgggttcaagtgattctcctccctcagcctccagagtacctgggattacaggcgtgcaccaccatgcccagctaatttttgtgtttttagtagagacaggttttgccatgttgcccaggctagtctcagactcccaaagtgctgggattacaagcgtgagccaccacagcaacattcagatttcaaatataacaagctaacgagttacaggtcttaaggtgttcaatactttgtggatacaggtcttcattcctaactccaatttatataaatacagagcattttttgcatggtttaatgtatactg

SEQ ID NO: 98023 - DNA, 1076 bp, Homo sapiens
aaatcctgtatctacaaaatatggaaaagttagcccggcgtgatggcgtgtgcctgtagtcccagctcctcaggaggctgaggtgggaggattgcttgagcccaggaggtggatattgcagtgatctgagattgtgccactgtactccagcctgggtgatgcagtgagaccctgtttcaaaaaaaaaaaaaaaaaaaagaaattatggtttgcaattttgatccaagttccagtcctgacaaatacaatatctgcatttatgtagtagattctatccaaatgaagttgaattgaaggataaataagtaagggtaacctactttttttcttagttactgattatgattctatacttggtttcctatttagtgtataacccaagttgaaccacaagagcagttatgtattaacaaattatatgtacttaacataagatttaccaggtgatataatttaattaaccataagaacttctttgtttttagtatattcaacagaacataagagcagattgctccaatattgacaaaattcttgaaccacctgaaggccaagatgaaggtgtgtggaagtatgaacatttaaggtaggaccttacatcaaaatactaatagtacctctcacaaaactagctttcatattaatgataattatgaattgtaaaatttactatgtaactgcagactaagaagccaaattttaaagctttggcattttcagtgtcacaaggttctcagctttcttcactggttgtttccaggtcaaattatgctgcagagtcactcattttgaaaggtggtttatttcagagttgataatttggacctgcctctgcacctctcttcttttcttttcttttttttttttttttttgagatggggtctcactctcttgcccacgttggagtgcagtggtgtaatcactgcttactgtgcctctacctcttaggctcaagtgatcctcccacttcagcttccagagtagctgggactacaggtgtgtgccagcatgcctcactaattttttaattttttgtagagacaggatctgattgtgttgcccaggctagtctcaa

SEQ ID NO: 98024 - DNA, 1053 bp, Homo sapiens
tagttgttttttccttctggttgactccctggtttgtttctagactgctttccccttgatgttgctccctgtctgccctcaggaggactggatgaggacaattactttgcagttttatttttcctttaataaatttactgagttgccatgagacagtgtttcattgtttctttttttcattgtttctgataaatggaacagaataagtcagatttattaaaatataaggaaactttgatatttcatgttaaaattcaaaggtgatctgggagaaagttctttagagggctgctagattgataatagagtgctagggacataataaggaatattgtttaggatataagaaggcatccctggagataccagagataaatcaggattcttcttgtctgtaattgttgttttcttgtaggtacgatgttgggaataaaaatgggagactggtttatgtatcatctagaattgtgatatggttcaaggggataataaaccttacttattaatataacattatattttacaagcattcggaaattgtaaggaacttttttcttagaacatgctcatgtctttggaataaggtatacccatataatgaatatatctaacttaagagagagctctttgttgatgcatttctatattctttcttttgtagtgtcctgctatagactatactagacacacacttgatggtgctgcatgtcttctgaatagcaataaatattttcccagcaggtaatcgaaacttttaaacatagtgttaaacattttagagttaatttataagattggtattttaggggggaggggggagggatagtattaggagctatacctaatgctaaatgatgagttaatgggtgcagcacaccaacatggcacatgtatacatatgttacaaacctgcacgttgtgcacatgtaccctaaaacttaaagtataaataataataaaataaaagattagtattttaaaagtaaaattaggttgctcgttaatgcatttttgtatttttttttttagctgttgtattttggcttgtttatt

SEQ ID NO: 98025 - DNA, 1398 bp, Homo sapiens
gatgatccacctgccttggcctcccaaagtgctgggattacaggcgtgagccaccacacctggccttaatttctaaaaaaaaaaaaaaaaaaaagaaaagaaaaggaaagaataacctagttctgtaaaataaaacaataattcctttcaggagttttcaatcgcctctagtggacaatgtattaatgttggaaatagatgttatagtaaattttgaaatgtcagggatttattctaactgcattaaacttttacaaagtttcaaaactataatgctgaatttaagttaggccctgtgattaggtagaaagaacactggcctagaactgaggagcaggggctccaggcatttactcgcagtgtgaccttggagtagtcgcttattttccctaggtgtcagtttctacacttgtaagcgagaaattggactatattgttcctaagattctatccagttctaagaatctatggtttcttttctacttctagggttagcataaaggaatcatctgtagcgaaactaggatcagtatgccgtaggatttacagaatattttcacatgcttattttcatcatcggcagatatttgatgaatatgaagtaagtatatttcactgattatcttgatgcattcttatcagtgtaacagtaatatatattgatgttatttctagtcttttagtttgggatagtgaattaaaataacatttttgtcttcctctctacagaatgaaacatttttgtgtcatcggtttactaagtttgtgatgaaatacaatttgatgtccaaggataacctgattgtaccaattttagaagaggaagtacagaattcagtttctggggaaagtgaagcatgaagggaatcataggaaaaatgtactgatcatataattaacattatgtactgtatatatcattttagacacatcaatcatgtatccatattatagcttctttgtttagtataggtttttgtatgctgggtttgccttttaaaatgggaaatactttttaagttattcataagctgtatattcaccagtgtggcactcatggtttttaaataagattagtattatctgtttataatgcctgttaataaaagaatttacagtttggtaaaattgctgctaaacaatcattggatcacaatcctcatcagacaaacccatctgtaaaaaaaatgagggagagcttgaggtttcacacaagccatttactaaagaggtagaaatgttttctattggttttaccttgagtttagatatcctaaaaaattctgtagtacgtagttttgtcttacctgttaactttccccaattgagataaaagtgttttaaaattctgtttatagtttttgatatgcatatataattatgtgtatatctaaatac

SEQ ID NO: 98026 - DNA, 1058 bp, Homo sapiens
taccatagtatttattttacaccccctctcccacgaagtttatgtttggattacatgcacgtgtgagattatttgcaataattcataggttccaagggtgttgatgaatagtcatacatttttttggactttgttataattcattgtggtaagaatgattgaaatgcagatttaacaatcttataatctattgaatgccatttttgataaagcactggaggtcttattgccaaactgattgtaatgaggcagtaagggtgaaaacattgtacatgttgtgaagaaagtatttaaatccaacttttgaacagatttaacaaacatgaggaacttttttatttagaaggataattttgaagatgaaaatgtattcatcttaattgttttttcaaatttaagggaataatttataccatcttttcagacaagaatgtacagcaaaaataaggggaacagtagtatactgagagtgtgtgtatgtatagtgtatgcctttccaagcttgccagtctttttggctttgaacactgcccatcagctacagtcattactgttccccaacccacaactatcttttaagaagtcttagttcacagtgaaaggaatgatgactttgaaattatggatttatattaatggcactataaaccaatggtaatggtaatttttaaacttgctaaatattgagaaactaaactactaagttaataaattatatatagcagtgtagctgttctctctagatggtgtctcacaatggatttctgttgcttgactattttcttagtgaatatttatactaaggtagtgactgagatttggtgatctggctgagtattttgaaacacattttgaataatatggcttagtgttaacggggacttaaatatgatttttttttcttactcatttcaccttccctgtactgtatgtttggaattgatcataaaacatctccaaaagaaaataatcagtttgtagtcttgcttttgtattcatgttgataatcttactaattgtgaagttgattcactactatactaggtaagacctaagtg

SEQ ID NO: 98027 - DNA, 1050 bp, Homo sapiens
cctacccagccttctgcactacctgcttccctagtgagccagggttggtggggccgtcagttcgtgctcaggcagaggattatgctctggtgagcgcagtggccactttgccaaagcaggtagcagaccactatgataactttcggatatataaggctctggaggccgtgtccagctgtgtccggcaaactaatggttttgtccaaaggcatgcaccatggaagctgaactgggagagcccagtggatgctccctggctgggtactgtgcttcatgtggccttggaatgtttgcgagtctttgggactttgctgcagcctgtcaccccaagcctagctgacaagctgctgtctaggctgggggtctctgcctcagagaggagtcttggagagctctatttcttgcctcgattctatggacatccatgcccttttgaagggaggaggctgggacctgaaactgggcttttgtttccaagactagaccagtccaggacttggctggtgaaagcccaccggacctagaaactcagttcttaccggcttgtggtaaaaaagcaaatgtgttatctttttattttttattttcaggaaagttatactagtattttcttaagtgtggaatcaaatgagcacataagctgtgtccctgtgaaaagaggtttgtagcctttcaggtgcctgctcctattcatttctctgtgaccattgatcactgtcctttgtgcattgtgtgtctaagatgtcttcaggggaaagatgggtaagagacagtgttgctaatgctgttccttctttgtgcctccttccaaaccacagttatttgcccaaactacctctcgtggctggtttttcattggcctggcctctgcttctcaggctaattagtgactcctttctttgagggtcagggttggaggccccttactggtggttttacagggggatcctactttgttacacatgttgggtttcctgataaaaagagagtattttattaaacccttgaaccagtgtcctagaccagatgatttttgcccatgtgtatccc

SEQ ID NO: 98028 - DNA, 1064 bp, Homo sapiens
atgatggcttagctttggtgcagaggcctgactttccaaagacagggtattttaaatggaggaatgtgtggtaagttggatctgacttctgcggtgatcctgaagatgaaccagttggattctctataggaggcacaatagatacagcaaatattctttgaataattagtgatgtgtttgagttggtccagaagtttaagaatagcaaatggagaatacgtgaaaactgaaggggatgtacttccaagagggggcatcctaaccacttctggtagaaaatgatacacttgtagaattccctactctagcactgttaatacttttatctggcattttctggattccttcgccagaaagtaactgtcttccaaatactatccttgaagtcctcaaatattcattttggtgtgttcctggaagcagcgttgcaggaggtgaaagaccactgcctagatcaggtattcatggatgtcacattaggagagtaataaaaagacgtcaactcactcagcagactataatcctctctgtgaagtcatgtgagaagtgggcaatgcacattttaagttgccccattatatactggagggctgtttcacaagtgaactcatagattagacagaagacctatggctataagaaggagcataagaaatagatataatctctgattttattgaaacctcagtttattctgcatgtagacctcattatttctcttaagaatctgtggactttgtagggtctatgaagagcccaataaattgaatatgaagttgatgtcagagtacttaagaagggcctaggctggaacatgggccctgggacactggtcttcccccttccccccaccccccaaggtggttgtacctgtgattgggacttaggttagctctttagctctgggaaatgtcaaaactgaagtgaaaccagtagttggtcaggttgtgagccctcaatgaggatgacatcatcatgaagtgagacctggagtgctggtgggtccttgccttgtcttttgtcagaaagtgaatatcaatggacctaaaagggtgtagacatat

SEQ ID NO: 98029 - DNA, 1048 bp, Homo sapiens
tagaaataatatatcctctaccatgcctcttctgatgagtaccacttgggaggttcagccatacttggatgttcaccaaggtaagcaaggcatagtacatatgtttcatccttggccttgagctgaattgtacccccttagctaatggcacagtttactcaccatggattttaaagtccactgctcctcacttaagaacaggatggtgtgagatgttcaagatgtttcaggaaaccaagtgtgccatctgcaagaagaaaattatagctccaaggagggatgagccctgcccttgagtcacttctggatgaaacatctgcagagggcctgactcactgggtaagctgaagggacagacccaggaataactatggaaatggaggatgcctttcttagattatgatgtgggagaaatggtactaacacctctgtgctactgctattaaggccatgccttgtacatgtaccctcattagttgagaatcaattgtttatgggatttaacatgatgatgaagcttcaaaaactagataatgattgttataggttggtatcatcatattattcttttaatacattccataaaaatatgaccaattacacattttttcctgattgtatatttttggaacacattaaataaaatagcttcagtagtttggcttcctttgaaaccagtctagaagcttctattggttaaaaagctatagatattaaaaatataaagttaataaacatggtatacatcttagattaatcacaaaataatacaaatggaatgtatttctttcaagccagatgaaaagagaagtgaaagaaaacaatccaacagaagccaggaaggaacaatgcaatagaagacaggtaggagaaaaaagaggcaaagaaaaaggaaaaatattgtaaatagaaagcccaaaataaaatggcagaaataaatacaaatatgtcagtaattgtaataaaataaaacttcatgagtcttctgtcaaaagacaaaactattcaaaattaaatttaaaaagcaatatatgtagttaaaagggat

SEQ ID NO: 98030 - DNA, 1042 bp, Homo sapiens
ttgctgcatttatgttcatttttccttagacataaggaaatagacaacattaggatattaaatatgttactttaattgaaagctattctcacagacagttggaaatagcctgaataaaataatgctaacaggttaactgaagtcagtatgtgggtacctatatagggcaggaaaaatttacacgtattagtatcttttaaaatactatgcgtaatagttcagatactaataaggattttaggaaatttcttttatgtgttgctacaaatatataaatgaatattgtgtagctttattttggtatcaaaattagacatgttaaaagcaaagatcctgagtgtgattagcaattaatacacattgtattaaaatcatctcaaattgttaatgaatactttaaaattatcatcctttagatgttttctccaaaacatcaaaggaaaaaaaggtatgctttttaggcaatactttttatagtaatgaaacgtttatatactatcattgtgttgtttcacagctgtatgaggttaaagatgaaagtttagtctcggtatcttcattcatttttataccatgatttataaaaatgatgttgataattaaaagttaaagcattgatcttttgtagttattaaaggtatttttgctatcatggatatgttatattacaaaataagagccaaatatcacaatttaagcagagtaagttttttggggggaatacattaataaattttcctaccatctctgttcttctgtactttatagtttggagtgagaaataaagtaatatataatatttgtagaactgaacgaaagtaatgtggaagcacatcaatacattttggtaaagagccaattgcctaaaatagctaagaaaaacacttcgatatcaatctttcttgaactaatatacaatgactctcagactcttaaaatttacagatggtgtggaacaaaaatgccttgttgtacacttgaataagcctgaataataaatataggattaacatgtatgctgaaaacatcagacaagctgaat

SEQ ID NO: 98031 - DNA, 1003 bp, Homo sapiens
gtattttaaaatattgaatcttcctatccatgaacatgatacatctctccatttatttgtcttattttacttctatccataaaaaagttttctttctccataaaaaagcgtgacacattttgtcaaatttattcttagtagactatagttttgttgctttaatgaatgctgttttttaaataacatttcctaatagattgtagctggtgtatagtaatgctcttgatttttcaatagtgataatctatcagtaaccctgccaaactctcatttacacaattatttatgattcagtgtacttctatttctttcacttctttttttcctggagtttttgcactgaccatgtctctgctacagtattgatgtagtgaaaacatcatgaccttgttcttgaaaaagggagcaatttcagtgattcaccattaaactttacatgtatgcatgcatgtatacatacatatatagacacacacacgcatactttgtaagtgggaagatactcttaaccagactttctcaatcttagcactgttgacattttgagccagattatttctttgctgtgaaggtctgtcctgtgcactgtaggatgtttagaagtatccctaggctccccatagttatgataatcaaaaatgtctcccaacattgccagatgttccctataggacaaaatcactcatggttgagagttactgccctaaatcaattaaggaagccattttctaccatgtttgttaagagtttttaatcataaaaaggtatggaattttaacaaatgcattttctgtctctgttgaaattaccattttttctcctttaatctattaatatgggaaattacattattattttctaatgttaatcagtgatacagttttattagcataccatagtctgtgaattgtacaaaactgtgatacttttcctcagtttcgggggtgcaaacattaaacaaaacaatataagttagatcccacattagacactgaattttaat

SEQ ID NO: 98032 - DNA, 1034 bp, Homo sapiens
gcaggagcgcaccggtgcctagcggctggactccgctgccgggcgtcccgctttcccccggggagccctaaacgctccaggccatggccgagggcgcggccggcagggaggatccggcgccgcccgacgcggcggggggcgaagacgacccccgagtgggcccggatgccgccggggactgcgtgacggcggcctctgggggccggatgagggaccgtcgcagcggggtcgcactgccaggcgccgcggggaccccagcggacagcgaggcgggcctcctggaggcagcacgggcgaccccccggcgcagcagcatcatcaaggtaagcaaagccgcgccgcaccgggagcgtggctgtgggtgatgggtgggtcagggacccgggcaggatgtgcggtgtccggaggcatccgggctcagcattgttttctcccacctccttcaacgccaaaccttccttccttatccggaggttcccagactcagctgtcagccacgagacgcacaagtgactttttctccccactgacggcagaggaaaagttccgctctgcgtctttgcgttctgatggatgctttccctcattttctctgcaagcttcactaaaccgttgatggagggaggaagggagaactctggataaatgcagacccaccggatggttgtgcattgctttccaatgaagggttagcttttcccatacaatgaagaaaatgcacagcttactctcaagtgtaaaaaaagaatccctctagacttaaatgatcccgaaatcccaagatgtgtgaactttcccggtagggaggcagagttttaagtggaccctgcatcacagtaaagagcaatgcaagagcccagagtttttgcgctgcagaaagcacaaccggaaagcaatcaatcccccaagcattatcactggtccttgtggttaccaccacatccagggaaaacgcttcctgacccgctaatcacctcacagaatttctctccatccatttggcaaggaatttgtaaacctctttcctccccttt

SEQ ID NO: 98033 - DNA, 1029 bp, Homo sapiens
atatatttaatgatgtagtattcaggtctaaaaaatgaacaaaatacttttaaggtgttatgtttcaaatcaaatgtgggttttgtgatataattttctttgtgacttatagtccttttttgcttaatgaaaataaatcaaaagaacttgggcctatcactcagaaagcaaatgaagtgaagaaactgacactttaatgattaagttgactaaagtgtcacagcttttagtgaggtaatttcttgattaaagaaatgatgtttttcagctttcagaaggaggctagactttcctttccagatgatatcaaaatctgataacaattccttgatttattcaggccaatttctgtgttttgaagtaaagccacttatctggcatttttcattaaggcttgacaacagctggctgcttcccagaatgcagtgctgtgacagagattatgttataaagccatggatcagctgcctttgtaatttgcttaaattgattatgtgtacatttcttcactctctggacttaaaagaagcctgcatttgggtgaggaaacagtattattatttcaatgacaaaagaccatgtctattacgccatattacacatagacacactgccttttccattgtgctctaatagtatttttagtttcaatctttttggaaagttattttaaatactatgatttctatttcggctgaattttgtagctttaatcaaataattaaagaagcaatatttaagatcagaaaagcattatttaaatgatgaaagtatacagtcttaggaaagtagttgatttttatttgtcctttctgtatgttaatatctgatacagatacttgctgatatgctttttaagttaaaaaaaaactaataagtaatcattatctaaagttgcagggagcccatatcttgctgaaagttctacaagaattccaagcactgagattaaactagacatctataccaataagtttagataccttgtttaaaaacaaatgttgccctagaagtacactagcaaagtac

SEQ ID NO: 98034 - DNA, 1042 bp, Homo sapiens
caaacaacatgagttgagacacttgaaaaatgtgaactccattcctggtatactgaaagccatgtaaccacaaattcttgttggttttaatatgaatatcctatttcacaaaccccaaatagtgaggttagagagagaatactcactaccctgaatatggaaaaattaatgcagctgaattattagtaagggcagatctagttgctgaaatgcaaataggtcaacagcaagttaatacaatccaacagagattcaaaattcttggtttgaaaggagtcccatatgctactgaaatagcatcataattttctgatagctaagacaagtggaagcggtagtggtagaattagtgcccatgttgctctaatttctatacaatgggttacgcttttgtcagtcaccaggttgatttagacatctgttggtaatagtggtaaagacacaattttaacagtcaacaaatacttattgaatgccaactatgtgtcaagcactgtggtaggtgctgggaatgtgaggggtggtagataaaaagggaactaaggcacttgcttattcttgtggaattaacaaacctactgagggttatccagatatggaaacagtcatattgtgcttcaggcattacttgagatatacacagaatgcagtgtggcctagagagggcagctactcctgccctactgtgagtgagagaaggtttgcccaaaaagaatgtatttgaattggacctttgcaagtgattaggattttgttgggctaagaaggaggaggcagaaagagcatgcaggcacaagaggagtgtttccaaagtccaggaggtttgataactcacctgggactggaaggtaagttgatttggctggatccgcgtgaagtataacattattgcatgtaagccttgtcttagtttgggctgctataacaaagttccatataggcttggtggcttataaaccataggaatttatttcccacagttttggagactagaagtgcaagatcagggtgccgacatagtcaagttctggtgaggaccatc

SEQ ID NO: 98035 - DNA, 1029 bp, Homo sapiens
aataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggattttttttttttttttgagttgtgctttcacaaaaccttgtcaaagacctcatgc

SEQ ID NO: 98036 - DNA, 1109 bp, Homo sapiens
aattcagtgttgtttacacctagacaatttttcttttttagaatttgctgtcctgttatgcatatttgtttatcttcactcttagcatgaaatgctgcccagttgggtaattttaaaaaattgtagctgactgacacaaattactttttctgagaacagatgactataatcttgctaatcttttacagagaaactgcaattgagaatatattctataggcagggtgatacgatatctaacaagaggaaagattcttgggcattggtataaccacctatgtggtcaggggttggtttttagagtcagactgtttcactatctccccacgttggcaggaacaattttgacagaaaaagatgtactgtgatggcactggaccgcagtcaaggccccctcagctcctctacactctgcaggttaatgcaagcgacctcctctctctacagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtcagtgtccccgaccgccgtaccccacctgatcagggctctgtgtgccagcagtagctgctgagggtccaagtggcacacaccacaccaacttctgtcagagggtgtctcatgccaggtccccaagtacagaagacgctgtcgtcacagtgggtactgtgtgtatgtgtatgtgtgtgtgtgtgcatgtgcgtgcgtgtgtgtgtgtgtatgcacacacaaagaaaaatgactgagaagttgaatgccaaagacagctgctttcctgagatcattttacttgtgggattgtaaagccagagcgctcacggagaattaaatctctcgatcggaaaacatggtttccatcagttcattttctataaaaaacctgtgaagtagttttgcatccaaaatccctcaaagaatgtttgattagactgaggaaaagaaatagccacatgacctagggaataccattgaact

SEQ ID NO: 98037 - DNA, 1029 bp, Homo sapiens
tgtcaccttatattttgtgttcctggatttgtgcttcatggttataccaagagcaaatcgtgtgtgttcattttgtcaccttatattttgtgttcctggatttgtgcttcatggttataccaagaacaaatcgtgtatgtgtgtgtgtgtgtgtgtgtgtgtataaaataaaataatatgtaaacatttacaaataaacctggaactgttagaaaagaaaaccctgcccagtttttcatgtttaagatttccagatgaaaaacttaaattcataataaataacatttcaaatgtcagttctccaaagagaaactattaattaccctgttatggctgattcattgtcaccatatcatttgatgatgtaaaataacacagttaagagaatagagccatattttcaagagcttctttttagtttatttttattttaataaatatgtcttttaagaatataaaatgtatttgtttgataaaatgatgccctatccacactttatgacaaggtcatggcatctgctggagtcagagatagacagccttttgccaatattttattatttatttatttttatccttacatttctcttttggtttgctaacagaaacatacatggtctaaactaggaacataaaattgagtcacttgttctggggtagggatacagcacattagaggtcatgcaatgccaggatatgggatctccagcatgagcctgagactaacgtgtttctagacacagggtgtggctgagccttgtgtcctgtctgtgccattaggtcattatgaccttatgtaaaataagtaaaatacattctgagtatcaccactcttttttttttttttttagctagtcttttgaaagatgagattagccctgctttctgtctctgaagacttttatggcaaatgagacccagtgaaaacagtaaggtgaaagtgataaggcattttctgacctggtcattaatattcaggcaatcccatgatacatttctaagcactttaacctgtggccacaaagtgag

SEQ ID NO: 98038 - DNA, 1057 bp, Homo sapiens
aaatcatattttataaaaatagcatctcttgtattgcaaatgactatttttcttggatgagtgggatgacaaactcaaaagagaccccttgggccctcgcaaagtcttggagaagcagttttacttcccttccttcacttagaccccattctttagcatttcttctgaagctcccacaagacccaagaatggctgctgcagtgtctcctcttcagtcagggaccctggttgaggtttgtgtattgttcattattgctctgttttgcagttgttcaaagttggaagacttgcctgcggagcagtggaaccatgccacagtccgcaatgccttaaaggaactgctcaaagagatgaaccagagcacattagccaaagaatgccctctctcccaggtcagtatcttcaggtgggggtctgggaaacagaagaagccattggtagactctctatcagggggttccttctgcttaaacaactgtcttctctgtcttttatttatagacttaaactgcatttgaggtgtaaaagattatgttgcttctggttgtagaatagaagttatagcttattaaccgggcatggggtagctcatgcctgcagtcccagcactttgggaggctgaggcaggctgattgcttgagctcaggagtttgaaaccagcctgggtaacatggcgaaaccccatctctacaaagaatacaaaagttagctgggcgtggtgacatgtgcctgtagtcccagctactcaggaggctgagctgggaggattgcttcagactgggaggtggagattgcagtcagccaagatcacaccactgtactctagcctgggtgacagagtgagaccctgggtggttcttaaaaaaaaaaaaattagcatttattgagactgggtaaggagagagtattaaaacaatttacgtatacgggccaggcatggtggctcacacctgtaatcctagcactttgggaggccgaggccagaggattccttgagccttggagttcgagaccagcctgggcaacatagcaagatagcgagaccctgtctctaaaa

SEQ ID NO: 98039 - DNA, 1044 bp, Homo sapiens
acatgctgtcaagaaagccaaggttgaacttctaaagtcatggaatgcaggtacatctttctaattgaccatctttagcataaacttactccttagaaataagttgttttattctgtggggagaatggattattttcagggcactgggggtgccatttagaaaattctctctcttagtgcgtttaatagtttcctggaagatatgtgttgacttctgctgaagggtaatatattcatagtaaaactgactaaggattctttttacttcccactggcctaaaaacagtgtgttctaggcctctgtggtggtggaaggtgaagactcaaaatctggatgttgtgagttgaagcacttctcaaaggacctgtgtccctaagctgccacagtcatttgtttgtcttgaattttaaaagggctttgaaatgtgtggaaccaaaatagttctgtttgtagtactggtgattctgggaaaacgagagcatggttgtctgtgtgggagagagctgatgtgggtcgattaccagtggcactgtatcgtgttggttttgctctgcagtgatgggtttctcactgagctgcccagaatcactcactcgatgccttttgggatcgatgacatttgatttgtaatgagtgggcaggaatgggagtggagaccagatctttgggtcaaagagggaaaaaaggaactccgtacagcagatcatagtctcttttgcatctgattccagcctgatgaattctcacacacagggggcattattctatataactaagacttgtattagatgctttatgtaatgctttctttttgggtacattttctattacgtgtaacaaaacattgactgaaagtgtttatttaataagagttaaaatttactaaaccaaatcaaacaaatcgaattgttcaaaaatgtttggatgtagaagcaaaccacgttaagatttgaaaataaattcacattttacattagtttttaaaataaaactaataaactaataaaatgtgaaaaaatttcacattttatattagtttttaa

SEQ ID NO: 98040 - DNA, 1006 bp, Homo sapiens
cctggctaatttttgtatttttagtaaagatggggtttcaccatgttggccaggctggtcttgaactcctgacctcaggtgatccgcccacctcggcctcccaaagtgttgggattacaggcgtgagcctccgtgcctggccgacaattttattttaaaacaaacgtgcttagcaaataagcaaaaatcctttctgactggattttttttaaggtcaaaattatatgtttaagaaggggtatattaattgtcactgtttcttatttatattggagtaattacattcatgcagtcatttaaataatgtttctaaaacacagaaaaggtgtctttaataaatgttatgtgaatcaagcagggtgccaagtacattctcagtgatataaaattccacatatatgcatggaagaaggatgaaggcaatgtattagaataatcagcagagtaggtgatgggattatgtgggattttcttctttttctaataaaaaaagtaaatatcaaattttacttccttcatgaattctttgaataaatgggaagataattatgtcttattccccaattttgataagctgttcacttcatccctaatttatccacaaatgtgaaaatttatacatgatacagatgtatttctgttttttcagtggaagattaaaaaaagaatcaataaatcgttaatgagcccctgtaatgtataaaccaagggatttcttagagttggtttttttctttctttctttcttttttttttttttttttgagacagagtcttgatgtgtatcccaggctgcagtgcattggcacaatcatagcttactgcagccttgaacttttgggttcaagcaatcttcctgcctcagcctcctgagtagctgggtggccatgccaccatgcccagcctaatttttactttattttttgtagagacgaagtatccttatgttgcctcaggtgattctcctgcttcagcctcccaaagtggtgggattaaaggtgtgagc

SEQ ID NO: 98041 - DNA, 1025 bp, Homo sapiens
ccatgtccctcttccccaagtaaacagcaattaaatagtcaaggttttaaaagggtttctttagtttaaaaaaaggagtagttattttaggtgaatttaacaattttccattagttcacattgcaaaatagtgctttggtattaacaaggaagttctgtgaggctgataatgtagtgaaaatatttttcttttctgtccctctcccctgtatacaagaaaaccctgtggtaaaattttttaataaaaccattttgcatgacagttgaaacttataaatcagttgctattcttctttattagaagctgagagacaaacatgttttaagttttttgtcacctgtaattgtaacattgactagaaaggaagaaattggaatcttaatattaagtcattacgtgactgaatttttcagtattgtttattttggaaaataaactgtgatccttaatatgatctttttgatgtattaatactatgttaaagttgagttattataggaatctaattacatgttaagtgggaaattagaaagcactaaagaaaccttgcaatgataaattgtcttcatccgaaaaccagaaggtattcagagtgaaggtgcctgtcaggagagaagcattcctagagtctccattcagacatctccattcagatgttgccctttagatttgggaaatgtggtattagaacaccccaaaccctttagtatcgacggagtataagaagagcaaattgttccctgaataggaagttattacacctttaataaccaggtaaagtcactttacaagggtaaataaggtgatcctgacttttttccttctcaaatgaatctctaggtaatatgcagcaaaactacctctatttacagcctctttcatatggcaagtttgagccttaagcacgtttttacagctaacttataaactcccccaaaactggggcttaccattgaaagtctgccaacactgttacaaatggtcattagttcccaagaaactttgaggaggaaaagaactgtat

SEQ ID NO: 98042 - DNA, 1186 bp, Homo sapiens
tttagtcttggagaagatgcagaaaaactgaagtgcttttcgcatactttgttgtgtttattagctaaaatctgttttagggagagaccatttggctctcattcttccctgggaagttcaaagaggagcccatggaaagtggttgcccaggagacattacaaatgaccattgactttgtcttcatacacagtttgaccaggaaaatcccattttcttaaattctacctgaggtggaactactctctccccctcctttttttttgtctctgtaaatggaagtcagaagtaatgaatgttcctcttgttacaaagcccagccaagtaagggttagatggggttcctaggcctgctgttcttcctcttcccaaagtccaaactaggctgaaggggagagagttgaggctgaataatgagcaccctcatttcttctcagcacacaccggggtaacctgagttgctctgtgggcacatcacctgaggtgtactcacctgactgtcacctgaaatgcagaggctcttgcttcgacctgcaatcctctgaattatgaaatcgatgtccttaacattgctgagactctggctctcattccacagagctatgctttcagcaactccgaatgaaccgccaggcagcaggggctgcctggggctcgttttgcctcactctgggctgtatttgttactctattaatagaaactgtgagctcctgaagaaacctaggtggtgacggtggagttcacccgggaaccttgacttagggtggggatacctgaggtggggataactcgggttacccccatgtgtggtggggatactaaaactgcagataatgtcggccatcagagtagtcagagctccaggttttactcagttgacagacttaggggggaatatttctttcatctgtcgctgagtttcttggatttaatatttaaaaaccttcctgaggtgacaaaatgaaagaaacaagataggcagtacatcctcctggtggaggtctcataatttcagaactctcccgagcatttatcatcccttttagagtgggatgtatatcaaacagccccaaaaaagcttttttaaaaaagttatttaatccatagagcctagttaatagtgccttcattaaaatgcttttgtcagcaaagggttttcagttttaacatttgcgtaacctaacagt

SEQ ID NO: 98043 - DNA, 1026 bp, Homo sapiens
gaattggcagagtattaaggctccagctgagaccagtgtgaattttttccacaagctcaggtgtgcaaaaaataccacgttatttttttaaaggcaatttaaaattaattctaaacctcaagttaatgagggtggagggtaatccattctcagtcattattgggactcccagagttgtccaaaagccacaggtattgtggagcccccttttgacattcagatataaattatcaatcagctcataatgcttactgctgaaataaccattgctaccaacccttgaccagccctttagatccaataactctgctgcctgcttggggtgtagaaatatgtttctagttagtagttcctgtgcctctagtccagctttcctacatatcctctgatgtcttaccacatctctggtactaacattctgggatctgacaacttctgacctttcccaacaaaagatgtaatatcatggttataactgtgcctggagaagcagataaaaagaaaaatttaaatagtgttctaagccagattggagagagtcgtggagcatatacttaactctaataattcgctaagagatgagctgcaagctagtgggaagtacagaatcctattttgccaaatcaggtaattaagttttgaaaacatttactgtaaaactttataaaatgtgcaatttgaaatatgttagcaacacatttcctgggaaactaaattctagaggatcagcttgagtatagtctcagcagttgacacagcaagcagagctcagctgcagtggattaaggatggctgcaaattctttgacattcctcccatggagaaatggggtctaattccttaatcctttaatctagactggatttagtgacttgcttcatcaatggaatacactcaaataacattttggaatttctgagactgtcataaaaagctgaagggcttctattgggcttcctgaaatgctcccttttggatccctgagcagccatgtgagtttaactactctgcaggagagagtatgtg

SEQ ID NO: 98044 - DNA, 1013 bp, Homo sapiens
ggattcagtaaaggttgtgttgttttgaatcagttgctttttgaattgaaagaagccaagaaagacaagaacatagatgcttttatcaaaagcataagaacaatgtattggctggatggtggtcattctggaggaagcaatacttgggttacttatccagaagtcttgaaagaatttgcacaaacaggaattatcgttcacactcatgtaacaccttaccaagtacgtgatccaatgagatcttggattggaaaggagcacaagaaatttgttcagatacttggggatcttggtatgcaggtgactagccaaattcattttacaaaggaagctccttccatagagaatcacttcagggttcatgaagtattttgagattacaggtatattaatgaacttgttcagtggaagaacataagcacttttgagtgttataaattcagataatgggatgtaattcatagctgcattgtcagttttggggtatggggggaagcacacattcctaaaatgtgagtgtaatgtgcaatagtattttttgcttgtgaatgtgagcagttattaatttggattgagttagaattagttaatttgaaatctaacaaggtggtttgtaataatgctgaggagatataagacccttaaaatgaaagttacaacattgttcttataaaaggtaactaaaattgttactgttggaaataactgattttctgagtaatgttttaaactaatttggtgacattttaacagtaattagctattttgagtggaaatattttcatttctcttcaaacaaaagcaaaggtacgatgctgttttctatcattttggaataactgcaccctgccttttgtgtttttgtaaactccttgactcattctttcatgtgtcaccaagtacttttctcatgagagtcaacatatatttgtttccaaatgtccacaagtgtacaatagtgtaaaggtggtttttaaaaacatagccaggtgtggtggcacgtgcctttagtt

SEQ ID NO: 98045 - DNA, 1039 bp, Homo sapiens
aatttgcttaacactgctacataatttgggtgaagtttccttctgcccgtttttcttgacctagataaatacactttgagaaatccagatctaataaatgtcaaccaacattgacattgtaattgggtgattacaataaaaggtgagcagtttgttgtttattaataattagcttttgcaggtaatgaaatagcagggaagtaacatgctgctttaggactaaaaaaaaaaaaaaaaaaaagacactgaagcttaataccttaatgacccagaagacctagatttataaagccatatagaataaaaatgttaatttcttggtttcttcccagaattatattttaatgactccataaatacattccaaatattcagagattcatgagaaaggattcttaacaaatgtttaaaaataacatttctttttggtgttttaacacttaattttataaactgcagaacagcatctctaaatggctttttttttttttttaaagacaaagtagtattatgttgcttcagtttctttaaatacctcgtttcttttgagaccaaaaattcccatcaaggaaataaatcagcctgattttaacattttacatattacattgcctttaagcactatgattggatggctttttttctatttgtttaataatccttggctaaattcacatgtatctaaaggaaaatagctgagttactgaattctataaggggaagaaaaagcatttattttcacatgattaactgaaatggaaaagtaagacatttagcagaataattcatttaaaaataattttaaaaaatcagacatatttaaaaatctaggttgtctatccagtatgtgaatgcttaattataattgttacatgttgaatgggtattaagagtaagtcaccaggtacacaaaactgccatcatagcaaaatgagacagtgttgaaaagacaaaatattttctggaatgaaaatatattcaagttgatccatattcagatgttttctgtttaatacttcagattggtcctttgtccaca

SEQ ID NO: 98046 - DNA, 1003 bp, Homo sapiens
ttcacctttattcacctgagtaacttacctgtttccaaagacacctaggaaattcagaatgttatatatgcttttccttatttactataatttataggacatgagtggatggattctcttcaatagagaaaatgattttctctaattaaaatgcaccaaattgatgtactaagagattgctttagatgaacacatttatgttcagtgaagattatgtggtcttcaatgacactgcaatataattactaggtacaaaacaaaagcagagatccacacacaatggctcactgtcttcgatgacaacacttttaggatctcatttattcattctttaagtaatttttcttttaaaaaagggataggtggaaaaaatagttgggaaatctttaactaggctaaggtttagacataggtataaattatttattttgtaacattcaaaaaccaaaaaccaccctgacatactgggtggcaagaaaagtcaagatcagattaaacatttgttttgcactaatcacaaaactaataatccaagtcactatcatcaactccagttgatctcagctctgattatgcatcagaacaccctgtgaggtctattaagttcctataccaaatcccaaacactcttgaatcagtctacaaagttgggacctaggtatctgtacattttttaaagttcctcaaaaaattctgcttctaggcaaatgtaatagatattgtgcgttgctcatgtttttcctatcagaaccatgattttaaaaaaactatcctttctgtccccatatatccctcatgtggcctccacttctactctcagctccagtggacctgactgccctaaaggttattctagaccctttgccagtgactggctcagggatggacaggtctaagttactttagagcaatgagacctaaggatatggaaagtgaattctgggaaagctttctcatactaggacagggcccctagaatccagcctgactcttccgctgcatg

SEQ ID NO: 98047 - DNA, 1552 bp, Homo sapiens
tcacaggattaaaagggtttttcctgtgattagtgttccatctttgttatattgtggtattgctttagtattcctctagcacctatattctgaaaatgtttagattcaattgaaaataaagtaaatttcccaataaaaggaaaaaaattaattaggtatataataaagtttactcatcatttccaccaccaaaatatttgctgtagttttgtatactatttataaaggagctgaaagaaatataagatgattataattgcattcaaaatataaaacgaggaggctataatgaatacgaatttaagcaagttagaaaaccaaatcgcagcttgaacaggaagtctttagggacaaaagtattataatgaatcagaaaaggtcaaagatactcctcaagtaattgaaatgttctgtgtaccaaaaaataaacactttgatgtggttgtatgactcaggaagtataaacaagtaacacaaaacacagccctagattagagaactgcaaaacaaatatatctttattatgtctttcaagtttaaaggaaaaattgctatttctaaaggttttaaaagtaagggttgtgctattgacactttaaatttgttggcaattcataaaagttaaaatgattctgttaaaagcctggagtgtgctaacgaagggatctggttacaagaattatttcttacattggctatatgcaattcgtgatatttcactgacattttgggtttttttttaactgtaggttttatttttaacttgttttttaaactttctccagctttatggttccataatgtaatttctgaagagtttggagtgggagtgaatatcttttggaagcaccttccatctgaatgctatgataaaacagatacctatggaaacaaagatcctacagcagcatcaagagctgcacaaattctggacagagccttgaaaacactggccgagttaccagaggaatatagggacttctatgcacgacgaatggtcctacacattcaagacaaagcctacagcaagaactctgagtaaataatgaagtgaatgcaatgcacattaacactttagtaaggtataacgatataaattaaagattttgttaaaataggaaagatacatcagatttacagattatgtaagtacgaaggggtgtttgtgtggattctacttgatacagattgttataattaaagaatgctgtgctgggaccactctttaacattcagatgctgaccactaaaagtccaacttaaaatgacttaaaaacagtaagaaaatatattgattcacaatacatgaaatctattgacagaatgtgctgcagtgtttctgatccaatgattcagtaatgtcatcaagaaccttgggaacccgcctccacaccccacccccttttcaaccacaacattggcatcatcctaaggctggctaccctcgtggtcatgggatgattgccagtagcagttggagccttgtgcatcttcatttacatgcagcggaagagtcaggctggattctaggggccctgtcctagtatgagaa

SEQ ID NO: 98048 - DNA, 1005 bp, Homo sapiens
gccttaaataggcttaactatgctgtcagttaatggtgaggcaaaggcaaatcgttttctgactccacattttctaatttgccaagtcttcccattttagggcagtactgcagaaatgtcttgaaggcccagttgtatatggaatacaaatgtttttattgttaggtaactgtaagagtcttaagtaagtcaagtctcattaaaggatcgggtttgcagttaaagtttagcatgccattggttctatttatttgaattttagataatgattacccataagcttttattggtcttcaggtaatggataatttgttaatacaagtgacaggaaaaaagcgtgttgtactcttcagtcctcgagatgcccagtatttatatttaaaaggtatgggattttttttaagtttatatttcaaaagtctattcagttactctttttgagaaatctcttgattcttataggaaaagaacacttcagtacttaatcctaattgtatttgtgtatatatgtaataacaggttcaaatttgaaattatcttattacatgggtatcagtcatcagaattaaagagtgagtcattgaaaattgtcttaggtgtcagtagcatagtaattctcacagtgttggtacagtaagtaactggatagaaaagaataaattttcaaatttatatttgtgattactttttttaaaatgctaactttgctgaatctatattatccctttttggaactttttaggtactaaatcagaagtactgaatatagataacccagacttggctaaatatccacttttttccaaggctagaagatatgaatgttcccttgaagctggtgatgtattattcattcctggtaagatttctagacctcactaatgtgctatttataaaatgtgtactctgtcactcatccttcatgtgattttttttttttagtacaaatatatatttgttatatgtatccggtcctatacaagatgatttttagacaaaactctg

SEQ ID NO: 98049 - DNA, 1370 bp, Homo sapiens
tttaaagctacaatagatctttagcattatagatttaacagtcacagtttcaacttcctataggttaccctaaacatctgtgtaatttgctgaaacatgacttttgaaaataggtgctgtgcatagcagtgatacaggaatgaattattttgctaatggcaaagcctagttggttcctcacatttgtatttccctgtggtcctattcttgattcatcatcatatatataccaagttttgtgaagtgatttttttttccatgtgaaaaatggccaccagataatgggggaaattgtattggaaaaagtgataagcctttagtataaggaggtataaatgatacacatgactctggctacccagagatccataactctctgggtcatgcaaagttatgttattcaggaaaaaggctgaagcttgttgagtcattaccaattgtaagaatttggggatatctgaagatcttaggatatatatgccttgagaatgtcaaatatctgctgtatttgtagggcagcaaaaatgtgtacaatattgatcttgatctgctgggcgcggtggctcacacctgtaatcccagcactttgggaggccgaggcgggcggatcatgaggtcaggagatcgagaccatcctggctaacacggtgaaaccccgtacctactaaaaatacaaaaaattagctgggcatggtggcgggtgcctgtagtcccagctactccagaggcttaggcaggagaatggcgtgaatccaggaggcagagcttgcagtgagccgagatcgcaccgttgcactccagcctgggcgacagaacgagactctgtctcaaaaaaaaaaaaaattgatcttgattatttatgatgttattttgtttgcttaaatttatgtacacatctataagcgttttaaaaacattaaaaatactagtatggtatatggtttggtgttgggaagtagagaaacttaaggaaggtaaaggaatatctaacaagtttccaaagaaaaaaaaatttttaagttctaaatcacagtataacattttatacatgtgttttgtaattcagttgagaccctcttgggaggattttaccatagtcagtaaatctgtaattatgaaatagacatgaactcttagcatattttacagttttatatgaataacatggtgagaaaatcatgtggtaatacattttaactatattctatgatgatgatgatgatgattgttgttgttgttttttgagacagagtcttgctctttcacccaggctggagtgcagtggcacgatcctggctcactgcaaccagtccctcccagattcaagtgattctcgtatctcagctacccagatagctaggattacaggc

SEQ ID NO: 98050 - DNA, 1072 bp, Homo sapiens
tcccgagtagctgggacattcagctaattatttttactatttgtagagaaggagactcgctatgttgtccaagttggtctcgaactcctggactcaagtgatcctccggtgttggcctcccagagtgctgggattataagcatgagccactgtgcgaggccaaaaattattatttatccttcaccaagtaactagagaactgtttgaattataaaacattcactgttagagaagtgagatataccaagtcaagcacttgggcaatccaaactcagaattctgcctctttcacccaacactgagaattataacataaacttcaaaagataataatatttatcttaagacataaattgatgattgaggttttaattgaactctcagtgcttttctatttttagctagcaccacatcacatagattctataaattactggctaataagtttcaaaatgttcttcgaaagtctaagggttttctactagttctaacatttcaagatttaaaaaataaaattaatgcaccagacacagaagtgcactgctcagaaattccttcaagaaagaactcactgcttcattgtaaggagtgtgattagcttagagctaccagctgttaacttcttcaggtccacctcaggattggaatctaggtcatgctcttcttggggtagtcacaaccagtgacttaagctggtaaaagacctagacattgccacccaatgcaggacttttctcataggcagtctgctcaggagttccaggatgagttggcagagactgtcagatctgtatctacatgtcttcccctatccaatcctgcttcctcccctttcctttcacagttatttctcctatttaacaagacttttgcactccttgtttttcttttctttttttttttttgagacggagtcttgctctgtagcccaggctggagtgcagtggtgcagtctcggctcactgcaagctccgcctcccgggttcacgccattctcctgcctcagcctcccaagtagctgggactacaggcgtatgccaccatgcctggctaatttttttgtatttttagt

SEQ ID NO: 98051 - DNA, 1424 bp, Homo sapiens
ctctagcctgggcaacaagagcataactgtccaaaaaaaaaaaaaattcactgtgttattcaaaagcacattttaaaaacaaattgctttttaatctttgaatgaagctgttttctgcatttgagccagctgggctggggagtttggttctaaaaggtgctgcatttttacagtcctcttgtcaggtaatagttatactagattactgccacaatccccacaaactctgtaggtctgtgattctgtagtataaccaaaatgtctttttaaatggattccattagctgcacctgagaactgttttataactttatagccatgctttgaacatgtatattcagttgccctttggtactttgatgtctaagggtaatcagtggtatatatttaaatagccatgaaatgtgaagtaaaagaaatagacacgtggtaaaagattaaagtctaaaaatcatggaaactatgtaaacaagatcaacttgaactgtcagtttggtcctctaagaagcagatgctgagatggaattaggagtgcaaaaggctggccgggcgcggtagctcacgcctgtaatcccagcacattgggaggcggaggcgggcggatcaggaggtcaggagattgagaccatcctggctaacacggtgaaaccccgcctctactaaaaatacaaaaaaattagccaggcatggtggcatacgcctgtagtcccagctacttgggaggctgaggcaggagaatggcgtgaacccgggaggcggagcttgcagtgagccgagactgcaccactgcactccagcctgggctacagagcaagactccgtctcaaaaaaaaaaaaagaaaagaaaaacaaggagtgcaaaagtcttgttaaataggagaaataactgtgaaaggaaaggggaggaagcaggattggataggggaagacatgtagatacagatctgacagtctctgccaactcatcctggaactcctgagcagactgcctatgagaaaagtcctgcattgggtggcaatgtctaggtcttttaccagcttaagtcactggttgtgactaccccaagaagagcatgacctagattccaatcctgaggtggacctgaagaagttaacagctggtagctctaagctaatcacactccttacaatgaagcagtgagttctttcttgaaggaatttctgagcagtgcacttctgtgtctggtgcattaattttattttttaaatcttgaaatgttagaactagtagaaaacccttagactttcgaagaacattttgaaacttattagccagtaatttatagaatctatgtgatgtggtgctagctaaaaatagaaaagcactgagagttcaattaaaacctcaatcatcaatttatgtcttaagataaatattattatcttttgaagtttatgttata

SEQ ID NO: 98052 - DNA, 1138 bp, Homo sapiens
gggcaggcatcaggcctcagtacttgtttcctctgaacacacagaggagcatgcagcatttttggggtcactccagtcctagtggtcctccagctgttagctattttcacctccttccttgctattaagcagtatttccaccccattcatcagccagcctgtaagcattgttgcttatataaagcaaacaacctgaatttcagtatcaaggtgtcggaggggttgttttctcctgaggcctctctcagcttacagatggccgtcttcttgctgtgtccttgcatggtcctccctgtgcatgcgtgctcctggtggctcttactccacatttgctcctcttataaggatgccagtcagattggattttggcccaccctgatggtctcatttaacttaatcatctctttaaggctttatctccaaatatagtcacatttcaaggttctgggggttagagcttcagcataaattttcggggaaggagagcacaattcatcctataacagttaggcagtattctctgacatgccatatctgacatgcctgtgcatcctctggcagcctagatttcagcttagatgtttcttcctttaggaagccctctctgatcctcccagattgggttagaaggctcttctgtatgctcccaagtcatcctgttcttatccctgtcaaaattcttcaacttgtcagtttacttgtccttttcccatgtagactgaaagttccctgaagacaggtaggatcttaactcacagtttgctttctcattgctagcagtgaggagaattgcagttgggtttttccctccttgaaaatggaatttcatacttcaaagttaggatctactgttttagaccacataaactaatgaccttctctcccactttcccaaacctacattatctcccatactgagattcagactacagcccagatttccagactcccaatgcagtctcgactgttctcctttccaactgctatctatgcatgattaagaggtaggtcatataactgccaaatgattgtttacttcatcattttaaaaagaaatataaaggaggatttttattgagacatctagattgtacaccacacactatcatttcccggtcctgagagtggatccagaatt

SEQ ID NO: 98053 - DNA, 1065 bp, Homo sapiens
taaaagcatgctaagatacaaagagagagaaaaaaacaggacagtgtcttagccacctatgggataatatcaactattctaatatacttgtattttgtgtcctagaagttggagtagtggaaacaaaaatagtatgttaagaaataatggctgaaaagtgtcctagttgatgaaaactataagcccacagattacaagaaattcaacaaacaaggtaacacagagaaaaaagtctgatcaaggtacatcataatgaaattgttgaaaaccagagaaagttgcaaaagcagctggaggaaaaaaataaaggtacattcatgcagagaaaccaagataagaatagctacctatttttcttaaacagcaagttagagaccttggcatgctatcttaaaagtgctgaaaaaataaccggtttacctagaatttgatattcagcagaaatcttcaaaaagtgagaagactcagagaaaagatgagacaattgattgccaatggacatgttttataagaaatgttaaggaccaatggacagaatagagttcaaaaatggacccatgcatatatggacaattgatttttgacaaaggcacaatgagctgtgtgtggtggtgtgtgcctgtagtcccacgtgcttgggagactgagatgggaggatcacctgagcctggagaggttgaggctgcactgagctgtgattgcactccagtctgggcaaaagggtgagaccctgtctaaaaagaaaagaaaacaaaacaaaaaggcaccaaagcaaagaggaaaagcatcttttcaacaaatggaataagtatatattcatatgagaaatgaacctcgacttttacatcacatacataattttagtgaaaaatttagattttaaaatggatgatagacctaaacaaaagctaaacctagaaattctagaaaaaaaaaaatagacatttgctgtcttgagattagcaaagattttcttaggatatagaatgcatgaaccatgaaacaaaaaaaatttataacttggaatttattaaaattaaaactttttgaaagacaacagtaaga

SEQ ID NO: 98054 - DNA, 1999 bp, Homo sapiens
gatcctgtcatgtttctccaagccttcttgggacagtagtgtccctagggttgggccactgctactcccttctaggcctctttagtactgagaactaccagcaagggtcaggaaacttgatagatatttagaattgaataatttgcctggagcttggcttttccctggctccagacccctgagagcaaatattcttgctagtttgcagtcccgctggtctctgagtcccatttgtacaacttggaaggagaaaggaagacagatatagggctgattttcttaaattatggtgcattcatatctttgtctctagtgggaaggttggtcttatgtgtgtatgagaaaggtggccgcctttatgttgtggtttcagaatccatactgctgaaaagggcacttcaaatatcaagtttctcttttttgctctccaatatgtgaaagcctacgttataaaaactctatttagtttcctatgaccagtatgatttagaagaaaaagaggacgggctttggcacttgaaagacctgattttgagtcatgccattgctggctatatgaatttgagcaagttatttaatctttctggaccccagttttctcatgtatgaagcaaagtgagtaacgcctacaattctgttatgattttgttgtgactaaataagataaaatataaagtgcctggcaccagggcctaaaatgcaaatgctatggaggtggtaagtcaaacttatcctcatatctcagtatatctcaattcaccctccttatgttgaataattttatagacctttccctgagactgatcaggaagaggatatgaaatctggggcaaggggcccagattttacccagccaagggtgacaaaggaccagaaggaagttgccttcacattttgcctaagtcccattctccctatgctttgcatttgtgaaaatattcatctgagattataggtacagcatgaagccttggaaaaaaggcatgtttacatcctctgccaggatagcataacaattaacaaagcaggtttttgaatctctgaatagtcaggtgcactgccatcaaaataaacttttatttctattctttgctgatagattacaaataaagccactaaaatatcctgaaaaagaagatttatatatgaattggacaccagggacagatttttcacacttattttgttggagcagttttttccttagctgtgggtgtttgggaagttcttttgttgtagcttttgttgcttacaagagggaaaaagctttagtatgctaaggtaagaatgattttgattggaggcaatattgttctcagtgtgggctgactttcacgtattgtagtgattaccagtacataactgagaaaacccatttgttgaagtgctgtaaacagcagagagtctgatctcacatactgccctgatcgacaagtgtttattgtaggaatgtggtcagtcctgtaattttttaagggaaaaggggaagatgttatgccagtcactgtgattgcaaatgccctgatctggcaggtctttttcctttctcgtttatttctcctgtggaatctgaatggtggattcagtacatgtactgagcttccagtgacttggtcagctcttgatgcaattgatcacaccactgtaattccataccctcaattttagtgccatatcaaaatcatgaacactcaaggagaccatgtaaatctacgtcctcaaaaattagaaataatggcattaaaaatgttatttagtgctggtttgtagcactgaatatatgaactcattcattgttctggtactccctgaacaagaactgtttcggttgcagtggatgatatcaactaaggtttccatggcagcactaatttataatatgaaaacttttgtggaatttcaccttctggactcttctcgattgcatttaaatttacattttcccctcatttattaaggtgaggcatatttagatattacttacatgtgtgtactagga

SEQ ID NO: 98055 - DNA, 1051 bp, Homo sapiens
gatgattgtaactttttgaaaagagccataaatattggtgggagttggttgttttccatgaatagaatcgaatattttacttcctcatatttgaatcacaatgaaagcactttcagttgttcaaagagaattaatatagaaacaactgttgattttctgtctttctgtctccatacacatgtctgcatgcacaggcgcacacactgcttagttttcctttggttaggcagctgaagagttactatgtagatcctggcagccttctacccatcagacaagcaagggcacaatcaattcctgttttcttgaaacgtataccaaataatcagaaactctgattattctgctggaaggcaacagcttgatggaaagatgtaccaattgaaaacaattctgatcatatttttgtcaggagaatgagatgcctccagctgcctgtcactaatcatattagaggtggaaagcaggaatgttttaccctgcaaaagattactctaatcatgtgttggaacgctacttgtactggctgcttatcccagaacggtgacattagacatcccttctgtaactggtcttgccagttggtagtagtctaaaccatatgccacatgagcacactttaggaattttctaattacagctcaaaggctttacttttatctttttatgcttgtactgcagacatcagtgattgaaaatgatttccccctcagcataatcctattgccagcagttatgaaagactaggaagatggtaaatgaagcccacaataactgaagaggtgtccgaattcaattatgaagaggcctgtcccatgtggacacataagccatataaatccattttaattgtgagctgtgatgcttatctgattatgtttattttcgatgcaagtgccaaagctggatttagaccagaattccagatcttcaagttctaatgactaatttgggtatccactgaatcccttaattcatttcttaatttgttctcccagaattagagagttgcttggttacagtcattttcacaaatttctcatggatcaaa

SEQ ID NO: 98056 - DNA, 1019 bp, Homo sapiens
aatattagccctcattaagaggaaaaattttattacaatatgtaaaatgtgtgtgtgtgagagagagagagggagagggagagggagagacagagaggaaagagagagatttggaagaatcagctttagtaagtttactggaaatcttcaagctttttttttttagagagacagggtctcactctgtcacctgggttggagtgcagtggcgccaacacagctcactaaaagttcaacctcctgggctaacacagttctcttgcctaagcctctggtgtagctgggaccacaggtgcatgccaccacaactggctattttttttattttttatagagatagggggtctcactttgttacccaggctggtctcaaactgctgggcttaagcgatcctcccaccttggtctcccacagtggtgggattacaggtgtgagccaccatgcctggcccaaactattttttaatacagtaaaatgcatttattatcatggcttagatttagtgaatgtgtaggagtgaaagtctactgagagaataaatctagtaatttaatgaactttcttcatagcttcataagagttagttaattatgatttcttaattcattgcccaaagaatgaattactggaattcattatattttttttttgaaaaaaaaaaactaagttagctgcctgtgtgtgtgtgtgtgtgtgtgtatgtatgtatctatgtattctagagaaatatatattatatgcatccagagatgtgtaaaatattctctatcagtaggagaatagattaataaattgtggtgtaatcatatgctagaatactatacagcagtaaaaaaatgaactagagctgtacacaataacatggatatatcccacagacatgatgttgaaagacagatatggcctgggtttgttagctcatgcctgtaataccagccctttgggaggccaaggctggggggttgtttgagcccaggagttcaagaccagcctgggcaacatggtgaatctcttttct

SEQ ID NO: 98057 - DNA, 1050 bp, Homo sapiens
ggctctgctgtgaacttcttggggaacattagaaagatgacctagtttttttaggtccaagtttttctcctcaggaaagtgaaatagttgaatgtggttgttttcaaccttcctctcagttctgaagttgtgtgactatgatctataaaggtcatttattgttgccttcataactcaagaccaaaggcagagtgtctgttaacactccatttcagtgactcccctgccacttatttctcttggtccaataaactattgtttttttgtttatcttccttttctcataaaacactaagtaatttcagagagaatctcattttggcattctttatatcctctaatgtatgatgtgtcttcgtgactactgaaaaaaattcttaaaagcagctacttccattattctctagtttttaaagctatcccctgagaactaaatgtcaattcaaagattcctgcatttgttatcatttctaccctaacctgtagaagtccaagacataatttgaaactgaaggattcttgcctggagacagtgggctcataaatatgtagcttgatttttctctataagaagaaattaggatttttaacaacactttttcagtatctaagttgaatatgcaaaattgggctgctgtacatgcttgcagatcctgtatttttaattgtagttacattatttttcaattgagtaataattttcaatgaagctactgcaaaataacaggttcttgcctaatgaaagattttacaaaccaaagactcatgtgttttaactctatctctaatttagactctgaaatatgccattcttcctttatatatgtcagatagctgtctgttttctaggccgagcatggaaaacacaacccaagtgggccacagaagaggtcactaatttcctacccagtacccattcttttcctcttccttagtaacacattctgattttattcaaagggataatgtccccagccaaaagactgcatttcctagcctcctttgcagtgaggggtagccaacacagagatcactaggtgggagttccag

SEQ ID NO: 98058 - DNA, 1060 bp, Homo sapiens
acaaaactgtaaggtaatgaatttttattattttaagccactaaatgtgtgctaatgtgttacagcagcactaggaaacacagtgtttcctctcctgttcggtaagaagaatagaatgagctgtgtcaccggtttgttgtaattgctaaataaaatgatttgtgagaagtacttagcatagggaacatagtgatgtatctccgccttgccagcgttcagacgggcaagatttcccactgagtgccctgttcccgtgtttaggttgccgatggacttctttcttaatgtcagtggcaactgtcaagtcttatagtggcccagtcactttaaggggactttgaagtctctcctagggttcatcatttattgattttatatatcaactctcagaagatgtttttatttcacttgttgccaagttttgggaaatttattctagtgccatccagataccacccactcataggtccttccccaaagcaattctccctgtattttctttctcctttctgcctggactgcaggaatgtctgaaggcttgttggggtctgtagagaggtaggggagggaagttcctagcagggagcagagaaggaccagttgccagtcatcccggtgagtgcagggcagtcccaggtgggttgggcattctagagtgaggcattccagttcagggatgactgggctggaagaataaactccgtgtattgttttcttatttttgctttgttttgttttgttttgttttattgattaagaaagtctctctaaagaggagaatcttcgcaatctgacattcattgatgtccttcaggtcagttaagtcagttgggtagatcctggtgtaagtgaataaagtgaaagccacaggttttcctctgtctttgctgggtcagtcagattcccagggaacagcttttgcattatcacaggacaagaaaccaacagaattgtattcctactacccaagtgctaatattttgtgggtttacttatgttatcttttaatgctcacaaaatcactgcgaaatacatattattacttccattttctgctgag

SEQ ID NO: 98059 - DNA, 1007 bp, Homo sapiens
agtggtttcgcactgcagtttgtgcatcctgcaaatgcgcaaggcatatactgtgggcctgtctggcctgagaaggcaggtcccgtggaacggttttattcccctggtggagttcttactgcatttcatagacagtgagccctgtgacttgtttatgatggttttgaggtgctgttagcccaatggccgtgggcttgctgagttggactgccttaggtttgagtcctggccctgccacttaactgtgggaccttgagcagttactagatctctttgtgcttcagtttccacgtatgtaaaaatggggataatcttaatttctattcgtagggttgtgacggtaaaatgaaaaaaaatgtatgtcaagcacttagcagagtgtctggtacgttataagttctccagaagtgtgctaattattattaataatatatttttgaaaagattattccttaacgacgtaatttgtaggaaactggctttccccttatctctctaggcttccatgagaatctatttcttgtgtgtagtgtttgggattaaggaagaggctctttctttatgttccaggatggagacactagtagttctcacggttttgctagtgcacgtccgaataccctgcggggcttgttaagcactgactgctgtgctgcccctgccctccagagcttctctttctgtctggtgaggggcagagtatttgcatctttaacaagttcccaggtgatgctgaggccactcatctgggaaccacactttaagaacccctgctctaggacagtactttccagtggaaatataatgtaagccacacataaaatcatacattttctagcagtcacattaaaaaagtgaaaagaagtggatgaaattaattttaatactgtattttatttaatccaatctatcaaatgctatcatttcaacatatagtcgatataaaaagtattaatgagacagcttatattcctttttttgtactcagtctttgaaactcggcctct

SEQ ID NO: 98060 - DNA, 1107 bp, Homo sapiens
atgtattaaaatggtgaaaatctttcctttatgactaatatgtttccctaataagttttaacagtttccttgatctctatttttctttaggacatatgtaaaaattagatgattatatctacatatgtttataatggtattactgaaatctaaattgcaatttttaggaaaaaagttttaaaaaatgtctaagctattgaaatgttgcaccaatatcaggacttatatttctgagtatcttaattttgtgttgattgattggtatgtatggaacatgtattcgtggacttgaatagttagcccgcagtaattggtctgttccaataacaattttaaatgataataacaaggagaaaccaggttcttctcaagaagtcaaagatccctgtacctttcttatagatttaaaagctcctgtggtcgatacatattaaggtatgagtattcagtcatgtttggcagtgatacactaccaagcatgatgaccaagatgtcagggagaaggtctgttgtccccagacatctgttactcactgtaggtcctaaaaatcacagcattagaggcttcttgggcttacctagaagtctgcaccttagagggctgaggcttcacgttgctaaaccctgggcctgtcatgtgaaatcaggtgaaaatatattgaaaagttccttgactactttaaacaattaagatttagatgaaattgagctgactgggcagatatagttcatagcagaaaagagaatctcaaaatagggacacagcactgtttcattttcatagcagggagggtcagctcaggaaaggtaatgagtacatgatgttatgcaggggcaaggtgggcttccggacattctggagggactagtgctgattggagggtgcagacactcaacgaggaccttcaggacacaccgaaaataacctcacctgtcccacagtttccccagtgtttgtccttagcagtagaacccaatttgactatctagtcacttaaacttaaaattttttttttttttagatggagtctcgctctgtcgcccaggctggagtgcagtggtgcgatcttggctcactgcaagctctgcctcctgggttcacgccat

SEQ ID NO: 98061 - DNA, 2390 bp, Homo sapiens
ttgaggaaccttcaaaggcacttcgtggggtcacaggtcagtaatgcttaagtaaaattgcttaggaaggcatagatgaaaagagcacaaagggagctcattggggctgctgttgatgttgttgaaaatggaaggttgtttttctgcagtgtgtacgattcagccttcctgaagccaggattgggggtgaaggggaatgtaacagggcagagaataaatgctcaatctagctctacaccaagtcagaggatttttttttttttttttttgagtctgggtcttgctgtgcaaggctagagtgcagtggtgtggtcatagctcactgcagctgcagtcttgaactcctggactcaagcaatcctgccttggcatcccaaagtgctgggattacagacatgagccaccacacttagccagtcagaggtcttttttaatggaaattccagtttaaagaaatattctatatagacacatttgctagaattcacctggggtaatgaaggaatagttgatgacaaaaagaaatgttattcaatgttttctttagaaagggcagaccaaattattttaactgctggtattttttatatgatgtgacagaacataatcttccagggtgttagaatctggaacattaattatttgtgctatagctatatatttattactcttcaaaaggccacttcctaatccactgtttgactttgggcacatcatctactctagggtcccatttcctttctgaaaaataaggaaactgcattggaatctactagatcagtgcttctcaatactatctgacccaatgccccatttttagaacaaatgttaaaataaatctcatgcataatataacctacctagaaacagaatttcaataaataaaaatataagacattcaggaaaaactaaaatagaaggctcaataaagaggccagatttttacacccacttataatgaatcactttgcaattaaatgaagtaaggcagtagtcagctggatattgtggatactgttttacatttgacatgtacagtaagagctcaatacgtatatttgtatataacatggaatcactgtgaatgcacctgctacaaatgcagtccaatttagggtaatgggtgtcagctctaatatcatggctgctgatgtggttttccacatggccaaaaattcttagtcaagttctaaacatcataaagtaccatcttcctttaatttatgcaatagttgaatcttggaaatccaaacaaatgttgtaaatccgtagtaaaactgtctagactcacataattatatatatatttttttaaaatcatgaatgtccaggggaacatgagaaagttcaggacacagattaattctttgttgtgtatgacattcccaggattgcaagtcatctagcatcctgccccccaaccccaccgccaacacacacacacacaatcattttgctaatttttaaaaatgcccgctcagtttttcagaatgcctcctaaaaggtggtagatcctttgatgagaatcactacactagttgacccccaaagtccttctagttataaaatcatgagtttgtagaatcagtggcgttttaaactcccgttatattcagagcactgtgctagatgccacagtagattcagagaaggatatgatatggtctaggccctgatggaatcacattctgatatccttgaagagaaggctataggttcactggtgagtttaaggtttggggaagagaggtgcagtatccgactgagtgctcctgggagatttcctgggagcattgggtattgaaggaccaatagaactgaggtggtaaaaaggatttggagggttagagagaagtaaagagaactttactgagtgccctcaggtattgcacacctgctatatatgacacactgctattctctgacaaaccaaagatgagtaagacacatccatgcctaagaaaagtttagactaccagaagagatggaggtgcaaacagaaaagcaaatggtgacatgtaccaaatcagggtggcagtgagaaggcattaaataactggcacactctgtaatacactagtaagttcttaaattgctcacaaagcacaaattttcttccagaaacacatttcctaacaactccactaatagtgctgaaactcatgtcatccttactcacttcatgatggtttcctaaaaccgaacaatgacaacaacaaaaataacctatttcattttgaatctgaattctccagaaatttttttaattcaattttcactgtgcctacaattttgagactgttttgatttatagtcagagcaagagaaagaaattaaataatcgagtggcagattcccaacttgttattgctttcacatgaattactttc

SEQ ID NO: 98062 - DNA, 1044 bp, Homo sapiens
agattccagtaacacagctagtcaccctaagtgagtatgtgttaaagttcaagagggctgctgctgttaaagttgaatagtgcagcacatatagaatgatttctgcttagtagacttcctgtcttggcggtatcactcagagaggattttaataagtgttgtttttcagagatcgttgttcggagtaacaaatttcaaaagtctaaattccgtaagtgaggtcagacaccagtggagaaaatgtagagtgggagtgtacagtgaatcagaagggactgtgtttggcttggggattggtggaggaggacaggaggaactgggttgttggtaataggcacagagggtgaacccgcctccatgaccaactcagaaaacacagtcgtggtccaacaaagcaatcagtctgtggagtgagaactgattccaagaaattaggttatttaatatgtttcaatctctggccctaatgtatgactcctccttatttggcagtggaaatcctgactgctcgtcagaagaaagcagaagaactaaagagactcactgaccttgccagtcagatggcagagatgcagctggccgaactcagggcagaaattaaggtcagttctaaaatatcacagcctgaaccctgagccagagagctgatcccaattatgtttgttttgcatccacagagttctgctctctgaggatctaacatgtacacccagctctcttccacagggtggaaatagagaacacagaagggggaagacccacataatcactgtgtttaagtgtaatgtgctttgaaggaatgtgttactccaaaggagaggtacaagctattttgtcagtcagtagagactgaaccaaataaagtaacttggccaggccatgaattatagctgggatgggggatattattttcacacactgtgatttgtatgtatgcatataaacacatccacaggtatatatacacacacgaagcatgaacgtagtgtaatggtgaagattagaaagcatgcggtctgtggagatttctttcctgtattattt

SEQ ID NO: 98063 - DNA, 1074 bp, Homo sapiens
gctgaggcaggagaatggcgtgaacccgggaggcggagcttgcagtgagccgagaccgcgccactgcactccagcctgggcgacagagcgagactccatctcaaaaaacgcgtacagcaaaaaagggtgccgttacataggtcattggatgctatcactggaatgtctgttgagaaataaacgttttaccatctgtagacacatgagggcgctttaagcaggcagcgtgggatgcagcgtgcaaagggagggagggaggaagaaagctttgtcaaaggtagcctgaaattcaggcatctccctatctggttgcggacctgtgcctgcgtcggggtggggagcaccgaatcgatttaggaaaagaactgcgcaggcccttgatccccacttctcatggtgaaatcaagtttgaggttcaaatcaaggctttcagagagtcagaatttccaaatctgttactttgtcaaaaaactgcttttaatctggtaacgtttcccattaacctcatttgatgtccttccctaagaatgtttaattagaatctccttttctgatgccagcagaattgaactgcttgtgaactgagctttaaattggacatgttgtgtttctagtcctccactgagggtgaattttgcagcaatttgcgtttaactttctgtgtcttgctgcattaagcacttctagaataggatcaacaggacagagctggagtatgcagagattctcaaaagaaatgtaaatttggaatgtaattgggaacccaacagggaggtgtggatttcacggatgaagtcttggtggaagatctaagtgccacaatgtgagtttgaagttattccatcttcataaggattaaactattttaacctctactaggcaaatgtttaagagaataatctgactactgtgcattaagtagagagattagagtttaaaacactttaaatgaatggcagaataggactcagttctctaggatcacaccaatagttccaccagacagatgaagatatgtaatacagtgtttaagcggcctgacattggcactaaaatattgaaattactgtttca

SEQ ID NO: 98064 - DNA, 1037 bp, Homo sapiens
gaattatataatatctttgaagtaaattattaaaatatcctatttaatttgaatagtgaagttttgaaaatactttgaaaaagagaagtaaaagtttaactttttaactaaagttagtatttgtttttcagaaatgaccactgaagattcattctgattatacaatatgatttttatgcataaaatttccatgtaacttgaatttaatatttttaaacagaatattttgactaatcctctattttttcatgactattcagttgtgtgtgtttattcgtaaatgttatgttttgtaattggatcacatatttctactttcagtgagagtatgccttcactatgttaaaaaataagctcataaaacagggtactttttattcaaatgcttatcattgtactttcattgctttgaaagagtaaagtaagtatactcaaaacattacgttttacaaaatcaaataaaacttttccataaaaagtggtattttctgtgtctgtactttttaaagccgtggagccctgtagtagtttgaaaacttattagtttatttaggttatccattttcacttacaaaattgctttcttgtgcagataaagtatgaaataattaaatcaattttggataactatccatctactaggaactttttagataggctgcttactttgctagaaaaagtgattatttaattgaagatccatgatgactgtcctgtggaatatataaaatattcagttacttttgaaaatgccattatagagaatccaggcattgtggaaatcaaagaccatagtgaattttcagaactaccaatgtggacattattagtattgcttgatttaggacattttgagttgctggacaggaaacatgttgacaattaatcatgggtgattccgttgacatcctccatttctttgcatcaagtagtttaagggaaatccatttagcacacttagtctttgtaagaggagtgactttggataactactgaaggccggggcagctgcgatagggaaggggaagatgcaccct

SEQ ID NO: 98065 - DNA, 1048 bp, Homo sapiens
actataagactggtcctaagccagttagatttttgggcccttccacaagtacccaaattaaagtcaagaactcggcctcagtcacggtgtctccagccagtgccatccagacgtcggctggggcgacagcaaaccggtttcaaagtggtagccgcagaaaggcagctcagcgctctgcaccttccagagccacggccctggtgggcacgggggcacctgggcatcctcaggcttcccctggggctgcgagcgctgaaaatggaggcacgcacttacctccagctaaggtgctactctccgacaagaagcctacaccccagcgggtgataaagctgaagaggactccgctgtgcgccaccgcgccttgcctgccctcccccacggccacgaggcaggccaactccctcaagccgcttcccggcgaagctgcccgtgccttgggagtgcggactgagaacgggaagaacaagggaaattgatgaaagtggtggacttgaaatttcccgttcatctcccaaagctttcaacccattcgacgcaaagaagtgacactttcttaatgcagcagaggggaagcttaggtttatgttgaggattctgttcctggaattgtgtgagctaggaatggaggaggggagactttcaatggttaaggctccatttctcattttcccaacttttatatgattgtctatgggcagtttgaatttctggttttcaatttattttttaatgattaattcgtattaaggcaacaagacagtacaacaaataatctctagagaggtccactttgttgctgaagtaaacgttacttgttgcaacccgaggatgggcatgaggtttggccttaggtattcctgtctgggaaaatggagggggtgatattagtggttccctgtactatatcacagccaagagagattagagagagaaaatgtagatcaaggcgagctgcctacaaattactctgtctccaaaggcaacgtgaaaagaaatgatggggaggaaaaaaccccatagattgaattagcactttgactctcac

SEQ ID NO: 98066 - DNA, 1161 bp, Homo sapiens
atttattttaccttttgagcctacagttagcaaatatatttgagtcaagagcagtggttctcaacgaggggtgattttgccttccaggggatatttgacaatgtttggcaacatttttagttgacacactgtggggtgagagttgctactggcatttagaaggtagaggccaagggtgctgctaaacatcctacagtgcacagggcagccccccagaacaaagaattatgtgaccaaaatggtaatagtgccgaggttgagaaacctcagtgtggagtctggtggaagatgtagatggaaaacatagcaggcaggcaggagtggtttacggagaccctcctctgtgttagttatctttcctctacaagtttacgaagcattatttttgatgcatcaacaggataacgatgatgatgactgagaagcacttgtaaggtcccaaggagccatctggtgaccagggaaaatgttcagtagggatttagggttgaatatattatatttgcactctttgctacagatggcaattttcaaataaccacgttattatgatcccatttccaagaatgggagttgaataagttgtaatcgcctctaatgacacattgatgctatgcagacttgcaagagagcagagtgagaggattgcagtcacctttcatgcttggggtggtcctcaggaagtgaagctgaaggagcaggcaaggttttgacaatgattgtttgacggttttaaggtcatttaaaaaaatgttcccccgtaggctttttataatgaatggtaaactcagttctggaatctttgaaggtttgtccatgactgttctagcagtccccaaaatgggttccaaagaatgcaaattttactggccatcaaaggtttcactatagaatgattgggaaatacagatatctttagtataggcctttcataatctttaatatgttaacatgaattttaaagcttcaagaagaaaaaaagatatgcagcagtttattagttttgcattgctataaaggactatcaggctgggtaatttataaagaaaagaggtttattttgactcatggttctgcagtctgtacaagaaggttagggccagcatatgcttctggtgaggcctcaggaagcttacaatcatggcagaaggtgaagggaag

SEQ ID NO: 98067 - DNA, 2121 bp, Homo sapiens
acaaaataaaaacactttaaatgtctaatgattgagggttaaatatattttggcacatccacagaatggaatataataaagcgattaaagttattttaaataactttttgcatagatgaatgcccatgataagaaatgatgaaaagcaggaaataaatgtaaagtatatcatatgactagaaaaaagactggaatgaaacatattagtctgtcctgagccaatgattcctggtcttctgattaggagtgactttgattcccttatatatacttttctatattttccaggtattgtacaagggatgtgaattactttataggcaggaaaaaaaaagaaagtttttaaacaaattgtggtgtatccatacagtggaatactactcactgataaaagaaatgatcattgctacatacagcaacatggatgaatcttaaagcatcatgctaaagaagccagacacaaaaggttgcattttgtatgatcccatttatatgacatttcagaaaaggcaaaactaaggatatggaggggacattgattgctaaggggtatgaggaaatttttggggtgatagaagtggtctacagattatgactatggatacataactatatccatttgtcaaaactcattgaaatgtgtacctgaaaagggtgaattttattttacataaattatatcttaataaatctgacttttagaaaaagcaaacttaatggaccggatttgggaatgtttttatagtatgtgtaggttttggagtgtgatcaagcagttccagaaagttaattgttttaaaatgaggatcatagagttatttgagtatcagatatgtctatcattataatgatttatatgcccagcttgctaaattgttattgttaccagaagtttaataagaagacaacaccaaatccattattgggacttagattactccaagcaatttttattcaacataattccttgagcttttttcatgtgtatatatttatgcttcttttctaaaaaaaattgagatggaaattcacataacagaattaactaaagcatacatttcattggtatttactacattcacaatgttgtgcaatcattacctctctccagttctaaacatttcatcaccccaaaaggaacccctaagcggtcactccccactccactgtctcccacagcccctggcaaccagcagtctgctttgtgtctcaatggatttacctactcttgatagctctacaaatggaacaatacaaatgtgacctattgtgtttggtgtttttcacttagcataatgttttcgaggcttcaagaataaatacatttttcagctcttaataaaaaacataacagatttaaaaattaaaatgaatttgaatggcatttttgcctaactcactagctcagattcttgttggaaaaggtggttatcgggtggtgatgtctcatatttgtacagtggttgccattttcagagtagttcacaaagttcccctgatttgatgttacagcaacccagtgaagtagacaaggcaagtgttacaacccaccccctatacaatacttatactgctccctacgactactgggaataaaggtacttgacagtttttgagtgcttagtctgtgctagaccctgttctaagcactttgcatttattaactcatttaatcatcacagtggtccttcaaggtacatactattattgtcatcatttcacagctgagaaaattcaggcccagaaaagtaactttcccaaggtgacatgaatagtgagtgagagatggagattgagacccacacaggctttgctggagcctgagccctcactctcagctgccctgagtatgcatcataacctgctgaatcttctcagctaatcagtggcaaagctggtggccagctcttcctgacccaggtcgtgagctgtgttgctccctggccctagctcctcgtgtgagcgcttcctgttcatgttgtgcacacctctctttgccaaacgggaggcatgaacctcagactctggcaggtcttaggcgaaacagtgttgctcagcattttgcagtggatggtagctgtcttaattatgtctttttaccttccaggtgttagctactgg

SEQ ID NO: 98068 - DNA, 1146 bp, Homo sapiens
gaacttgtttgaattctttgatttggatgtcagcgtttaggaagcaagctgatgggtggttggttattaggagtgcagcatgaatagaaagttgatttggttccagatcccctttaggaatttaaatagttatatgggttctgctactgaagttattcataaactatattttcgaacgatagtctttccctgctgttgccacatctgcagaatgaggcctgactagaaggttgggagggttaatgctcatcttcagaagtctcagctctgtaatcttttattcctggtttttattcaaaaaggacacagcatgcccacattcatgctgtcagccaacacatgtttgtttcaagtgcctgtgacatgtatggcactgtacaaggggctgcgtgggacaccaagaaatacaacatgtagttctttgcccttgaagtttatagtatagttgggaattcttgtagatgtatgtgtaagtaaaattccaaaccaatataggagttagatagcaatattaaatgaaagtgcaagacatggtagggccccattttcattcactgagtcagtaaatactaggcatctcgtttgtgtcaggcactattccagacacttgggatataacagtgaacacaatatagtacctgtccagagtacttacagcagtaaagctgttcctcccagggaaggccctggcagcttcactgggtgaaacccttctgctctctgccctggagcaccttgtggtctcactggtggcacttcttttttttttttttttttcttttgagatggagtcttgctcttgttgcccaggctggagtgcaattgcatgatctcagttcaccgcaacctctacctcccgggttcaagtgattctcctgcctcagcctcctgagtagctgggattacaggcatgtgccaccacgcccagctaattttgtatttttagtagagacagggtttctccatgttggtcaggctggtctcgaactcccaacctcaggtgatctgcccgcctcggcctcccaaagtgctggggttacaggtgtgagcccctgcacccggtcctggtggcacttcttacacagggtgctggtggcttattcaatgtctgtcttctgcattagctataaactctgggaggactgg

SEQ ID NO: 98069 - DNA, 1050 bp, Homo sapiens
aaaaaatgccaagacctttttaagttctatatttgaccttaaagaatatgtctccatttcattggccaaatggtcagacaggctgtatggataagggatgccaaagtaatcagcctcttcctgtagggcgatgcgggtttgctcatctgtgggaatctgaacttctccatgaaggtaatccaaaaggtatttaaatagacgtccatcacggtcaataacacaagcccctagaaaacattcagttcaaaaatgattatagagattctgtcgatcaataagatttcaacaaatcaaactaggtctgaggacctctacaattataaatgtttctttctcacatgaaagttaacatctagtgttcaaataggtttatgtaatctaagctagacttttggttattcaaacaccaaatatgatataccagcaaccctctgcttacaaataggtgatattgtaaaatagaatctgaatgagatgtgtgggacaatcacctgtagttctataatactgcacataagtttgaatgcaaatatatatcaccagggttgccatgtttggttgtactggtgtactatatacaccatgctaggccaagtgggcaagagaggctaaaaccaaacccacactctgctcaccaagccatgcaccctggcatggaactgcatcttcctggataaaagggcacccttttctgatttgtacacaaagaaactgaatgagtcagtggtggacctttgcgttctcactaccatatgggaaaatatattctgagatccatttagaactttggatgcaatgactatattcccacaatggccactgcaaaagctaagggcaccccacactgctggtagaaacagcagtttacccctaaccttatctcagctggactagaacaggtatatggaggttctcactaaagagagcatgtggggtgctcatcactatgtccagtgtttgcatatcagcaacactacaaatctggggttcctcactccaggcatgccagatgattcgaattactgggttagtccttttgtactacgagaa

SEQ ID NO: 98070 - DNA, 1043 bp, Homo sapiens
gccgcggaagaccgtggcggggctttctggctccccagctcctcccggctcttcccgcttcggaagaggagtgtgagccccttgagcgatgtttttcaaagtggggttcgcgggcagatcccgacccctcctcagactttctgaggaactgtgtgctgtggccggagtgtcttcgttttcccaagcgtccctgatggttttgatgcaggtgatcataggaatgcactctgggggacattgtccccgagggctggacactttccacatagcagggagcctaactgggtgcttttgaggatggggcctgcggagtgcccccctggtgtggccttggaatgatgatgttcctatccttaggagagactgcctggggttggggtaggaggagtagctcttaaatcctcgggatcggggtgctgctgtgttatcgtagccaagtcttgagatggacagatgcttagagagtgaaagggctgggtcaggatccataggggtgaaacagtgctggaggaggcggtgtggggtgaagcaggaagaacttggggttcgtcctgccgttctggattggggctggctccacaacctactagcagtcagtccttgtgtggcccctgtacacatcactctttttttttaccccaatggcctcatctgtcaacagggacagtaattcccatccaatagagtttttgtgtgaattaggtaaagtgtgtcaagtgtctcttacaatggctggcacataataagcattcagtaaatgggagttattaagagtgacacaggccctggcttccttggcctacagaccaaaaagtagggattaaacaagtggggtaaaaagtggacagacacacagtatatttgtagaattgtgcaaggattctaacttggggggcagaaggatacgtgggacggtcatgcaagaaattaggtttgctgaaggccttgaagaatagataggattccagggagccagtaatgaggcagagggaacaagttccatcccatgcctcagaggtggctctcacacatggatctttgga

SEQ ID NO: 98071 - DNA, 1037 bp, Homo sapiens
tgaatcatttccatcagcataacctgctggaatgactctcatcctaaaattccttttcttgactcttatcccaccttcactacagcttcacttctctacttctatttacaacaaagtcttctctaaagggttacatccagccttccatctcccattcactctccagcccatttttggctggtttgcgtcctcaccacaacattgaaactgctcttgtcaaggtcacctagaactcccacaataccaaatatgatggacccttgatttctcagtggcatttgacatgaatgacactttgctctcttggttcctgtaactccatacgctcctgactcccctccttcctcttggctcttccttgtaagcctgacttctaaatgctgaagtcaatgcttcatgttgtctcttctcatttatctgccctttctgcagatggtttcattcactctcatagctttaaatgcttatgctttccaaatatccaccttcaacacagaattttacccctgagctccagatttattcaattgctaattgatctctctacctgaatgtctgaaaagcatctgaatcttagtagtccaaaacacagcttctgatttcttccctcaaacctattcctctcccataattcactgactcggtaaactcactattatcccattgttcaaattaacaatttagagatattcctacatttttccctttcccttaaatcccatatattgcagccatgaaaatgcacttctcagatctccaattgcagggagcattgttgactgatgcctcagctgctgtcctttgaaatttatcaccaggctgcactgcccactgactgctcccagccagtgactgagcagagggatttaaggcaggcccattcctgggagacacagaactcttctgatatgggggactttggcttgaaggctttccactggctgtgctgaaactttctcagaactgtatcatatctacaacttttcctacttttcctttcctgttctccacaagggttgaaactgtctaatgtcttt

SEQ ID NO: 98072 - DNA, 1058 bp, Homo sapiens
aggctgtattcatttcctttggctgctgtaacaaattatcataaatgaggtgcttaaaacaactgaaatgtatttccccacagttctggaggccagaagtctaaattcagttatcactggttttcccacctcaaggtgtattcccagctgcactctctctggaggctcttcaggagaatctgttccttgctttgtcaattcctgatggctgctggcagtccttggcatgtggctgcatcactcctgtctctgctgtctcttgtaaggactcttgtgatagtatttagtcctgcctggataatccaggataatctccccattacaagatcctcaatttattcatatcttcaaaggccctttttccacatgaggtttagaattaaagggatctaataactttgggggaccattttccagcttaccacaggaccagatgaggaatgtgtagcacttaggggattcgagtgaggggaatgaacgtgacccaggagttgagggattcttgccatgattgataaagtgagctgagtcctggattgacatagtgagctgagtcctgtggactcaaggcaggtagtggtggggaggctgagtattgagggttaggcaggtgcaggtgacagagttttttgtttttttttttgtttttttttttttttcagatctcttcagatggaggcaaggaggcttgggaaggaaatggaggcatggggaggttggtcttacatggctcaacatcaactgctgcttctcagtgaagctatttctgatccttttcctctgcccagtcacagttaatcgcttctcctctgcattgtgtattgtagccattactcttgtaatactataatgtaatgatttctttatcttcctgtttccataataggccataaatctaatagacaaatttaagatttcctatttctccaacccccttccccaccttggattgggtatatctcttctgtacttcctttaaactctgtgtatatctctaaggttatacttcttacattgtatgaaaacactgtctgtacccgcattgtaccatgcattcc

SEQ ID NO: 98073 - DNA, 1411 bp, Homo sapiens
aattttcccagattggctaccctcattcctatgggacatttccagttagagctgcagaatcagtttctccattctgtctgctagtcaaaggtaggaaattaggtagagcagcaagtatcaagatttaatttttgtgactgatctaattatgtagaatgctatgtctgtgctgcagtcctcttactccttttttatacatattctgcattcctcacaactcttgaattcttcatcttctgtctagctttcatttcctcacctctaaactctgggtttatttttctcaaaactacatctgtattgttattcccttttctaatcttcagttaaaacttgtgaaatgcattttgtctatgttttactaaggaatataaaaatttcttaaggtataagctgaatattaactcattttaaaaatctttttacagataattcttctattttcaaaatatctttaaagcacaacaacagggcattagctcaggctcttagtagagaaaaagagaattctcgaagaattacaactgaaaagatgctattgcaaaaagaagtagagaaactgaattttgagaacacatttcttcgcctaaagctaaataacttggtatgtaagctatattgtttttgaattctaattataacttaaatcttttagctgcattattatagaagctttaaaaatatttttcaaatctccaatagtgaaaaattattgaaagtcagtataccatgtaagtctatgtcaaagtacaaactgttaatgggtaataaaatatgtgttttaaatctacattctaaatgtgtgcttgtgtgctgtgtaaaccagtataatactttgaccaacattcgattgctaatcataaacaaagcttggtacattaatacatttttaaaagatggtcatagttcttccggtgttcttgaaaggaaaggaattcccagaatgttgttattcttttttaatctcagcatttacctggctacaagctaaacagaatgagaattatagttgtttcttttccttccaaatttcaactctgttcacagacaggacagtgagagccaatgattagctaggctgcaactatagatctaaatctaaaatgagtagaactttttataatggaaaaaggacctactctacttgtgggtttaattccggtggctgacaaactgttctcttgccatgtgatatattactatgagaagatagaaaaatgtttataggaaaacaaaattgttctaaagtattcaacatatgtgtgtgtgtgtgtatacatgtatgtatgtatgatatgtatgactatttggactatataatactatttggtactatataatataccattttagctgaatgtgatctcaatttttagctcaatatgatatcaactattttttaagttttctc

SEQ ID NO: 98074 - DNA, 1033 bp, Homo sapiens
ttgatctatttgtcttatcattatgctaatactgtactgtctcaattactgtaaccctcctaacttttttctttttcaaagttttctttgtttttttagctattctaggtcttctgcattttcatatgaattttaaaatcagcttgataatttggcaccattcccttgtttctattacagcttagctctgtaataaaaaacatggttgtgtgttgcctaattttctggtgtttattaataattaaaacatgtttgtatctgaaaatttagaaatatggataagtaaatatataaaagatatattaaaatcacccagattttgaattttaaaaagccatttaaaagatgtattataaaattcaataaaatattgcataatacatatgtagacatgaacatattgcatgtatgtaaagatattgtatttgtgtaggtatagtcatgtatttattcctacacatagaagaatgttgaggttatataccaaaatgttggcagtgattatctttcgttggcatgattaaggatgcactgtgttttaaccttattatcacattattctcattaaattattaaaggtaaatgcaaaaattgttcttttactattaatgtcattgtataatttggtactgtgataactaacatgatttaataaggttagaaactttgttttctttatttttttcaaaaatagttccatcagagttcctttctactgtcagctagcaagaagaaacgaattagtaaacagtgcaagttgatgcgtcttccatttgcaaggtaaatatgggcttgaattacactagttcagagtatatagattttatataacacaattagtgtttgtgtgtattgtacagtgttcaggatcatcaacctgtagttatctactaacgtagaaatgagctggtttgtagtgtcttgctataggttgtttctctaggactccaaggaaacttacggtcaatcccccaaccaggtttatttgtaatgtcttgctactttatagttcttttttttcttttcatctagt

SEQ ID NO: 98075 - DNA, 1025 bp, Homo sapiens
ataactgcccatgcatttaaagaaaatttataaaacacataatttctcatttccttcccacttgcctttagggttccattaacttcaaatgatgatgaagatgaagataaagagaaaatgcagtgtgacaacaatattaaatcaaagacattacctgatattccctcttcaggatcaacaacacaacctttatcaactcaggataattcggaagtgttatttcttaaagaaaataatcaaaatgtatatggtttagatgattcagaacatatttcttctatagttgatgtacctcccagaggtgagattgttttaaaaattcattttgagtatttgtattagttacattcatcagatgttcttcctgagggcaattatgtataacagttaataagttagctctcttatgttaccgatttgctaacttctgccatttaaaactgctggtgatagatttaattttaaagtaaatatgctgacaaacatcacacccacagtggcctaatactgttactctggaagaaatatttagaaataaatggacctaatgagcttttctcaatatcttagcttatgatttgaaagataccatatatttacttagttttaccctctttttttgtagatatgaaaattgggggcctagataggtatagagactctttgaagatcatcaccagttaattaatggtaaagcaaaaacttgagtctgggtaatggttgagcaagaaaaaagatggcatttacattttatttacatagtattcctaaatgataatctgtggtgtagtctggtgcttacagatttgccatagattttcagactgggatatggaactataacaattttgaatttagagcttagaattgtttttcctttctgaaaatgtgtgtgtgtgtgtgtgtgtgtgtgtgtgtgggcatatgtatatgtatataatatatacacacacacatatatacacacatatatatggtatacatataatgtatacagtatacatatatacatgtgtgtatatatt

SEQ ID NO: 98076 - DNA, 2776 bp, Homo sapiens
tcagaaaagtgaaagattccagctctgaaaaaaagagagaaagatcaaagagacagtttaaaaatagttcagatgtcgatattggggaaaagattgaaaacaggacagaaagatctgatgtcctggatggcaaaaggggtgcagaagatcccggttttattttcaataatgaacagctggctcagatgaatgaacagctggctcaggtgaatgaactaaagaaaatgacccttcaaactggctttgaacaaggtgacagagaaaatgtactgtgtaataaaaaggagaaaagaataacaaatgagcaagaggaaacatactctttatcccaaagttcaggtaaatttcaccaggagagtaaatttgataagggtcagaattccctaacttgtaataaaagtaaagcttctagacagacatttgtgattcacaaattagaaaaagataacttactcccaaaccaaaaggataaagtaaccatttatgaaaacctagacgtcacaaatgaatttcacacagccaatctttccaccaaagataatggaaatttatgtgattatgggacccacaatatattggatttgaaaaagtatgtcactgatattcaaccctcagagcaaaatgaatcaaacattaataagcttagaaagaaagtaaaccggaagacagaaataatttctggaatgaaccacatgtatgaggataatgataaagatgtggtgcatggcctaaaaaaaggtaatttttttttcaaaacccaagaggataaagaacctatctctgaaaacatagaagtttccaaagagcttcaaatcccagctctttctactagagataatgaaaatcaatgtgactataggacccagaatgtgttgggtttgcaaaagcagatcaccaatatgtaccccgttcagcaaaatgaatcaaaagttaataagaagcttaggcagaaagtaaatcggaagacagaaataatttctgaagtgaatcatttagataatgacaaaagtatagaatacacagttaaaagtcactcactctttttaacgcaaaaagataaggaaatcatccctggaaacctagaagacccaagtgagtttgaaacacctgctctttctaccaaagatagtggaaacctgtatgattctgagattcaaaatgttttgggggtgaaacatggccatgatatgcaacctgcttgtcaaaatgattcaaaaataggtaagaagcctagactaaatgtatgtcaaaagtcagaaataattcctgaaaccaaccaaatatatgagaatgataacaaaggtgtacatgacctagaaaaagataacttcttctctctaaccccaaaggataaagaaacaatttctgaaaatctacaagtcacaaatgaatttcaaacagttgatcttctcatcaaagataatggaaatttatgtgattatgacacccagaatatattggagttgaaaaagtatgttactgataggaaatctgctgagcaaaatgaatcaaaaataaataagctcaggaataaagtgaattggaagacagaaataatttctgaaatgaaccagatatatgaggataatgataaagatgcacatgtccaagaaagctatacaaaagatcttgattttaaagtaaataaatctaaacaaaaacttgaatgccaagacattatcaataaacactatatggaagtcaacagtaatgaaaaggaaagttgtgatcaaattttagattcctacaaagtagttaaaaaacgtaagaaagaatcatcatgcaaggcaaagaacattttgacaaaagctaagaacaaacttgcttcacagttaacagaatcttcacagacatctatctccttagaatctgatttaaaacatattactagtgaagcagattctgatccaggaaacccagttgaactatgtaagactcagaagcaaagcactaccactttgaataaaaaagatctcccttttgtggaagaaataaaagaaggagagtgtcaggttaaaaaggtaaataaaatgacatctaagtcaaagaaaaggaagacctccatagatccttctccagagagccatgaagtaatggaaagaatacttgacagcgttcagggaaagtctactgtatctgaacaagctgataaggaaaacaatttggagaatgagaaaatggtcaaaaataagccagacttttacacaaaggcatttagatctttgtctgagatacattcacctaacatacaagattcttcctttgacagtgttcgtgaaggtttagtacctttgagcgtttcttctggtaaaaatgtgataataaaagaaaattttgccttggagtgctccccagcctttcaagtaagtgatgatgagcatgagaagatgaacaagatgaaatttaaagtcaaccggagaacccaaaaatcaggaataggtaggttaataaccattatgaaatgataaagttttagaagtgttttgttttttgttttcgttttttacttagccagtgaagtattttctaactggtatttttatggaatttaaaaacaatatataactgagtacatgatccatagaaatagcatgaaggaataaagaaagtttcatactttgggaaataacagtgagagtatcttggacatttacaactataaatggatttggcctttaccacaaacttgtctaataaagaccataggcaaataatttgctttttcatacatctgaaggaaattgaatgttttaaatgtatataataatgaattgta

SEQ ID NO: 98077 - DNA, 1050 bp, Homo sapiens
tatatgtgtgtagatccctaaggttttggcgggtaagtcaattccaggtaaaagcacactgaagcaaaagaattacaaaggtttagagttgcaggatttgttagaagactggtgagacattttttatctttgtgctcctcatggtgccttacacagagtgagtgatcaatggcatatatgttgaatgaactgtaatttgtgtgcttccatgaaaagagttgaactaggatgaactttgggagccatatgtgatttcagaatgaaaaagttataggctactttgacagtttgtttcaaatgttagtctctttcctctcaaaattgaatcaagatttaaaatttgctgtggtgatttgcagaccactatatagctcatatctatttgtatctctatatactttttaaaatatttgtgaaaaataatattctttttcaggtgatagaccattacaggacttgtcaaataccagttttgtttcaaataacactgctgaatctgaaaataagtcagaagatctatcttcagaacggacaagcagaagaagaaggtgtactcctttctattttaaagagccaagcctcagagagtaagtatttcaaatgattttagtatgccattataaaatatatccttaaaaaaatttctgcctgaattagtatttgagcacttctgataattcaataaaatgtatattattgatatgtaacaaccacagtatgatttgggtaagagttgaagaaatatgtcctttggacaggctatttttggggggttggagaattgtctggatttaaattgatttgcttttggttagttcccagttctactactgtcatattttaaattgtagcctgatacttataatttttaaaatttgtggcctgtgatttgcaagccatttttgttaccccatttgtttatttcctaccttgttccctagaagtcaaagtggtttatgtgtcctttactctcaaagaataacagtcctttctctttatttttgtaaatttcaaacataccccaacaaagagaatagtgccctcctccaa

SEQ ID NO: 98078 - DNA, 1034 bp, Homo sapiens
agtgtcttttgcaatcaatttttctctgatcagtgctttcaatgtatcttgattctgatacatagtgttttcaatgtcgtttttaagtttctccttttctttaggagttattaggaggttttaaaaattccaggtagatgaacctttctggttttttgtttttatttgtaaatctagttttattgcattttggtcagaaattatttattgtaatatttctgctttatggaaattgccagtattttctttgtgacctactataggatcagcatttataactgtgctgtgattgcttagatgtatattctccataatcaaggtctaaagtttgatatatatccatgagatttactgtatttattatgttgcttagatcttctgtttcttattttttgtaaataagtgatctgttttgtactaaggttatactaagagttgtatattaaaatctactgtgtcctgtgtttccatgtatctcctgtagtttttgcttcagaagggtggttgctctgctttttgctatgtaaatatcatgattattacttattcattttggattatggcctttattatattaaaaatgtcctcatttgtcatgttcagtgctctggactaaagacttaaagtctttaagatataaagactttaaaaacatatttatgagaccttcctgataactcctaccactcctatcttcaatacctatgatgatcattccataatagcaagcagctttaattaggatgtactttcatgggagctactagaagctgtgatatacctagtgtataccatttccaatccaaaaagaaggaagaaaaaaaagtggcaactggatggtcatcactcggaatttatactgaatgttgtggcttttgcttttaaaaattttaccaactaagctgtatagcaaatcatctgcatgcactgtacatttaaactaaaatagaaccttatttccttacagcattttgctgtgttttatttagaataggtacttcttttgaaaggattaattaaactctatctaatta

SEQ ID NO: 98079 - DNA, 1028 bp, Homo sapiens
tctttagggggacacatcattagcaggcatccagattcagatctgaatcccatcctggctgtgggtaactgtaccctcaacttgctatcaaaaggtaagtgacagcccctacttggagattattaagctgtttctctacccctttttctctctggggaggcaggaaatccagtcttgaaaatgacttttccctataatatcaatacatttctctgcttttctggatactggaaattttgtgagtcttgtcttaatagcacaggctttcttcccctgtgtctttctggttttttgtttgtttgtttgtttttcctcatactggtcaccctacactggacatgtttgtgttggttaatgtccggatgtgatctgattattgctgggaactacatactattgagaactattgggtccctttgttgaagacattctccaggtggtacaggagtgttgtggcacccacatcgtgctttgagctcacacttaatttatcattgatggaaacatacaggtctttttcaggtgaaaaatgattgggcctcattctatatttatttacttgatttttgttattaaaactaagtccacaacatctaatttatcgcttcttccaacttgcttgaaaattattaggaagttctaattggtcctctgtaaatttgtggggttttttttcgttaaaaaatatggactagttttctatcatctgcattgttaaatacttactcttcataccatttaaaccataaaactatctttttttttttttgaaatggagtctcgctctgtcacccagtctggagtgcagtggcacaatctcagctcactgcaacctctacctcctgggttcaagcgattctcctgccttggcctcctgagtagctaggactgcaggcatgtgccaccatgcccagctaatttttgtatttttaatagagatgtggtttcactatgttggccaggctggtctcgaactcctgacctcgggtgatccacccgcctctgcctcccaaagtgttgggattaca

SEQ ID NO: 98080 - DNA, 1052 bp, Homo sapiens
ggggctaaatatctactctccactccccctaccttccagccaaataaaagccccaataagcaaatataatagatgccactccccccaccctcaccacttcaaccagcagactcgtgattgtctgccagagaatcccagcatcagatacaagctctggctttgtggaaaagagttgcctcacattgtgttcagagattaagctctcaaagtctaaagatcatcaactggatcagagcaaatttaatcaaagtttagagcagggaaatatgcccctctccctatacattacagttcttttatcactttcctgactaagaaaaattcagaaaattggctcaaagttattcaaagagcaagcagccagtgaagttgaaaaagatgaaacttttaaaaataggatttataaaacctagcttttttttcaacctggaatctctttaatcttagattaataagaaaagcacatgaacagattccaataggaagtgtgttatcaatcaaaatagaacaaaaacaaatatatctctgtcactatcacaaagatttaatctggcacatgcttttcgagtttttagtagattgaatggggcaacgatcaaaactcttgaatcaaggggtaaggctgatgaccataatggaaaaaaatgtgttccctaccggaatctgtcctgaataataatcatcaacaacaacatgagcatagctaggacctatacagagctcactgtgtggtcaacatggttctaggtcagtttcacacattaacttactaaatgctcaccacaatcctatgaggcaaaaactatttttatccccattctgatggggaaactaaaaggcagggttacccaaggttacatagctagtcagtaacaaaaacaatcaacaaacactctgtcaaagaacctgggccccaccggtgctataaacaaaccaacccagtttttgaatgggggaaatggcagaatcacaatagcccatccctctaaggggtgttgtctagacacctactggtggccagaaggaaacagagataagagaatccccaacta

SEQ ID NO: 98081 - DNA, 1050 bp, Homo sapiens
cccagcactttgggaggctgaggtggatggatcagttgagtccaggagttcaagaccagcctggccaacatgatgaaatcccatctctactaaaaatacaaaaattagccgggcgtggtggcacgcacctgtaatcccagctactcaggaggatgaggcaagagaatcatttgaacctggaaggcagaggctgcagtgagccaagatggcaccactgcactccagcctgggcaacagaacgagactctgtctcaaaaaatatattttttttaatttttagccaagcagatgtagtcaaatgcgactccaatgtggttactattgctaaacagcgacatctaagacagcagccactgctaaggttgaactaagcctattcccacccagaattttgtatctgcttcatgtgtgtactttccacaggtagtctgtgtgggccagatcatctgtgctgtggttgcagaaacagacgtacaggcaaaacgagcagctgaaaagataaagctcacctatgaagatctggaacctgtaatcttcacgatcaaggtaaacagggctggccggtctctccctacggttgtagaattaaaagtacctttgtaaaaatcttaatgaaggatctaattgtttttccttgccactggtttgctctggaaaaatcaactttctttggaaaacattacttgcatgagctgaaattatctttggttccaaggagtggaaaagacagaagtttctcacattcaaaaagtctagaagtgggcagtccaggacttctatggcattctgtgtgtttaggatccagccttcttatatctagtcactccatcatgcattgcttcctggagggcacatttggtccacaatggccacggaagctctagctgttacatccacattccagacagctgagaaaataaggtgatgaagaagggtgtgccccctccctttaaggacacttcccagtccttaaagggaggcatgtacattgcacatgccttcctccatctctttgtttggaacatggtcgcatgccacacctaactgcaa

SEQ ID NO: 98082 - DNA, 1051 bp, Homo sapiens
tatttttcagatccctgagtgagaggttcttgtacctgagctacctaagtagtctaacacaagcatttttcttcaaggaaaaggtaaacgaaaaaaaaaaggcagattcccaaacctcacccatcatgcacatttgacttatctcatgttccctggagagtcacatttaaataagaaattagtattcatcgtccgggatcatcatagtgtccccagccctcagttatgaacgtagcttccttctgaaggtttcgctaatccttcttgctggttttctctgcaaatctagaagacctttccttggacttcccatctctgcagccagcctaccgctctaattctcccttgcttgtttgacacctttcatctgtcccgggagacagtgattttccagagcatactggcttttaagaaaaaactaacagtggaaggaaaagtcggaagaactggcttttatgcttttttgtttttctgcaatttaggatgccataaaacacaattcattcctgtgccgtgaaaaaaaaacttgaaaaaggaaacgttgaggaggcctttgaaaaagtcgaccaaattgttgaaggtgagctcccagggatacttaatagactctgcctgattctattctgaagcaaccatcaaaagtgtatgatttcccctcagaaagtccagcctctaaagtcttggtgctttgccaaatttctcttacatctcttcctttcaaattgtgtgtgtgtgtgtgtgtgtgtgtgtgtgtgtgtatgtgcagttttggcgttggtgggtagggagcaatagcataaataaaagaaaatctctaagattttggtttgggcagagtaaggaacaaaacttggcacttttaatttgtgatccagaactattgtctctgaaacagattgccacaggacaaatgcctggttccttcgtcaggataaatccaggccagccaggcagggcacggtgactcacacctgtaatcccagcactttgggaggccgaggcaggtgaatcacctgaggtcaggagttcgagaccaacttggccaacatgg

SEQ ID NO: 98083 - DNA, 1002 bp, Homo sapiens
cagagtgagactctgtttcagaaaaaaaaaagaagaagaagaagaaatacctgaggctgcgtaatttataaagaaaagaggtttaattggcttatggttctgcaggctgtgccagtgtggcacgagcatttgctttcaggtgagggctttgggaaatttacaatcatggcagaaagtgaagtgggagcagggacatcacatagtgagagtgggagcaagtgtgagtgaggtgggaggtgccacacacttttaaacaaccagatctcacgggaattcagagtgagaacttacttattaccaaagtgttggtgctaaagcactcatgagggatccgcctccacgatccaatcacctcccaccaacattgggaaatacattcaacatgagatttgggaggcgagaaacatccaaaccgtatcaccaggtaaaaagggctataaaataccattaagaacattggggtttcatgacttcagaaattttaagaatttcttgcctaggaagaacaatgtacaagcaacagatttaattgcctttgagaaacgcttttggtgagaactctttaggaaggactctgcttttccttatgtgcctggtgtgctgtaatggaggcccaaagatagtcatggtgcttgtgacatgcactgtccagtgagggacatggtacaataccaccacgaatgtatcatacaaggtgctattagaatatggaaaagggagtgaccaactccacagggctgagaaggaaggggttcccaaaagatttggaataggaagcatttgaggtaggtcttggcagaagagaagaggttggtcagatggggaagagggaggtaggagcagcatgtggagcagcctgaaatgtagctgtcacattctagagcagggagcagcttgctgtgtgtggtgtagggtgtatgtgtatctgtgtatgtgtatgttgggacagggatggcaaagatgaagagggggttagcttgagaagggctaagagcccatcct

SEQ ID NO: 98084 - DNA, 1051 bp, Homo sapiens
tttttttttttttttgagacggagtctctctctgttgcccaggctggagtgcagtggtgcgatcttcactcactgcaacctccgcctcccgggtgcaagcgattctcctgcctcagcctcctgagtagctgggattacaggtgcgtgccaccacccctggctaatttttgtatttttagtagagacggggtttcaccatgttggccaggctggtctcaaactcctgacttcaagtgatccgccggcctcagcctcccaaagtgctgggattacaggtgtgagctgccgcgcccagctgatggaaagtttttatttaagatgaaaaagcaactaaactaaatagaacttaatcactgccttattgctattattagtagtactactgctattacttggtatgtactactattagtagtaatagagtggtcacagtagaccttaaatttatagaggatgttactgtttacaaaatattttcacatgcattttataattcttcacagaaactttgtgagaaagtaaggctgccttgctttcaaagcaagctaactatagatagaattgatgattattagtcttccagaacaaggccatggactaccattaagtaaacttaatgtcaatttatctgataagaaaaagtggaaccttttttctaatgatacatttcaggtcctactcttaaaaagcagtcttggaagatttcccagatctttctgggataaaattagttttctttaaaaaagcagtttcattttccagaacttaaccagtatagaaggctttagcatcagagaactttatacaataaggcttgcccagcacagagatccttagcactaggtgactagttatagtaagtgctgaaatgaaattctctgttagttctctatacctgtgctttgaattcaactcacatttttcaatacctaaatgccacgaagaactttcagaacctaagcgtgttaggccgttcttgtgtttctataaagaaatacctgaggctggtgcggtggctcaggcctgtaatcccagcacttcgggaggcaaa

SEQ ID NO: 98085 - DNA, 1100 bp, Homo sapiens
ttaaaggacaacgtttcacaaataaaaatgataactaatatgtccctatatgtatcaggccctcttctatgcactttatgtagtaaccccatttcatcctgaaaactaccctgtaatctagacactattattagtcccattttacagatggaaaagccgaggcatcgaggtcaggtaacttgtctaagatcatagcgctagtaagtggaagaggtccagttgaacccaagcagtctggcttcaccattataatgcaccgccttaccaccaagatcttatttattcattcaacaaatatttattcagctagagaccagtagagatagtgacatgttacgcctatggcctcacaaagcttatcttctatttttgccacgttttaaaattgtatcatctttccccagtaccatcttgatttaggcatctattacccctaactaaatgggacttttgcaataacttcctaactgtactatcccctttctcaacatttccagagcaatcttctcaactgcaagctgaatcatttctcttcactgtttaaatgcctctgtttatactcagggatagctctgaccaatgtttttcacctttacttcccatcacatttgtggttcttaacctgttattaccatcattgtggggtatgtagcaaatgatttttgactaaaaatgatattaaagtaagcagattattttctttaaaatgtaaagtggattaaaggttttcctgaactcctggcctcaaataatcctcccaccttggcctcctgaagtgttgggattacagaccacaccttgccacttatcttttctctgcttttgggtgcacccatgggaataggcaccgtgcagctagcaggggaaacgttgtttgtgaattgtattatggtaggaaaaggttccaaacaattgaactctatgctttggtcagacaggacacatcttgtcttgacctttcttgagatgtccttccctcattttccactgtcaaaatcccactattgtttcaagccttatctcaactactgcttttttcccataagcctttcttagtcatggatgtgaacacattccttctttgtaattgggctacaggc

SEQ ID NO: 98086 - DNA, 2349 bp, Homo sapiens
ccgccgcctccgccgctgctttcgctggagggcgggcggatgtacggggcgcctggggccccggcgcaaagcgcctcagtgactgtggtccgctcgttgcggcggccgccaccgcaggcgacagggtcagtggagaaagagccgcgggaccctacggcgccccgctgtggccgatggggtcctgggcgggaagcgggtgatctgtggctcgggcgggaggcatgggaagggtgtggattgggagacacgttaccggggaggaggctaggactgtgggatatgggcgaaggaggctgggctggctgttagttttgcaggcctgagtggtgcaaggcggccgctgttgcggtcacaggcatgacctagggtaggatggtgctgcccgtaaccaggcttgtcagaagaaggggttcaccttttgacagtgttttagaattggcatacacattttggatgcctgctgactatggtgataatctctctttgcgttctgcgatgcttagtggtcgtggaagatgtaagtgaatgtaaagaggaatgtggagaaaactgaacaattaggtttatgacgggtgatcactgtagcactacaatgtcgcttaaaagtagttcacagcactaatttgaagggtttcttgtagagagaaatgcacattttgacgtacatttgattcaagtgcaggtaattctttgtgcctgtatcgggtataattgccagctttatatcctgagagtgggtgttccatttgattcatatgtgactagactaaggtttgatgttttgctttaaaaattagtattatggcactgatattaaggctttatttctcctttcctagggtgtcttttatgaataatcaaaagcagcaaaagccaacgctatcaggccagcgttttaaaactagaaaaagaggtaaatatttacgttttaatgtctctcttcaaacctccagaacatcttgtgtatcttgccttctctgacaggtacttgcatattactaaagcctcaaaagaagataccagaaagaaacttgaatttctcgttgactgccatttcacatacacctttaatatttctactgctttactgctcaagccttaatttttagtatcaatatatctctaagccggttagtgaatcttcttttcggtgtgaaggtaaaatatttttaaaaataaaaataagggctctgttttcactagcaggcagtctcatttaagcaaacttaaatgagcaaaaatgttaatttataaaaggagaactcctaatgtagtcacccagattttgtgaagatttgtgagagaaaactcagacttcacccatggaagttaattgtggaacaggattcacattgtaatgtcttttgaaatacagacttagtagaaaaagtattagaattatattactattttttttttgcattagtgtgtacttaggtgagtattgaattctgtagcaaagtgctgtgctagtgatataaagctaaataagacgtagtctcagatatatttttactgtttttggtcaaaagcatattaaccttgttttacaggtggttttgaggaaatgaagaactaggtcagctactggttataagttgtgtttttctttttcttccttaagtagcagacattttgagatatatattgtagaattttaaaatcactaatcataggctgtctgtccccttgtagtagtggtggggagaccaaagtgtgatttgattctaatctttgcagattcatttagatttagctggtaaattttcttaaggagctggagttgtaaactagaacagtttggcagtaaaatgggaaagtgtatctcttgaatatgtgggttactgatgttaccttgatacaaataatagcaagtagctttagcattcttattattagcatcagggagagatgtaacttccccggttccagatagagatgattcgtggcctggctgttgatggttagggtactgggtagggtatacaacactccctgtctgggactgagggagtttccagacacaagactttcagtgctaaaaccaggaaagtgctgggcactcagaggtgtttgtcaccctagtactgtgtgaacagatgtcatctagcctagattgggaaagcaaaaccctattatgaagtgtgtgaaagcaactcagtaaaggtcaggtatgtgcacaaggctgtggtctgggagctttctattttattaatgtcatttggtatttacaacaactttatgggataggtactattcttatccccattttacagtaggggaattctggcatggcgagtgagactatttgcttgaattcaggtggttaaatggtggtcaggatttgaa

SEQ ID NO: 98087 - DNA, 1368 bp, Homo sapiens
gtttctgtcattgggtgctcattaaatgtactttctaaagctcaccttcataaatgccaaaggattggttcaatttttttgtttgtttaatattatggacatttaaggaaaaggatcaagagctccagtgtctggacaaaacccaaaggaataaaatgtacctgttagaggatggcctaaattttggaaaagccaagaggcagtaggagggcgttcccagtagaaattggcttatggcagtaggaacacaagacactagcacatttagatcacttgtgaaattatttgaaaagttgcacaattcttgtgagtgggccatcttgtcttacacttgcagaggggaaacatgcaaaggatgtgaatttaatctaacttatttaacaattgcatcttcataaggtgatagttttgtggcattttggtaaatcttttaaaactaaatgttttgggtcccttgtccccccagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctgggtaagtgtctgtggtttgtgggcttaataatttagaaaggtataatatatggagattatggagagtctagaatatgaactatttggcaaacttgttaaaatggagtgatttttttggttttgttgtattttggttttatccaactttagccccaggtggtacactggcagatgacatgatgcgtacagatgtctgcgtgtttgcagcccaagaagatctagagaccatgcaagcatttgctcaggtaaatgaaactttacataattgttttcagttggctactatccatgtggtatatttgaggaatattctacttttaagagttgtggttagaaagttgaaggaatttgattttaaattttagggatactgttcttggtgcaacgggatgaattagaaacttaaggtgtgttaaggcgaacaaaatagggaaaaatgaaattaactcttctgttcctatttgtcctgaaattactcaatttttaagaaaaatgtcaagctggaaaagtcagtttcgtattgtgatttctctagtttatctgcatacatttatttttaaagttaaatgagttgtgagctgattagcttgttaatcaagatctcattggaaagtttcatacgtagttatgtttgtgttactgtaagcaaagaattaaagtacatctaacctggacattcttatgtgtcactaggaattcttctcaagctggtttaagcagctcata

SEQ ID NO: 98088 - DNA, 1050 bp, Homo sapiens
agaggaatgttaaatcctaattccgccacagatttggagtaattttgcttgtttgtttgggttgttttttgagacagagcctcactctgtgtcccaggctgggggtgcagtggctcagtctcagctcactgcagcctttgcctcccgggttcaagcgattctcgtgcctcagcctcccgagtagctgggattacaggcatgtgccaccatgcccagctaattttctgtttttagtagagacagggtttcaccatgttggctaggctggccttgaactcctggcctcaagtgatctgccctcggcctcccaaagtgctggggttataggtgtgagccaacacgcctggcccaatattgcatatagatgcccagaaaacttgatatgtttatcaagcaccaggcactgttctaatgatactaattcactcaatgtttataaaaaccctgtgaggcaagttttattatccacattttacatgtgaggtgcagaggttaagtaacttgcccgagatcattcagctaatgagtattgtaacttagatgtaaacttggatggttagatcccagagcccacgtattgaacaggtagccagtataacatgctttactgcttctcttattgtaatgcagttgctgttttaacccttaattgttttactttttacagctgctgctgttcttgaagggtttttcagagtcggagaggaacaagctagctatgttgactggtgttcttctggctaatggaacacttaatgcatccattcttaatagcctttataatgaaaatttggttaaagaaggtaatcagccttaaaggatggtcttcagttgactcagagtggggtggataagagcatggtttactgttcatagatgtgacttctgtgaaagtcttcgtttattaaccagccttaaatttaataagttcagtctaattcactagacatttaatgaatacctttggcatccaggtttaatggctttctttaggcatacaacagatacccagatttagacaaaatgttgttatatgtaataaaaataaaa

SEQ ID NO: 98089 - DNA, 3033 bp, Homo sapiens
attaataccaattgggagacttggagaagatgacgtttggggaaaatgtcaagctggaagggaaaatcagttccctgtttggctccaattgtcggattattctctacagtaatttttttgaagcttttttttttttaaaaaactgcttgcagtagtgagtatttaagttaccttactgtaattctcacaacagtcttgtcaagtgtagagactgttgccctcaatttatactttggaaaacactttaagtaacttggccaagaatatacaatttgcaagtggtagactagggagattggagaagtgataaactgtggcccaggaaagttcagggttaagtttgtgaggaaagtcagtaatcccatgtgattgaactatgaagggaaggatatagggggacacagtgattgaaaccagggaaggtacttctgttaattaagctattttcttttacaggagtttcagcagcttttgctgtgaagctctttaaatcatggataaatgaaaaagatatcaatgcagtagctgcaagtcttcggaaagtcagcatggataacagactgatggttggtaactttttttcattcttcccattcttgccaaggatgtaaatgagagaaatttctcatttttaagactgtgaaaagaaagtgtttttcttaatctgatttaaagaaagtttaaccagataaattcttcttttaggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatgtaagtttttgtttaaaccgtctttttatggctaagcttctggcatagagattttcactaatttgaggaacttacttcaccaggatgagattgagttaatagtaacaggatgttatactggaactttgcctcattcttttgcatatgcttcttcagtgcctgactgaggcccagaaatacaagagactggagctcagggcacctttcagttgtaaaggtctctttttatatgtggtacacatgtggttgccagttgcatggaaaaggagttgttagtttttgttaaaggtctaaacttgatgtgtgaagtatgtacataatcaaaactgacttctgttactaaatttggattcatttgcagataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaaggtattagaactatgccttgacaaaacaaactattctgctttcacgtggtgataagtgaactgtgactatatttttctaagaggatttatcacatcctgtggttcctagggatggcccaccagtaaataaacaaatagtaacattagctattgatgataatgctctgaattgggctgtggttcacaggttaaaaacaagaatatggcctggccaggcacaatggctcacgcctgtaaacccagcactttgggaggcaagggcaggaggattgcttgagctcagtttaagacgtgcctgggcaacatagtgagacctcatctctactaaaaatcacaaaaaatagccagtcgtggtggcgcatgcctgtagtcccaactactcaggaggctgaggcagaggatctcttgagccctggagatcaagactgcagtgagcttatgatggctttgtcagacaaagcctgggtgacagggtgagatcctgcctcaaaaaaaagaacatgatgaaaaggaacttcagcttgtaattagatgtttgcttttgaagggggtattggaaaataggaatttttccccccctctaaaatactaatattgtttgacatttacttggactacttggtatagtattgtttattttacttagctacttagattttctgcttttttttttttctcttgagacagtctcactctgtcacccaggctggagtgcagtgatgtgatctcagctcactgcagcctccatctcctgggttcaagcagttctgcctcctcggcctcccaagtagtgcctggctaatttttgtatttttagtagagacgagcttttaccatattggccaggctggtctcgaactcctgacctcaagtgatccacccgcctcggcctcccaaagtgctgggattacagacgtgagccactgtgcccagcctattttttaaatttctggtaaataagttatagtttgcagtgattataaaagatgagttaagttctatattgtctgtattgtaggagttttgtaatggatggttatttgtaatgaatgactaaatcttttctctgttcctttaaaagcaatacagccctctacttgctgcctttactactcaaggtcagtctgagctgactctgttactgaagattcaggagtattgctatgacaacattcatttcatgaaagccttccagaaaatagtggtgcttttttataaaggtaatttagattttgaattttgtaaataacacttaataaaaacccttataaacacaaaattatccaaatgatgagttatctggacatcagctccctgaaatattttacttctagttatgagtcacctctgattaaattgggtgctttttagtgcactgatacttgtttaaaacatctaaaccctattcacaagttgaagtatgaaatctaaagccatcattatgcgtcctcaaacttgcctcctatactcttaaccaggtatacattcccaaagttcagctaggtgtggtggctcatacttgtgaccccaacactttgggagcctgaggctggaggatcgcttgagcccaagagttcaagaccggcctggactgcataaggagacctcatctctacaaaaaaaataaaaaattaggcagggaatggtggc

SEQ ID NO: 98090 - DNA, 1752 bp, Homo sapiens
aatcctagcactttgggaggctgaggcgatcaggtcatttgaggccaggagtatgaggccagcctggacaacatgggaaacccagtctctactaaaaataaaaaattagccagttttggtggtgggcgcctgtagttccagctacttgggaaactgaagtgggaggatcacttgaacccgggaggcagaggttgcagtgagccaagagggtgctgctgcattccggcctgtgggacagagggagactctgtcttaaagaagcttcaaagttataaatgggaacttttgccttctgatacataatgtttgactgtttttttccccttttctagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgttttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattc

SEQ ID NO: 98091 - DNA, 1116 bp, Homo sapiens
ctgtatctgtataccattaagtaataattagactcccaaactgtaaaccacctacacagaattctggtgtagctaaaactacattaatatttctacaaccaattcattgcatgtttcttccatacaaagtgtgccattttatactgtgtatagtgaaaaagtgtgtcatcttccagaactacattattatctttgatcgtagtttgtttcttcataatgacactgtagtgtttacttagtagaacattatagtaagtggatatcacttgtgacagtaatagtgtaaagaaagggaatgctttataaaaagattgcagattccattccatataaaaagattccattctgaatcttaagtggtaattttagaattcaggtgccagtgccagcctatggcctcaagtatgtaattcttaatatagatgttaaattgtacttttaattatgattggataaatgttttttctaactgtcagtttctaaggctgtctccttagaaactaaatgagtttttagagctggttgtaagtttcttagccttactctgtgagttatagatgttatttcattctatatatagatgtttattccattcttatttaaaaaaaaaaacctccatataccaaaaatgctacaggatattttgaaatagcatattttagttaggggaaatgcatgtgaccaagaggttggacttctaattcagtttttcaaaagcttttttccattatcatacccccagcctttttaggcttttttttttttttttttgagacggagtctcgctctgtcaccaggctggagtgcagtggcgcgatcttggctcactgcaagttccgcctcccgggttcacgccattctcctgcctcagcctcccgagtagctgggactacaggcgcccgccaccatgcccgactaatttttttgtatttttagtagagacgaggtttcaccggattagcgaggatggtctcaatctcctgaccttgtgatccacccgcctcagcctcccaaagtgctgggattatgggcttgagccaccgcgcccagctagacttttttctaatagagtcccccataaattttattaccatagatacgctgtgtatgtactgt

SEQ ID NO: 98092 - DNA, 1051 bp, Homo sapiens
agtacatttaaaaataccttagccgggcttggttggtgggcgcctgtaatcccagctaggaggctgagacaggagaatggtgtgaacccccaaggcggagcttgcagtgagccgagattgtgccactgcactcccgcctgggcgacagagcgagactctgtctcaaaaaaaaaaaaaaaaaaaaaaaaaaaaaaaaaaatatctatctatctatctatctatctatctatctatatcttcatcccatcaactcattaagaactgagactatactcctagcataaagatgaaaggatgataagtacactggaaaataaaaataattagatttgaaatgactgttaattgcctctagttaagctgggagaaaaaagtgaagagaaaggagtcagaaagcctttctgatccagtttcatataattatgtctaagattgttcagatattaatccacttaagagtttttggacaaaagccaattataaactcattactccaaagacaaaggtacttgtcacatcatccagattccacttaaatcaagtccactgaaaacctttttattcctggtattttaacctgtaggccttagtaggctggggaatagaaaaacttcgtattgatactagaggactaatactgagcatgaaaaatcatagcaaggcaatttaccagaatttgcaaatacttatcaacctattttatatggcacctgtagacagcatctgaggaatatttgtacaaaggtaatttggtaatttaagtaacactgtacactaaaactttggcatctacattacatttaaagccaaccaatagttgtcagttcctgcaagcagcctacttcagtatgagagcagaggtttatcagtgttatgcctacaactttaattcattcatctagaggattttcactgatttttatagaaagaacccaaatgattctacttagtaatacatttataatcaagaaagaatctgttaagaccttgaaagacagcaggaaatgctttgtctgttgcctgtggtggggtaaggaacaaagcacaactg

SEQ ID NO: 98093 - DNA, 2648 bp, Homo sapiens
tggctaattttgtttttgtatttttagtagagacggagtttcaccgtgtagtcaggatggtcttgatctcctgccctcgtgttccacctgcctcagcctcccaaagggctgggattatgcctgtagcgtgagccactgtgcccggccaattcagatatatatatatcttaatagaggtgggatctcgctgtgttgcccaggctggtcttgaactcctgagctcaagcagttctcccatcttggcctcccaaagtgctgggattacaggtgtgagccactgtgcccagcctacattacatgtgtttttttttttaaagtattagtgttaactaactttttaatttctttaacaaacattgagtattttttttccttaaattttgctttgctttgcagccctagggtggtcccaaccatgtgatgtctggagcataggatgcattcttattgaatactatcttgggtttaccgtatttccagtaagtgacaatgatctatttcaaccttgctttgcacaagaaaggtgcctgtttatatgaataaatacttttgcttcccccattatagactattaattgtagataagcataaataaactaattcatatttctttcataattgttttatttaaaacatctttcagtatataagcaattatccgtgtccatgtagggaatcattggcgagtttgttctgcaagccttaatgttagtttttttgctgtcagctttaactgtgtctgttttggtggtcatcttccccaagtctgtttttattttatttctagacacacgatagtaaggagcatttagcaatgatggaaaggattcttggacctctaccaaaacatatgatacagaaaaccaggtacgttttaagagttagtgacatccttagtatcatttgatcacatctgctgattagaacttaattttttttttttttttgagatggagtcttgctctgttgcccaggctggagtgcagtggcgtgacctcggctcaatgcaagctctccctcctgggttcacgccattttcctgtctcagcctcccgagtagctgggactacaggcactcgccaccacgcccgcctaatttttttgtatttttagtagagacaaggtttcaccatgttagccaggatggtctcgatctcctgaccttgtgatccgcccacctcggcctcccaaagtgctgagattacaggcgtgagccaccgcacctggccagaacttaatttttttttttaaattttcactctaccaagtctcaggcgctgattaggactttataaataatgaagtcaaactaatattttttcagttaaatagtagattaccttggtgcaaagcaggtaacatttctatcccatggctgccatttaaatctctagaaaagtgatctgggaaagcatagtaattgatacctttgctagctgttttaagttttcagtgttataaacatgaatggatattgacttatttttaggaaacgtaaatattttcaccacgatcgattagactgggatgaacacagttctgccggcagatatgtttcaagacgctgtaaacctctgaaggtaagcctttgagacattgctcaaatagtcaaaactgagtttcttctgtttgtcttttgagaccgagccttgcttcgttgtccaggctggagtagagtggcacgatgttggcccagctcactgcaacctctgcatcctaggctcaagcaggtctcagcctcccaagtagctgggattacagatggatgccaccacgcttttttttttttttttttttttttttcaagtaaagacaagttttactatgttggcctggctggtcttgaactcctggcctcaagtgatccacctgccttggcctcccagagtgctgggattataggcgtgagcgaccatgcctggcctcttttctgtttttatggtggttatatatatatggtttactatactgttacatagtgtagtcaatggtagtggaaaaggctgttgaatgaatttctttttttcttccaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaagttgatatgtatctgaacagtttgttctaagtaccatttttcttcctacttctattaaagaatggacatagatttctgtttttggagacttcctcaagtctttgggaaaatttagcttcatttccattttagggattgtcaagattgagacattgccccctaagttaaatgtaatgaaactagattatgggacacacagaacttaagattagccgagaagagttccattttattcctactcaaact

SEQ ID NO: 98094 - DNA, 2130 bp, Homo sapiens
caccgtgcctggctaattttcatatttttggtagaaatagggtttcaccatgttggtcaggctggtctcgaacttctgacctcaagtgatttactaccctcggcctcccaaagtgctgggattataggcgtgagagccactgctcccggtcctagagctctttactctttccccactgtatcctaactcttttggcaacctggactaaaagaacatttgagataatgtttgacagtgacaggtaccatataggaagaagttgtttagctgaaataccaaaaaataactcatgtgagtggtggtttgatgaaagaaatttgtgtcattcagcatgtaatagaatcagaactgaacactaaaccataaattaaaaaaatacagtgggtcagagtagtagtacagtttgaagacagtaatacctggaattgagcatcatgtctgtcattcttaaatttgcatgcatctttctaacaggggaggtagacatgtagcagtaaaaatagttaaaaatgtggatagatactgtgaagctgctcgctcagaaatacaagttctggaacatctgaatacaacagaccccaacagtactttgtaagtatcagattagaacttgggaagtggtatcaggtatatttaaattaggagcaactatacttagctatttttcatgtgtttgtagccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattgtaagttcttggtatatcttcgttaatttgctggttttatccattccacatatcaaaatgtgcatcctaagtgtgtacaatttttatttgattaaaaataaagggggaggaagaataggtatgaagagatttgattacaggctgttgatccagcagtgtacatttcattcagcaagtaggatatccaccatataacaacgtactttgttgcagactatgatttagacttttctgatgcgcaaaaatagtaacttcgaatgctgggtaaaaattaaggcgtgatatatctcataaaagaaagcttcataagaggtagtaagttttagttactggtgattttctagcagactggaatgttgaccattctttgggaaaggaatcagaggttttttgttgggtttttttgttttttgaaatggagtctcgctttgttgttcaggctgaagtgcagtggcgcagtcttcactcactgcaaactctgcctccccagttcaagtgattctcctgcctcagcctcccgagtagctaggactacaggcacacgccaccacacccggccaatttttgtaattttggtagagacagggtttcaccatattggtcaggctggtctcgaactcctgacctcaggtgattacaggcgtgagccactgcacccggcctgttgtggggttttgtgatttggtttggtttggtgttttctgattacagcaactttctctttattctcagttttgcacagtaataagttgactcacacagacttaaagcctgaaaacatcttatttgtgcagtctgactacacagaggcgtataatcccaaaatagtaagtcttccaaaatattcataaagtatcttatgccttaatagcttatgccttcttaaccatcatttatgattttcagaaacgtgatgaacgcaccttaataaatccagatattaaagttgtagactttggtagtgcaacatatgatgacgaacatcacagtacattggtatctacaagacattatagagcacctgaagttattttaggtgagtattaattgtcctttgagaacctttgtatttccttattgagacttaaaatttttttagcagttttaggtcttacttgtggggctttatcatattctctttaagggataagtatcatgaagtgcattatggattttaagctctcaattgtaccagataattagctctgggaatttgagcaagtggcttaacctttctggaattgttttcacatttgtaatatgtggtagggtttttaaatgtaa

SEQ ID NO: 98095 - DNA, 1774 bp, Homo sapiens
attattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgtaagtttcccatgttgggattacttttagggaagttggcaatacaggtaattgatttagctttagaaagtggtctgaccatgagttagatacatatctttatacccttttttacttggatgtaagacacttccagttaagaggtacttgccccttcatattttttaaacagctactaatagtatgtataatttctaattttaggctgagaacacactttatattgttttgaaagtattgttttgttgttcaactggacactgttgttaggccatatttttttcccccaccatattagtggttctcagccttggttttatgttaagatcctcctcgagaggtttgcctaccccagaccttttcagggtagttacctaggaatctatatttttaggaagtgctgtaattcattctgataacatagctggagataacttggtgtcccaagtttaattatgtatgtttatcaaactactgattgaa

SEQ ID NO: 98096 - DNA, 1120 bp, Homo sapiens
ttgatcagttaggttggggcagaaataaatcacaatggtggaatgtcatcagttaaggctatttttactttttttgtggatcttcagttgcttcaggccatctggatgtatacgtgcaggtcactggggatatgatggcttagcttgggctcagaggcctgacagcgtggacttctatagtgctatatttgtactactgggagggcaggggtaaaatgtaccaaaattagtaaattgtgattcctccctctacttttttcacttttttttttttttgcattcttccaataaatctgggcatgatatggctaatgcagagtgcctgtgaatgaagttcaaactgcagaatatgggacaacacagtaattggatttatcagtgatttcagattgggtgataatgattcttgaattttggtcttaaaacgaggtcacgaggggacctttgtaattacgaattttaaacagctcagtgtggggtacaatttaactaggaaaaacttgccttttatgtagatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgataggtaaggaggatacttaaaatgtctgaatataacaatacattactagacaaaactagtatcacttaaaataagtacctgattactaccattcgtttgtttccaatgagagattttgatggtttgtaatgtttgtaaaattaagctgcttgtgggggagtctaggtgctgtcttgaagagaatgtgaggatatttggtcttagcataaaacattgaaaataatttttatttctctagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtactt

SEQ ID NO: 98097 - DNA, 1050 bp, Homo sapiens
ctgaagattttctttttgtttttggttgtttttttttttttttgagacggagtctctgtcgcccgggctggagtgcagtggtgcgatctcggctcactgcaacctccgcctcccaagttcacgccattctcctccctcagcctccagagtagttggaggcgcctgccaccacacccagctaattttttgtatttttagtagagatggggtttcaccatagccaggatggtctcgatcttctgacctcgtgatccacccacctcggcctcccaaagtgctgggattaccggcgttagccaccatgcccggcgaaagattttgtattttatttcaagaggagaaggaagctattgaagtgttgtaggcagggaaatgacatccaaagtaatgacaacagtcatagtttaaatatgctgctatcacgttttcagtaaatatgattggttttttgtcttaactgggtttctgctgcatcatttctcaatcatttttactcccttcagaatttcttggctctttgtgccagtaattactacaatggctgtatatttcataggaatatcaagggtttcatggttcaaacaggagatccaacaggtaagttattccattaaccaagatctaaggaactgaatgtatagtatgaagaagtgggtaaaagaagaggaattaaatacgtggagtttttgttttgttttgttttgtttaataagttctgttctacaagtacagaacatgcaggtttgttacataggtatatgtgtgccatggtggtttgctgcacctatcagcctgtcctctaggttttaagcccagcatgcattagctattcgtcctaatgctctccctccccttgcccccacccacaactagccctgctgtgtgttgttcccctccttgtgtccatgtgatctcattgttcaactcccacttatgagtgagaatatgcggtgtttggttttctgttcctgtgttagtttgctgagaatgatggcttccagccatccatgtccctgcaaaggacatgatctcatcctttttatggctgca

SEQ ID NO: 98098 - DNA, 1036 bp, Homo sapiens
atgggatggacgtttgtgtattatgtaccaggctttgctaggttacataattcattagctcctctggatggcctgtgaagtgggttatagtatctctgtttcgtaggtgagaaaacaagattggagaggttaaatggcttacctaagttacagtgtgctggtaagtggcagagccactatttgaacccagatctctatgacgacagctcttttgcccatatgttttgatgcctcaaagatccaggcctaaagtatacctgtgtaccattttctttgttttgacatcagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggtgagaagcctctttcatatttgatattttccctgcaaatactttgaaactttaggatgtctttccagtaaagttttaactgctttagggttggggagggcatgattccatttttatataataattttaaaataatgttgctgaaatttggcagttaaattgcatttgaaaaaggaaacattttttattcttatggagtaaggagagcagaagtcttccttactggactgagcttcatgattcctcacttttgtggcacaatgcctgtcacccaggcacttggaaa

SEQ ID NO: 98099 - DNA, 1022 bp, Homo sapiens
tcccacaatattttctctaggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggtacaatttatttttctcttttttttgtgtgtatttattggtaagcatcttccttacaaagtctataaccctggtatttaggcttgaaacaaatagttttctctggagttgatttacaaagtagcatactcctcatttgtttgtgggtcctggagaactatggaattttttcaaaacaataaaaacggtaagtaacactaagtattttctatgtcaggggactatactatgcattttacctacagtatttctaatcctggtaatgttcaaagatagttgtttttactttagagaatacagatagatcctagtgatgtggtgataaggcttttattggttcccagcaaatcagtgattcccaagtgcttttttatatttatctttacattttaaatatatattttcataaatcagtctttttatttaacatcatgggaaatatttttctgaatagtctttttttgtttgttttaagagactcccaggctgggcacggtggctcacacctgtaatcccagcactttgggaggccaaggctggtggatcacctgaggtcaggagtttgagaccagcctgactaacatggagaaacctcgtctctactaaaaatacaaaattagctgggcgtagtggcgcatgcctgtaatcccagctactcaggaggctgaggcaggagaatcacttgaacccgagaggcggaggttgcagtgagccgagatcgcgccactgcactccagcctgggagacagagagagactctgtctcaaaaaaaaaaaaaaaaaatgcagatttttgtattcacctcagaccttataattagaatggagtttgcctgagaa

SEQ ID NO: 98100 - DNA, 1050 bp, Homo sapiens
aactgtgctgaatgagaagtgtggaaatggagactgccatcatagccaacttgcttggagaagtgcagagataatgtgatagatggagaggaatgaaggtgtgtagtgagggttactgaaaaattggacacacttgaatgtattaaatatttaaaagccaacagggaaggttcttgttgaaaggaggaagaaaggacacagacatcaatagtgttagattctaaacagggcaggaaggtgaagaatgatctaaagcacaatgaaaaaaataaatacccacctacccaccctctagttagttgtcttttccactataaggatgtttaactataactccatatatttaagtatatatgactgtgtgcccttttgcctttttatacttatatatttaaaaattacatccaagaaataaattcattttttctttagcctctacaatagaagagttcatatacctcttatgaatgactaacgtacaggtattcttaaatctttcagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtg

SEQ ID NO: 98101 - DNA, 1048 bp, Homo sapiens
acatagcaaattttcaagcagctctacagatccactgctgagcaaggtgtttgccaacacaaattgaaagacaaacccagcttacttttaaaattttctgtgctaactatggatgtgtatctgccaagtacatatttttcatattctaggcatcttaggagattttcttcccctttggcaaaaatgatttcaacaaacattttaataattgttctgctctcatgacttacttgttccttctttaaaagtcctatcaatacttgttcactgctctgggataacatgcaaatagcacttttattctgttcttttgtatgggtgtttgtatattgggtcatgtcttaagtgctgacttatgttcatatccttttgaacttgccaggcctttcttttcaagatttttaccagcagtgtcgggaggcattcctcgtcaatagtgatctgacactccgggcccagttaactgaatttagggaccacaagcttataagaacaaagaaggtaagactccactattgtagcattgtatgccaggaatagtccgtatcatttacttaaggacacatatatgtttgacttagacctgattttgaaactgatgttccctgttgagtcacagagattcatttaggggatgtgccatttgagtttgtagaaagagccatggtagaagtaccctgcttcagagcagagcagaaaactcacatgttctagtccagagtaataggcaattagaaacatggtgagtcaaataattctgttcttttgttttttccctcttgctcattcattaatttggtctgtatttattgagtactaactacatagatattgcactaagtattaggatacagtagtaagcaaaaatctgattgcttttcttatggagcttaaagtctaatgggggagatggacattagtcaagtaatcgcacacataacattttaactgtaaggaagtcctatgattagaaggtacatagttctgaaagagtttatttaaataggtggatttgacctaattatggatagatatcagaagagaccac

SEQ ID NO: 98102 - DNA, 1050 bp, Homo sapiens
gcctgtagtcccagctacttggaaggctgaggtaggaggatcccttgtgcccaggaggttgggggtacagtgagctgtatttgcaccactacactgcagcctgggtgacagagtgagacccttcctcaataaagaaaggaaaaaaaaaagacttacttgaggagaaacaaagatcttgatatataaaaccatctctctttttttagtctaaatggaaattacatattgtaacttaggaatcatttttaggaacagactactacttcacctagtcatttctttaacttatatgatcctagtaattactcagttttattactgaaattaaatatgcttggtccttaactggtactgttgctttaaaaagaaaatactaccaagtaaagaatttcacgtgtcctattttacattaatattactgtctaattttgatatgagacagatatttgaagctactaaggactgactactctgttcactttcagagtgacttagtagaagaatattttgaagctcacagcagttcaaaagttttaacctctgatagaacactgcagaagctaaagagagctaaactggatcaggtatgttacaaggaatgttacttctaaattttttttactctgtcctgaaaaatatgctacgtaagcaacagatttgaaaagtatacacaagtagaattattgtcctgatcaaatgaaacacaagttaatgtgattattacttcttttattatataaatagtaaataggccgggcacacctggctcatacctgtaatctcagcaccttgggaggccaagggaggaggattatgtgaacacaggagtttgagaccagcctgggcaatatagggagacctcgttgttactaaaaatttaaataaataaataaataatttactggattagacagactgtaattatgcatttttcccctcttactcgtttattatttcttcaggatctatgataatcatcagggtcatagttccttgatatccatttaccatttatctctgttattcatttaacctatatgtattcactaa

SEQ ID NO: 98103 - DNA, 2126 bp, Homo sapiens
gtaatcccagctactcaggaggctgaggctggataactgcttgaacctgggaggcagagggtgcagtgagctgagatcgcaccactgcactccagcctgggcgacagagcaagactctatctcaaaaaaaaagagactatcttgttcttaatcctcttcaattcttcctttttattcttttctccctggctcctttgtagtttaatagttatttaaaatcaggtggagcatttttatgtttcagtataacaccaaaatgatctcagctaagttgcttttgttgcttcttttcatatgaagttttttccctatcctgtgaatcagcctttaatccaaaaatgacataaagagaagagcaaggactgagccttaagtatgcctagaatgttgaggaggctgaggacagtgaagaagagatgaaataaccacaaccagtagcttgggaaccaggataatgtcataagactcaaatggaggaattaatatcaagggaagattaaaaaaaaaaaaaaaacttagtgaatcatatagaagaccgaagggattaaggaagaagaagcagccaattcatttgtagagattgttatgagtattttgggtcagtttcaagactggaggataaaaatgggggcaggttagaaaggtttaggagccagtaaaatggctttcacttgtacaaatttaactacaccttctccatttagagaaaaaaagcaaaaaagcagttaatttggtatgtgccctttttctcagtgaacagtgtcccagtgtgagagttaacttggaaaaggtaaatctgtttcttcatttgggttcattttccacatgcctctcatggtgtgagtgtgagagcatcattaaagataacacttatatttttttatttaaaatggcctctattataagtgatttggtctttggtctttagaaaaaaaaagcgagagaaagaaaattgttaaagtaaaaataaaatggcccctaaacaaaagaccactattccatttattctcggttgaagaaatggccatctgttcaacactctattttatgtattatttatatgtattatagactttttggcacaaaataaactgttcacactttatggaagatttaaaagattttaaagtataattttaactctgcacagttttcacttgattttagatctcactttctggcccttctttctcaccccccatcaaagatgtgcctcaactatatatggtaagaaatgaaaggaacataagtggttgatggagaggagagtatggtaattagagaaagcagcaaggtcaaagttagttatttgtattttcttttaaagaaatctgtgggtaatatgaaggaaaatttgaagattctgggaagacagctaataaaggtgaaagcagtattactcctaatatgggtaggattatttttctgataaaagtaacagaggtttttaaagaatttttgtaagcgtaataaggttatttccctctttatctactgttgtcctttaaaaggtttttatatatttctttgtttacagcttcagaactagcaaaaacaccacaaaaaagtgtttcattcagtttgaagaatgatcctgagattacgataaacgttcctcaaagtagcaagggtaagacattacattagttctttgaaaagaattttcatagttgcttcaagatagagcatgttacttttttccttgtttgtgaatttttatatatattttcttcttttctgaaaattcattcaacaaaatgcaattaatatttcaactcatgtaccttagtatacccgtgtttagcagtcagtaagagggaaaaatatctgtgctaactgaagttgtgcaaattgacagggttaaccagaaatagtctttaagtcctgttgtcatgtgcttgagttagccaattatttatagaagatttggctttgggaaatactatatgaaataaggcgtttggagtttggaagtcttacagattgtggagcagctgtttttgaatgatccattctaactagattaaaaagtgtacatttcgttgctctttatttatatttttgtttttgtttttgaacaccaatgtcacttgccgacatttctgtttttttcattttttagagac

SEQ ID NO: 98104 - DNA, 1127 bp, Homo sapiens
gtgatcacctggctcagcctcccaaagtgctgggattacaggtgtgagccactgcgcccggccaagaaagcttctaccataaaacagctgtttaaatctcaacctcaacaattgtacttttcatctttgcttcagaaaataaatataaccaaaaaactccctttagtcctcccttcccagggacaactgttactaggaattgaatgcatatccctctaatctggggttttgctatggttttgtatttttacatagatgtctgtgtatctttgaatagcatgttaaaacttatataaacagtttcatagcctgttttctttactatgtatttccaaatattttatatataaatatagttaaatctttatgcaaggctatgaggggtacaaatcttaagtttttttgttaaaatttttttctgttaattttgttcttttttcctaaatgtatattgcatttttttctttcagaatcattgaaaaatggctctgctacaggtggtggaaataaagtttattcttttcagaatagaaaacactctgaaaagatggctaaattaggtatgttgcttttctgatttctataactattactcatctttcctaaggtagatttaaccacattccccatgattattataccactacatttcctaaaagaatgaagagagattccctatggtttagggaataatgagacgttccctaaaagaaggatgttatattaagcacaattaagttcatttgtttttttcatgctcagatgtcttctgttttcagctagattataagcttcttgtagtatgtgcacagtctttgtttttctttagtcctctccaaaatatgtagcttagtttctttttttttttttttaaaggtggagtctcactctgttgcccaagctggagtgcagtggtgcaatctcggctcactgcaacctccacctcctgggttcaagcaattctcctgcctcagcctcctgagtagctgagactacaggtgtgctccaccacacccggctaatttttttgtatttttagtagagaaggggtttcaccatgttggccaggttggtctcaaactccaaacctcaagtgatccacccacctcggcttcccaaagtgctgg

SEQ ID NO: 98105 - DNA, 1063 bp, Homo sapiens
cttattataatgtttatggattatttcacttttaaaacttttaacattttcttttgaaaatatagcgcaaaggattgatctggttagtaaaactaaataaaaactgctttaatttttagtttaattctttcaaactttaattgaaaatgttcagtaaagcctaatataaaacaaaatgcccaggagtggtagtcactaataactacccattgtaatttaaaatatgtggttattttgaaccctaaaaatatatactttcaagattgtgtgtgtttttttttttaactatataaactgtggaagagtggtcagagtggtcagttttaatcaaagagaaagcttttttcccagcttttaagtaatgacaatataaatattataatttcttatttaaatgtaatgtttagaaagaatttatacctgtcatgctctatttctttggatgttcttataggagctaaattgaagaaggagcgagcgcagcttttggtcaaccccaaaaaaataataaagaagccagaatatgatttggaggaagatgaccaggaggtcttaaaagatcagaactatgtggaaattatgggaagagatgttcaaggtatttgagggggtgaaatatacactcgtttctgctagtagcagaaattgctttataggatacacaaaagtagtctggtaggttaaacagtggtgttctatatgatcatgtttctcatctaaaaagcatttgcttcaatttctccatagttcttttttttaacaaccagtcctgcacatagttttcagtaagaaggaatctatagaccaaccactctaaagttattttatttttaaaatttttccaggatacatgtgtacaatgtgcaggcttgttacataggtatacatgtgccatggtggtttgctgcacctttcaacccatcatctaggttttaagccccacatgcattagctgtctgtccttatgctctccctccctccacccacccgcaggctgtggcatatgttgttcccctccctgtgtccatgtgttctcatttttcaactcccacctatgagtgag

SEQ ID NO: 98106 - DNA, 1945 bp, Homo sapiens
ggtttgctgtatttgagtataaacagctcagtgttaattatatcaaaggaagttctttacatcttcattgattacaaaatttaccaaagaaaatgtatctaccaaatataatttttaaagtacttgttaaggaatgaggcctctttaacatataaagtatcttaaaaatattctctgacctggaaaataggtttacagtagctacaagattccattttaggttttcttatgtcaataaatgtcaatattttacacttccagcaaaagtacccgttaaagctaaatctaaatattattcctcatagcacagtttctggtctccttaaattaaggatcctactcatcaggattgaataaaaagggggaaattcctaaaattggtatattgtataatattgtgggttaagtaaaatttaggggggcattatggaaatgtacctattttaaagggcagtggcaattactataatattggttaaactggtaaagtttgttaaataatttatgtccatgatcattctgagtgttttttttctttgcagaaaaacaggattgggttaagaaaagctaaaatactcatttttttaaaatgtatagcccaataagaactaaatgatttatttcaaaagttaaataattttttttggaaatcatggaatgtatttgcatattgatgttccaaacaggttttatgtattgttttttatagcagggagtagttgaaaagtaatgagtatattgattagctgtcttggaaagagaggattggctttctaacaatcactgatacaggtttgggtttgggggggtttgtttgtttgtttttaagttttatcatccatactgaattgagagatatgctccatgtttaaaaatatttgtaataagttcatctacttgacactgaatcttttttattcttactctaaaattattctggctttacattcagtttaagtggttaagtgaaacagtttttagggtgcaaaaattattttcccactgtttttctcatgataatttgagtctcctgagctataatttctgaaggatttttactactttggcattatgtaatctgatctctgtcacaatgatattaaataagaactatctcactttcatatgtttgcttcataaaaggatatggaatgtacacatcagctctttttttttttttaaactagcatcaacctataacttggtataaacttcccaagtatttagagaatagtgctggtgaaaatttaaataggataggcatatagaaattatgacttgtattgagtgatgtcctttcaacctaggactagtgacaaccttcattttttcagagctgaagaaaaaaccgtgaatttaagatcatatttattggtgcatgtaagccattatcctgtcttaatgaaccgattaatgctgttgattgttgaaatgtgaaatgtagtcactgttgaccttgtaaatatctgccagagatgaaaaaatattttaagttattgtaaataaagatgtataaaattcagtatcagtctgcaatgcagaaacatatcttagatgttaaaatactgtgtttgagagatgtgtaatttacccttagatgtatctagttacattaagagtgtaaatttttttgtacagtataaaaatacagctctatttggcttttaactggatttccctgagttgattttatcttacgtaaattttatatcttaaaagggtcttttcatattttttcaaagtgtaccatttttattttatatctgaacctttatatcataccctattacattaaggcagtataaaaattatatttaacaccacaaaataagaaacaagacaaaggcaggtgtgaaattaatacataaaacgtgccatatatttctgtagttaattgcaggggtacagatttagcactgaacgttaaagcagccaaatgtaaaga

SEQ ID NO: 98107 - DNA, 2575 bp, Homo sapiens
tgtttaatgtaatgcaatttgtgtaccttctaatcatatatctgcagttcctcatttttataaaactttgatatcatgccagtaagctagatgttgaatgtatgtaagtagcatttggtaactgctaagaggttacaaaaacattattggtaaaaaaaatttccttagttctgatctggttggataagattttatcataacttttctgggtctcaggctctgatgtttgaaaaagaagggaatatattgggttttaaaaaagtgtattgtgacttaaactgttataagttatccttccacagaatacatcagagctatcagtgctttgtacatttagatgtttttacttgattattgtttaagaaaaatatactgaatttatagaaagcaagtattctcctaattagcaaaagttaaaattttatctctaccattaaaattacaatagattttgataaataaccagaaaaaacgcctttttttttttcacacctagcaatcctcccgtttttattgtaaggactttcttttttccctaagagactttctgttagactctttatatatgagatgcttgtttaaatatggtggtctgtaacatttttccagctcatgtgaaaatggaaaactagaacctgaactagtatctacaacattgccaaagtccagggtaaagctaaaagttgataagtagacaatttattgttttgtgtgtgtctgtgtgtgtgtgtgtgtgtgtgtgtgtgtgtgtatggtgtgtatatgtatatatcacaaagttgtattttaaatattttaaataccctttcttttaatttaagggatgtcaaataaatgaaaggagtttaaaaatagccaaaataaatgagctataaaggcccataacatactaaaacaggcagtttcaggtatgtaaggaaaggaacattatacttacctagaaagtgagatctaaaaaaaaattaaaaataaataaaaaataaaaaagaaagtgagatcttggctatggctggaggtcagtcactttatggcataaattatttgggaggtaaaaagactgttttcaattcaaattgtgcatttattggcatctaaatctagcatgattttggttagagcacaaaagaaataccacataataccaaatcacagcaaatgttagaattaatacaacaaaattttcctttggctagaaatcttatgttatacctgaaaaattggttttaaaaaatgttcatcttggccgggcacggtggctcacgcctgtaatcccaacactctgggaggctgaggtgggtgaatcatgaggtcaggagttcgagaccagcctggccaacatggtgaaaccctgtctctactaaaaatacaaaaaattagctgggcgtggtggcaggcgcctgtaatcccagctactcgggaggctgaggcaggagaatctcttgaacctgggaggtggaggttgcagtgagccaagaatgcactactgtactccagcctaggcaacagtgcaagactccatctctgaaaaaaaaaaaaaaaaaaaaaaaaaaagttcatcttagaggattttatttatctgtatgtatatacatatatgtttgtatgtatacatacccacattaacattttatgaccctgtaacatttgttttctattcttttaggtgatgtgaattgacctcagtgaagaaacatttcatttagtctaagccttgcattcagggtcttacaacagatttcttgtgcaagaattattattagttaaaatggaaggtgttagtttaacaaactgagagtcaaattttctaagtttttaaatatgcattttaacatgcattatttttggcatttaatttaaaatagttttgtttcatgtatacaacagctgttacagatatatgccagcaatattcatacttttttaacaagcttttgttatatattttctaatctccataaaagtctaatcatctatgaaaaagatatttagggagaaaatacttgttttctgtaataaaacaattaggttggtgccatgtatgccaagttggataaaagaatacaaagaaacagctgaaggttttgggagctcgctctgacattaattactagaaagcaaactaaaatgcaaagtgaatagttaactcagaagatttgaattttttgaaatagggtctcactctgtcctctaggctagagtgcagtggcactatcacggctcactgcagcctcaacctccctgggctcaggtgatcttcccacctcagcctctggagtagctggaactccaggcatgcaccaccacacctggctaatttttgtatttttagtagagacgaggttttgccatgttgcccaggctggtctcgaactcctgggcttaagagatccacccacctggcctcccagaagtgctaggattacagacataactaccacacctggcctgaagatttttaaatgtgaaaatattttaagaagctaaggggaaaatcgttattttaaaatcctgatccccttaactttaccccttaccattccccttacctttccaattcacttttgtctatttatta

SEQ ID NO: 98108 - DNA, 1023 bp, Homo sapiens
accagcattggggttggcactgagggaggtactaatttagcagccaacaatgctaatcgatactcaactgtcagtctgcaggaagaccggctaggtcaagctggcgaaggtaaagagctcctcagcccaggagcccccttgaccaagcagtctcgatccccaagtttcaatatgcagctaatatcccaggtgtagttttgacatcctccctcatctttctgcttaccttttaaactgaacatttcattgtgcaagaagacacttcatcccacattgtgaaaatattggtcactgttatcagatttcatttagtttaggtatcttcatactgtattttgtatcaaaacagcaataaggttttctttatccctctttcctacatcttctcttcacctatcccttgtaaatgtgtttgtgaagcagtataaaatggttgccttttccatgccttcctttctccttgggtgatgtgcaatccatcgtaggctgatcggtcccatttcaacactgtgagactgagggtacattagaggaaatggtgtatatgatccctatgaaacgattctttggcttttgtttaaaaacaaaacgggtttgttctcataatctatagaactatgaagattactggatcatatttttttctcttaaccaggagtgcctcagagattctgctatgactttggacttctctgagtctgtgcaatcattttctggagaagcatggggaaaggtggtagactgctgcactttttcattaaaatgagggtagctctttctccacccccccatctcctttatcccgaagacataaatgttcaattacggaggcatttaaatcaagttgtgaccacctccattggagggcaggactcttgattgtgtaattgataatgcactttctcaatggctgtatagtcattattaacgtgtcttccctcttccccacaaggacatataaggtcatttctgtccttcaagtttggccaactaacaaatcagaatctgaggggcatgttctat

SEQ ID NO: 98109 - DNA, 1043 bp, Homo sapiens
cctttcaacaatcttgtaaattaagtagaggtggcatttccaaggcaatacaggtaaagagattagtaactctagtgttactaacagtattcttttattgtcagtggtctctgagggacccagtaataataccctttttccctattcaaatctagagccacgtgataaacagaaaaatagttcgtagatggggaacaagtattttcattactgttaaaagctaaattgaaagactcaactttccttcacatctagaccttggaacagcccactggaaagaatgtttgagtgagctgatcaggcacacctatccaggctgcttaattccacatgggcttgtccaagtggagagggaaggagcaagacaatcctttagctcaagatttttgctagattagtacaacccaattaggaaacatgcatcagtcaaatggcaattaccaggtatgtcactttccttttcagggagcagaaaatggtaggacaaaatgccagaagtatttagggaacatttctcctcatgtaaacagaagagtggagaacatcctaatgtttatcagagattaaattttgcatgttatttatcatctgaagaatcagacaattctaaattgtctcataatcagagtttatatgttaattctttctttggaatgctttttctctttgaaagtcaacaattttaaggcatcagtggggtatgtgactcatattttagaaattctcatttgaaaagcctgcttaaaagaatacagaacaacaaagatatgtttattacacattataatgcaaattttaaatacatattcgaaaattatggacacatgtagtataaacaaaaactgcatattgattgtaaacttgtatagacttatattatcattgtaggttgccaatgccatgaaaaactcattaccatttgatgctcctgattctacacaagaaggccagaaagtccttaaagttgaagtcactccaacagtgccgaggatttctcggactgcaattacaacagcttcaatccgtcgtcatagatggagaag

SEQ ID NO: 98110 - DNA, 1050 bp, Homo sapiens
cctcatctgtaaaatggggatactcattatttaagttcaaagagttgttttagaggtaatggagttaatacacataaagcattttagcatatgtttactatttataaagagttgttttagaggtattggagttaatacacataaagcattttagcaaatgtttactattattataatgaagaaaagaaccagatagtaaatggttatctctgagtgatgagattgccaattatttttcttttttatattttgtgtatgtgtatttcctaactgtgaacatggttgtagaataagacacttttataaaatcctttaactggaattttcaagtatttatattggcttttttttttaatattaaatgctttaccttaaaacataaacaataaatttgggtatttgatatctacaatttgcatatttctcacttgtgttaatcttttccttacagacatggcccatgaacatggacatgagcatggacatcataaaatggaacttccagattatagacaatggaagatagaagggacaccattagaaactatccagaagaagctggctgcaaaagggctaagggatccatggggccggtaagatgaattaagtaatttagatagaatgtatcctagagaatcaagtgtctatgttgcttttcaatgtattctccttagagaatcatgaaaaatggctttttactttaaagggttttttttggtttttgttttgtttttgagacggtgtcttgctgtgttgccaggctggagtgcagtggcgcgatctcagctcactgcagcctccgccacccgggttcaagtgattctcttgcctcagcctcccaagcagctgggattacaggcacgcgccaccaagcccagctactttttgtgtttttagtagagacggggtttcaccatgttggccaagatagtctcgatctcctgacctcgtgatccacctgcctcagcctcccgaagtgctgggattacaggcatgagccaccacgcctggctactttaaaagtttttggtttgttttgagacagggtct

SEQ ID NO: 98111 - DNA, 1090 bp, Homo sapiens
taataccaagtctctaacttcatctttccgtgatgttgtaatgactagtgtgggcagagcccatctgacctgtgacagataagctgacgtgagtcttgcatttgagggttctgtaaaatcctgaggcatatgactattaaatgtgaaaccatcaagtgtttattcttctattttatatgtgaaacttgggcatatacttaattatcctatgccacagaaagattcctattgcgattcacttaaatgatcttctgtagggtagcatttaagtcaattagaaagatgaaaattaaatgtcttcaacgtatatacacacacgttgtgtatgattataattttttctttttttttttctagcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaatctgcttttgtcattcttaaaaaaaaaaaagtgtctcaagccatatcagatttggtttagaatacatagggggttggagaacagcagtagtgcgttctgcatatagcaggcaggcatcatatatttggctgagcaaatgggcatgttctaagaagtttttttttaatctttttctttttttttttttaactagtcctgacctagctggcactaacaagtatttaaatgggagttggccttgctgttttttttttgagatggagtctcgctctgtcacccaggctggagtacagtggcgtgatctcggctcactgcaagctctgcctcccgggttcacaccattcttctgcctcagcctctcaagtagctgggactacaggcgcccgccaccatgcccagctaattttgtttttgtattttcagtagagacagggtttcacc

SEQ ID NO: 98112 - DNA, 1018 bp, Homo sapiens
gctcaagcagtcatctcacatcagcctctggagtagctggaactacaggtgtgtgccaccacacccagctacatttttttttttttttgagacagagtctcactctgtcacccaggctggagtgcagtggtgctatctctgctcactgcagcctctgcctcctgggttcaagtgattctcctgtgaaaattgcttccttttctacacttgttctgtatttatgttcctctgatggtctccacttctagccactttctttttttggcgatttaagtttttggcccaaatagataaacatcttctacattatttttctcttattctcgatactgggttgccatctttggtgatttagtacttattatgaaagagagaagctacaccacttgataccactttcatctgcatactcatgataatttgtatcttctgcagtgaactcttaagttgaagaaatgaataatttatatgtatatttgtatacttttaaaaatgtaattgaaaaatcctctcatagttacttaactccaaggtttaaaaatgcttcccagggtaatgagtttctttagtcatgtgactttagaaatgggaaccaaagcttccttatctacttgtgaaattcttgagttttttccttgaacttcctttttatcttccctttggcttatatatctgtgttttttgtttgtttttacttgcagctttcaaaagtagttttcaaagtcaatgagattgtttaaaagagtaggtacctgacagtctcttgcttgaatactatctagtgagtgaaccaaattccctgcaacaataaccacaactttgaatcaagagttaaatgaaaaaagtaactccttcagcatttactgagcacctgctggggctgaggaatgggggcatgtagatctccctctgctgtctggagctccctttctggttggaaaacatagaagcagcgcaaaagtttcacccaaaaccttggccatggtatgctattgaaaccccatagttcagattttat

SEQ ID NO: 98113 - DNA, 1090 bp, Homo sapiens
agcacagacaagttgtatatagcacaaagctatacccccagaggagacactatatcagttgctgtctgcctaggctttctgtaaacgtgctggctatcattcagcctaaatgtagaatgagtctatccctttaacctgggccatcaccaggaatgtaaaggaacctagaacgaggacccaggcaagagatgagaaactaggggacagatgagtaggtaccagggatggtgatgagactgaagcaagtggggaatttttattttcttctctacttttctctattttccagattttcttagagcaaaaagcaggtagtgctttttacagaaaatgaatgctatataaaagtaattttaagaactttatatatccctagtgttatgtacaatttctgactttgaatagagatatctcccaaagggccaagtttggccctttagttacaatggagaatctgttgtgtaaactgagcaaatacacctgccaagttgaaatttaatttaagccaatcttgtctagatgaacttaagagaacgtctcctaaatattttattgcagtagtgtagcatgattgatagtatgctattctcttgaatagatggggttgtttcttgagccactttttattcctttgatcaaaaccttgaggagaaggaatgcctgttttcctgactgctgttgcatgaagttagacatccagttcctctaaaggtgacatcagatggtttagatacctaaaaagaagtgaggctaagccataggtcttcttcgtactacctgaagttgagacctggtctctgaactcagttattgctgaagcattaaaatcttacatcttgcttaaactcaggcagcttgacctgttctcatttttctctatcaaataaattgaagcctggtaataaattgatgatgagttccaaacatccccttggttggagacattgtattctccccactcacaatgaggtcctgccagtttccagaaaattttgcatgggggcttacccatccttttagaatcacattgcaagtcactctaaagcattagcattgttatctcatgtagctgcaaaagcttcctttcaca

SEQ ID NO: 98114 - DNA, 1102 bp, Homo sapiens
acttccctggctgaggcaaggttgttgcagcagccccaggagtctttgttagaatcccaccccagagctccttcctccagtcctctcagcagttttgttagttccagtattaagtgtaatttctacaaaaaatgcctggaatatttctgtttccagaaccggatgctcctgttagctagtgtgtgaaagataactctgacttgcctaagctttgttgatgttttgaataataattggcgatagtctcttgacttctgcaagagaaatgaaacagaaattggtctcaagttttagttgctcttgtgaaggtcagggacagtttgtaccagggtgtgggtgtggaaaagaaggggagatatagtcattaaattagaatatgcctgtgaggggagttaaggggaattcctttaaaattctagaaaacacacacaggtgccaattttgtctggctagggaaaagtaaactgctgaaaacacttggggggagaaatgaagctaatggtatcttgatcagtcaggaggattgggtatttgaaagcagggaagaaaaataattggacttggatattcctttgccccttcatctgagtaaggtgaaagcaagtgactcttcagaagaggcgaatgggacactgagtccagcagctcaggcagggtggagttggtaactgatgggcacaagtcttttactgggctctaaagaactcattcatctgggtgtggtggcttacacctgtaatctcagcatttcggaaggctgaggtaggagaatcacttgagcccaggagtttgagaccagcctgagaaacacagtgggaccctttccctacaaaaaactgaagaccttatgagcttccctagtctaagagtaatttttatgttaatttcttggcttgggcttaaaccccaacaaagtggtgattattcggaccccagccctacctctccctagtatgctctcctttctcaagtactcaccacctctagccacagtgaactgcctccagcatacacacacgctgctattttgttgcatctgagtgggctggctccacacgggatctgtagtttccttttgatattttctttcaatgtgccagat

SEQ ID NO: 98115 - DNA, 1061 bp, Homo sapiens
ttttgaagtaggagagcaactagaaaaaaggagtggcacagggacagaaacttcttttctccattgtttgttcaaggccacgtgggtggagtcattgaggtggaggtttaactctgtgacataagtttccctgatttagtcaggctgtctgtcgttgggcttttcccacttccttctactacgtacttcttccctattcctcctactgaggccattaaacccttagttgtaattttccctgaacatgctttacattctgatgaattctgaaaaagaatgtggggtttccttgcagatgagttcatctgttgtttcatttcctttacaatgtaggttttcttctctgtctttttggattagtctgtttttggttctgtctaccaaggatccctttctttagacttctatagatccctttctatagaacttaatctacttaagtcagggagaccacccagaaggaaagagcccatactttcaatcttaggcataagttagcttgataagattttcagaaaaattcccttttaaccacagaactcccccactggaaaggattctgaaagaaatgaagtcagccctcagaaatgaagttgactgcctgctggctttctgttgactggcccggagctgtactgcaagacccttgtgagcttccctagtctaagagtaggatgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactataggtaattcatcaactcttcctgaggctgggtgggtgggagggagtgaagtgtctcagactctactgaatggcagaaacgaggataataagaagtgcagccactttac

SEQ ID NO: 98116 - DNA, 1013 bp, Homo sapiens
ttatttgatacccacacagtcatgtagaagtatatcttttttgtttgtttgttttttgagatgacatctcactctgttgtccaggctggagtgcagtggcacacctcggcttactgcaacatccacctcccgggttcaggcaattctcctgcctcagtctcctgagtagctgggactacaggcgcacaccactacggctttgctaatttttgtatttttagtagagatggggtttcaccatgttggccaggctggtcccgaactcctgacctcaagtgatcctcctgccttggcctcccaaaagtgagccactgcgcccagcctggaagtatgtttgtaagcccagatggaatcatcatctattgtttcttttttttaattaaaaaaattttaatacagttcaaatccccatgtctggctcatttcagctcctttactgccaaagcaggggacaaggactgcttcagtttctctgccttctctttctctgaaggtatctgctgcattgaacttgaaagttcacattatccttatttttcttgatcttgacagatttggcatcctttcacctggctgtgagcagaaagtccttgatttcctcaattttgcaaggcatggcgatgaggcacacagggagaggacaaggacaggcacccctctatcccatgtatcacccaaaagacactcacagcctgccatcactttataacctgcttttagtttgtttaacagtagatcacaaacatttttgcatgtcagtagtcacatttctacagcatcagtttaatgtatgcacaatagcccataatatggccatagcttaatttacttgatcaatcttcagttgttgcacagtgtttgctttcatacgaagtaagtattaaacatccttgtaacttagtatttgttcttatccttaattgttttctagggggacaattcccggaagtggaattacagagtcaaaggacatgcatttttcaagcctcggatgcatcttactagatgtccta

SEQ ID NO: 98117 - DNA, 1663 bp, Homo sapiens
aaaaaataccatttgaatttgtatttcataaagtgactctggggtgcttactttagtcaattcttaaaattttttatttgttccctaagaaagtaattactgtttctgttgcctggacagttacagtttccaggaaacatcaggaagtaggaaactgtagggccagagagtagtacaacgttaaattgtccgatttatgtgtattacttaaagctataaattgaactagatcttgccgtgctctgtattgagtataatttgtatacttttttataattaatgactaaatgatcactttggaggcagggtggtgggggtgtattagcagccaaataagcacatctgatcaaaaagaaccaggcttagattttttttaagtacattgatgttgatgttccaccagaaacaccttaagtgtatactgttgtgtaatgtctctagaaaggaatcctgtcttaaaactgggttttgctgttttttgaagtttctacctaaaatcatttttggtatatcctgataatctctataatactagaattgtctgcaaaatatagtaagaagaattggagcctaatagctgattcctcccaatttatctgttatgttttgtcactattcacattttagtcttttctacgataaaaattgtatgtgtactttcatgccagtataggaaacctcaatcttttttttttttcgcctttaagaaggttttcagtgattatacctcaggtatttctgagtgtcctattgtctaataggagaaatatcttcccgagctcagaattaaaagttctcctaaattatgaagatcccaaatcttatgtaaataaccttaggcatgagtccttagggagaagttaatgaccattgttaaagtgcttttttagaaaatgttgtgctgtatgttcttgatttgacataaatgaatagactttggcaagggaggaaataagttaaaaggcagcttacaagagcctattccctataaagggtataattttacacagtactcaaagcttgttatcttttctgaccattttagtacagaattagtacttggtggttactaacatcaacttgtgacatctagaactagggctcttagtgtttagtgggccacttctctgatgtcagatgcatgcagacctgtactccacatgcaacccaacagcagtgcagtgtgataactgagcggtcgcatggcagaggacatccccctcagagtgggcacaagtgccctctagggcagccaggggaatactattgttcgatacctgggatttgactttgtcaaacagctctttgtgcccctatctttgttttgtcaaatgtagatcagttaataaacatgagtagcttgaattttcatttgtctccctgtgtctttgtcacagctgtctgcacaggtaatcctgtactaaatcttttctgttatgtttttggttagaaaacaacctctacttgtcaaaccaacacatacacaagaaaccactaatagtaataataaacagatcttaatgtattttcctagatattttttaaaatagcatagacagtatctatgtataccataatacttccttagcaaaagtaacagcaacataaaaataaaatctaaagtcattgatatgcagataccaagtttgagaagattcgggaa

SEQ ID NO: 98118 - DNA, 1047 bp, Homo sapiens
tcactgcctcagcagctaagctcctttcctattaagggtgtctccttgggttttttttcacccctttaggtgtcctccttaactattaaaacagattatgactcatacctttgacatcttgtcatcttccactgaaaactttaatttgcagcttttaccaaattattaacaccaaataaatagttttattgctgtcattattgttattacacatataattttagcttgtgttttaagatttgtgggaaatgtaaaacatgcctttccccttcctttgttttgcatattcaggatcacaaactctgtatcactggcagcagcttgctcaaccaaacttgggaaccatccttgatccacgaccaggtgtcattactaaaggctttacccagttgcccggggatgctatttatcacatctcagatttagaagaggatgaagaggagggtattacttttcaggttcagcaacctcttgaagtggaagagaaactttcaacatccaagccagtaacagggatcttcctgccacccattacttcagcaggtggaccagttacaggtgagaagagtgtctggttgaatatggtataataaccagaagtactttgcattctgacttactagacagtcagctggctacctctgctcactggagggtacttaatcttgcatatcagataatgaaaatctatagcattagtggcattcctaattctctccactttatcttagccagcctgcgttagtagattgggtagagagctggatgaattcaagtcagtggttcacaaaccttttgggctcagaaactctttatactctaaaaaatcattgagaattccagagagcctatctgtgcaggttatatctattgacatttaatatatcataaatcaaaactgaaaaaccataaaaatatgtattaactcatttaaaataattgtgttacacaaatatgtttaatgaaaaatagctaatttttttacatagtgagaaaaacagttgttcaagtctctaatttttgacttaatacaaaatagctttattc

SEQ ID NO: 98119 - DNA, 1012 bp, Homo sapiens
ttatgatggtataaaacatctggagaagagattttttccttgtttctggactccaattattgatttaggccctaatttgtatattgacatcttccttaatactcttatttattctaacaggtgactttccagatatattgtatcaataatacataagatgagccctaaggaaattcagtttaggactgtgtaccatagaactagttaaacttgggtcatcctaccctaggcccacagcctgccacttacttaagtggtgctttgaatatctaaaacctctttcaataaatcttgagtctcctgatatttttaacttgttagaatgtaagcttcatgagaacaagattcatctttgtttgattcatttataaatggtatttttgtattaaaaaattaataaaaacttctgagtttatattagaatttgtaatgttggttcaaagagttgttttaacaatctgattcttaaacttctgtgcaatcctgtgaacttttttaaaagactgaaactatacattttagtagattttcttaaaaatagggaggcataattttgttttttatgtttgaaataattttaaacttagagtaaagttccaagagtagtataaagaatttttgtatatccctcacatcgattcttcagtttttaacatattattgcttttgccatatcattcaatctctctttctctttctttccccctgggctattttaacagtaagttgctgatataccttattaccccgtagtacttaagtgtgtatttactaaaaacgaggacatttggacactcttaaggacactgtcctacataaacgcactacaaccatcagcatcaggaagttgatgtttatgcagtattatcatctaatccacagagcccattcaaatttttccagttgtctcactaatgtccttcaaaggatacattgaattttgttgtttccatctgggacagttcttctgtctttatttctctttcgtgacttttgtaggatgtcctcagtt

SEQ ID NO: 98120 - DNA, 1587 bp, Homo sapiens
ttaagcaccatagggtggctatagttggcaataatttgttgtatattttcaaatagataaaaggtaggattttgaatgtcctcaatgcaaagaaatgataaatgcttgaggtaaggaatgtgctaattaccctaatttgatcattatacattgtatacaggtgtcaaaatatcacatgtaccccataaatatattcaattattttgtgtcaattaaaaatactttttagaaattactgtcaaaaaatgtatgccatcatttttactttagaagttctcttactaaaagaaaaaaaacctggagaaaaaaaaactatactactaggatatactaataaaaatcagtggagaaatgatcttgtctagtatttctttggttatcctactttagaaaaactaattttcatcaattttctctgtagcctagtaaaagttgaaatatattggattcatttacatagactctcctctttagatgtctgctccaatgaggatctccctgaagttgagctggtgagtctgctagaagaacaactaccacagtataggctaaaagtagacactctctttctatatgaaaatcaagactggactcagtctccacaccagcggcagcatgcatctgatgctctctctccagtccttgctgaagagactttccgttacatgagtgagtattttttttactcttttagtttgtgcattaaagtaatgatcatgggtatcttggtattgatttttaaagcactgatgtttagtagccattgttcagtgtatacctacttttatttgaactgatttcacaggaagagataattctgtgttatgtctgaatgcagaaagtttgtcatccttatgactctcagtgtctagtgttgcaaacatacttagacgttttcgttacttgatattttcctcagactgagtagaaaagggaactttttaaaaagcaaagtgatttaaaattttaatattcctttataactgtcaacatttattatcccagtagtttgttatcctaagctatcagcttttgacttttatctttattaatatcgttggtaaacacagtcacaagaattatgtcagcataacgaagcatagttcttaggtacataagtagttttaataatgccaggagaaataaatataccctatatagtaatcttcattatttaaggattcctaagtgagagactgagccagatttgttctgaaaataggtctgttttacaccaagctgttagaaaagacaaatgaatttttaaactttgaagtgtggagacctttttgcatttgatcccaaaaatctgcattaaggctgaaattacttttctaaaaattcatttggtaaaaaatgttgtgtgcacagtagctgttagaatttataataaaagcttatgagttcaatactgatatgtttgtgaaattcctttaattagaattaagtaggtgattgcatcagatcctggacattttcccagtgagtgctttagtgttttaatgccagattgtcgttggagaaggactattgtgcaatactcattttcatagtaatcactaacttgttttcagcactagtttccta

SEQ ID NO: 98121 - DNA, 1049 bp, Homo sapiens
tgacagagcagcagagcaagactctgtctcgtgtgtgtgtgtgtgtgtgtgtgtgtgtgtgtgtgtgtgtgtgtgtggtggtggtgttgctgttgttattccaacataaaattacaaactccttttttgggaaggactgctatttattatgtctctttttcttttagtaaaatgttttatcatttacaaagtaatagaaattggtaagaaatggaaaccccatgccaataaccacagaagtgtttgaaattttaccagtctgtggagatctgaaagtctaggtgttaggaaatcgtggtctgtactcactaaactccactcttagcatctcacttaccgacaccttgcagcttgtctttggatccaatctcttggctgaactggtttctggaaagttatcattgattttatggtcccttacccctttttaaataaaccgaattttccctttgactttgtataacgtttaattctgttcacattctatctctgaaactctcctccctaggatttgctcaaagtgcttctctattcttctgcctcagtaaccattttcagtctcctttatttactttgttcctttctacttcttgagggtaactctcttgtaaaacattgaatatttatgatgcctgtgaagagcaggcatgagaatgaattaactataagtagaagccacaagttgccaagcagagactgtcttgatataaatcaaataagtagaattgaacagttttactgatgacagttcctgatttttttaagtatgcacatatatttagtacattgtattcctttgtatgttccactgttattaaaccatttatttatagacatttagttccagttgtgtggtatgtgctttttttttccccccaaaccaataccgtatgggcatccttatccctacatcttagcacacttcgtgagtatatccattgtgtaaattcctggtggtagaactgttaagttacagcatgtgtgcatttaaaagtttggtagacattgccaaatagccttctgaaagcttgttccaatttgcacctttt

SEQ ID NO: 98122 - DNA, 1074 bp, Homo sapiens
agaatgtggtggatttatggtaatgattataaattgatactgagatttccagtataaaatcacaaaatgccaatttgggttgaagatagagacttggagagtaactatagtgtagttggaaattgaggcctttgaagtagatgagattccagaggagagaaggagagagagagggcccatgagagaatcctgaagaactggggagaatagccattaaacgcaggtagaggaagagagttctcaaatttccacagcctcctatttattatagccttcaagctctgaatctaataacctcctggattgcagatagccagtagccatatctcaaaaaatttacctgttcttatttgccctgaagttcatgggcaaaccaaaggcgtctattgcatgttaattctccctcaaaaagtaaccttatcttcaaagcccttgagttgtctgtgacaactggttttgaaaaacaatgagtcttatgtctaaacatactgtaattagaaagtctctcgcctagtagaattacattactaaaataggtatgtctttaatatgcagataattctagaataaatctagaattatatgtgtttataatactccatcctgaccatcactcaccgccattttaagttaccctctgttctggtcatataagattgcacgtcctggtgccactgattacttcgttgacttgaagagctatattgcctatagtttttcttttgacactgatcatatggggacttctgcttctgaaggccttaaggactataatttttaaataactgaaggatttagagtcatcttaagccaccaaaagcaaatttgtgttttattgttagagaggacaaagagaaatgaggacatagattttctacctcttcttgacttgttgctgtttttaaaatttgtattttccttactgctatgtgaaagtgccatttcaaggggtcttcctagctatttgatttgaggataaattctgaagagcagattatacagaaatattcttaaatctgttagcacaattgtcatctattcagtctgtttctaatcttctgtgaagtatttcca

SEQ ID NO: 98123 - DNA, 1033 bp, Homo sapiens
tcggggagtgaggggcaagagaagttgtaaggtttcaagcctgagtaattgaggcatatgccagatgtagttatcttttaggagaggaaaaagttcatctatccccaactcatcagttaacaggtcctgttttcactatctcacaaacccgtaaatccttcttaaaatttccattcacctagtttatacctttattaaaataatccatgcgtaaatgtgataaaattttctaattatttttgtctctaatctctccattccaaaatttatcctgcatcctgcatttacatttatttctctcaaatgtcacttctatttagaaatgtgttccctgcaggatcaagttcagacttcttaatctgaactagtcaaatttaaatctccaaataccttccccataattcttcccactcaaattggtctgtatatgctgccaacctggctctgtctgctacttgctgttggatattatcattattattttctcctaccagatagtctcctcacctatccaaatcttttcctccttagggagtccacttaaatcttacatcctgtgtgaagccagaccacctcagctagaaaagagctctctcccgacaattctgttgtaacactcatcaaatatttattatctggtactatcttattttcttagatttcttagctcattggatattagatctaatccagatcattagagctgtcccttttggagcttagacttcttaaatctttaacctccctttgggcagaggctgttgtatactactatttatctttttttagtacttttggtttaattcaagtggcatttgttgaaagctgttcaatgaacagctgtttgaccagttgttaattgaggtcattgtattgaaattttctttttcaactggctgcttaatatttatatataagtgatgttctagctttattcttagctttactactgactcacataacctcttgaagataccctgtttaactaccccgtattgtggtttattcatgctagaaaatgagcgtacaaagt

SEQ ID NO: 98124 - DNA, 1944 bp, Homo sapiens
tcttaaaatatttatatgtgcacatgtatattacacaaacaaaaaaagactaggagaaactataccaaaatgttaacagtggctctctgtgaggtagcaatagagggatttttatgtatttttaaatgtttttatgataagaacatagaacagttgttaagagtatgaccctagagggaaactaagttcacattctacttccacttctttttattaattgcatgcttttggacaggttttctaacttatttttaagtgttgtcttctgaaaaatgggaatcataatatcacatactttgtggagtggttgtgagatttaaatagataaaagcactaagaacagtgctttcactaataagcacccttgagtattagctgccacgaccgccattttcatcataaggaaaaaacagttgtttttaaatgtcttgtctcttgtgtgtttatcctagaaagccgtgattctatcccactttttccggcatcccaatattacaacttattggacagttttcactgttggcagctggctttgggttatttctccatttatggcctatggtaagaatgctggttttaaataaattaacttagcctagatgttataattatatagatgagttgggattttagatttatgatttgccacatttaatttataagtctaatgactgattttagatttcatggtatatttctatatctggtacatgttgaattttagtctgcagaaaaaagtaagaattggtatgatgatcagtgaaccaccactgcttttccaagaattccgtgcctttgcacaagctgtgtcttcccttcagcttccttcccctcttttaatggagacctactgttattctgcaggaagaagttgtttttccacctctgccccccatccctgtccgtttcactgcattgtaaactatttcactgtattagaaacatctttgtgtgtgtccatgtccctcactggacttgtgcttcttgagggccgggatcatttatatattttttatttgtggtgtccccaggtgctcacgtagtacttagcacaaagtagtgttcaataattgtgttgaataaatagtgaatggattctagagctttgatttttaggacagcttttgtgaattgcttctggatttaagaaaaaaaaaaatatatatatatacacacagaatgtatttttattcaataatattgacaaatcattaattctcttccctaatctctaaagtgtcattacaaaaaattgtttaaagattcttgaaagaaaatcatgtttgtgtgggaaagtgttgtttgggttagactccaaaaagtaacaggtatgtttgtgtttatggttgaaaagaacattaaaatacagctggaagcaaaatcactttcaatgttcatctaaggattttaggggtttctttcaggttcagcaagtcaactcttgaggacctattttcctgaaggaatgagtgaaactttaataagaaacattctctttggagccgtgagagggttgaactatctgcaccaaaatggctgtattcacaggtatttacttatttgtatttattaaatgaaataattttaatggaagaactctttgaaggaggttttaggaaggagcagttgaatattagaaaaaagggataggaaacttgtaagtgaaaattgagggaggaagggaccattaggtgcagtggattgcttacattttatgtccattcgccaaacatgttcagaccacatcctctgtgccaagcagttattgggattggggtggagtgcctgccctcatggagctcacagtctcaatctaatgaggatgttcaggagatgagctgtaggaaatgggatcctagttagctgggtgtttttcgttttgtttttgtttaagcaaatgaagagcttcattatctgctttccatcttatgcataaattggaat

SEQ ID NO: 98125 - DNA, 1093 bp, Homo sapiens
ttatgttaggaaattaaataccatatatgaagtgtgtcttgatttgtcgcttatgggtttcttttccattattgttcaccattctttatcaaaaaagcacatgtgtataacttttggttaacttatttgcactaaaagacttcaaattaattgtgtcctacaggatttacatgggtataatgtgaagtcagatatttacagtgttgggattacagcatgtgaattagccagtgggcaggtgcctttccaggacatgcatagaactcaggtaagtgctgctaaaatccctgagctacttgcctttcataagactgcttacattctagataatttctgttaaacatgtttgctatagactcttaggagctttattgttgttactgttttaatattttgcctgaaaagtgttgaaggaaagttctgtttcttttagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggtaatattgatctcttttaaatagcacaaaatgtacatgttttacattttatagaagctttgtaacattgcccttccaggagaatacaaatcttttgatcaaaatattgtctgctctagaaaatatcaatgctaagaacaattagtgggaacaagcaaatgagaagaatactggattcaaaatcagaagaggctgggtgcggtggctcacacctgtaatcccagaactttgggaggccgaggcgggtggattgcctgaggtcaggagttcaagaccagcctggccaacatggtgaaaccccgtctctactaaaaatacaaaaattagccggtgtggtggcatgcacctgtagtcccagctactcgggaggctgagagaggagaattgcttgaacccagtaagcagaggttgcagt

SEQ ID NO: 98126 - DNA, 1027 bp, Homo sapiens
ctccagagttaatgttctcctcagaggtggaagaatatcctgataaagagaaagaaatcaaagcctcttcataataccagctcacctttggaggaataatgacccagtatttgtcccatttttgtttttaaatgtatttttataagatgtatacatgtgtatttgtaatagattttttgattatataatactgaaacatctctcaatattatgaaaaatgttaaaattgtgtttgctgtttatgtctaaacattaatttgtctagcattatcatcttaatgacaaagggaataatgaactagaaaccagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctccccttactgaataaattgaaatatgaagtttgtcttttctgaaactggcttagtgattgagtatcatgtaataattataatataatttagcttgaaagatgctctacattatgaccaataaaaagggaatgtatgttttgtttgaaaaattatataacctaaattttttacctagaagtaactaaaaagttgcttctcattataatctgtactagtggttctcatatctggttgtacatcaggatcatagagggagattttaaaaatctatgtagcaaaagaggctgagcagggcaaggctcaggggaataaaggagagacctgtgagcttgtgggctcccagttgacatctgcagtaccctttcctctgtcccttttttctgagtgacaagaaataggagtagaaattcaccatctctgttctccagctctttgtcagagaggtttctggttttccaggaaatccccctcttgagatgggtcctgcactgggaaagatctcttcagaactatatccaatggtacctcagctgttgtatatg

SEQ ID NO: 98127 - DNA, 1802 bp, Homo sapiens
aataaggacagcagtcatactggattagggttcatcctaatgaccttatcttatctttattacatctgcaaagaccctgcttccaaataaggtcacattcataagtactccaggttaggagttcaacatatctttttgggaacacaatttagccccttttaaaaaaaatccaccgagttagagcccaatgatatgggtaatagaaagaggtagaaactaatgaaattttatagatcaagtttaattttctttaggatgttttaaccccaaaggaatgttgtccaaagtagtctagttagatgttttatgtggcctttgtaaattagataattttgtcatgcgtgttaagtatacactgtagctacttaaaacctagtaatagtatatgtgctagcattagactagagaaggaaaaaactatagtcaagaaagtaaagttttgttaagtttacaactgcgctgtgacaagaaacttttatattttctaggattgactttgctaaaatatcagtagcaatccgaaattttttggccctggatcctacagctttagcatctttctgtgagtaagcagtttaacatgataactgtgtaatacttcagttataccataattttgaaccaggataaatataattttttttaaaagttgtattactgctccttataaacattacctatagatgttcagtgaatttgtaattagaaacataaaaggcataatattgatagaattattttttcaattgaggttcatctaaataactttgaaaagcttaatttattgtactatattacttactttttaacttttgtattttctacttgacattaaacagattcagcgggtatggccttttaataacaaacaatattttatatctttctgatcatttggaatgcattttgttctaagttttgagaatattaataaaactagttttaggaccttgagcaagtcatttaacttttaaaaagatgttctaggttcttgtcagttctaatgatgaaatagtgaacgtctcaaaagatccttctgcacctattgttctcaaaaatttatataaggatgtctggcctattgaaatatatttatttggtcaaataaatttcttttatatcatcagtcatgaaagtatagattattttcgatattaatctataaattcaaaataaaccaggttgttaaaaattattagtaatttcatttgtctttttctcagtgtactttactgctcttatactatctctgagtcagcaaatgacaagtgacagaatccacctttacacaccttcttctgttaatggtagcctctggtaagaattcacaatgacattagcaattgttaatggcaataacagcaacttttcttatccttccattctttttcaactgcaaataatgaaggctctgtttttgtttccaaatatatggcaagaaaatacttattcctttggttaatgggtaactattgttatgtccacctgcatttttaatgaaatatcttccttttaaaaatctgttttagatcttcaagttatagtttttttttttttcgagatagagtctcgctgtgtcacccatgctggagtgcaatggcactatctcggctcactgcagccaccgcctcctgggttcaagcgattctgcagtcttagcctcctgagtagctgggattacaggcacccgccatcatgcctggctaatttttgtatttttgtagaaatgggcttcaccatgttggccaggctggtcttgaacttctgacctcaggtgatccacccgccttggcctcccatat

SEQ ID NO: 98128 - DNA, 1037 bp, Homo sapiens
tagcatctttagaacaatagcgcgttcctgtgactgtcattcttctccaattgtaattttgactactggatggtattacggcagcttgcctcgtcctaatcttgtagtacttgcattaatctactgttcgaacgaatggattgctaaatgggacaaactacaagagtgtctaaaatttaacccttttgaataaatgtcttatgcaagcagcatgagatacttggaacattaaattggcttctaggcatttctgttactatatgattctaaaatacttctcaactgtaatgctgtctgaactacaaacacttttcttattcatgtaaatgagggtttagaagggttccccccacctttctttctgccctaaaacgcattcttcccagtgtatgcaactggcctttttaaaaattgtgttagtatgtggtttaaaacctccatttgtttcccattgaattaaaacaaaatccaaacttcccttggtctgcaaggccctaactaatctggctcctgcctacctctccttggtaattgtgcggcagccttgctgtccttttacctgaaacattccaagcccaatttaacctaaaaatatttgcatttgttccggttgctgctttctcattcaggtctcagctcaaactcagagaaactttccctaacaaaagtagcactcagtctccttcattcattacgttttgtgtgtgtgtatcttgtgtatatatatatatatgcacacacgatatgtatacaagatatgtcttaaatatagcatataaatatattttatcgtacatgctgcatataatatatagtatatattatcatatatatatttttaacattgtttctaatactcaaccactagaatgtaagtttcataagagcagagttctctccattgtgttcattagtgtattcctaatgcttagaaaagggcctggcctagagatggaaaggaatgtaggaaggaaggaattttatatgaaatttaggatgggagaacaaattttaaattgcccatgtttctcatcagt

SEQ ID NO: 98129 - DNA, 1001 bp, Homo sapiens
atgatcatgccaccacacttcagcctaagcaacagagtgagaccctgtctcaaaaaaaaaaaaaaaaaaaaaaaaagggaaaaagaaaactgtccagactctatacaaattgtaggattgagccaggaaagcactctagaaacaaaacaaaacaacagatcgttacagtgttgtctctaaattccaagagtgtgcctcagtaataacccataattcttgcaactgtgaccagaccagctagttcttctatgaagaactataaggtgcaatgagaggaaatggggcacctgagtggagctggtccacgcaagacttttctgagctctaatgatgggtaaagtcaactgggtaaagaggtggaagataaataaatatagtatttgtcatttacttctaaaaagtgggtaggtgtggtttctaggaaatcaattcttctgaaaggctaaaaaatgtgtttaaaacatggagttagggggagcattttatgcaatagtcgttttctctttcacgccactggtgatggttaagagtaggcaccacaggggaagactgtgtttcatttgatgtgtatcccagtgtgtagcacagggcctggcttgctgaggaaatgctattgaaaatatattccagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacatgaagctttctacagccaccaatccacagaatggtatgtgtcaccaggactccttttctagaccagaaagtaatatcacctctgacatgtgatcaaatgaataggcagaaatcctgacagacttactgtgatccctatgaggatcttgtacatttttggttgcactactgccctaccagtgataactttaagaacaaatttcaagccaggaaggaaataaatgga

SEQ ID NO: 98130 - DNA, 1052 bp, Homo sapiens
tctgcatgtgaagaatattagctagcttgtaaaaaaactttgttttagaataagacgggaaatgaaaaaattttgtctatactaattacaagtaggcaaaagacagccactagataggggaactagaagggaacagggaaaagtgaaatcaattaaatctgttgggccatcagctgaatttgttcataagggattttgtttctttagtcccatatgcattgctctctttatgtaatttctttaaaagtgaatttgaaattattttgaacttttcttccaggcatgttactaccagattcagcgtgagaagcttaactaggctgcataacagcttgaaaactggattatctactacagagtgttataacaccatctggagtcttcctgtagtggcaaaaaagaacagtgttgaaattggaaaggactttgtgttatttaggttgttagaatgagccttaccaataataagagccctgagcccagaaaaaaggactgtatagtttaaagggaggattgaaagggaggtaaaaaatcagattagaccagttcttggcctatgataagttccaaaaataccatttatctactatttgaaaaaagaagaggatatcccttcctacagtaaagggtatgtcagctacatgaagttgtaagaaaagcttccagtagagcttcttatattaaagaagttgatggatatttttgaatttctggtttgcctgaatccacctgcagttaccccgatccgtttgcaagaaccagatcgtacttgaaactatagtggccacactctgccttcctgagtcccttccagtcatgtgtgcatcatgtctctttgccaagggaggggagaaaggaacttttaaactgcagttttaactttttctaagctgtttcttgatgggagaggttctgtgcaaaactaccacattctgtccccaaaatgtggaatgcatccaaataggagtcttctgcctcttaacttaaaagaacataggaattttgtttttggtttctttatcatgctacagagagtgaatacactggaattc

SEQ ID NO: 98131 - DNA, 1028 bp, Homo sapiens
gacaaagttaactattttaactagaaaaatggaagcaataccaacctagggttgatgcctgggatctcccatgtgataattgtcttttccctactttatccttatcttcagtgctttttcttttctttttatttctgtgcaggggggaaaagtatatgggaatgtggcaagatgatgtgtgtcaagggaatggtgtggtggttacccagtttggattatactacgagggcaactttcaccttaataaaatgatggtgagtggaatatttgcatgtagttattactaactttttaaagctcctttgtccttaactttttaaatcatcttttgattagtttccaccttcttagtactattttccttcttttaagattccataaggctttggggatatgactgcgtgcactcttaagttactctgtattttatgtgttgtaatttttctcttgtttcttcttgtagggaaatggggttttgctttccgaagatgatactatctatgaaggagaattttcagatgactggactcttagtggaaaggttggaaactagctttctttttttttctccctaataaattcttttactaatttttttttactttaaaaatagctgatttacatgccataaaattcacccctttcaagtgcacgtttcagtgatttttggtcaacatggctgtacaaaccaccaccacaatccagtttcagaacatttccatcgcccaagaaaatcccttctgctcattcagtgacttccatttccacctaaagtcccagccaaccactaatcacccttaatcactctatagatttgccttttttgggccttttgtataaatggaatcatacatgcaatctcctctatgtggcttcttacacttagtataatgtttttgttttttccatattgtggcatgtatagtatttgttcctttttatggctgaatagtgttccaaaactacattttgtttatccttttaccagttgatggacattgggttatttccaactttagactattgta

SEQ ID NO: 98132 - DNA, 1063 bp, Homo sapiens
taaaaaatttttgtaagtgaattaataaaagcttctaacatttcttaattttatgttctaatatggtaaatatcaatagatacagtccacataagaaaaataaagggatcccgagaccaaaatatttgagaactcctgctctatcctggggtctctgctgctctattcactaactgccaggttttgtctctgtcacctgagttatgcccctatttcatatgtacttttatgtagtagaatttttctgaaaccaatctccttttcccagtctcctgcagtgtgctacttatgctcgtgggctgaattttctcctacatttaatactatatgtctaaggcagactgaggctacagattctgcataatggttttatgttctttttttttttttcctctttaatttttgccctgtaggcatctccagaatatcagaaactgcaggattccagttcttgttatgagtgtcttgctctccatctcggcaggaaaaggaaggaagcagaatacacactgggcttctggaagaccttccccggaaaaatgacggtaagccatgccagttgtcatttgttaccctagcaaacagcaaccatttcgataacaattgatacaattttctctgttcctcacttgtttgtggtaataaccttttaatgacccctttcctaaaatgtctaaggaccatactaatgggtactctaaataccttctctcatttctagaaatcctctctgaagacttactcaccttctttagtttgtttttgtcttctttttaatctcctttgagctctaattttgtgaagtgtttagatcccatataaatttagattttacaccaagctaagctacgaccagcaaattcccttaaatgtgatttgtgtctgttttattttctctttacatgttaaaataattttgattgtttgacttgtattatatttgtctttaattccaggattccttgaggaagccagagcgtcgactgctgtgtgagagtagtaaccgagccctgtctctgcagcatgctgggaggttttccgtgaattggttcattctctttaa

SEQ ID NO: 98133 - DNA, 1035 bp, Homo sapiens
tttgctttttcttccagtgtttctatttagcacagctgcctagaacaattagtcttgccatttattgctgtgacttttggctttgaaattaacaggtaatggtgtcagctggtctctgattattcatcttaaattgttggatgcatgattcatttcctagaatataggcacaagtctgtgattaaccgtttgtattgctaccatttgctacttttcatactaaaaatcctgtcttatagatagggaaattcttttaattatatctggcttatttcattgtatttctactttcacagcacctaaaaaatgtgcattctgaaagaggtactttctagtgaaattttttatttaatgtacatattaccaattccaaaatgattaactaaatttttttttcctctgcctctagtgatttcctaaataaaaaccaagagctgttgcaagatttgtcagaagtgaatgacgaaaacactcagttgatggaaatactgaatactttgtttttcttgccaatcagacgacttcataattacgcaaaagttttgctaaagcttgctacttgttttgaagtggtaagctcccatgtatacctctttggacatttggaaagccaaggatcatagttgtttgtatggattatgccaccacaagatctggaactccagtaatttaatatttacctgtgtctaattaaatttaattttcttcagggaaatgacagaggaaagtatgactgtagataaattgagttttctgtggattcagtttccctttagggccttatcaagatgaataaactgtattcattttatgaaactgtctaaagttgagactctatcagatgctactcattcagtagttgtcaaaatttattggatgcatgctgactatgagttaaacagagctctttaaagccctggctttctgtataatggcatacacctgtaaggcaggggtgttacccagcctggattcatgctagactttatgccaggtgtttaggttaccttagcaaatgctgagaggaatcagtta

SEQ ID NO: 98134 - DNA, 2030 bp, Homo sapiens
tgagagacccaacagacaaccaacagtgttctgtttttccctgcttcacttctccacttttaatttaattaaattaattaatttatttttttgagactgagtcttgctctgttgcccaggctggagtgcagtgacacagtcttggcccattgcaacctctgcctcctgggttcaagcaattctcctgcctcagtctcccaggtagctgagattacaggtgcccaccaccacgcccagctaatttttgtatttttagtagagacggggtttcaccacgttggtcaggctggtcttgaactcctgacctcaagtgatctgcccgcctcagcctcctgaaatgctaggattacaggcctcagccaccttgtttggccttaattttatttcctactgtttacctactgtttatcccctttttatttgatctgctttcccactctgttttcccttcttttttgtaaactgaaaccattggcttatttctagctttcttttccccataaagtaactcacattctcaaagtgacatgctgcagggaaattaacccccaaaactagtatattctaggatttcttatttttattaagtaaaatagcatatgggcttttttttttagtctttgtgtttgtttttctggctagtaagttatgaatgtgtggggacaagatctttcttgctaaaggtaacattgggaccaagtacaatggttcatccctataatcccagaactttgggaggccaagactggaggatcacttgaggccagttcaagaccagcctgggcaacatagcaagaccctgtctctaccaaaacaaaacaaatttaaagattaaaggcaacattggccaagatgtgtctgtagttgccagtcctggctttacattccccatgaatgatttcacagtctagatagacgatcaaataggctgatgaaaggaatgaagctctcgtgtgtgtctttggttaccatgggatgttaatagtgcattgggtctgtagcttgcctgcctgatttaatgggatatgtgaataaagacatggaatgttttttatacagtggtatctggggtaaatgacaaaaagtccctttttaagaaaatctcttttcattgtacaaaaggcaggttaattcttagatcctagatattttaatatatagcatagagatcctccctggtctcattaatcttattttactcggaaagtggtcctgagacatgtatccctatcatttggatctttatatatccagggggtctgtttccaaacagttgtaatgtgaaatgaaaggtatcttggagataattgaaagtaggtgtgtatagttatgtatagatctggatatgcatatataacaatgatgtactgatgaaccagctctaaaaaaaagcgaccccgacgacccccccaaaaaaaaccctagtctgtggtgcttgcagattttcactatggccaattttcaagctgccaatggtttaattacttgcttgcaaattttctgaatatttaacagttagctcttgtcagctgatataagccagcttcagtataccaaattagtaacataattatatgttatatttaatccttttgttttcttctgtttcagcttggatatataagcagagtgacagcaggaaaagatagctatttagccttggtggataaaaacattatggggtatattgccagtctccacgagttagctactacagaaagacgattctattcaaaactaagtgatatcaaatctcagattctcaggcctcttctcagtttaggtaagttgcaaccccctctctcccaccattaaaccatcaggtctttatctcttcttcctatgtcacaaataatgaaaacctgttagtttatggtttacttcttgctatgcactgtctttgtgtgtgtgtacacaggtagtcaacaatttacaaactgtttccaatttgtcaatagcctcactgcccctgccctgtcctaccactcccagagctcctgcggcttccagaagtagaaaatggaactttt

SEQ ID NO: 98135 - DNA, 1145 bp, Homo sapiens
ggactacagccactttgcctggctcgttaatttttgttttcaaatgagaaaagtatttgtcagccttagtatagtattttgttcagcatattctttagaatacaagttctataggatgtcactagatgttgtacagaaaaggtttctgtggctaaatgtttggaattccagctgggttaaacatatttaaacagggcttttatttacaggatttgtcaccaccttcagtgtgtgctaatgtgtgtgtgaatctctgcagaggaggtagtgggaggatagattgtagcagtgagtatttaccaatttcatttgactaacaggtccccttttctacagagagcctctagaatatgcttcaaaaataccattggtggcgtatgtttttgaaaatcttaagtttgtccaaatgatatgttttcttaccctctggactcccactccttcaccccacgtctggttggttttcagtttcccccaggctcttaagaaaggctgcacgggtgaaaacgaggacagtggttctgacccccacatacagtggagaagcagatgcgctcctgccttctctgagaacagaagtgtggacctgggggaaagggaaggaagggcagctggggcacggcgatgttctgcctaggtaagcgctaccaacatttaccgatagaagttggcttaaacaaataatctctctcctgggaaggtctctaaatctcactttcctcatagaggaaatctgggctcttctagcttcagattattacacaccattaactctgataaaaagctgtcactttactcttgaatttgttcttaacagtaaaggacttggccaggcctggtggctcacacctttaatcctagtgctttggaagactgaggcaggtggatcacctgaggtcaggagtttgagaccaggctggccaacatggcaaaacccagtctctactaaaaatacaaaaattagctgggcatggtggtgggctcctataattccagctactcaggaggctgaggcaggagaatcgcttgaatctgggaagggcagaggttgcagtaagctgagattgtgccacttcacttcagcctgggcaaaagaatgaaactcttatctcaaaaaaaaaaaaaggaaaagaaaaaaaaagcag

SEQ ID NO: 98136 - DNA, 1040 bp, Homo sapiens
aattctcactatagtgcagaatattaaaaagagtcatttttaaaaagatgaattaatgtgaaatactgtgtgcttgaaccagatttctacaactgcttttgaaaatttaaaaagaaaatccaatttggttaaatctataggggactaaaagtttgctgttaaaatttttagttaattcactaacccttttttttttcttttttcttttttttaaccttcagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcct

SEQ ID NO: 98137 - DNA, 1015 bp, Homo sapiens
ctgccccttggagggtggcttctgccctcttacaatgtcaccacagcagcatgattcactcaggcccttggacccacagggagggccaaggctcagcagtgctttctaagccctataaatcaacaagcacagctgaagccatttagtaggaagcttgttaataagaaaaatatggtttaaatgggtccttttattggagagagggagcagaagatgatggagaacagggcccccctggcaacgaggaggtttgtaagtagtgccaagctctccctcacaggcaagagttggattgcgttaactctatcacgcctcaaaccttttccaggaggatgggaagcccaaggtgggagcaacaggaggggggatgggcccagagaatgtgcagagagagcgccccttgggttatccccgcaccagagatgtgtgggtccttcaaggggcagctgggaattttcaggttcaaggaagaccacagctgggctggagcatggactctcgtgtgtgacccagggcacagaactgaagggagaaagtcagcttgaagttttcaagaagggtaatgagccaaagagataaggaagacctctagagaggtgggacttcaaaggaaaagaacccaagagggagcctgaggaatcaataacgtagtcaaaccaaggtaaggatgactgtgcttgaaatgcactggaaagtgttttttgatgatagttgccttggaggatcatgagacttagctttcttagcccagggactaagaaggtccaagcacctgagtttagggcttgggtaatgacagactaaggaaagaaggctgaactaatctgatttcccattgacgaggatcactgcatgggtcacaggaagaacactgaacttgtcaaaagacccaagttccagtaggctttgccatttcctaatgagggaactgagcaatcaatcccttgaactctttcatcctgagtttccccattgacttagggtgaatgatacctgtttcacaggcttgctgtca

SEQ ID NO: 98138 - DNA, 1545 bp, Homo sapiens
tggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttctttgcagatttggggcgaggggtgatttggaaaagaagacctgggtggaaagcggtttggatgaaaagatttcaggcaaagacttgcaggaagatgatgataa

SEQ ID NO: 98139 - DNA, 1046 bp, Homo sapiens
cccttcacattgtgctgtgttcttatgcagtcaattcatacctaggaattttagaagcgcagggatttttcttaaggaggcacatctctgcagaaaatatgtgagggagagtgtttgtgaaagagcatgtgtagcatttaagaaaaacattggcaggagtttggtgttaatccccagataaggagtagaaacacttgtgaaaattttctgcagtttataaaacaaaactactctgtacaacaaccccatgcaacacctattctttttaagtaggtatgtgagaaatcttggcaagaaaaaaataaaataaaagtctggacaacatcttaccattaaaatacagagagagaattttaaaatgtgcctaaaataaaataatgatattagaaatcatctgggtagaactctagtagtataacagctgtaggtttgagccctgtaattatactgggaaaatctcttctaactctcccatctttaatttcactgaaaaggcaggtggctatttatagatggtatatttttatatatgcatacgtgaagggtgaataacagcctacggggctccaggaaatcctagaagggtccaaacccacaccaatgtggactgaaataagcaattcataaatctgttctatttttctctgatttacccccctcagtggcattaaaccgaattcataaaacttggttcttcacttctcctcactgtgtgacatttcttacatctgaatctgtgttctttacatttcatgctaaagtaaactagttaaaaagggtacgattaaaatgccagctctttagtaaacacacattgtgtctcttactctctttggttctttaaaaaaaaaaaaaaagatctagtcacttggaattttctcaatttgtggatttgtagtagaaggaaaaaaggaagtttgaccaagacaatagttgtttattataagggacccagttcaacaagtactgatcaagcagccactacactgaaggtactaggaaaaggactggagggacgcagatcaaagtaagacaaagtccacctg

SEQ ID NO: 98140 - DNA, 1062 bp, Homo sapiens
tcttaggtgtgggttgaggttaagcagatgaaatggaactaactaattgggctcagaatggaactttttttttttttttcttaagagacagggtcccactctgtcacccaggctgcagtacagtggcaccgtcatagctcagtgcagcctggaagtcttaggctcaagtgatcctccttcagcctcctgagtagctgggattacaggcacaccccaccatgcctggctaatttaaatgtttttttataaagatgaggtttccactatgttgcctaggatggtctcaaactcctgacctcaagcaagcctcccgcctcagcctctcaaagtgttgggattacatgcatgagccaccgtgcctggcccctagaactttattataaaggggaatttctccttttctttcaccatctcccaacttactttttagttttcttctagccttaaggcctgggtatttgtaggaactggaaataagagtaaacccatggtctggaaatgttctgtgtccactgcaggccactggcttccttatggagttcttgatagaaatgaaaatgtttctccaaagcagctttttgcctaaggagacaaccccacccccaattccaataatgattaaacaccctagaaattgtccttataagccagcaagataactttagatttgaataattatcagttagacttcgggctgttgatcttggatttcagtggaagatcatactcttcatttagtaaatttacatacaaggtttggagtaccatgagcctcctactggaaaagtaaaaagagaggcataattcacagttcttacactgctggaaaggactccctcatttaagagatgaggaaacgggccaggtgcagtggctcatgcctgcaatcgcagcactttgggaggtagaggcaggcagataggccaggtgtttgagatcagcctgagcaacatggtgaaatcccgtctctactaaaaatacaaaaactgcggcggcagcgccactcaggcgttgggtaacgctagacagatggactgtcacgtgacatgaagtggctccgaa

SEQ ID NO: 98141 - DNA, 1288 bp, Homo sapiens
agaaggaaagacacctctatattctttagattaaagaacacaggattcttaatattagaggagtgtaagtatgggtcacatttggatctctttgcacttttaaattagtggccacgtaattgtagtcaatttaaaaactgcttttatagtctaacatttttctttcctcttacagctgggaatggaggaagaagatgtgattgaagtttatcaggaacaaacggggggtcattcaacagtttagatattctttttattttttttcttttccctcaatccttttttatttttaaaaatagttcttttgtaatgtggtgttcaaaacggaattgaaaactggcaccccatctctttgaaacatctggtaatttgaattctagtgctcattattcattattgtttgttttcattgtgctgatttttggtgatcaagcctcagtccccttcatattaccctctcctttttaaaaattacgtgtgcacagagaggtcacctttttcaggacattgcattttcaggcttgtggtgataaataagatcgaccaatgcaagtgttcataatgactttccaattggccctgatgttctagcatgtgattacttcactcctggactgtgactttcagtgggagatggaagtttttcagagaactgaactgtggaaaaatgacctttccttaacttgaagctacttttaaaatttgagggtctggaccaaaagaagaggaatatcaggttgaagtcaagatgacagataaggtgagagtaatgactaactccaaagatggcttcactgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaatcatactaatgcttattttattttaattgtatagaaagaaaaaaatgcctaaaataaggttttcttgcataaatactggaaattgcacatggtacaaattttttcttcattactgtacagtgatgatgttaatgactttgaagcactgaaagttactgaagtgccttctgaatcaaggatttaattaaggccacaatacctttttaatactcagtgttctgtttttttaaaaacttgatattcctgtatggtgcatatatgatacagttacctaatc

SEQ ID NO: 98142 - DNA, 1077 bp, Homo sapiens
cttttctcctaggcgaccaccttcagtgacacttcacttggggggacagactttttgttttgagttgctattgggataaataaaagatgcgatagttcatcttttattttgacaatagaatggcaaatgaaggaatgcatttacttagacttttacttatactgataattttaacactcaagactgattaactttgttttactcggtttcttttgtaatgggtatacagtaactttgaggatgattacactgttttaagaaaacctgttaagaatgctaaaaagaatattgtggtggaaaaatacaggttacaaggtttatgtttctatttgcactatatgtgtaattaaatagtttggttcaagtaaagcaaatgatttatacaaagagggataatttttttcttttttatctccttaggatagcagtgagattcacttcaaagtgaaaatgacaacacatctcaagaaactcaaagaatcatactgtcaaagacaggttcgtccattttggtattaagtacaatgctttgtcgttaatttttttttttttatagaagattgtcagaagaaaaatcctgttttattattttcaccattagcaactcaaggaaaacactctatcatttcttgtaccctgcttaactgctttttttgtcttgtggcccattttaaagtttgaattcgtaagatgggaactagtttgaaaagtaactcagaattgtaaaagcgagctcaaatgaatgtttctgtcttgatggcttaccagtatatatagcaaaaaaggcaagtaattttttggtgattactatggattgtttttgtacttctaatcatgagtgtttagccatatgttaaatttaagtagtagtattattagtatattatctctctttttttttttttttgagatggagtttgctcttgctgcccaggctggagtgcagtggcacgatctctgctcactgcaacctccgcctcccaagttcaagtgattctcctgcctcagcctcccgagtagctgggattacaggcatgcactaccacgcccagctaattttgtatttttagtagagat

SEQ ID NO: 98143 - DNA, 1065 bp, Homo sapiens
ataaaaccacattacagtaggttgacagtgaaagtggggatagcaaaagctgaatactctttacgaagtttgattttgaaaaaaggtgataattggctgggcgtggtggctcacgcctgtaatcccagcactttgggaggccaaggcgggcagatcacaaggtcaggagattgagaccatcctagctaatacagtgaaatcccatctctactaaaaatacaaaatattagctgggcgtggtggcacgcacctgtaatcccagctactcaggaggctgaggcaggagaattgcttgaatctgggaggtagaggttgcagtgagccgagatcgcaccactgcactccagcctgggcagcagagcaagactccgtctcaaaacaacaacaacaacaataaccacaaaaagaaacaaaaaaggggagaaaaacgactagagaagtaaggtcaagggagagtatttttaagttgaaaataaatgccataaaatatatgaataaattgcaagtaggagcattaaaggaagatattaatatcatttggaaggttgggggagtgctgtggttcatagacgagttttaaaaaatcctggacttggccttacatggtggctcacgcctgtaatcccagcactttggtaggccaaggtgggcagatcatttgaggccaggagttcaagaccaacctgggccaatgtgatgaaaccctgtctctactaaaaatacacacacaaaaaattgctgggcatggtggtgcatgcctgtaatcccagctattcaggtggttgagggatgagaaaatcgcttgaacctgaggttgcagtgagccgagattgtgccactgcactccagcctgagtgacagagcgagactctgtcatagaaaagagaaaaaaaaaaaagcaggccgggcgtagtggctcaagcctgtaatcccagcactttgggaggctgaggtgggtggatcacctgaggtcaggagttcgagaccagcctggccaacatagggaaaccccatctttactgaaaatacaaaaattagccgggcgtggtggcacactcctgtaat

SEQ ID NO: 98144 - DNA, 1002 bp, Homo sapiens
cctgaaggaaggaaggaagggtggagttttgtttgctgggctggttgttctcaatatctagggccagttatttttaaaggttttaccaaagagtaatatacatacaaaaaagtgcacaagagtgtttggtttgccgaactttcacaaactgaacacatccatgcaaccagcactcagatgaagaactgctgtattgacttaacaagtagaatagttttgtctgtttttatacagcataacattttataagtgaaatcatacagtatgtatctctgtgtgttggttcttttgcccggcactgtttagaggtttgttcattattattgtatatagttgtatgttattacatctcattgctgtgtggctttccattgtgtggaatgcagtacactcaatttacttattcattctgcttttgatgcccattgaggaattttctagcacctgtttttaatatgagccaaacttataccttttatagcaccttctatttcaggattacttttgggctgaataacagaaagtttgatttattgtaggttaaacaattttttttttctcataaaacaagaaatgtagacaaaagtagctcaaggctgatgtggtagctccacagttccttcatattattttcttctccatccttaacagcagtctttcactctggtgcttgtctacttgtgggcacaaaaaagctactttgtgttccagacaggagaaaagggaaaaagtatgttcactttatatctctttggccaaaatgggtataaaagaagctgggaaatacgttttttatctgggtaaatttaggtttccctttgtaaggaagaaagggaaaatagataccagataggtaattaacaatgtctgtcatacttccaagtctgtttgctagtacttttggatgcaatcaaactggtttgttctaggcttagcataggtctagactcaaagggtaaggtttacacaaccagtaaaatttttagttatagttttgagttc

SEQ ID NO: 98145 - DNA, 1965 bp, Homo sapiens
ggcgtgagccactgcgcccggctaggagaatttcttgaacccgggaggcggaggttgcagtaagccgagatcacaccactgcactccagcctgggttacagagcgagactccgtctccaaaaaagaaaaaaagaaaaaagaaaaaaaggcgcaaaggctccgttcaggccctagatcccgcgatacaaactttctcggcccgccccagcccgctgtggcgggaacattctggaagtgacggcaatctctgcggcagtcttctgtcggaagtgacgttgctatcccagaatcctcagagaaggagtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggtaggtgggagagcgagccgttaaagggggaaggcggatgctggacagacgaggagagggaaagacttaagcacggaactactcagagtagcgtgggtgcctgttatagcccgggctctgggaggagggagaaggcctttacacctgagagccatgttacgtgtaacacgtggccccgccgtttggggagacccgttctgcattagaggattttatttcctcccgttgaaggggtgggcaggaggcgtgttagaatttaacagattatagggaattcggactttattctagatgttttgaggaatgatcgaaagattttttttttttttgagatggagtttcgctcttgttgcccatgctggagtgcagtggcgcaatcttggctcactgcaacctccgtctcccgggttcaagcgattctcctgccttggcctcccgagtagctgggattacaggcctccatccaccaccacgcctggctagttgtttttgtttgtttgtttgcttttagtagagacggggtttcaccatgttggccaggctggtcttgaactcctgacctcaagcgatccacctgcctcggcctcccaaagtgctgggattacaggcgtgagccaccgtgctcggccaatcgaaaggatttaagcagaggaatgacctgctaatttgtcttaatacggttactctgctgtgtggagattagactcgaggagataagaacggcagcaagaatacttttgcattcatttggacaagatgaaattgcctggtatggagagaaacaaatatcgatagaaattgtgaaggtagaacaggaaggactggctaatagattgaatgtggggttttggtttaaataagatgttaagaaagtttcttggggaaggactaaagatttccggtttgggctgtgcgaagcttgcgttgtctattagacctgataatgcagttgtgtagatcgggcagttcagtatttcagatttgaagcttaggggaaaacatctgggctggtgatgtcagtttgaggtttggttgttttcgtggggaaagtttgacaagttcgtcagcactgaaatggttgaatggtaagacattcgtatcgcaagatgctgttgagatgttaggaagaatgagtgagattgagtgccttttcttgtgcggtgcaactcttctgaggtctgtgaatatagcaatgaaaaataaagtttttatgtatattctacatatatatatgttggtagaaagcaaaaacgctaggtaaaaataaatgtaatacaattttagctatgaaccaaaaaaccatttgtggtgtggatgcaagaaagtctggatgggtgcagagttctccatgtttcacttctgacatttgaaaatacgcagtttgcatttgatacgtcaaatgttatttttaagaaaacca

SEQ ID NO: 98146 - DNA, 1162 bp, Homo sapiens
ttgtaagtaagctccttagtcccctttagagctacgaaacatgtcaattttacttttctccagctttttggaatcttatctaaattaccatgtagagttctgcatagcttcaaattctcttagccaatgtggtctgtaagtgtctatcgatgaatttcaccgttaattgccgtagtatactgtcctgtaccggatgtgaagaggagcaactctgcacagtgcactggttgtctcccatggtaggaaggaattggcttatcaatggtcggatttctagacctgggtcctaaaatactcaaccgtgtctcgatgaattactgatttctattaatgaaaagtgtcctcctccatgaaaatgtctttgagtattccgttggagtttgcagtgctatttatctgcaagttactgttcaaaatgattaaattgtggtttatgtaacctagtactaaagaaataactagttaagctcgaatatgttgacattgattagtttgtaattattggaattaacattgatcgtttctgagtataaaagacatacaaacgttctggaactagtgatggctgcacatttttgtgaaaatgcactactaaaaagtgaattgtacactttaaaagggcaaatattaagatacatgtaaaattaatatgatatatggtgaattttatctcctaaaaaagtagacatacggttcaaagttattagtttcctttcccataatctttcaaaatgctagggtataaaattatgttggttgccaggcatggtggctcatgcctgtaatcccagcactttgggaggccgaggccggcggatcacaaggtcaggagtttgagaccagcctaaccaacatggtgaaaccccgtctctactaaaaaaatagaaaaattagctgggcgtggtggtgtgcgcctgtaatctcagctacttgggaggctgaggcgggagcattgcttgaacccgggaggcggaggttgtggtgagctgagatcgtgccattgcactccagcctgggcaataagagcacaactccgtctcaaaaaaaaaaattatattggatgcatataattcatgctttgatgagaatgctttaggaagttttttgaagttttttgtttttttgttttttttgagacggagtttcactcttgttgcccagg

SEQ ID NO: 98147 - DNA, 2357 bp, Homo sapiens
gaggccgaggcactagaatctcataaacccaggaggtgaaggttgcagtgagccaggattgctccactgcactccaggctgggctacagagcgagactccatctcaaaaaaataaaaagaaaggttccctgccctaccccctaggaccccatagctccagctacggcccaaggctggggcaggaatatctcttgaggccaggtagattctagactgaatagccactgtactacagctgactggactagatctgaattccatttagctgttaaatgggcaattcgaactagtaatttgaccaaaattacatgcagggtaagaaaactagttcattatcttagtgaaagaaatagcttctacaccttcattttacatgtaaaattgtatttgaagaatgcagctgtatatgcctcacctgtaccatttaaataaaactatttaaacattttattacaggttctaaatgagaagaaacttcaagaggttgatagtttatggaaagaatttgaaactccagagaaagcaaacaaaatgtaagtactcttgaaatcaataatttagcagttaacatttagggcttgttttattttttacatttttccctgatttatataatgttacattcgtagttttctgttttgaaatctgtttcaggaataattttggtatgaacctaattattacaaatgttttacttggaatataggccatctcaattaatttgaaggcagtagtctcccccttacccacagggattatgttccagaagaccctgtggatactttaaacctcggatagtaccaaatgtgattgctgtcagtaggaacacatttgtcttcgtgtcttccacacacaaatgtaataccttttttatcttaactaagcacttaccgcacacaggggttgtaacctgctttttgagttttgcaacatcaaaactagcatgaactactttttctttcatcacaatttcatggaagattcattcttagtgtagatgttaaatctttggtttttttgtttgttttttgagacagagtcttgttctgtcacctaggctggagtacaatggcgcaatctctgctcactgcaacctccgcctcctgggttcaagctattcttctgcctcagtcccccaagtagttgggattacaggtgcccaccaccatgcccagctaatttttgtatttttagtagagacagggtttcgccatgttggtcaggcaggtctcaaactcctgacctcaggcgatccgcctgcctcggcctcacaaagtgctgggagtacaggcgtgagccaccacacctggcctaaatcttcgtatttgtatgtatatttaagggaccacactagtatgttcccttaccagataagaaaaccttgcttaagatgacactgttgcctggtgtggtggctcatgtctgtaatcctagtactttgggataccaaggtgggtggatcatttgaggtcaggagctcgagaccagcctggccaacatggtgaaaccccctctctcctaaaaacacaaaattagccgggcgtggtggcacatgcctgtaatcccagctactgggaggaagctgaggcaggaaaatcccttgagcctgggaggcggaagttgcagtgagccgagattgcgccactgcactccagtctgggtgtcagagtgagaccctgtctccaaaaaaaaaaaaaaagatgacactgttttaggcaactagaagactagttttccttcttaaagggttatatgctttgttgggttaatctgattcgttgttgtcaatgatgtattcttcttggaactgaatctaagtgatctgactcaatattcgtcactaccactgagacaacgatgaatcaactatatgtttctttctggataaaatactaccctgaggctgggcgtgatggctcacacctgtaatcccagcattttgggaggccaaggcaggcggatcagttgagcccaggagttcaagaccagcctgggcaatataggaaaaccccatctctaccaaaaacaaaaattagctgggtgtggtggtgcacacctatagtcctagctgcttgggagactgaggctggaagatcctttgagctcgggaagtcagggctgcagtgagctgtgattgcaccactgcattccagcctgggtgacagagtgaagtgagaccctgtctcaaaaacataaagggggccgggcacggtggctcacgcttgtaatcccagcactttgggaggtcgaggtgggtggatcacaaggtcaggagtttgagaccagcctggccaatatggtgaaacctcttctctactaaaaaatacaaaaaaattagccagccatgggggctgggc

SEQ ID NO: 98148 - DNA, 1788 bp, Homo sapiens
ttctgtctcaaaaaaaaaaacaaaaaaccataaagggttaggatgtaacaagaatgagacctgacaataagctattttttttaatggcatttgtacaggatagacaaatgaatatcatgagattcctaaaaaggactcacgtacgttttcttgagtcaattctatgctgtataataaagtcatctctgtacagctttatgcaacaggggtttgtattaaagcttcaacatctttactcttggccaaaatttcctccaaagcctacaactttcttttaataatccaagcattactagcctaacatttagaaaaactagtaattgtatgaagaatatctaacttcacaccctgatacacaatggtaggcatgttttattggtgtgtgctttggaaacagtcaagcacttctttccaagttatgtggcttttgaatcaacgcactgcccccaataacatgtttatctcttttttttttaattctagagtaaagctaaaacattttgagaaatttcaggatacagcagaagcattagcaggtaaagtaaaaaattagaagcttgcttttttgaaaaaattaagtcttagccgtttgtttttcttgtttaaaaggttgtttgcttcagttgcctgtgttaaccttattcaatgttgtcaatgatgcattcttattggaactgaatttaagtgatctgactcattcgtcactaccactgagacaacattgagttagcttttttcaccatagggctggttttccccatgtgtgaggagaggtgagaagtggttaagttgatctccctgtggaaaccagcaacataatgctgaagcacaattcagtaaaaggtgttctacaagggaccaaggtaatgtggtcaagtatacagctctctcctcattttaatccaagggtagagttgtaatcctgagaacagccaggattcacagttgaaaaataatttaaaaagctcttctgggggtatagatttttagttcaaaaaaacatatcaatattcagagttatacagaaactgacagaggtgttatttttaaaagattcagaagaatggatgactcatactcttcaactagatttcatcacgggacaacagagtgatcgggtttatttactgtaattgactgcagtaggtcttacagttttgtttttttaagtgttagggaaaacaggaagagcagatataaagcccaaatcattaaattttcaactgcctgaattctttatcacaaatcagccaactatttggcggtgtagtttgaaaatgaaggaccgtgaggaagaatatggcttaaagctgggcaagaatatgacagatgcaaaaaattttgttaaataaccacaggagaaaggtacagtttttgtctgaaaatttggaatccaactaaacatgctggaacataacagaccaccctaaccttggcagaggggtaggctgaaggaagacccatagggccagtttctttgttttataaacatagttctagggctgcttcaccaactcttcagtaattagagttatatacagccataaaaaaaactgtggtaatattaacttggagaatttttaaaaagatagcctgttcatcacagcttttaagtatgggtaaacatttggtaagattccaagcaagattgtgttagctgtattcaaactctagggggtgttgttgacatagactgggatatgaacagttcctagtcctgatctcaagtagcctcttctgaattcctttttgcatacgatctttaatctgcttgggatatatctggcc

SEQ ID NO: 98149 - DNA, 1198 bp, Homo sapiens
aataggcagcctttgctactaagttttacattgctggaggtgtacaagtggagatacaagcaaagctaaggccttcactcaaacatgtttatattatggcagaactttgaaaatgattacactcatttttactagttttgatgtgattttaggatatttcaggacagtctatttgaaatgacaaaggaaagtgagtctgttttgtcttcccaaaaagattgtttctaagatttcatgattctcccttgagttcatgagaagattcttgtgagaaggaaagaaaccctggacctgattttacccctggctctgtagcaaaaatgagggtgggaagatcaaatgaaattgtgaaacatgtaacttataaaacatatatcatttcatttcagaagtaacattaaattcaagccctttgaaaggcctattttatttttttaagtgtcaactagggcaaggtctcaaagttaaaaatttgagagttaatgcttttgtttttctttttcttgaaaagcattcacagctctgatggagggcaaaatcaataagcagctgaaaaaagttctgaagaaaatagtaaaagaagcccatgaaccgctggcagtagctgatgctaaactaggaggggtcataaaggtaaagtcacgatatttttggtcatgcctgctagtcagatctcacagcataccaactacaaagcctagcctttgcaataagttgcttatcataaattctcaatacatttttttcttttctctaagctacatgataatggatttcccctaacatcagctgaactgagcaaataagtaatacctatttgttctagaagatatagaagaacaaaaaatgataaaaattgactttaacaaatctgctacccatatataatgttaatgttctatgtatatcatgccatatttttgtctagccacatttttttccaacgaaaatggggtccttatattttttagaaatatatttattagaaaacttttagtaggggtgtattgctggagatgaaataaaatgtgagagtggaaagaaagactaggaaaatagcctcccaaatacagaaagcagaacaattcgggcggggcgcggtggctcacacctataataatcccagcattttgggaggccaaggtaggagtatcacgaggtcagcagatcgagaccatcctggctaacacagtgaaac

SEQ ID NO: 98150 - DNA, 1050 bp, Homo sapiens
cagtcaagtattctacaaacacactggaaattatgcttcttgtccaactgagaaatgcgtatatttaaattagtgccactttaatatttaggaaataatttcaggctgggcgcggtggctcatgcctgtaatcccagcactttgggaagatgaggcgggcggatcacttgaggtcaggagtttgagaccagcctgtacaacatggtgaaaccccgtctctactaaaaatacaaaattagctgggcatggtggctcatgcctgcaataatcccaggccgagacaggagaatctcttgaacccaggaggcggaggttgtagtgagccaagattgcgccactgcactccagcctgggcgacagagtgatactgtgtctcaaaaaataataataacaacttcaggaaagtctttttttttttaatttaatatagatgttcatgttcttgtaggaaaagctgaatctcagttgtatccatagtcctgttgttaatgaacttatgagaggaattcgttcacaaatggatggattaatccctggggtagaaccacgtgaaatggcagctatgtgtcttggattggctcacaggtgagaattactggaaaataaagtcaacttacttttatttgataagcgcttaacatagatctgttctaagaatgttacaaatgctcatttgaaccacatcagaaccttatgaagaagatgatagtaatatcctcatttacagatgaaactgaagcccaaggtcaatacagctggtaagtggtaaagccaggatttgaacccaggcagtctggctctattgtctggattcttaaaaccttaaaacctcatcaaaggaattctctactactctgatcttggatgccctgtttcttgggctttccctcctttatctctgctaagtcatgccactcctccatctacttagtattcccccaaattctctcatctgctatggtcttatgggataggtgtgtatttgtgttttcattgctttactctgatttttaataaggcaaagaggactaggtgcagtggctcacccct

SEQ ID NO: 98151 - DNA, 1052 bp, Homo sapiens
tgagattcaggcgtgccccaccatgcctggctaatttttatatttttagtagagacagggtttcgccatgttggccaggttggtctcgaactcctaacaggtgatctgcccacctcggcctcccaaagtgctaggattacaagcgtgagccaccacgcccagtccaatatgacttttgtattacacagcttatcctatttgtcattcatacataaactcattcatgttacagaaataaaggtcgtagcagcacatatagtttttttttttaatgtgtattttctgttctcgtatggtgcatttctacttagctgatttttcttcttagaaaaaccaattacagctctgactacaggctgatttgagtaaaaacaaaaacaaaaaaaaactttaaggtgttaatttaaatgcttttcctagatgctatcttgctaatttattttcccctttcttcccagcctgtctcgatatagattgaagtttagcgctgataaagtagacacaatgattgttcaggcaatttgtaagtatagtacatgcaaagtccgatttgttgctctgtccttcatgcgttttcatactgttgaaactatcttttatgattctgtctgttgagaaagagaaaggaggccaggtgtggtggctcaagcctttaatcccagcacttgggaggctgaggcaggcggatcacctgaggtcaggagttcaagaccagcttggccaacatgacaaaactctgtctttactaaaaatacaaaaaaaattaaatgtgcatggtggcgtgtacctataatcccagctactcaggaggctgaggcaggataattgcttgaacccaggaggcggaggttgactatttggagattatatgaatcacagaattaacattacgttaattaattcatttgtatttttccatgaaaatgttaaaaacataagtgcaatctttgtagttgtgtattctgctgtgtcattaaatggtttttagaaagctcaaaagctgccaggcacagtggctcatgcctgtaatcccagcactttgagaggctgag

SEQ ID NO: 98152 - DNA, 2091 bp, Homo sapiens
tttttcagtttctgatgataaaattgctctggcaatagatcctggtaatggttgcataacatcataagaatacttaatgctactgaatagtacacttgaaaatggttgaagtgttattttttattcttttttttttaaattttttgcgacggaatcttgctctgtcacccaggctggaatgcagtagcacgatctcggctcactacaacctccacctcctgtgttcaagtgattcttctgcctcagccctccagagtagctgggactacaggtgtgcaccaccatgcctggctaatttttgtatttttaatagagatggggtttcaccatgttggccaggctggtcttgaacttctgacttcgtgatatgcctgtctgctgggattacagacatgagccaccgtgcccagcctgaagtgttaaattttatgttgtgtatgttttaccacaataaatccctttaagttttgtttgtttgtttttaatctactacagccttgttagatgacttggataaagaactaaacaactacattatgcgatgtagagaatggtatggctggcatttccctgaattaggaaaaattatttcagataatttaacatactgcaagtgtttacagaaagttggtgagtaatttgttcatcctttaaggcattgaaagtaaatgaatttgattgcatcctaaaacatgacgtatagcattttgttaagcaagattcccagggtttttgcaatttctgtgtatttgggaagtgtagcagtttagtgtcttaaatttaagaaacaaaatgaattttaacttagattttgatggcctataacatgatattagtacctaatgctaaatagcagtattgccgtctgtactgttaatatacagaggaacttgattgttgattgtcgttaacgtacagaggaacttgattgattgatggtttacttgccttacgaattactggccccagcttcagtataaaattgtctgtgacattattattagtcctgtcttttttaaatttttgccacttatattctgtaataagtgttgtggcatattttgtcctctttttactctgattattttttggaagaaggtggtggggagacatttaatgtctaaacttaaacccttaaatgaggaaaactgttatactaggtcaaacttcttcattttttttgttttgtttaggcatccttttcattggctttctactttttcttttgactatttgctggattttatataatttgttgaagagtgattctccctcatcctctgcaaacattccataggcgataggaagaactatgcctctgccaagctttctgagttgctgccagaagaagttgaagcagaagtgaaagcagctgcagagatatcaatgggaacagaggtttcagaagaagatatttgcaatattctgcatctttgcacccaggtaaattttactcctggagaatctagttgtggtgttaccagctctatagtactaatttttctgatggcaatgatgatttttacacttattgttgttcacctgataacataaatatgagggtgttcagtcactacctcatctgatgccatcatgatttgtatacttaaaagggggaaatacatattaaaaggaagtaatttacaatcatcgtctgaataatgaattaaccaaaaatcaattaagatggcagagaaggccaggcgcgttggctcacgcctgtaatccccgcactttggaaggccgagtcagggattgacctgaggtcaggagttcgagaccagcctgaccaatatgatgaaacccccatctctactaaaaatgcaaaaattagctgcgcgtggtggcgtacacctgtaatcccagctactcgggaggctgagacaggagaatcgcttgaaccagggagggggaggttgcagtgagccgagatggcaccattgcatccagcctgggcaacaagagcaaaactccatctcaaaaaaaaaaaaaaaaaaaaaaaggatggcagacaattatggattgagccttttaattctgagtcttatgtctatatcttgtgatttttttttctttcagatttgaaggtag

SEQ ID NO: 98153 - DNA, 1369 bp, Homo sapiens
acaggtgtgagtcactgtgcctgggctgcttagaatcttttaaaaatacagttacgctgactaagattttcaggcagtggaccaagtagtttacatacattatataacgaagtcctcattacagccatcttatagaaaactgatgttaggatcatgaggtcaagagatagagaccatactggccaacatggtgaaaccctgtctctactaaaaatacaaaaaattagctgggcgtggtggcgggcccctgtagtcccagctactccagaggctgaggcaggagaatcacttgagcccgggaggcggagattgctgtgagctgagattgcgccactgcgctccagcctgggaaaaaaaaaaaagaaaactgatgttaggcataggtgatgtacccagtacccagggttgtgtagctgctctttcataattgagggctccagtgttttagacaggaatttttactgtttttactcatatgatatttgtgacttaactttattccttatactaggtgattgaaatctctgaatatcgaacccagctctatgaatatctacaaaatcgaatgatggccattgcacccaatgttacagtcatggttggggaattagttggagcacggcttattgctcatgcaggtgatggttttaatgtaatttgtaaatatgagtgtttgaagtattttctggttaggattttgtttacatctttaaactacagctgttaaagaaattttagctgataacacaaaagtagatgatatgtgggagatcactaagggccaagtgttcaatgatgatttctatttgtttgcctgatttccttttggataatgaaggcatctttagtcactacctcttctgagacacttgtggtccattgttagaagtttgttagggttaattagaacaatcggatgaatgcaggaggataaaacagttaacattttcataataaaaactcactagacctagatttgaatacagttttaagaaatcactgtagagaaagaaaaaaaaaagaaatcactgtagaggatttgtgcccttgattgattaccttagtttcactattgagtgtgaggatgtaatatatttgactttcaaaaatattttcaacaactgatttataataaaactttgtatatgtgtatggcagtattataaggatgatatgctataattaaaatgctatgtaattgaatacctacaaatacaatgaagtactgattcatcatttttatgttacttggagacattgttataattcatcaaaaaagattatatcatctgcatcagagtgtttaaaatggcataactcctttttttttgtttgagacagagtttcactctgttgcactggctggagt

SEQ ID NO: 98154 - DNA, 1740 bp, Homo sapiens
aataaagcgttcaataaaataaaatgttaattagattgaaaaagaacccacgcttttttttgtttgtttgtttgtttgtttgtttgttttttgagatggagtctcactctgtcgcccagactggagtgcagtggtgccatcccggctcactgcaagctctgcctcccaggttcacgccattctcctgcctcagcctccagtgtagctgggactacaggcgcccggcaccacacctggctaattttttgtatttttagtagagacagggtttcaccgtgttagccaggatggtctcgatctcctgacctcgtgatccactcgcctcggcctcccaaagtgctgggattacaggcgtgagccaccgcgctcggccagaacccgcacatatttaagattgttacgaggaaaaagatgcacttcttttcagtgacctcatagcacagaactaatgtcactgagtagaaactaaagtttaaaaatattttttaaaaaaacctagtttgagctaatatttgacatgaattgctgtaaaatcttttcagccacagaagtgttggtggtgatatatggccattagattgtggcaaaggttgaaatacgatggatgatttgaattgtatgattcataatagttttataactcctgattttaaaacatccaagttattgaggattttacatctgaacatggaatatagttcttcatgtttttctattagatttctcgaatgctggcagccaaaaccgttttggctatccgttatgatgcttttggtgaggattcaagttctgcaatgggagttgagaacagagccaaattagaggccaggttgagaactttggaagacagaggggtaagaactacatcatgcctattccagaagtattacttgtcaaaagttaataaactgagtaaatttattaacttcatctgctaaacagttttatgatacttattagtatgtctaaagtattctttttgtgcctactgttaacaattgctattatttaccaagaattgatgtatccaactgcatttgccattaggatatgctattcaaaataacaaaacaaaaaatagcagaaattgctgtttgctggcccactgattcactagactgtatagtgtattataaagagattatgacttagaagtgtatttgtaatttttcgttttcttcttagataagaaaaataagtggaacaggaaaagcattagcaaaaacagaaaaatatgaacacaaaaggtgagtacatttaagtgaggatggggtgaatagtttttttaaatgttaattattgacagtaattttttattgtaaacttcaccttgatgtgcccatagttttttcaaatttatttatttgaccaaaattgtgtatgtttattgtgtgtatgttgttttggaaaatgtgcacattgaggaatgattaagtcaagctcattaacatgcattgtcttatgtactttttttgtggtgaggacaccttaaaatctacttagcaattttcaagaatataatacattgttagctgtagttaaccatgttgtgcacccctaatttttttccatgccatttagttttccgcattaacttctactagttttcattcatatacatatttaatttattcatttccagatattgatagtaaatttttttaatctaaagttcctctataatatgttctttatcaaaaagttcactcagccgggcacagtggctcatgcctgtaatcc

SEQ ID NO: 98155 - DNA, 1778 bp, Homo sapiens
atagaacattaccaattataaatacatatttaagtataatttagtgttttctggaaagaaatcaaatgtgtttctgtgggcattcacattttcttttttgtgaattttccaagctttctacaatagccatacattctgcaatatttatagtctataacttattatctctagttgacaaacatggttctttgtttcttaaattataaatgtctttaacctaaaaaaattaaatagtcattcagcttacaggtctgcttaaaaaacagaacattttttagcttgttttgaaccaatttttttaatgttcctgtgcaattagtactttttactttaaacatatgcacttaaagcatccattcacattttaggcactcatttcagtattttctttctgcttacattagaacaaaagcaaatgttgggttctatggaatcttttccatgtgcatgtatttgtatcctttcttgttcttgtgatcttgtgatgaagacttctatactaagcttggtttagattttttgttctgcttttttttttttttttttcccccattgagcagtgttctgaaagttggatggttcagttttcactttctagttaggtgtgaagacgttttctcctttcatttcccccatgctgattgagtgttttcctgtaccatagtaactacattgattactaaatcagaattcatttagctcaccacatctcttgaatgtgattgacctacttgaaaaatattaatacctttaacttttggaaactattagtcttcataaactaccccaaagccactaaaatgaaacaacattgtgtgcttatgtaagtattatctaatggcattttctttatctcttgagaattatttcaattccagatacttgttagagattttctaaaactttttgggtctttcagtgaagtgaagacttacgatccttctggtgactccacacttccaacctgttctaaaaaacgcaaaatagaacaggtagataaagaggatgaaattactgaaaagaaagccaaaaaagccaagattaaagttaaaggttagtttgaattttttttttaacacaacttatactcacttctttagaactgtggattttgtgagtcttaaaagtacatgccatcccactttattataaaactgctcattgaacgctaatggtgttttaataatgccattatgttctctgggaatatgatattgttaaatttatcagactgcacagaggaaatgtgagaagtttagtcaaattaggtattttactaagagttccaaaacttcatttctcctacatgaactatttggagaattaagagaaaaaaggaacgtgttttctaaattggttgttgaaaattttttgttttatagttaagaatgaatacagaattgatggaacagtgattttcttcattgtttctcttacacggagcggactggaaggaatacatactggtagcctgccgtcatagttacaatatctaacaggtgctcaccagttaactaggctgtcttgtgaagttgataagcaggcgccccattattagttacacctgggtttattgaacacctactagcaagtctagcagaagagtaaagcattaacacaatgattgctttaacttggtttctaagtagcttagtggtcaaaagtatatgatctacaaatgtggatagtatacttgatagagaaaacaaacaatttatttaacttttatgcttctttttattgaaaagtaaggagatccctaaacccactagtagcat

SEQ ID NO: 98156 - DNA, 1689 bp, Homo sapiens
atacttagtgctttctatgcatcatctttttaaatcagtaacagtccagtaagataagacattcttaagttttatagatagggagcttcaccaagggtaaatacaatttttcagggttgcagcaggtagattaaacccaggccgtctgacttcagagtgcaagctcttaaccatttctaatataattgactttcttcccaataatgattggagatcagatgacctttgttttaatcctgatttttatacatgacttcatgatcgtgagaagattgctctgagctctatctatatcattcgttaaagttagtggtaggccttggagaaccttcccaattataaaataaacaaaacaaacattgggtagttgatgagaatgacagaaaaaaactaggactcaaacgtttttggaaggaatgagatctgatacagtgttaatttgttgtgcctttacacttaccctattcagttgaagaagaggaagaagaaaaagtggcagaagaagaagaaacatctgtgaagaagaagaagaaaaggggtaaaaagaaacacattaaggaagaaccactttctgaggaagaaccatgtaccagcacagcaattgctgtatgtttgtttttaattatcggttttcacttggaggggccagttctctatatttcaatctattttctatatcagaaatgagcaggcattttaaaaaatggttttcattgatggagaggtaaaagtgaaatggctttgttgtatttatattataaaaggccatttcccaaatctagaatttattactaaaaatcaagtttgcattgaggggaggagtatgatttgctcaagcttactttttttataggtggggtttttatattttcaatgtgattactcacccatacaatttcagctctttcaaagcattcttgttggctattttcagagtccagagaaaaagaagaaaaagaaaaaaaagagagagaacgaggattaacagaaaggaattacgattatatcacccggacacacatcatgcttaagattcaactgggagcataccagggatgctctctaacgtaatcaagggaaggttcagtaagacaaagtgatttatcatctataacttcaaacctatttgtcttgacatcaactctgttaaccttatgtcatcatttcttagagtctttgatatacaaataaaattttctttgtattttaagacaattttgtgatctctttatatcttaggtagagaatctttggctctttctgtagtttgccatgtgatgattattgttttgataattataactgaaaagtgagagttgttttgaaatttaatcttttggaagtcagtgattaagtggaccaattcaagaccccactctaatgtgtttcttttgcctttttggactactttttattttccacctataatctttctacctctttatttaaataaatatttgtttcttattcaaatttttaaattaggtgagcaaaactttttagttcaaaagggtgggagacagtatccctccctttactgtttgcaattctaaaaggcataccaaaataattcttaaaaccctgatttgtttttaaagtagtcagcctgaagtgacttttttaaaggttgtacaaagtgatcataaagaatggagaatagggaaaaaataagaaaaaaaaaagtgccag

SEQ ID NO: 98157 - DNA, 1102 bp, Homo sapiens
aaattttgcgtatgacttaatgattcccccaaaacttaactgctaacagcctactgttgaccagaagccttaccaataacaaactcaaaacacattatgttatgtattactgtattcttaccataagctagagaaaaaagtgttgagaaaatactgttcattcagtggaagtggatgatcataaagatcttcatacttgttttcagttgagtaggctgagaagaggaggtgttactcatgctgtctcaggggtggcagaggcagaagaaaatctgtatgtgtcaagggtcaactgtaaattacaatagttcctaaaacatctggagaactttttaaacagtaaatttctgatttactgggtatcgggtagagcccaagaatttccatttgttacagattccagttgatggttgggggacagcacctggaccactgtactgcaaggactcccttgcctaaccctatagttctccaaactaaaaccaaacttaaattgatggtcaagaagtcaggcctgcccattttggcaacatgaaaagcaccagaaagccagcgtcaggcctcagttgtgctgttgcactgtaggtaattgaggagccccagagggctagacaatcaggtcaatgctctccctacatagataatgcaagcttgaatgggtacaagaaaaaattagtagcattgtttcctggccgtaagaatttgcttttgaagggacaaacttaattgctgatactgcaagtgttctatgtataattagtattaaataaaagggaaaaaacttaggcattttttttcttctttttttgaaatggagtttcgctcttgttgcccaggctggagtgcaatggcgcgatctcggctcactgcaacctctgcctcccgggttcaagcaattctcctgcctcggcctcctgagtagctgggattacaggcatgcacaaccacgcctggctaattttgtgtttttaggagagatggggtttcaccatgttggtcaggctggtctcaaactccttacctgaggtgatccacctgcctcagcctcccaaagtgctgggattacagccgtgagccactgcgcctggccccattgtgttgt

SEQ ID NO: 98158 - DNA, 2961 bp, Homo sapiens
accatcctggctaacacggtgaaacctcgtctctactaaaaatacaaaaaattagccgggcgtggtggcgggcgcctgtagtcccagctactcgggaggctgaggcaggagaatggcgtgaacctgggaggcggagcttgcagtgagccaagatcatgccactgtactccagcctgggcgacagagcgagactccgtctcaaaaaatatataaaatatatatataattcttaaaaaaattattcttaaacatgggtatgaggaagaggggctgtttagatcagaggtgggcaaaggacagcctgaggttcaaatccagcccatagcctgtttttgcaagtaaagttttattggaacacagccatgcccattcctttaagctctgtctgtgtccgtactgtttatggctatatgctccaacagcacaattatgtgttaaaaaggacaatggcctgcaaagcctgaaatatttactatctagtcctttactggaaaaattttctgaccactgttttggattaaaaggaacttaaagggtcaaatgcgatgtataaaccttgatttcaaacctgatttcaaaacatgaaagacataaaagatgttctgggaacagttagggaagttctaatataaactggatattacatgactttagtgaactataattacctttagatgtgattaggctgctagggtcatgtaggataatgtccttagttttctttttgtttttttttttgagatggagtctcactctgtcgcccaggctagagtgcagtggtgcgaccttggctcactgcaacctcagcctcctgagtagctgggattacaggtgtgcgccaccatgccctaatttttgtatttttactagtgatgggttttcaccatgttggtcaggctggtctcaaactcctgacctcgtgatccgccctcctcggcctcccaaagtgctgggattacaggcgtgagccactgcggcggctgtccttaggttttgttttgttttgttttgtttgagatggagtttcacttttgttacccaggctggagtgcaatgacgccatctcagctctccacaaccttcgtctcccggcttcaagcgattctcctgcctcagcctcctgagtagctggaactacaggtgcccaccatcatgcccagttaattttgtattttttagtagagacggggtttctccatgttggtcaggctggtcttgaacttccgacctcaggtaatccacccaccgtggcctcccaaagtgctgggattacaggcatgagccaccgcgcccggtctgtccttagtttttaaagatgcaagctgctgggaggaagtatcctgatgtctataatttgttttgcagtgcttcggcagagattatgaatataaatagatgaagcaaatacagcaaaatgttaatagttgttgaaatatgttgtgggggtatatgaatgatcatcatactattttctccctttttattcctgaatgcttgaaatgatcataaagtcttattttttaaagcagaaacatgctatttattttgctttaattctgagttctttctctctgaaaacttccaagatccttgcaaagttcttgccagcaagtatttgggacacccactatgggccaggcacttgtgagcagggaaagctcaaaagaaaaagatgcagtagctgatgacctcagagaattcacaaagtgaacctcagacctcaaacgctcctgatgaagaaggcatgttctcatttaaataaatgactgaggaggggggaatgtggggaagcagcagttagagattgccatagaagatgagaattatggaaattaggaacacagaagctgtgaagttgaatttgagtttatgaaacagaaatcattcctctccctttctctactaaccaccaaatactacacatttgaagaaaatagaaaacagccgaaagagctgagtggcgtggtacttgcctatagtttcagctgctcaggagggtgaggtaggagggtcacttacgcccaggggttcgggtctagcctgggcaacctagcaaaaccctgtctctggaaaacaaaaaacaaaaaagcagcaaagccccaccccttggcaggtaatagagttgggactacagctgcatccccttgtaaccccgtctccccaccccaaaattgcccttccacatcctttaagctttggcaatttagtactcacctggagagctcttctgtgccacacaagtgtaaggaggtagccatgtgccttctcagggcctcataaaactgcctcttaacctgagccaggaagcagggagggcttggtttctagcaagggtaaatgtgcctgactccaggaaaagaatcagtcagacaacaaatacatctatttgtagcctaaaatctgctgggccagcaacatgctaataaccagctgggcatgatggagaggccacaagccgactgtcaggatgggaagagccctgcactactggtcagagaaaatatacgtgaaagtgctgcataagccaaatggcactatttaaaatatgcttgctgttataagctgatttcactacttactagttcatgtccttagacaagtcaaccttgccttttcggtctcagtttctgcagctataaaatggtaataattttttgtttatcttgtagagctcttagaaactcagatttaaaaaatgcacaggccaagcgcagtggctcatgcctgtaatcccagcactctacgaggccgaggcgagtggatcacttgaggtcaggagttcaaaaccagcctggccaacatggtgaaactctgtctctactaaaaatacaaaaatcagccaggtgtggtggcacagccctgtaatcccagctactcaagaggctgaggcaggagaatcgcttgaacctgggaggcaggggttgcagtgagccgagatggcgccactgcactccagcctgg

SEQ ID NO: 98159 - DNA, 1353 bp, Homo sapiens
gtgtctggtctgctcggagccactggaagtgcctcccggagggacgcagggtgtctcgccgcctccctgcccacccccttccccggctaccttcatccgccctcccgccgccccccgccctcggtccgcgacgcccgagttccgtcaggagcccagagctgcgggagaacgaggcggcggcggcggcggcggcggcggcggcggcggcagcagcagcggcttcctcggggggttgtgattcgctcacaggagccattgacgggagaagaggaggctttcttggtggaatttacctcaggcaagatcgagccgcaggaataaaaagcgaggaagggaagggagcgccgccgggaggactagaaggggcagcctctcacacccactccgcctgccgtctcggggagcccggaccggggccgcgaccgcgacccctcccctcccccgctcctacctctcctcagccttcgccagggcctccccaaccctctcacggttgttctgcgaaggcgtggggactgtgagcttgtccatggaggcaggcaccttttttgatccagtcaaggaagaggatttgttgttttcgaaatcagagtgaaggaagcaccgaagcgaaacttaaggaatcctgccttcccggagccgcgggcgatgcgactagggctgccgggcgccgccgccgcccgtccggcttcgtccttcccggcagtcgggaactagttctgaccctcgccccccgaccccggatcgaatccccgccctccgcaccctggatatgttttctcccagacctggatatttttttgatatcgtgaaactacgagggaaataatttgggggatttcttcttggctccctgctttccccacagacatgccttccgtttggagggccgcggcaccccgtccgaggcgaaggaacccccccagccgcgagggagagaaatgaagggaatttctgcagcggcatgaaagctctgcagctaggtcctctcatcagccatttgtcctttcaaactgtattgtgatacgggcaggatcagtccacgggagagaagacgagcctcccggctgtttctccgccggtctacttcccatatttcttttctttgccctcctgattcttggctggcccagggatgacttcctcgctgcagcggccctggcgggtgccctggctaccatggaccatcctgctggtcagcactgcggctggtgagtagctccggccggcacgtcccggccactgcccctgcgggtggcgagggagggagcccgcagaggccgaggcctgtgcttgcccttcgccatgcgtccccccgatcgcggtgcagcggagctgcgacccggtgcctgc

SEQ ID NO: 98160 - DNA, 1188 bp, Homo sapiens
tctcagaacataggcttttcaatgttatttgttattcttaacctttttagaatatagattctcatttatgatgacgtgctcataatattgtgatcagaactgataaaagtaagagaaaaagcatttatttaaaaataaacttaatttttgtttggtaatacaatcatcttagaatagtgtctcttaaaagggagagagtaaaagaatcactgcttaaaagtggttgtagtcttttttttctttggtattgcatagcaccagatgacaaaatttgtgaagctggatttcagacctgtaacagtaatgataatagctagtatttattaagtgcctgccatgcaccatcagctattcaaataactttacatatattttttcatttcgtcttcatgacaattctatgttgtaggttattatcattccccttttccatagagggagagtaaagtacagagaatttgaataactcaccacacagtcagtaaattatggagccaggattatagtgtgcgccctcacataccacattaatggtaacagcagcactagcagcaacaacttctcatcttattggatatatgagatggagtaattagccttcaccagatcaacctttgtaaagaagcagggacacttacaaggtgttagtgcagcagtggttatgcaaatgtcgtagttctgaacatgtaaaactttgcttggcctaatattgaagtggctagtgcagcttcattaagtgcaagctgattagagagggcctgtgtggatttgggttacacagatgcagtgatgttaactcgacaggcgcaaatggtgcagctgaacaggaaaataaatcctagaagactgattgatagcacatcctttttcggggtcatggataaatcatttcttttgattccctctttctcacttattgagttcttggactccttaattcttagaacattttctttctttctttctttctttctttcttttttgttcagacagagtatcactctgtcgcccaggctggagtgcagtggcacgaccctggctcaccacaacttccgcctcccaggcgcaagtggttctcctgcctcagcctccagactagctgagattacgggagcccaccaccatgcccagctaatttatttttattttttgtatttttagtggagacggggtttcaccattttggca

SEQ ID NO: 98161 - DNA, 1047 bp, Homo sapiens
ttgaaaagggcaattttttccccattgaattgtcttggcacccttgtcaaaaatcagttcaccatatatataagggtttatctctgaactctcaattccattccattgatgtgcatgtctgtctttatttcagtaccacactgtgctacagtctttatttgttgctttgtattacgttttgaaatcaggaaatgtgaatcctctgactttgttcttctgtttcaagattgttttggctattctgggtcctttgcatttccatataaagcagcagcttgtcaatttctactcgaaaggcagctggtgtttgaaagagattgcattgaatatgtagataaatttggggagtattgacatcttaataaatattaagtcttataatcagtgagcatgggatgtctcttcatttgtttagataagattactttttttcagtgatgttttgccattttcattgtgtaaatcttgcacttcttctgttacatttattcctaataattttgttcttttgatgctattatgaatgggctcattttcttaatttcgcatttggattgctcattgctagtgtacagaaatacaattgatttttatatattgatgtattctgcaatgttgttgaacttttattagctctagtaatttttttgtaggttccttaggatttgcttatatacaagcaaatttggattttgtagattccttaggatttgtttatatgcaaatcctaaggaacctacaaaaaattactagagctaataaaagttcaacaacattgcagaatacaagaccatgccatcttcaaacagagatgacttgacttcttcctttctaatctgtatgtctttttatttcattgttctttttctttcttctttatttttactttttgtctcctttccctggctaggggaatctccagtacaagtttggataggtttggggaagccaacatttttgtctcgttcctgatcttcgaaggaaagtttttagtttttcaccattaagtatgctgttagttgtgggtttttcttttttcttttttct

SEQ ID NO: 98162 - DNA, 1022 bp, Homo sapiens
ccttctaggtttgttttgaagacttggtaattttgaacatggacattttctttgatgatattttttatttggacaccaaaattatttaatagaagcaagagtggtgagaataatttgagtacgaggggattgcttttgggaaatgagaattttaaaatttccttcttgtttggagtttacaaatgaattcatgaacagaagaacgtcattgaatgtaaaattagaaatttatgtaaagatttcagttcaaataatttagtagggaaatttatgaagtcattcggataagacaaagattttatataatattttgaaaacattaaataatttgtcattcctttatttcctttattttagcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggcaagtgatactttccttacctgaaatgactgtgttttatacaattgatatttatctaaaaaggacatgggagtatgttaaaatcctgttcagaaaaacagtgaatttaaaagtgtatatataaagccaggtgtggtggctcatgcctgtaattccagcacttttcgaggctgaggtgggcggatcacttgaggccaggagtttgagaccagcctgggtaataacatggtgaaaccccgtctctactaaaaatacaaaaattagtcgggtatggtggtgtgcgcctgtggtcccagctactcagtaggctgaggcaggagaatcactgaacctggaaggcagaggttgtagtgagctgagatgtcaccagtgcactccagtctgggcaacagagcaagactccatctcaaagaaaaaaaaagtgtgtgtatatctccacaagccccaaatttataaaaggctatttatttttagattatttttaaaacatcttt

SEQ ID NO: 98163 - DNA, 1058 bp, Homo sapiens
gcacatgcctgtaatcccagctactcgggaggctaaggtaggagaatcgcttgaacccgggaggtggagattgcagtgagctgagatcgtgccattgcactctagcctgggcaacaagagtgaaactccgcctcaataaataaataaataattcttagattaatcatgcagttaaaccttttttggtggccttttcccccccatgaaatgtctttggtatcctttaccatttttctgtttcttaaaaatatgtttcctgttgatttgcaaaactgtttcatagcttacacgtactctcacatttattgaaattactgcttagtttgttgtttttctcttagttttctttatcatattgtctccttttttgtattcatattgatttataggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtaagtaaagtaaccaacttttctttgtatttcctttctccaaagatttgcaaaatataaaaaaacttaaaaaacattcaaggttgaagccaggcgtgatggctcatgcctgtaatgccagcactttgggaggccgaggtggatggatcacctgaggtcagagtttgagaccagcctggtgaaatcccgtctctgccaaaagtaaaaaattagccgggcgtagtggtaggcgcctgtaatcccgctactcaggaggctgagacaggagaattgattgaacccgggaggcagaggttgcagtgagccaagattgcaccattgcactccagcctgggcaacaagagtgaacctaaaagaaaaaaaaaattcaaagttgttgggagtgagaggtagagttccagcatcataagattacatctggcaaacacctgaaatccgaaagcgatgcaccaggacttccaaggcatcaatatattactaaataactttggtaaaata

SEQ ID NO: 98164 - DNA, 1057 bp, Homo sapiens
aaaattgtaaatacttatggagctaaaagttaaggaggaggggcactgaatgtttttcccattttttcatgtcttttctaaccttttggcgggggtggaatttaactttagactgttatttctctctcttcttcagtttttcactgtttctttcataattcactcatcgaatgccttgattcaattagccaagtatgggctattttttttgttgttattttttgctttttcttccaagctagatctattcaaaatgattaacaagttaaatttaaaccagtctttcatattcagtattaactacttgtttgaaaaaacaagaaatctgccccctctcaattttttagggcattaaatgtaaacattagtctgattatgattactgccattccaaacatattaattaaaagcaacgtttatttcctataaaaacatttgttcaaaacattgagctccacaataaatcatagtacagaaacaatatcataacaatttggattattttgctaatgaattcacttaactgatcacatcgttttggatttaaatgtttttctctacttgtatgaaagctacattgcttgaaaactacaaaaactaatccccaatttgcctttctacacagtggtaaaagattaaggagctgacataaccactagtgtgttatatttaagcttccctttgctgcttgctgcacatgttacaatgttgttctttctttgacacagacccagacaaaagctgagtgtagcaaggaaacagacagaacgcctccagtagtggcccccgcctggctccaggatttgtaaacagaaacatcccaggctccaatgagacagacagaggttccctgtctgttctgcattcaggaagtgtttgcttgtataagcccaactattgcacaggcatacatagtagtgtttacatttggctgagtatttaactgagaaaacttaatagggaagaaaaagagggtttattagaggtaggagaacaagacaattcaggtataacatagatgtagcatatgttatgtaaaaaggtttttttattttga

SEQ ID NO: 98165 - DNA, 1050 bp, Homo sapiens
actgcgtccggccaatacaagagctttaagaatacatatccataataccattttcacatctgaaaaaataacagtaattcctcagtatcatcaaatgtcaagttggttctaatatactttaggtttgatggactgtttaggaaatcagcgttcattgattcatttgaataacttctatacaatcttctttaaagtttttataatattgcttagggttttaaacttttaaagtaagtcatcatgggagtgtctcccagaatttggctttcatgctattctgcattcatcttaatttataggtattacctagtttagtaaatagctttactcctattgacattaggcataaatcttgctgctaatctttctgcagctcttctttttaagtgtaatattataaaaagtgtaaaaagatattcattttaagaaaaccatatattagtaacctgtttcctgttcttataggagaccgtaaacaaggtcttcacagtatgaacatgatggaggcagcagcatccgaaccctctcttgatctagataatctgaaactgttggaggtaagtttgccgttagattatggactgttgtttctactgtgatactagacctggaacagtgacttcattcaatcattaagacattcattcatttatttaaccctatttactaaattacaattttttgtcaaggcctattctaggcactaggaacataggtgaacaatgtctcctggggcttctatttgaattggggagtctacagacaggtacaggaatgtataatataattgcaagtagtagtaagtgctatgaagaaaagtacagtggataagaaagtgatgaaaagggggttattaaagaaaatatgggccaggcgcagtggctcatgcctgtaatcccagtactttgggaggttgaagctggtggatcacctgagatcaggagttcaagaccagcctgaccaacatgaagaaaccctgtctctgctaaaaatacaaaattagccaggcatggtggttcatgcctgtaatcccagctactcaggaggctg

SEQ ID NO: 98166 - DNA, 1211 bp, Homo sapiens
ttgttgtttcctgcttgtattgctgcctcaaataatattgggttctgttactaggtaggaagagaagaatacattgtggggatcagcctttgctcgtgtttcagagctatgtagttatattccctgttgtaactgtggtcttcctcacctttcatgcatatttttgctagttgttcagagcatctttttttttttttttttttttttttgagacggagtttagctcttgctgctcaggctggagtgcaatggtgcgatctcagctcactgcaacctccgcctcccgggttcaagcaattctcctgcctcagcctcccgagtagctgggattacaggcatgcaccaccacgcccagctaattttgtatttttagtagagatggggtttctccatgttgactcaggctggtcttgaactcctgacctcaggtgatctgcccacctcagcctcccaaagtgctaggattacaggtgtgagccacagcacccagcctggagcatctctttaatacgtttgctttctcactttgtttcaatatacacctcacctcatagataccccaaagttacctttgctataattgtgtctttgtgctttcttctaccctcatcccttgctacatttccttgtcatattatagccctgacattattttttcagtctctctgacatctttagtgaagagaactttaatatatcagttttcttagatctttgtttcattgtatattagcatggatcatcttttctagctgatgcttcatgtataaataatttctcctgaataatttatccgttcatttatcttgacatcttgcttctcctaaatacagaattgtccaaagtattgcctgtgtcagcaacttgatgcacttgctgtagtgctttagcacattaaccattggactgtgtccacttagctcttcaatattatactgcctttaaaaagttggcttagcacagaacttaaaataccatcctaatctcccttttcaagacttgcataatttagcaaggtttcaagtcaaatgtaggctgaaaagaatgattgccatcagatataagttttatttaaacagagctgttactctgaaacattagctaatgttaccactaaataagggtaatacctttttaaaaactaagtacatagatgctgctattgcatataaatatagtagctatttgaatttatgggatttttctttttt

SEQ ID NO: 98167 - DNA, 1127 bp, Homo sapiens
ttttttttagtagagacggggtttcactgtgttagccaggatggtctcgatctcctgaccttgagatccacccgccttggcctcccaaagtgctaggattacaggcatgagccactgcacccggccacccagctgtatttttgtgaattttaaaaaatattaagttgtatacatattgttttgcaattttctcactgtatcttacagattatttatattgatatacataggaaagtctagctcattctttttgattgattaatagtattcactaaaatggatttaccacagtttacttattcaggaagggcattttataggtaaaaaataagttatagaaaggtttaatgacatggttagggtcaaataacattgacatgactaagatttatatataacttctggtctaatgtctgttcttcagaatatgctacgttctctctctaaaaaatatcactctaatttatcaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggtaaaaactactgtcaaaagttgatattttttgaagtgaagcagttatatcttctttctctacctatagtacctaactcaacttttatgtaagaatctttttactttcatttaaacctttagttcattgctatctagtgtttagaaacattattagcagcaggatgcaaattaggaatttttttttttagagtactccaggttttcatctgagtgaaatttaattaattgccagtaatagcttatctaactgtattttgtttggtctctgattgctttagcagtaaacattttccttatgcaccatctgagtgtttgagacaaggtacacttacgatgtttactgagttgaacccagaaggaattagaagcaatgaattatttgtaaacactttttccttttctttttttttcatgctccctttctccctccttccttctttccttctttcttccttccttcctcttctctcaccttatctccttcccttcctcctcttttctcttctt

SEQ ID NO: 98168 - DNA, 1048 bp, Homo sapiens
actgggcatggtggctcacgcctgtaatcccagcactttaggaggccgaggctggtggatcacctgaggtcaggagttcaagaccagcctggccaacatggtgaaaccctatctctactaaaatatgaaaattagctggacgtggtggtgtgcgcctgtaatccaagctactcgggaggctgaggcgagagaatcacttgaacccgggaggcagaggttgcagtgagccgagatcatgccactgcactccagcctgggcaacagagtaagactccgtctaaaaaaaaaaaaagaaaaaaaaatcattaaacctacagcaaggtctctttaggatttccaaatgtgcctgaaggggatgaaaaaataaaaagattgtgacacaattttttttgcttacttggtatcagaaatacccctgttattctatcatttatgatagttagaaattttattctgtcattcttttctacaaatccacaggggaatccgtaccagagtaccagatggcttttcagacagaggttggaaaccatcccacttttgaggatatgcaggttctcgtgtctagggaaaaacagagacccaagttcccagaagcctggaaagaaaatagcctggtaagaaaaaactaagttattaaagagaggacttatgactgaatatgttttaatgttgtttgaaacaaaaatagactgttaataacgttaatagtttttggagttgcctaatgccacaaatcaaacttgatttttatgatgttttcaaatttttcaatatgaaaaaaagtcagttttagttccattttgtttttttccaagcttaaaatactatttagagagaataactaatgtgtcataagtttgccagattaggtaacagctggataaattaacatattaatattttaaatattattgaaattctatcttactctcttgagaatagtaccaaaactgttaagtagtgcaggcttacataaccaatggctaatgaaaatttaggctagacctgaaaaaaaccaaggcgcagcctatgaattctgctaatt

SEQ ID NO: 98169 - DNA, 1029 bp, Homo sapiens
attataggcgtgagccactgcgcccaaccaagtatccttaactgggggtaaaggagaaaagctcacctagagatagaagacagccaaatgtccccaagttccatcaaactcaaaacttatttttgaagcagaattagtggctattgattgacataacgtaactgaattagcaacaatgacctaaacctgtggccttgaagaaacatctacgacttattgttgcttttacttttatgaataattcttcaaggagttaaggtaaatcttgcttgcttacttgttcatcaccttttgagcatgttccgtaatccttgaagcctaaaatatgttattagagctatgtaaaatactggttaaggtaattgatttttcttttacctcatgtggtaaactgaaaagctcaatacatttttttttttaaagacacatggtttgacatgtactttgtcttacaggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacggtaagaccctaaggggtgtggcatctatcaatcagtattagaaactgagacccaacaaagaatagaaaataaatacttttaaaccagcctaatagttcaatgattacctcatacaatctaaagttatcatttttctttcaatattcctattcttctattgaacatttttgtttggtacaagtgcaagatgaaatctgcattttttaatatgtaaaggtatagtgaaagaagttagtctttctctatttatggtccaactttcctgcaataataaaggtaaaatgtttttataactccaaaagttcataagcacttctatataaattgtctcatttatcctttgttgttattccttcttcctctgcttttttttttaagtaaatggaactatgaacttgcct

SEQ ID NO: 98170 - DNA, 1901 bp, Homo sapiens
tcaaggacttttactgatatgactcagactaccccagaaagatatgtgccattactagggcatgcctcttaatggaggcctttggaacaacctaaaagcttatattctttttactatttggccattggaacttaattgataacataccttttgagtaggcactatgcatctagaattatggaaatacagaaaacatataccatggttcttcctctcataaaacataacgtctggttgtatgaatatacattccataaatatatatttcatgatgttataaaactataggggagattttttaattaacttataaaccaaaataatgaacatttataaaaattatatctcatccacatacatttttcagtaggcttaattcacataaaactaacacttatcaagttattaattgacacttgattatttgattagactttttaacctttagaaaaatgtacgtttggaagaaaatgaaaaacaactcagactttaaaatcagaggtgttaaatttggagagacagtttgtcataaatgtacgttctcaatgtgatactttttttctttctttaagcaacctgtcacataataggcgtgtgccaaaaattggtccttatccagattattcttcctcctcatacattgaagactctatccatcatactgacagcatcgtgaagaatatttcctctgagcattctatgtccagcacacctttgactataggggaaaaaaaccgaaattcaattaactatgaacgacagcaagcacaagctcgaatccccagccctgaaacaagtgtcaccagcctctccaccaacacaacaaccacaaacaccacaggactcacgccaagtactggcatgactactatatctgagatgccatacccagatgaaacaaatctgcataccacaaatgttgcacagtcaattgggccaacccctgtctgcttacagctgacagaagaagacttggaaaccaacaagctagacccaaaagaagttgataagaacctcaaggaaagctctgatgagaatctcatggagcactctcttaaacagttcagtggcccagacccactgagcagtactagttctagcttgctttacccactcataaaacttgcagtagaagcaactggacagcaggacttcacacagactgcaaatggccaagcatgtttgattcctgatgttctgcctactcagatctatcctctccccaagcagcagaaccttcccaagagacctactagtttgcctttgaacaccaaaaattcaacaaaagagccccggctaaaatttggcagcaagcacaaatcaaacttgaaacaagtcgaaactggagttgccaagatgaatacaatcaatgcagcagaacctcatgtggtgacagtcaccatgaatggtgtggcaggtagaaaccacagtgttaactcccatgctgccacaacccaatatgccaatgggacagtactatctggccaaacaaccaacatagtgacacatagggcccaagaaatgttgcagaatcagtttattggtgaggacacccggctgaatattaattccagtcctgatgagcatgagcctttactgagacgagagcaacaagctggccatgatgaaggtgttctggatcgtcttgtggacaggagggaacggccactagaaggtggccgaactaattccaataacaacaacagcaatccatgttcagaacaagatgttcttgcacagggtgttccaagcacagcagcagatcctgggccatcaaagcccagaagagcacagaggcctaattctctggatctttcagccacaaatgtcctggatggcagcagtatacagagtaagtggagggatcatataatctctcctgtgtgtcttttggggccatt

SEQ ID NO: 98171 - DNA, 3163 bp, Homo sapiens
cagaggttgcagtgagtcaagatcatgccactgcactccagcctgggctacagagtgagactccatcccccaaaaaaaaaaaaaaaatttgatccaccttgagcattaaatacaattaaatacaataattaagtacattttaccaagttaagatcgctaccaaaaccagaagatttgagaatacagctgagaagtttaaatgttctcctgtgttttgtgtgtgtgtgttttcccttgccttataaaataagtcaatcagttattaaaacatttgggttaaagagtctcaaaaataagttggttaagcttttcctggaaaaacattgtctggcattatgaatttcaagaaatgttcattagcaccctcctgagacattggtttgaccttttcttgagttacatcccttacccgttatttcttaagtttgttaaatagctcatttttctgcacttttattttcagtaggtgagtcaacacaagatggcaaatcaggatcaggtgaaaagatcaagaaacgtgtgaaaactccctattctcttaagcggtggcgcccctccacctgggtcatctccactgaatcgctggactgtgaagtcaacaataatggcagtaacagggcagttcattccaaatccagcactgctgtttaccttgcagaaggaggcactgctacaaccatggtgtctaaagatataggaatgaactgtctgtgaaatgttttcaagcctatggagtgaaattattttttgcatcatttaaacatgcagaagatgtttaaaaataaaaaaaaaactgctttatcctcctgtcagcaccccctcccacccctgcaacaaagacttgctttaaatagatttcagctatgcagaaaaatttagcttatgcttccatatttttaaattttgttttttaagttttgcacttttgtttagtctcgctaaagttatatttgtctgttatgaccacagagttatatgtgtgtgtatcaaaagtggtctcaaaatatttttttaagaaaaaaagcaaaaacaatgtattgctgataatcagtttggaccagtttcttaaggtcattaaaacagaagcaaattaagacaggtttgactgcagtggtgtctggtatccatgttttatttctgggcacaagctagtttttatgttgatacgttcctgaacatattatcttgttggacatcttttctcttgtgttttgtttgaatgtgcaatagtttataggccacaaataagctttcttgtaagctctcttcctaacagggcacatattcttccataatataaacacttttctgccccatctcccatacttttgaaggtcagttctatgacagtgaattttgcacaggagaagcagctacctgatttcttactttctctctccttatcatggagaatacagaaacattgtctgaaagggctctaaagaaggaactaccaaaacctgacttgaaatgccatttcttttaaccttccaaatcctaaatgtttccttcaaggcatcttaataaacttatttgcttctggttttgggagttcataagagagaatagaacaaaatacaggacatcaaatattagccatttcccattttattttatttttctatgtaggttcatgttccatgttcatttatttaagaaatacatttttattggtaagcttatagagctacacttatggaatttttaagtaggtaaataaatggttaagacaaaatagtgttatagccttcattctctgaataggccatctttgactcataaaattacccttactgtttattataacttcagaagtaatttatagttctgaacctatagtatcttttaccctgttcccaagcaaagactggtgactttatctgaaaatgattcctcttcccatgacctaaaacactgtgaggaaaaatcattcaagtggcatgccaagtccctatgaaggaagggctgctatcaaacctaccttttttgagcaaactgagactaaacttctctcttttcaaaattgtgttatcttccttaatcctattttcataatttttccttttgccagtttttcacattatctttgatatgtgagcaacatttattatttacattagagtataccttttagtaataaaatgacttgaaatcatattatttttaaaagccctttgcttctttcattacttataatctcctctaaaacaacctctgcatgttttttttaaataaagcactttctgtcaaataatggacttttttctaaacagaaattattttctattaatttgcaaactgatgatttcacttttttttacttttttttcgattatcagagtacttagtaaatgttatatagtttagttctaagatagttccagggattaaaaggttaagaggaaaacacaaatcaccaaatttctgatttatgtttttatctcctgaacaatattttctcactcatattcctctatcttatcacttagctaaagacagcctaaatttcccaattttctgtccaaaatatttgtgatttacttgtatataagccttctcatttgccatgtgctgtgatcttacaagttagatgttactatacctaccatttattcagctggattgctgaacacagttctggattcatagaattaagaatatcttgttagtgcccaggatttccacgttttgtgttttattggcccttttctttattcagccccttaatctattttcagtcttctggcacgtaatttttttcacagttattattcttctattaacaaattatttttatctttcctagtacattttcacttagttctcttgcccttaaatatctttcacatgcattttaggatattcttttcaaatatttgtaggacaactttgaatcaaaataaattatgttccttctccaatttgaagcattgaggataaatgaccatttgaggtctaactgatcttttcctgccagaagagttatcttacgttctgctatatttgtatttgggccagttgattgtaggttgtccaacattttttaatattgggaaaattatgataaaatgctttaaaaattaatatgccagattaaaataactgaatagtttactatttcattcaagcatgtttaaaacaaataatttcctttcaccagttt

SEQ ID NO: 98172 - DNA, 2679 bp, Homo sapiens
ggaaagtatatatcatttttataaattttaaattgtacatcagacttttaaaatctgtaatatacaagcaagcaaaattattttaaatgacttaattgtatgctaatactcatctgataataaatgcttcttaaagttgacatttaactgctatcacaaagttttatatgtagaaaagtggggtccttttgaataaaagatcattcaactaaaaatattaaaatttatttcactggatggtaatgtaaccttaaaagcatcataataggtaaagtctaatattagttcccttaacaaaatcctaactgtataccagaattaggtcactgaaagaacttgatttgaattacgtttagacaaaaatgatttaattgtaaattcttaaaactttctaaatgcataattggcaaaaaaaaaaacccactgttaccagtgtaggaagttacaagaaggcacatactgaatgctgaagtatacatatgctatttctcttaaacctcagagcaaccatatgagcattgtaattaatattcccattttacagatgaggaaactgaagctaagagaagctaagtaatatgcccaaggtccacatctagtaacagacaaagctgggatttcagtctatgtctgcctctctccacatctctttcatccataccacactgcctacatgccatatgacaggatgtgtaatgggctaacgtttatttaaaaagttcaggccaggtgcagtggcttatgcctataatccccgcactttgggaggccgagccgggtggatcatgaggtcagacgttcaacaccagcctggccaagatggtgaaaccccgtctctattaaaaatattttttaaaaattaactgagcgtggtggtgggcgcctgtagtcccagctactcaggaggctaaggcaggagaatctcttgaacccgagaggtggaggttgcagtgagctgagatcgcgccactgcactgcagcctaggcgacagagcaagactgcctcaaaaaaaaaacataaaaattcagtcactatactctggcacaattttcatttgtatatgagccaaaccacataccttaatgatttgggaagttaggcaaatatgagatatgtagacatatctatgctgattgttgcttgagaaataattactaattctagacaaaactcaatcctgtatcttccatcatgaatcttaaaatcatttcacttcactcctaacatttcttacattgcagaactaatggtaaagtaaattttacggaaaaagttaagatagctttgggaacagagacctttccctaaattgattccatagcagatttgggggaattaacaaagaatttcagtctcatcaatcctttgaatccatcttcaaaacttctgcttttaataactttagaaaatttactaatctatagaactaattgagtaggatataggaaggatacaaggatataatgtcctttttataaaagtttagtatagcttctttacatgtatccacttgttccagaaaatgtgcattggttctgaatgtgaaaatatttaaagagagaaaggaacactcaagtaagtgtgggcttcagtgggaattatcacaaaacattggcaagtatttttatttaaattattttcaaatttgacttctacagccaagtggaattggtaggctgtagctgttacactgaaatttctagtctttgtaagtgcctcctgaaagtcatttaaaatggaaaaatatttcaatgagcttttccttttttcatatttatggacatgaatattttattggagatcattaactcctagaatttgagattatatttccatacaacattttataaagttatgttgaacttactacctgttatgtgcaggttattatgtaactattcacagattgcttcatatattgctttatcttcccatctaacttcttaaagttaaaatccggacacacatgttgattatctagaccagtcattctggaaattgtaacactcccacataaaccccaggagactttttcagaatgcaatgtttctaaatgtactgttactggcagtttactctccagcatataaggttgcattttaacttttagattatgaactgtgcaaactttacccaaaactatcttgcatgattccctcctaaatatattccttgattaagtaaatctggcaaatcactgtttgagctagttacataaaatttgttatcaagagaaggcttttctacaagtttccagattaacataaagaaaagagggaatcacagggcatttaagtgcaccttcccattactttccttaaatcacctcatagttaggctgggcgcggtggctcacgcctgtaatcccagcactttgggaggccgagacggtggatcacgaggtcaggggactgagatcatcctggctaacacgatgaaacctcatctctactaaaaatacaaataattagccaggcatggtggcacgcgcctgtagtcccagctactcgggaggcagagacaggagaatcgtttgcacccgggaggcggaggttgttgcagtgagccgagatcgcgccaatgcactccagcctgggctacagagtgagactccatctcaaaaaaaaacaaaaaaaatcacctcatagtttatgtctgacttactccaaacctcagtt

SEQ ID NO: 98173 - DNA, 2434 bp, Homo sapiens
acagaattgtatatcattttgccattaaaattttttaacatattgcagcaagcttagttttatgattgagccacaaccttttacatattttttgtatgaaatattaaacactaaatgcaagattaactttcaaaagcaaaccctacattaatcaggtattatctatggacatttttgtagaccacttttgaaatacttattattttgcaacatagactggactatacaactttcatttaacttttaggtgactgatttaagttgagtgtgcatatagagaaaaacctagaaatttatctcatggcagatacatttgaaagtacttcagaagaatttatgctgtatattaaaactaggctcaaaataaatctatcgtatctttaaaagtccaattctgttattactgtgatgtttgtagtgttactattaaacattgtgaacatacacatttttaaaacaacttgaaacccattttaaaatctgggtaagagagaaggaatcttcagaacaaaatcacatcattagggtgtccagtttatgattgaatttttaagcaaattactgtatttgaaactacaacttgatttggttttcagttttaaaaggcaacatgtgggttttatccattttatttatacctttagatttcagaaacatcttcatgttttagatgcattctacagacatcatgttacttaaaaactcagggcccctttcatccctttgtacactgaaaaagttcaattgttagcaagtaagcaattagatccagttgaatatttaaagtgtttgttgcacagttcatttaatgtttcatcttatttgactttttcacatagatataatatcagatttcattaattataaaaagttgcccagttctgtaattactgaacagagggaatgactcaactaattggctacatgttgcaacaaatttaggcctttagagttgaagcactgacttaaaacgacttacatttctgttctttggtcaaatgaccatacatgatatgggacaaattgtttcattttgtttgttttttaataagggaacttggtaaagtagttcctgtcagataggattttctcaagagacaatttaacgttataaagccttctaaaagtgaactaaatattttataactttagtaatagcttggatggttttgagaaaataacctgtatttatcacattgtcaaacagaatttttctttgaatcagacaagttcaagctctaaattgatgtgctatatacttaaaatcctaggaagttatctgtaaccagtctcttgtctcaggctcttcaccttgttaccaatcctcgtaagtatgtaaaggaaacatatttttaaagaagcttaacagtaagaaaaaattactaaaagatgcaattcaaagataggtcccagtttaacactgaattgcttgacttctgtggcttttctttttctggccacatttatttatttaagcaatttttgtatgccttgttatttcatttccatagagattatattgtatcagtgtttatgtaagctggaatcatcctcagttttttgctgataatttttcaaataaagatacatggataattgtaaaatacactaactcttagggtgttgtagtagctgaaacatggagatgcgtagctgtcatgctttttctgaatggacaggagaaacataagctacggagtattcacttctgaggatgcttttccggaaaaagaaaggctagaaaatactcgcacttcctcagaaccctctttcttgttaacgggtatcttttgttggtgtgttttgctcttacattacagatagactatcatatatgactttatgaataatttcagttattttgcttttgtataagctgtctgaagccttgctatgctgtataagttgtgtttgatggatcagtgtgagtataaaataaagcaaatcacttttcttttgtattatctatggatgccactatgaaagctgacattaagccactaaagagttttctatgaataagtgtaagtaaatgctttgatatatataaacctaaataaaaagattgtattgatacagagacattggagaaggagattttaaggcagttctttaggtttaaaaaggcttgctgtaaaatggtgcgttattccgtttattaaagatcatattaatgacaatagtaattgtgtttttttattttaagaggtcaccagaaattgttagtatgataattagggagtttgcactagaatagtaaatgttctatctaatatgactttcataactcagtatgatacatcaaaaaataaaaaataaaaaaaaataaataggccgggcgtggtggctcacgcctgtaatcccagcactttgggaggccgaggtgggtggatcacgaggtcaggagatcgagaccatcctggctagcacggtg

SEQ ID NO: 98174 - DNA, 1045 bp, Homo sapiens
tctaagcagagttacagtatccacaaagccctagaaagcttgagagggtagagttttttcagggggatgagaggacattcaatgagagtaggatatgagatgttatatggaaggatggagagagatgactacacacacagctattacagagggttagcatgctgttcttagagtttgaacttaacctagaagtcatggaagaatttaaacaatggggtttcaaaataggtaactcagttggtagtatataggatgaattgagaggaagggagaaacatagaaatacatatacctggccgggcctggtggctcacacctgtaatcctagcactttgggaggccaaggcaggaagattgcttaaggccaagagttcaacaccaacctggccaacaaagcaagaccctgtctctattaaaaaataaataaaaaagaaagaaatacatagaacggtatggtgctggtgagagataatgaaagccttaaaccaaggtagagtcagtgatggcagagaagagggagcagattgggtctgggttaaagagaatcagtaggacccagtgaaccattaagatgagcattggagagagaaagactgttaacttcagggttctaatttggaaagggaggttaatgaaaaatctcagggaatgtgcagctgacaaagggtcctgcctttataagttttaaaaatagaaaaatttttatatattgtcttgttattatatcatgtgttcaaatttttggttccgaaaatataggtagacaactttcacctatggtctctgcagaaatgcttcaagaattgagccttccctgggtaagtcactcagaaattcagttcaatctttttaaatgaatgtgttatgagaccaacttgttgcacacagcatttgtactaggaaattttgatgaagtggccctgtgcctgtactgtaaaatgagcatggaagctgggtgcggtggctcacgcctgtaatcccagcactttgggaggccgaggtgggcggatcacctgaggttgggagtttgcgaccagactgacca

SEQ ID NO: 98175 - DNA, 1044 bp, Homo sapiens
ccgaagctcgccggagaagaggagccccagcgccccggtttgcaaagcaggtaagtgctgggggtcgcgcagcaagggggaggcggctgcgggaaggggtcccgggcgcgcgctgcaatcgcgcggggactgcagagctgccgcggagcccgggtggctgggggcggggctgggggcggtgccgggcggtgggggacccggcagtgcggccccgcctttcccgggcctaccctacgccccgcccgcccgcccgcctcattcacccctctgcccgccccgcacggctccctggtggtggaggtgcagcggctaaaccttgggcttgagctgatgagtgttaatgataaacctggcttcctggccttactcctggaggagtcgttactgcttaccctcccttgagggtgaggctaggagtggtttgtcactttgttttagggacaaggttaatgttggcatagcccatatctgctgctgctaagtatttctgttcacaaaacagtttcagatctggggtactgaatgcattagcagtggcagatttggatcactgaacagaggaggctgagaaccgtgttttagcatttcctaagacttgataaatgggtagcaagaagtgaaaattaaacaagattccttaggaaggtttatgggttttgtctgaggctctgggtgtatttctgattttgtgtactgattctgtgttttgaatgtagaaaaacagaatccagtgttttgtctccatcttgttattgttttagggagctaacattcgttgtttttctgtttacctggaagctttcttggggaaggtcctgaatggagctgttgggtgccaatggagtcattcataaagagtaactcaaaagagaaattcaaattgtgggaagtggaaaggaataaaatttataatcttgttgccttaaggaaagaaatgggtggtttttacttacgtattcatttttgtcaacatatatctttgtctttccttgtctggggaacttctgttagaattttccaggcagaatggttgggaatttcagg

SEQ ID NO: 98176 - DNA, 1041 bp, Homo sapiens
ttttatctgactaaatctggaaggaaagtctttgtaaacgtcagagtccctttttcattaaagggaggctaccaccagtttgcagctgtgatgaatgtaaaaatccctaccgtaaagggtaagggtctaccccatataattctataaacctcataggactcaaatttcagggtccatctagatcaggctgttgacttctaggtgtcttatcagatgaactggatgctgtaacctttgttagggatccggtatctcagagtccctaagttgaaggtatcaagatccctatccagttgctttattcttctagggttagagctaattggctggtgtagaacttcctactcttgactactataaagtaatccaagcacccatccctgacagatattttaaacttcccaccttcagtgactgtcatctccatagcaaagccgtttgtcattaggaactgaggtatgtttagaaaaggtacctaggcaacagtgttaaccagaaagtttatttttgtgccttctctccttttacccaacttcattttacttattaaaatgtcaaatagattacaaatggagagatggtataacatcgaggtgaggaggatatactttgggtagacagtttgagtttaatacctgtgttctgccaactagaagccatgtgatatggaaagttatttttcttatctgtgaaatgggtggtgaaatctacttcatatgatagtagggattaaataagggaaaactgaaaaacagcacagtacctcagtataaaagttagctgttgtgtatcatattagttttgcttctagttttagtgtatttaacataaattaccagtgtaggttcagttttcatggttgtatgaagtttcaaattggtgataacattgcctgtgaacatccagaatggtgtttctcaaagtgtagtctgtggttcatctgtatcagaattacttagggtgtgtggtataataaaaaaaatttggtcgggcacggtggcttatacctgtaatcccagcattttgggaggccaaggtggg

SEQ ID NO: 98177 - DNA, 1051 bp, Homo sapiens
gtggacttaaagctttttcagtatttattcttttcccaagataggtttttatattatttgattaggaagcttgagtatttgggggattctttgtgtgtttttctgagactttttacaagttattacagtattttgtttgtatttcacgatatgcagaagatgatttttactaggaaattaatctcttaacattgaagggacagtattgctgttaggatagtggtgtagtctacagctactagttaacaaaagatagtttttcttgggcttacagttagaaaagaattctcacatacttttctgcatgtttttttcccctggaaattcaggggagattattcattaggaagaataaatactgccaggtttcttagagctagagtctttcacatttcaaaggtttccccaaatgacaaaaccgtcagatgtttaaatgaaattgtctcattagaaaatatagccaacacatttcagaattatttgattgagtgttagagtctgatgttagtaacaagagtgggagatgccagcatcttcacagtcacataaactaattttgaggtaagaattttatttttttattattttttacagtagttatgttttttttattatactttaagttttagggtacatgtgcacaacgtgcaggtttgttacatatatatacatgtgtcatgttggtgtgctgcacccattaactcatcatttaacattagatatatctcctaatgctatccctacccccgaggtaagaattttaaaagtgtgtgggtgttttgtggctgttactatagcctcaagcaagaaagcccttccataggattttcttatttcttcatctgggctgaagacgcttactagcctaggagggtttgagagccaagagacagtgaggtagaaaaagaaacttacttttctctgaggaatggaaggtgcattgtaatttgaaaatgaaaattactgccctacactaaaatcttgggatgtcagtccaaaacagagcatgaatgttatttaatttttaaaagttttttgccgtttcaaaatt

SEQ ID NO: 98178 - DNA, 1285 bp, Homo sapiens
tgagccgagatcacatcactgtgctccaacctgggtgacagagtgagattcgtctcaaaaaaaaaaaaaaaaaaagaggcttaattgactaacagttctgcaggctgtacaggaagcatgacgctggcatttacttggtgtccggggaggcctcaggaaacttaaatcatggtggaaggcaaagggggaaagacacaggtcacatggccaagcaggagcaagagagagaagtgggaggcgctacacacctttaaacaaccagatttcgtaagaactcacagtactaagagggactgtgctaaaccattcatgagagatccacccccatgatttgggtgagacatccaaactgtatcattgtggcactaggagagtttaaagttatattctgaaatctgagctctgttacagtcgtaaaagaatttctgaggttgacattcttttactatatttatttatccctgttccctttgcagtcgttcacagatgtgaataaatgttcaaaatcctaccttcattgtgtgggatttgggttttaaattatatttcatacatgctaaggagcaggtttggtcactcacactttttgtgaggcctgtaaactttgatttatttttgagttacttatgtctgttggaattacgcttcagcctagaaaattaaaaggtaatgttaagcctctcttctccatcccattttcttaaggctcctgttccaaagagtgcacttattcctgtaattcccatcaccaaatcaacaggctcccggttccggaatagcgtggaaggattgaatcaggagattgaaataataattaaagagactggggaaaaggaagagcaacttatagtaagtgatcttgtatcttaaaatcattcttgaactcttataattattaaaaatgcacagtttgggtttccatatttacttgggtttcttccttctcattgagagagcaaaaatttatctcttttgaaaaatctttgacctgggtgagtgaatgaaaagttttcattttgttgcatgtcatagaggcaactgatctgacttgaatttggattactgaacagaaactattttttgtttgtctgtatttagaaaccattaggtgatatacttcttatttgctgtaactccagttaacaaaagtttagcttactaattatggggggcagaagtttacatgacattgaataccttctaagcatgaatctgtctgctccttttttgaatgtcagtgactatttggttttggttgacatgctaggctatgtcatcataaagt

SEQ ID NO: 98179 - DNA, 1955 bp, Homo sapiens
gtatatctttaatttccttgctgtctccttccagtatactatagacctcggaaaaatcatggcagtggaatataccatacataaaggcatacatgtctttaaacatctagattttcttttgctataggaaattcattattcccttgaccgtcttagctcatcattgacatgcagtgctcatcgggctgagccacctgcatggtaatggggctgtcaagggaactgaaagcagcaatgatgatgggggcttcttgcattctaagatacatatgttgaatcatatgtcagatagcactttggtcctttatgtttgaaggtgggggacagagcttgagttttatattccttttctgtgatgtaagttaactgtttttaaaaaataaaagagcttgtttccaagcttttttttttttttattttttaagttcagtgacttaaaagcattgggttgtctgttctatgtctaggccaaaacagcttcatgaaatcccagccttttattgtcctgacaaaaacaaggtgaatttcattcctaaaagtggatctgctttctgcctcgtcagcatcctcaagccactccttcctaccccggatcttacactcaagggctctggccacagcctgacagtcaccactggcatgacaaccactctgctgcagcctattgctgtggcctccctgtctacaaacacagagcaagaccgagtctctcgaggaacaagtacagtcatgccatcagcttctctactcccaccaccagaaccaattgaggaagctgaaggataggtcacagtgcaacgtggctgttgttctgggaaattgggaacctcctcagatcactggattctgatggcatcgtgcgcttctggtcggctgtgatgtgctccagctttccagtgacatgtgacggcgaggcttctggaagaaaggatcccccgtgacggctctgccccacttgtgaacgccaaccctcagtgcttagcctgctttttatcaaagcactgattgaaacaagaaaggtctcattctttacctttggagagacaatatcacgtttttgttttcgaattagacttctttaaaacacacacacacacacacacacacacacacacacacacacacacacccctgatccttgccaacatgattcctaaagggagatgtgactgatgctgcaagaaccatcttttctatgaaaatgactattttataatataccaatgttacattttctgaaacgtagcaaacaggatattcaaaagattctttggtggcctctgtttcttgttccctttctagatgtgtgcttttctcagctgttttcagctttgggaccaaagggattgttgacgttttcccagcaatcttaatctcatgactatgttcttctcccaaacaaggattgataggtaaatgcattgaacaagtatatataaaaagagattaaaaagcaatattcgtacattatgtgatttatgtttttgatgtcaaaagtttgtgctttgggtgaaatatttgtataactgctgttttcttcactactcctgtacacatttcaccatgtggtcagaaaagttgtagtctgaagacaagtgctttaatatgttctcacccatattggaacttgatttaaaagtcagtgagccaaaaggaagctatccagcgttgattgctagctaagagtaaggagcccctttggttttctgtgatatatatatatatcacacgctctccctcctttaccacaggtgtcattctacctttaatcatcactgtatcatagccccaaagagatcctgaaatggctgtgcatggatttcctcctttgcccttgtgatgttgttgtcttgtggatttggttgggctagtagtttgccaggagtgtaatccagtggatagtgatccaaactgtagccgcagaatcctgtgactgacatttttctttgtggtgg

SEQ ID NO: 98180 - DNA, 2067 bp, Homo sapiens
ttatggcttctcagtcatgaaaagctcagttatttggggtctacattttctcactgagagccttgatattttgccttctttgttatgcattataacttgactgtatcaccactgagtatctgctgtatcagaagttcagaagaaaaggtaaaactgaaatcagaatgggggtagaggaagttaaaaacaagttatttaaaaagaactcttggtttttggatgacttgaattctgttaaatctgtgttcttggccttgcacttccgttcctcttccatctctatccctgctagtcacaatggcattttagaactagaatgccactctgtagaggttttcccttttgctctgttgtgcctatttgtctaattcatatctttctgtggagtttcatatgtccttaatctaaagtaacttaaaattggaatggaagaacaagtttcagaattatttacagtcttatacatagaacttctagtgtaatgtttggttgtaaggagaatgtgaatttgcaggtaaatgaattgtatggcaaccagacagatccctggggtttgggagaaatagagcttgagatttgaaaaaaaggtacaaggtacaaaacaactctaactgccagtgccaaagggctaatttttaagcatgtaagctttaccacagtcttgaaaaaaatattaaccataggttcattcagctgttttatttaacccttagttccctggtggttgattttttttttaaatgggtctccagctttccagtgaaatgtgacactctcaatagaatgcataatgttggtttctaaagttacactccataattattgttattctgtagaaaactgtacagaaggtaaatagaatagcttcaatgggaatataatttaaatttttttaattttataaaaatttatttccattgcattaaaagaaatgggtagcatgtgtctttcagagaaaggagctatttggttattcactttgtcaatcttaggtttttttaaatctttaaacaatttcttctttgtgatgataaaaataatataaatttactgtttctgatcatgactgagtctattacttgtcatggcttttgtacgcaactgtgttttaaaaataccggttttgcctctttggttacatgtggtgagcatggatgtcaagattatttttcaactagattattcaatttgttttatatttcttatacttaatacttatgactacagtccaaatcagtcttttagaaggtgctcttgctaactgtggaatatttgacgacatgaaagtcctttttctttgctttcagtggttggctttcactgaaagaaagtgtaaaaaaagtcagaatttatagctttcactatgtccaagactaggactgggttataaagattttcttttgtgaaggaaaataaaagaaaatttgccactactgcatttactttactattgtaaacttaagattcattccttagtctttggaattttgatgtctcaaaaccagatgagtggaagtgctgaatttgcaaaataaagctaagaatgcttaactctgcactttaagttctactctgaccaaattgaagatgagcagagcagccctgaacagcattttgtttatacagtcttgtttaagaatagaatttttttaactcttcattttttgtctctgtggaagctgtgtaactctttttaaaatgcaatttaaaacattttgttattctaacaattctctcaaaaaacagcatttccaatggtaatcggtattgttacgctgtacttatgtattccctgtacctgaacacttgttgctgcctcacaagaaaatagaacttttatgttaaaaataaagtctgttcttcttgagtttttttctgtgaatttttatgaatattgtccaaattcaagttacatttctttttggactggttatttatctagcttttaagcggtacattgtttttctcagactaatagaaaaatttgtttgtgttcagcagcaagttccttgctacccctcacctgccctagaactgaaagtacctgctctttggggtaagtgctag

SEQ ID NO: 98181 - DNA, 1013 bp, Homo sapiens
gagtaaaaataaaagtgtgacaaacttttgtacttcaactacagtctccaagcaaccaagaatgtataatgaaacatatatttaccaaaaaacatctgaaattttattatcttaattattctgtggcagtttcatatttcatacaccaagaaaaggaaagggatacgttttcatacttttctaaacttttccatttgctttaaggtgtctgggtccagctcttgggatacatctttcatccacagtagagctcctctgtattctgtgcgtgcctgctccatccgattaattgtcatcaaggtatcagatactgccctttgactgaatgttgctacttcttgcttcagacgagacagaggagtacacagggccaatctaatggcagagaggtaaaaatcagagggttgaacacatcataagtaaaacaaaacaaaggtttaaaccaatgaaaaagcatatttgctaacaagatgaatctacaagtaaaaaattattcagttcctaaggagattttgaaagcaaataaggatcatatagccaactctgaattatcaataaagatgtgttggccgggcgcggtggctgacgcttgtaatcctagcactttgggaggccaaggtgggcagatcgcctgaggtcaggagtttgagaccagcctggccaacacggcgaaaccctgtctctactaaaaatgcaaaaaattagccaggtgtgatggtgggtgcctgtaatcccagctactcgggaggctgaggcaggagaatcgcttgaacccgggaggtggaggttgcagcaagccgagatggcgccactgcactccagcctgggcgacagagcgaaactccatctcaaaaaaaaaaaaaaagtgtctacacctcctcccttgttactttaggaaatatgtcatttttgcaatactttggaagttattccatgtataaataacctgccaagtaaatctgccatttagaaaacagttctgaggggaacagagaacctgcattcataaagca

SEQ ID NO: 98182 - DNA, 1049 bp, Homo sapiens
ccaactacacaggaggctgaggcaggagaatcgctcgaacccaggaggcggaggttgcagtgagccgagattgcatcagtgcactccagcctgggcaacagaccaagactccatctcaaaaagaaaaagaaattcatgttaatatgttgttttgttgcatatagatagctagacaaacagtatataaggccatagtttgggggttaaagtagtcaaggaagtgtgaaaatgggcctaattataaataaattcttaaaatgaaataacatttttttctgaatatatttgttataataaatgtctgtggtctaccaatgatacaggaaaaagaggagagatgatcaaataaacagaattttaagattaagtggttattggggcaaggttggtaaaccctgtaaagttttcagataagtataagtgattattcaaatgtttgttttaacactgtgaatgcatataatatgttaatattttcatcttttagttgtaaggctcctctctatgatctggctgctcatgaagacaaagttctgagtgtagactggacagacacaggggtaagaatttattagttatttgatgaagaggaaagtgactagaataaatctggtgtttgtgtttataaaatgtattagtttcgggccgggtgcagtggctcacgcctgtaatcgcagcactttgggaggccaaggtgggcagatcacgaggtcaggagatcgaggccatcctgactaacaaggtggaaccccgtctctactaaaaacacaaaaaattagccgggcatggtggcgggcgcctgtagttccagctacttgggaggctgaagcaggagaatggcgtgatccaaggaggcggagcttgcagtgagctgagatcgagccactgcactccagcctgggagatagactccatctcaagaaaaaaaaaacatttattagtttcaatatatttgatatttataattctgtattatttcacttaatattatttataaaatgtcacctctcattcaaagaagaaacaaatttgtcctttaataggccagg

SEQ ID NO: 98183 - DNA, 1031 bp, Homo sapiens
agtaatatttggggtcaaattcaagtctgccacttataagctctatgaccttgggcaagttatctttatcagcctcagtgtcttgtataaaataaaaacagaaatatccattccattgtaaaggaagaaataagtcaggatatgaaagatgggcagtttgtctctgtcatgtgggctttgtaagtaataagtactattattgtttcaattattctgtaatgaaaacactttccccttttggggttcttcctttctagactcccatagtgaccctctctggccacatggaggcagtttcctcagttctgtggtcagatgctgaagaaatctgcagtgcatcttgggaccatacaattagagtgtgggatgttgagtctggcagtcttaagtcaactttggtaagacaaattcagtgttcttttaagtgataaacttctagagatggtttttagtctaccatggttaatgttctttccttttctttttcagacaggaaataaagtgtttaattgtatttcctattctccactttgtaaacgtttagcatctggaagcacagataggcatatcagactgtgggatccccgaactaaaggtgagtcatgtaaaccactgggggaatatatgtgtgaataacatctatttctcatctctctggagatgtacaaaaaaaggaatttctggccaggcgtggtggctcatgcctgtaatcccagcactttgagaggccgaggcgggcagatcatgaggtcaggagttggagatcagcctggccaacatagagaaaccctgcctttactaaaaatacaaaaatcagctgggtgtggtggcgcgtgcctgtaatcccagctactcaggaggctgaggcaggagaatcacttgaatcccagaggcagaggttgcagtgagccaagattgcactactgcactccagcctggtgacagagcaagactccatctcaaaaaaaaaatttctacaaatattttttgggttccttctacctacttcccttttctaaaattcaacgctt

SEQ ID NO: 98184 - DNA, 2025 bp, Homo sapiens
ttcatttatataaccttcttacctcatagtaattgacatatttccagtctatatcagctactcttaagtgctgtcatcaactgaaaacgcctagttgatagtctgagcattagcatacactaaagttagtgctaatagagttttactatagtatcaatctactctttatcatgacaaaatggtaaaagttagttaaaaggtaacaaacctgagggcaataccatattgatttattaatatgaagggttataaatccacttagaatttgaaagtttcctaagccacattgaagtattctggacttaagagtgtttctttgacagttagggtaacaggatgcttgtattcaaaggtgaagatttatgatttttcatattgagccgaaaagttttatatgttgtttagtccaaactttagtggattaactgtacctcttctttttggttaaggagagatagaaactcaacttgaacttatttaaccttaaaagtaaatggattgtgagatccaaggaaagattgaacaaccacatcacaagaagggtaatggtgcatttgggcctcaggaaccagtggaatagaggcttgaatgtggtccgcacaccctctcgctgtcttgtccctcaagttgactttattctctctcacttcagattggctttcttcaaaagacatggcaataagcttggccttcaagatttcccagattttatgttctgtcctatctgcccctggaaaaaggctaatttcagttctgtggaacacaagttctttgaaaaggtcctgaatgaggaagagacctactgttgtaggcaaataatatgaatcatattacatatgtcttttcccttcatatacatctgtttagttttgcagtggctcctgggataagatgctaaagatctggtctacaggtaaattaaatatttattttaccttgacttaataatgttgtttcaaaaatttaaattcggaggctatatggtggcttacgcctataatctcagcacttcaggaagccagggtagaaggatcacttgaggccacgagttcaagagcagcctaggccacatagtgagaccccgtctctactaaaagtagaaaattaaaattagcaaggtgtggtggtatgcaccggtagtcctagctccttgggaggctgaggtaaggggattgtttgagcctaggagtttgaggtttcagtgagctatgataccatgccactgcacttcagccagggtgatggagtgagaacctgtctcaaaaaaaaaaaatcagtttagtgaaaggggactttttaacccatattttgccataaaaagagaccagtatggcaacaaattcatatatttctttgtgtttcaagattttttttttcctaccccaccacccccttacttacaggatagtgtcactgaattgcaagtatcaaaaacatgtttggtgcaataggacataaataccttgattctcaaagttctcttattcaggaaacttggaagtaaataaaaatactttccgagccattttgacttaagtaatgtaagaatgacttttgagtcattttactgttaatttcttaggtaagctggtttacttaaaaaaatttttcaatgcagttttaccaatattaatatttttactctgaaagcatagattaaaaggagcaaattgagggaggaggaggaaggactttgagaggaaggtgctttcatagtagtaagaagacactgatgagaagaaaagaggaaaaaacacacacccatagatacttacattttaagacctagtagctacaactatttattgcataggtaaacaaatcagaatacctctgttactttttaggtaattgctgtgttacacagtataataccccaaatgcatttcacaaagacttgagggggatcaagaaaagcttaaccagttttgaataattatgtgtaagatggtgggaaatatataatccgttttagtagattttacaaaaatgatgaaagcaaataatttggtggcaaaaagtgat

SEQ ID NO: 98185 - DNA, 1067 bp, Homo sapiens
tttttttgaaacggagtctcgctctgtcacccaggctggtgtgcagtggcgcaatctcggctcactgcaagctctgcctcctgggttcacgccattctcctgccccagcctcctgagtagctgagactacaggcacccgccaccatgcctggctaattttttgtatttttagtagagacagggtttcactgtgttagccagaatggtctcgatctcctgacctcgtgatccgcctgcctcagcctcccaaagtgctgggattacaggcgtgagccaccacgcccagccatgccaggtattatttttaggaggttgagaaacgtcaagtgatctgatctagtatggcttgaaatctcaatcttcatatcaaaaaagagtttaaaagtataatcctcaaagttactttgtcattgccaaagaaacatttcagggtttggaaaaactgctttttgtgtttcataagatttttttttctcataggatcttgactggttcttatgataagacttctcggatctggtccttggaaggaaagtcaataatgacaattgtgggacatacggatgttgtaaaagatgtggcctgggtgaaaaaaggttaggacagtttgcctacacttagaggaatcctagatagggatttggaaataagccatttttggtgctggggaagaatggggagtgggtgggaagtatctcatacctcagttattatgaggtctttcaaaaaatacagtgttcaagaagaaaaagattatataaaaaattcataaattgttagaagtgtatctttattaaaattacatcagataatatacattttcaagttaatattgaatgtattacattcatcttttattttcttctgtttttgtttgtttgttttgttttgttttgttttgttttgtttttgagatagtctcgctgtgtcacccaggctagcgtgcagtggcatgatctcggctcactgcaacatccacttcccaggttcaagcgattctcctgcctcagcctctcgagtagctgggactacaggcacctaccatcacgcctggctaatttttgtat

SEQ ID NO: 98186 - DNA, 1034 bp, Homo sapiens
ctcaggcagtcctcccacctcagcctcccaagtagctgggactacgggcacatgccaccacgcctggctaatcacttttctaaatgttgcttaacagttatcttttctgtggatcgtttctggccctgctcccctgccctccttttctgtggttaaaatgacctatggtgtctttgttctttttatacatgtcacctaatggcattgttcttatataacttcattctatttgattactaaacttcaacctcatcttagaacagagaccatgttttaattcatttttgtttacaacatgtagcaaaatgtctggatgtctggcatttatttacccaataaatgtatgttgaattcgtaaaagcatgtttgttcaaatatctgtagacttgatcttgacatatcatttcctttttatagatatgccgtagatgatgttcccttctcaatccctgctgcctctgaaattgccgaccttagtaacatcatcaataaactactaaaggacaaaaatggtgggtatatatgcttaggagagggcacagtgtccctaattattctaaaatgcattaagtttttagttccttttttggccttatgatactgtatgaattttgtagtggtaaaatttgtaagttataaagtacaggttcttctgctggatgatactgtaaatactgctttgaaagaaaagttttcagaaaaaaatttctgtttaatctgtttttaaggccatgtggaaatatggtggttgtagttaaggaataaagattttggtataaagttgtaatatagaggtaatcaagacattgattgttctacagagggctgagttatgcaggcataaaacaagcgttttagtgcttaggccccatttactagtgaagcacaaagcaaaatgacaatatcagtatttgagtgtttagtgtaatatcaaaatgacagtatgaataccagtattttattttttgtgtccagaattcataaaaaaaggatataacaaaacatggaagaatataaaacatttaaaagataca

SEQ ID NO: 98187 - DNA, 1077 bp, Homo sapiens
ctttgtatttccgcctctcgcctctctctaaaagccgcagttagaggcgagatttaggaaaaacctctgccgagtgagcctctggttgggaatatgtatgagaaaaaaaaactggcaaggcgttagtcaagcaaagctgaaggcagaggaaatttgatatctggctggagtctagaggatttaatgcaaataagatactctgagggcagcgtggcaaaaaaagactacaattcccggtggtcacagcgtttgagaagcgatgctttctgagacttgtagtaactaggagctgtgtttgaactatccaggctcaggacagcctcttgaaaaaaaattttttattaataaagcggatttgagtgggatctttttcctaatcgattacgggcccacacgtatgggaagaattctaacaatgattaaagggacatgctacctttacgactatccttttctaatcgatgactcctaaatctaggagtaggtagtcgatgtttgtggtctgggcgtctgtagaagggcaacctcgtgctttctgcagaggagaccggagggcagaaggcagagtccaggcttagactgcagttcctcgcttacctgtgcagtctaattttgagctgcctctttgtagtcttaaaaggcaggagcttcgtgttgtgggtctgctaacccgtacgtttccgtgggcaagtcgtgtgtactcctcgccatggctcagctccaaacacgcttctacactgataacaagaagtaagtaagcgttccagccttctctcccttccccaggttcctttccgaccacccctttggtatgaccttgtggatccctggttgtttctgctgtcacccccacccttttttctgagattacctgctttctaaccagcttcgtaggttctatataatttgaattgtgagtgtggaggaggctgaagggcttcaggtttgctttctgaatgaaacattttatatgtgtaatttaaaaatgaacagtgggccttgttatagggtgtctgctagtggtggttcacagtttttgaaaacggaaaaaaagtttttgaaaatgaaaaaacatat

SEQ ID NO: 98188 - DNA, 1034 bp, Homo sapiens
attttttttcaagaggctgtcctgagcctggatagttcaaacacagctcctagttactacaagtctcagaaagcatcgcttctcaaacgctgtgaccaccgggaattgtagtctttttttgccacgctgccctcagagtatcttatttgcattaaatcctctagactccagccagatatcaaatttcctctgccttcagctttgcttgactaacgccttgccagtttttttttctcatacatattcccaaccagaggctcactcggcagaggtttttcctaaatctcgcctctaactgcggcttttagagagaggcgagaggcggaaatacaaagaaaagaacggatgagagaggaaacggtcgacggtggccgatagtggtcctactgtcgtgggactgctctgcgcgctcccggtggggcgcgcctgcgcattatgctggtctccatggcggggcctcggagccaagacgaggttgagtagactcgttttgaattttctcccctctgctccggcggacttcccatgtcgccttgtggggctatcggcggcggcaggactgggggagtcagaggtctggcagcgctgtctgcgcagacctaccggacgctacctcccaaccccccgtcttcctcctgcctcctcctcctcccgtcacctcctgacccgccggagctccgagcaactgccggcctccgcccccagccgcagccggtcactggcggcgccttccgcgccaagcttgggggccttttcggggtcccacatggcacggcttccgacccccggcccgggacggggctcgcaggccccagaggggcaggctggagaaggaggaggttaggtgtcttcaggagggttgctgagcccaaggacgcgccatcgccgcggagaaggagccggaccccttgggcggagcgcccaatgtgtggtccctcacgccgtcccgcaccttgctttttagggttctttttccgctttctgagcccttttataccttacgtttagaaggggaaaatcatcctcccacacct

SEQ ID NO: 98189 - DNA, 1470 bp, Homo sapiens
aatctgggaggtggaggttgtggtgagctgagatcatgccattgcactccagcctgggcaacaagagcaaaactccatctcaaaaaataaataaataaataaataaataaataaataaataaataagtaatccaggcatgaggtgattatgccttccaggagaatgaagagaaggcaaatctacgggaaaaaaatagtaaaatctgtaagtacttagatatttttaaataatgtttacttttaatttgctaagtattaatacaactgagaatatggcatatattttacataagcctctgaatactttacagataaattgaattttctctaagcttaaatgcttaaagtagacttctggttgataagatagattatcttgagattataatataatgaaacaaattcttctttatcttgtataaaggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtatgacatttttatagttcttttattttacaaattaattagctcaatttgcaagaattattttgtaagggaaattatagttttccaactatttcattaagtaacggttttataaggtagagatatcaatagttccctaggtattaaattgatttgccactgtgtaagccattgagtttcttagccccaagttgtagataattcagaccaaagaattattccatactgtatagcatatactctgtataccatataccatgtaaaagctttttctcaaaatgacaaagacatacttaatacactttattatatatttagtactttgttttagctacttactatgagcagaaacttcagccgcctgtcatttttttaaaactaatctttgattacttacggcagccagaaatgaattccaagccgtaaataaaattccatttcacaccttttatgctttaggttttaaatgtgaaatattagcattcttttttactttcctttatgtgtcagtctgggtgaataatttgttattgtataatggatttaagtgtatggaatatcgttttcgtgtgatctttaaaaaaaacttttaggtatgtgaaaaataaattgagtcaacaattagatccttcaatgaaagtcaaaaatatcactaaaaaaattagatcctgcagtttgaagagcattgcatataatttttaagtaggcattgtcagttattgtaataattttatacagaaatatcaattaaagcagtatcctaccagattagttcattttcctaccgtctacttttctttttttttttttttcatggctctccaagagatctgcattcacctttagttaattctcttgctcacttggccagcaggagctgggagtgctgtagaggcagtatg

SEQ ID NO: 98190 - DNA, 1748 bp, Homo sapiens
ttcaacgtcttttcttttgttgttttttttaactttttttgtaaaagaagcaggggtcttgctatgttgcccaggctggtcttgaagtcctggcctcaagtgatgcacccaagaagatgggattgcagaagcaagccactgcacctgattcggtgttttcttatagcattggagaaaataatttggttttgttgtatgtcctttcacttaaggtctcagtttccaggagcctaacaatgatgttaactgagagcttactgtaattcctagaattatttcctaattaatacatgacttttctatttagcagttttcttagacattttatatttatttccactggggcatcattagcataaggcaaaaatttggtaaagccattcactatttactaaacctgaatcttaacaatggaagtataatacagttctgcgatttggtccaccaaatgtaataagcatatatatgttaaattttatcatttcttttatatattgattttttatacaattaaataacagtgctgccttctatttctatcttcttttgtctccgtgtaaaattcaagcccatcatatttcatataatattaattgatacttttggaagcaatgtaacatgatgtttacgcacataacctgggtataggcccaagctctcttatttactaggtaggtgtatgattttgggcaaattatttcacttctacagtccttagttctatcatctgtaaagtgggaatgataattgtacgtatgtcgttgatcattaagggttaaaggagatatttgatgtgaagtgttccatacagtgcctgacatagcattaaaaacattattatacttaaactgaaaataatgatttctttaaattcataaaaatatcaaagctcagctgggcgtggtggctcacgcctgtaatcccagcactttaggaggccgaggcgggcggatcgcgaggttaggagatcgagaccagcctagtgaaacatagtgaaaccctgtctctactaaaaatacaaaaaattagccgggcgtggtggcacactcctgtagtcccagctactcgggaggctgaggcaggagaatcgcttgaacccgggaggcagaggttgcagtgagccgagatcacaccactgcactccagcctgggcgacagagcgagactccatctcaaaaaataataacaaaactcactctaatatatttagatgttttaccaatgaaaatattacatttctatagtctgcaataattctatgttgtatggaaaaagtttaaataggaaaatataaattacttacagagctataaaccatactttatagaagtttatactgaaagagaacctttctgtcttttgatctaaaggcatattgctaaatggtttatgtctttattccattttgtattctttacagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacggtatgattacaaccataattccttattacagagtctttctcagcttctattaatatttagtctaataagaatggctagtgttaggccatctgaataactgcaatataagcaaatacaataggccgggcgtggtggctcatgcctgtaatcccaacactttgggag

SEQ ID NO: 98191 - DNA, 1045 bp, Homo sapiens
ttagaaaaataatatttttctcacttgattctgtgtgaatgtctcttctgatactgttttttaatcagaaagttacagagcaactttcccacaaacaaaccaataaaacaaaaccccacaaaaaccaagagcatgaagaaaagtttaaatccctaattatatactcttttggtttttaggtagaaactggagctatcaatattttcatgtaagtatttcaaggagtagctctttaaaaatggtttctaaattagattttaaaaattcattgtcatctaaatgcatgtttagtcacaatgtatcagtattgtgtttaaaggtgctcagcatcactttttgaaaactatgtttacatatttaaaatgtttaattattttgaaatgtatagggtattaaatacaagcttctaaaattttcagtatctatattggctttctctaacagctctacagcaaagtttgacatgttttttgtgtgtgtcatgtattgtaagttgtaatatctgtaggagtgagttggacattctaaattagcagtaaaaaattcacaattacagctcagcttgtttattcattatagtttccacatttccaacttccaagtgaactttatatatactacagtgaattatagataaatacagccatggtggacctttccctcaatagtgattttttgtacaaacagttagtataattaaaaggaaaagcttttatattttatgcaaggtaaatgtttcctaaatgtcacaaaagtgatagaaaacatagcttttgggatctggtcctgcattagagtttctaattctgagacccaccagcttgtgtttcatcttctttatatcctgtcagaatacatacttaatcatgtgggtatgagaaagatgttgtttaacttgtaccaggtttaaaaaaagaggtttaaaaaatgtctgtgcgtatatatatatatatatatatatatatatatatatatatagcaacttgatgtatagtgtccttgttaccatgtatttttttcattaaaaatcctgctttttttttat

SEQ ID NO: 98192 - DNA, 1068 bp, Homo sapiens
cgtgcctgtaatcccaactactcgggaggctgaggcaggagaattgcttgagcacgggaggcggaggttgcggtgagccaagattgtgccattacactccagcctgggttacagagtgagactccatctcaaaaaaaagaaaagaaaaaattattacaaagcatcctaaaaggcaaaaaacaacctgaagacataaggcaaagatcagaaccaaattcatataagacaggcatgttgaaattaccagactgagaatttaaaacaactatgattaatatgctaagggctctaatggataaagcagacagcatgcaagaacggatgggcaatgtaagcagagatgtaaattctaagaaagaatttttaaaatgctacagatcaaaaacactataacagaaatgaagaatcctccttagtagactgaatgaagatgagctcattagtaaactggacatggctaagagaacatttctgagtttgagaatatgtcaatagaaacctccaaaatggaaaagcaaagagaaaaaagacagaataaaatgattcagaacatccaagaactgtggaataactacaaaaggtataaatgtgtgtgataggaataccagaaggaaaaaaaaggaagcgaagcatatttcaagcaacagtgacagagaatcttcccaaattggcaatagacaccaaaccagagatccagaaagcacagagaacaccaagcaggataagtggtttaaaaaaactacacctaggctatcattttcaaattacagaaaatcaaagataaagagaaaatcctgaaggaagccagaggaaaacaaacagctttctatgcaggagcaagataaggattatatccaacttctcatcagaaatcatgcaatcaagaagacagtggagtaaaacatttaacatattgagagaaaaaaaaaaaacaccagcctagaattctgtatcccataagattatcatataaaagtgaaacacaaagactttctcagatgaacagaacaatatttgagggaatttgttgccaacagaccttccttataagaaataattaaaagaact

SEQ ID NO: 98193 - DNA, 1152 bp, Homo sapiens
accagaacaagaacattctaagagctttgatgtatttgaaatgtctgagatgtgggccttttccttgtatctgtacaaaaggtatgagtgggaagggagtcttgctccttattctcactggacgcattcttggttatgaacatgtacccatctctaggagtctgtctgccctagaggattctatggtggacatactgtgttagctgtgatgttttcctgaaacacaagtttctatgaaatctaatcagtccatgtgaaagtatagcgggttgtttgtgggaagtgaagaagatacatctttagtttttgataagtctagattttttagtatggcctctttttctaacctgtggatgtttttctctttcacagatttatttaattgcccaactaccactgatgaagatatattggagtgactgctgaaattgcctttttgtttttaaccagaggacagtccatttgtttcacttctttttgctttctttactgctatgagctttactgaacggctgaaaaacttggaaaataaaatggacatgctgtagtcttgaacataatttttttaaggaaaacttaaagtgccagagtgaaagccagaatggcatccagagagaggctctttgaactttggatgctttattgtacaaaggtaattgctttcctttttatttttatgttttaaaatactttattataaaatttgtgactggcagtagtaacactttatttaatagataatagtgtatttagtcataatgaataaccccaaacttaaaagcgtttaaaggattttctgttttcctctttttcaggtttgaacacacatacaatattggcatactgttaaaaactgtagggtgcggcttttatttgatacttatccccaaatgatcctaaaattatataagtaaaattatgcccttaagagaaaaataaaatatttttatttttgtttgtgcttttcattttctcccacaagtgagtgtaggatagagacatttttatgagaagggcattaagcatttttcttggaatgaacctttgaaattgcatcacaaggttattgattgaactgcgtgctgtgtgactgccactaagttagcactctttgagcattgtctcatttccttctcactacaatactgtgag

SEQ ID NO: 98194 - DNA, 1091 bp, Homo sapiens
aatttaatctggagagtcctggggccttgttttgaaaagacttgaaatacacataagaagaaaggcacataaataaatgttcagttgtccagaaaaaaaagatgagggagtagccattcagatacctgggagaagagtgttctgggtagagaaaacagccagtgcaaagtccttagggtgggagcatgtctggcatgtcccaggaaacagccagaaggccagtatagtacagggtaacagtggacaaggttacagggatatgggagggcaaattgtttaaacttttatagaacattgttaagattttagctctttgagtgacatgagaagccatttgagagttccatatacttaatgtacattttaaaacagcacatatgtactcctaaatatcacttggagatttcatagtattgattctttaggtatctgcttaataggtgtagaagcattttttttttcctgataggcatacttaatattataatggttttgttatttcagaaagatccagattacctgaagctgtggttggacacttttgtttctagctatgaacaatttttagacgttgactttgaaaagctgcctaccaggtatgtagaaacgctaatttgtaacccctggatgagtttttcatttttggcacaaagatttcattgatgacatattacaaggatggcaattatgttaccctcttgatactcatgaataaccctattctcatagagacatagctaattgatgacaatagtctttcttgatgatgccagacctggcttctagaaaactctgcttctctaggacactaccagctggtgttctgcaacacacttcatttctgacactaactaccagatcccacaagtaaagggcaaagtcctctgtaagactgccttcacttcagacattagccactacaagtcttcgggaccacccatacttcagaccaactggctataaattctgggttctcacacctcctccccacctcaagttcagtaactcactacactgacttgaaaaactcactgaaagcactatacttgtgattacggctttattgtaatgaatacacataggacaaggtg

SEQ ID NO: 98195 - DNA, 1050 bp, Homo sapiens
aagtgctgggattacaggcgtgagccactgcacctggccaacagttgacatattaaactagttatgtagatacttcatttttactttacagttattgtttcttttagaaatggtatgcacactgctatacacagtatttagtatacatagtatttttaagtggaacataatttattctaagtattttcattaaaaatagtacaattgaagatatcaaatagtctgtctctctctttagtaagcctcttctgaaataagaaaaaccactctgctctaataatcttctagttactaatcttctagttacttctagttactaatctagttactaatcatcatgtgctacatctgtgttgcagacgagaaggcacagagtatctggaataaataaaagagcttctttaggatttgggctgaaaatgaagttcatttaaatgccagagattttcttcttgtatttcaacaggcttcttatttttttccctttctgttgtagggtagatgatatgcctccaggaatatctctgcttcctgataatattctgcaggttctgaggatccagcttctacagtgtgttcagaaaatggcagatgggttagaggaacaacagcaagccttgtcaattttgcttgtcaagttcttcattattctttgcaggtatctagtagaaaaaataagctagttttcactcataggtgggagttgaacaatgagaacacatggagatgaggaggggaacatcacacactgggcctattggtgggtagggtgctaggagagggataacattaggagaaatacctaatgtagatgatgggttgaaggatgcagcaaaccactatggcatgtgtatacctatgtaacaaacctgcacattctgcatacatatcccagaactttaataaattaagtaaataaaaaagaaaaaaagaaaaaataagctaattatctgttttaatataattgttacattaccaaaataataattaattttgtttattattagtgatgtttgtagttgatatggagctttaaagagtaagtgcact

SEQ ID NO: 98196 - DNA, 1038 bp, Homo sapiens
ctctcgagtagctgggattacaggtgcccgccatcatacccagctaatttttgtatttttagtaaatatggggtttcgccacgttgaccaggctggtctcgaactcctggccgcaagtgagccacccgcctcagcctcccaaagtgctaggattacaggcatgagcctccacccccagccctttttttctttatggtgaaaaaagtgtctatttggaattaacctgctggactcagtttagatgatcccagttttgtaggcaatattgaaagcatcatagtcaggaggcagtctaacatatgccttctctccagcaggcctgattggggtgtagacctggccacatcattgtcaatagagcttcttcatggcctgtctgatctgttgttgggcttgatatctacagtgaacacaagtgttttgctgtcatctttttcattggctgacttagtggcttaaagggattttgatgctggcatagtagtcaagtttgtatcttctctgagtgttcctctgaggatgtttgggctgcgtttggaaccatagtgtcttgggccaccagaaggtggtgatgtgcagattgtgtgtgtgtggggtggggtggatgccttttagccctgcctgcttggccttcatagccttggctttggctttggctttgggaggggcagggaccaccttccttttaatgccatcttcatgaaaaggatctccagataatctttttttcattactttctaatatatttcctttatggcaagagaaaatactctttatgacttcaataaacttaaactcattgagttgtattttcttatttaaatttattgagttccacttttcatcatgaataacattccttgccttgattatatttcttgcctactttgtcagatactaatatagccacccagcaatcttatgatgagagtttgcatggtatatgtttttatgtcctttttatgtattatctttctgtgtgtccactgtggctgagtggaactctgtcatcttctagctctgtgtaaaatcagaga

SEQ ID NO: 98197 - DNA, 1022 bp, Homo sapiens
gaaaacacagagacttgttcttgttagtgcctaggggtagtcaaaccccaggagacctccataatgaaacctaacactaaaatcaagtagctactggaagtccaatttattattttatgtaccaaaaatccttgtgatccaggcatagctatagtgggatttatatcaaagttggaaagttgtttgttgaatatggcattagtacaagggtgtttagaggaattgaatatataaaagctaaagaatggtcatgtcataaaggtcagaaaaatcaaagtctaattactggtttcctttcccaaagcatcatatctgggcttcccattggcatatttgaaacctgtcctgttttgtgttatgttaaaaacaaagattttgtagccagactgacctaggtttgagtgttcatctctaactagttatgtgactttggatatactatttacatatgttttagtttattaatttatgatacggaaatagtaacatttatgggatatttgtaaggactaaatgacataatatatgtacagcacttaacaaagtacttgtacttttaaaaactaagtaaataaaagttttatcagttagatctatgatttgctttatgtagcagttaataaaattaaaacagcttaagttacttttctaattaaaaacaaagtaataaataattcagagttaatctggtgcctctgggatcttcagggattcagttttcttttgaatgtcaatctgtcatgcttactattctatttcatgctgcaagatagcttctagagttctggccattatgttcacatttggggctctaagatagagggggtaaggaagaaggatacaaatggcatgtgtcaagtatcttttaaagacatactgaggccgggcatggtggcttacgcctataagcccagaactttgggagactgaggtggcaggatctctgagccccagagttcaaaacgagcctgggcaacacagggagaccctgtctctacaaaaaagtttttttaaattagtca

SEQ ID NO: 98198 - DNA, 1005 bp, Homo sapiens
aagctgcagaaccaaaattcaaactcaggtctctgattccaaggcctgtagtgtatatatcaatttattgttatgttaagccttacatatactcttccataacatataataccatacctctatgcagtttattttatattgcatatttcagcatgtaactcgaccttttgttttctcatttctgaaataatagaacttcctaagaaccttgttccttagcatgctcttaataaattcctttataaatctgtctctccctttgagtatcatttgaatttttttcaaattgtgggcaagttgaaggccttttgggatgctgacttttatatactgaaactaaaatacttgatttctttattttactcagaagagggtaatgcccatgtatgctagagataatctcaattttcctttacagaatacaaatgaatataaatgaagctcaattcttgatgactttggagaatacttttaaactaatgttttaacaaaatgtgtggtcagataaattttggaaatgctgcaccgtgacctcccttgtcaaagtatccattagcatatttgagactctgaggaagtacttctagaaagaaccatttttaaagttagtttgatagcacttcacaaacttccttaactatagaaccatactgggtgttacgtactacggtatctttggtttgtgtcagtaacagctttccttcttttttgtgtgtattagtccattttcatgctgctcataaagacataccggagactggacaatttacaaaagtttaatgaactcacggtttcttgtggctgaggaggcctcacaatcatggtggaaggtgaatgacacgtctcacatggcgtcagacaagagaagagagattgtgcagggaaacttccctttataaaaccatcagatctaatgagacttattcacttaccatgagaactcccaccgagtttctcccacaacacatgggaatttggggagctacaattcaagatgagatttgg

SEQ ID NO: 98199 - DNA, 1014 bp, Homo sapiens
aatttaatgttctttctccattattcttgtctctgtttttaacagctatttttaaatgctaacaataaggtggcagacaagaacgagaaagaccttgccaacaaattactgacagaaatgaatgaggaccaggtatctacaaagcctgcatcttgtttcagctgaagtccaaaatcagccaatgggaataactattcctgtgcttttcttcttatgtcctaaaatacacaaacattgtcaaattctaatatttattaattatttttgaaaattactaaaaagttaaaaattgctttcatctaaaggataaatatcttggtggttgatacaaacaatcagtaccattccattccctctacgtgtgtatggtcttttcaatttgaggagatataaagtacaggaatgggatctcagtacaatgctgtccacctggtggtgacttttctaagcactgtggtatattgggaccttagggctttctttgtgaatatgtatggtcattgttaatatcttgattctttgcttcttattgacaagtgatgattataattcaatggacaacctgaatcttggaggaagggaagaagatgctgaactctctgttaatttagcataaaacttgactttttgtattctagaaattcaagtctatacaggtataataaagcaaaaatatgtaatttatgttgcttctctcaatacattaggtaatttagtttgaaaaaaaactacctttaaaaattgacgttatttttctcttccaaaatatttccaataaacttacatattgtcttttattaacattgtgttaatgtccaagtttataaatagaatttttgtataacaagacacattatcatctaattattttttattctagatgtgaaatgccaatttacagaatattgttttagatttctgtataaatgttaatccctcttaaggcctacttaatgtagattaataaaacaattattatagtctcttagaggttcacattacaattccaaattg

SEQ ID NO: 98200 - DNA, 1058 bp, Homo sapiens
ttttagctgtctttttatacatgcaaatggaatttaaacctggatggttcaagtgtagttttgaaggggaattaaaacataataggatttctggctgggcatggtggctcacacctgtaatcccagcactttgggaggccgaggtgggtggatccacttgaggtcaggagttcaagaccagcctgaccaacatggagaaaccctgtctctactaaaaatacaaaaattagctgggcatggtgacgcatgcctgtaatctcagctactcaggaggctgaggcaggagaatcacttgaacctgggaggcggaggttgcagtgagccgagattgcaccattgcactccagcctgggcaacaagaacgaaactccatctcaaaaaaaaaaaaaaaaagtaataggatttccaatgaatgatagacctccctcccttcctcttgagattgtccattatttttaaaaagcatgtgttaagcttgtttttttctcaaaacattttaatgtaataagtgaatgttgccttatcctccttgacatgtggtttatttttcttttaaataggtaactttccttgcaggttatagtgtttcagaaatccatttcatcagaagaggaatgtaatgcatgttaagtaattattttttcaggttttcagaccaaaggtttcctaactcaataaaaatcgtgagcacatttgttaatttcttgtttccccttccccctcaataggtgtttcagggacaattggattgtttggccatatcaaccattcaggctttgaccgcagtaatgaacaaatctccagctgctaaggtgaaacatatatcctccagcttttttttttttcttaacttttattttaggttcaggggtacatgtgcaggtttgttatataggtaaattggatatcatggggatttggtgtacagattattttgccacccaggtaataagcatagtacccaataggtagtttttcaatcttcccgctcctccttcctttcatcctcaagtaggccctggtgtctattgttcctttctttgtgtccatatgaactc

SEQ ID NO: 98201 - DNA, 1055 bp, Homo sapiens
catgatttaagaaggcaaatagtgaattcgtgtctttttctttatttaatattaagttaattagcataaatgagtattatttaatatttttaatattccaacatattcagtctttgaaaatgtactttgatatattgtcttcccatcccctaggaagtatttaaagaaagaattggttatacacatatgcttgaagtattaaaatccctgggtcagccaccactggaattacttaaagaacttatgaatatggtgagtttataacctttattaagagaatttctgttaatatccattttgaaaatgataactaaccttttatcttttatgttgcttttcaggctgtagagggtgaccacacttcagttgggattttgggcattagtaatgtccaacctctcttgcttcttatccagtggcttccagaactacaatcccatgacctgcaaatcttcatctctgattggctgaaaagaatttgttgtattaatagacagagtcgaactacttgtgtcaatgcaaacatggggattagaatcattgaaacccttgacttgcattcttccctccatcaaacttgtgctgagaacttgattgcaatccatggttccttggggagtcagtcagtgagctcagaagaaatccgtcgactactgagattgctgagagtggatgaatctgagtctgttcacccttatgtcactcccgtgactcgagcaatcctgacaatggcccgaaaactaagtctagagagtgccctccagtatttcaatttgtcacatagtatggcaggaatttctgtgcctcccatacagaaatggccagggtctgccttttctttcagtgcttggttttgcttagaccaggatcagttgactcttggcattgctaacaaaggagggaaaaggaaacaattgtacaggtattggtaaaaattatggaatataaatgaatactgtcataacaatatatgctgtgattcttaaacaggaaaactgtttccaagcatctagcttttagatatacagcttatctaaagtctcttcatccttagg

SEQ ID NO: 98202 - DNA, 1058 bp, Homo sapiens
ggctggagtgcagtggcacgatctcagccgactgcaacctccacctcccaggttcaagcgattctcctgcctcagccacctaagtagctgggactacaggcgcccgccaccacgcctggctaatttttgtatttttagtagagacggggtttcaccacgttggccaggctggtctcgaactcctgacctcaggtgatctgcccacctcggcctgctaaagtgctaggattacaggcatgagccaccgcgcctggcctatatcttgtgattttaaagacctttatttatgcttactgaatcttatttggaagaattttaaagatttgaaaattagtagttttacttttttacttttactagtggaattccactttacaaggctgccttttatttactaaactcttatgaccaaaatggattttaaaggggtctttgaaacaaggttggacttctgtgtggcaatagaatttaagccacagaattgtgggtaaagatgttcatgatggctttatggttttatgtactttaatgatgatgaaactgaacaaccaactttaaaagttctgataatacgtattttttttagtttttttacaggaagtggcatgggttttgaagcctttattacccattcaggtatgttggtcgtggcagtgtgcacaaaaagagaatatgcaacggttatgcttcctgaccacagtttctgtgattccctctgggtaaggctttagggcatcacatttaacttctagtatggttaatggtatttcccaccattgtcataaattcaacagcagtcatttttttgctaaaaaatttaaatgaggctgggcgcagtggcacacctgtacgtaatcccagcactttaggagcccaaagcaggcagataacttgagctcaagagtttgggaccatcctgggcaacatggtgaaacctgctatctactgaaaaatacaaaaattacctgggtatggtgatttgtgcctgtggtcccagccacttgggaggctgagttgggagaattgcttgagcccaggaagtcaaggctccagtaagc

SEQ ID NO: 98203 - DNA, 1119 bp, Homo sapiens
gaccttgtgatccgcccacctcagcctcccaaagtgctgggattacaggcgtgagccaccgcgcccagcctctcctgtgtctcttattataaggggttctctcagactacggccccatcccgatgacttcatttaatcccagttaccactttaaaggccctattccaatacagtcacattggggattatggctttaaataggaagtttagggggacatagtcagtccataacactgccagtacttttgacagattttaatgaattgatgaaacaaaatataaccgtatctctagaagaaattatgtaactgcttccaaaatcatgagccttattccaaaacttgtcattttttcaactgatatattaatatatctgaagaattcatgaaggcagtagaattagggaaccttggataagtttgcaaactgtttttcattttgttttggctttttgtttttcttttggctatgattttaaacatatgtactaatagttattggatcctaactactttcaaaattatatgtatattctaacaggatgttcaggagttaagcttttaagagttatgtaactgcagaatagcttcttatttgtctaaatatcttttttagattgcatgggaattttgagatgaatgggattgcccacatttcagactttatattagaaccttatcttttcttttctttgtttttttttgtttgtttgtttttttgagacagagccttgctctgttgcccaggctggagtgcagtggctgatattggctcactataacctctgtctcctgggttcaagtgtttcttgtgcttcagcctcccaagtagctaggattacaggtgtgtgccaccacacccagctaattattttatttttagtagagacaaggtttcgccatgttcgctaggctggtcttgaactcctggcctcaagtgatcctcccaccttggcctcccaaagtgcttggattacaggcgtgagccactgtgctaggcctaaatgatcatttttaatggttgcatatttccttggattcaagacgtgttatttacttaggttgtttataatttctttctttttttttttttttggacagagttttgctcttgttgccc

SEQ ID NO: 98204 - DNA, 1073 bp, Homo sapiens
ctcagaagattttccttaaaaagaaaagcaagccaaagttactatgaatctcagaattacatggaaatatttttttaacactatgaattcttttatgtagaaaatatagaaatgtaaaaattaggctgggcgcggtggctcacgcctgtaatcccagcacttcgggaggctgaggtgggcagatcgtgaggtcaggagtttgagaccagcctggccaacatggtgaaaccccatctctactaaaaatacaaaaattagctgggcgtggtggcgtgtgcctgtaatcccagctactcaggaggctgaggcaggagaatcgcttgaacccagaaggcagaggttgcagtgagccaagattgtaccactgcactccagcctgggcaacagagcgagactccatctcagaaaaaaggaaatgtaaaaattaaaatttcaattcttatactttgttttgtctttcaggaatggttgtaaatataatgaactatctctagatgatattcgaacaataaggacttctttgtatggactaattaaatattttctgtgcaaaggtggatctcatgaagagatacaaagtattatggggtacatagctgctactaatgaagaagaacaggtattatgcctaagatacatctacttttcctttttaacatttgagttgctacatcatcttctgaacgtatgtttgtgtctagttaaatattttgagagtaaaatatgtgtagtgtcacattcaatattatgcacttaagaagtaaattttatcttttttttttttgagatggagtctcgctctgtcacccaggctggagtgcagtggcacgatctcgactcactgcaacctccatctcccagaaggagaagtggttctcctgcctcagccccctgagtagctgacattacaggtgtgcacccccacactgagctaattttttgcctttttttttttttttttttttttccggtaaagacagggtttcaccatgttggtcaggctggtcttgaactcctaacctcaaatggtctacccgcctagggctcccaaagtgctaggattacaggcgtga

SEQ ID NO: 98205 - DNA, 2029 bp, Homo sapiens
taagtagatttatgttgactaggctattttgccctctatatataatatttattatttactcagtggttacatgacttcattatcggtattagatgagttaatgcaggctgtttccctataaggttgccgctcaaaagcttctcattattcccatcttatttcatgatagctgtatctatgattcattgccaacaatattttttttggttatttcagttaaagagttatttgttgaggacttactgtttacacacaataatattagacattacatgtaatataatgatgaattattattcttttaagctaatggggcaggggtcaataagagaagtttacaaataactataaacaaagaagagtatgacaatatctgtaagagagatacaaagttctatgaggttttcccaagagggttttacatgttgcaaagaccaggaaagactttatggaggagatgtcttttcatatggataaaagaggatagatatggttccaacaggtaaatttgaatagtgaaaggatatactaaaggaaattgaataagacaaaagcatatctggttcaaaagatatcagaggccaggtgcagtgagctgggtggatcgcttgagccgaggagtttgagactagcctgggcggcatgacgaaaccccattcctaccagaaatacagaaaatcagccaggcatggtggtgcacacctgcagtaccagctacctgggaggctgaggtgggagaatcactgagcctgggaagtcgaggctgcagtgagctgtgatcacgccactgcactccagcctgggtgacagagggagattctgtctcaaaagaatttttttaaaaagacatcatatcagatatagtgaagttaagataaaacattatataggatttaattaaataacttttgtggcttatgaccttatttgtgcttgtatatatgaatgtggtggtttgttttgtgttgtttaattttaaaagctctttggaattttggacgtgctcttcagtctcctacgtaccagcccaaccagaggtcagcttttcttactgctttttgaaccaggaaatgctgacatactgtacgcattgctcttaaatcagaagtactctgacagactaagagaaatcatttttaaggtacaaacatttcttaaacatctttgtattttgaggcgtttgtgggtatatgaattttcttgcaatatatccattctgtgactataaattatttttatatctatttctctaagatgttcaacttatttttatatatagttttcatgtttcagttgtttgcatattaaaaaactaattatattgtaatctgaaaatcctctcagtggaatattcactttgtcataccatcctcaatataaaacctcccatcttcttgacttggtgggtctatgtggcaattcagaacatttcaacagctaataataatagcaaactttatgtagcaaccactatatgtcaggaactaagtacttttcatatattggcttacttagtcttgcaataacttcatgaagtgggtattattactattatcattttacagatgaagaaactgagtccagagagatcagtaacttataaaataaatagaagagttgcttcacaaatgtttacttatccttgaaaattattttaattttaataactgttacttaagtggattattagattgatccagaggtgtactgacacacatttgttcttgcaaactacatggtttgtttccacctaagcctttctcattaagaaacaaaattttaaattatttctctttaatttgccatgtaattaaactagagttttaagcataccaattatacaactacagatgaatttcagtccagtttattcttttttaaaatttgtttatttttttgagacggagtctcgctctgtcgcctaggctggagtgcagtggtgtgatcttggctgactgcaacctctggctcccatgtacatgtgattctcctgcttcagcctcctgagtagctgggactacaggcacgc

SEQ ID NO: 98206 - DNA, 1152 bp, Homo sapiens
ggacactacagaaaatatgtgcaaaagattgttttttcttaaggagcttaaatttttaaaggcaaatgaaaactaatttcagatattctttgttgtttcttttgtttgttttgttctggttttttggtttttctttttagaaacagagtcttgctgtattgaccaggttggtgtgcagtggctagtgacaggtgtgatcatagctcactgtagcctcatactggatgcaagggatcctcctacctcagccttccaagtagctggaactacaggcatgtttcaccatgccctgcttctaatttttttaaataatttttttcagtacttaatgacagacagtagaatttatgccagatgctgggagtttggggatataagattctttgtcttgattagtttacaatcttgttgataagacatgtatataaaaagataaataataatataagagccatgcagtatggacagtacgttcaagcaatcaaaaggaacaattatttagggttgactcaggaggatgtcaaacattctaaacctattttttctttaaaatttgaacatacctataattcatattttaaaatgaaataattatttcagcattttatacaagtattatccacagttctttctttggttatctctggtatttaattttaactttttgtttttcctaccatagatcctgttattaatttcaaagatctactatctgtggtatatatatctcacagagcacatataaatgttagagtggccatctgcagaaaggtcagtaaactcttaagatatattttaatgatagcagcatcaccatcatgctataaataactttgcattattttgcagcagatacaagttttcatttattttataaatgacgtaattttataagtaaacaattttctttttgaagtaaattaacttcatgttatcataagaaattagcatgtgaatgttttcttagttcttcgtggtctcctgcaaatatgttctttccagagtcaaaaatgtattaccagagaataattttcttattaagaaccttcaatgattgtgaccatttctaattaatataccatattatagagtttctgaatcttttgaaactttctggaaataattttctataatttgtttaggagtattcca

SEQ ID NO: 98207 - DNA, 1131 bp, Homo sapiens
cctgaacaaatgtagggggctcatggaaagtatttagttgagaggatattactctattatttaacatataccatcatcctattcattttaatttttcttttttatcttccagcagatattttagtgtactcttactctgtacaatgagtaatatggagattagttggaaacacagtgccagtcttccaaatagtttataatctaattaagaatataatcttttgaaagtatattcttctatagtttctcattaaattaccttatcattaaaataactgaaaatattatttttgatataaagtactatgtactttttgaagaattttgtattctaaatctttttacaggttttgcaaattttgcagttccagccagatgcagcacatcaaatatcacagcaagtgggttggcaagacaccttagttaggctttttttaaaagcaaaatttgaaaacggaaatactcttcataagcacagtagagctgttttaatgaaagacaatgataaaaatatgtcaactgaagataccaagaagaactctgatgaaaaaacagatgaggaaaaaatcacctcttttgcctcagctaatgtgtcttcggatcagtggagtttggaggatagacactctttagactcaaacacaccattatttccagaagatagctctgtgggagaattgtctttcaaatcagagaatcaagaggaattctggcatagtaacccttcacatttgagtttagacctcagtggaattgactcatgtgaaatgagtgatagtggaagtcaagtgccagacagtctgcctagcacaccatccccagtagagtctactaaatcgttttctgtgcactctgacagagaaagcagcatcacaaatgatatgggctttagtgatgacttctctttacttgaaagccaagaggtaaaattgcttatttttccaaatgttgtttttattttcatgtctgatatatacttctaatccttagaaatatgtgagcagttgttaacaatttcatattgtattcatgttctaagtttcatgatctaaggtttagaaacctggaagtcactagattgtgagttttttgagagcaaagctaatgtcttactcatcttatgtctctagg

SEQ ID NO: 98208 - DNA, 1033 bp, Homo sapiens
tcaagtaaaacaggaaacttttgacttttaatactatgtatattaaagataaatactccaaacatttcaacgtttctccattgttgttaaattccatttataggcctggcatggtggctcatgcctgtaatcccagcactctgggaggctaaggcaggtggatcacctgaggtcaggagttcaagaccagcctatccaacatggcaaaaccccatctctaccaaaaatacaaaaattagccgggcatggtggtgcatgcctgtaatcccagcttctcgggagactgaggcaggagaatcgcctgaacccaggaggcagaggttgcagtgagccgagatcacaccattgcactccggcctgggcgacaagagcgatctctgcactccgtctcaaaaaaaaaaaaaaattcaatttccatttacagtatcttagggatacctgctagagatagtatatctttagagatacagtgctgcctctcaagctattttgttttgtttttaatgtcctactgtttttctaagctcacaatggttttaagaggactttgttttccatttagtttgctacaaaagatgttagaatgggcaatctcagaaaacagagaagcaaaaactaatccagtaactgctgaaaacgccttccgactagtgctgatcatacaggactttcttcagtcagagggactagttaattcaaacatgtggaccgagaaggtgcagtaatatctctttaaaattatattttgggtagttaagaactttattcaaagaaaaattttgcaccccctctttttagagcgttaatgcttaatcagattcaataaacaaggataagatgtgatgaatagtcacagatttttgttagctattactaggatgattcttttggcttttgtcaactgaacattggactagcttttgaaatatttgtggtttgtattaatgttggggaaaattgatcatcagtaaattgaaaaactgaatgtttttatttctcaatttttttcctttgtgatagcttttagaggata

SEQ ID NO: 98209 - DNA, 2064 bp, Homo sapiens
tagccaaggaaaaaggaaacccctagtgatctaatttacctttcctcactggggattaaggccaaagcttagtagtagtatacagtatttctttgtctgggcttgtgccctgactatgtatattactcgggaattttaagggtagttcggtttctgatcaaggacttggactcctgtatacctgttctttatgtatcaaaatattttgatttcaaataacagaaacatcaagccaaattgacttagttaagaagatttttttgctcatatagtttagaatttcatagttaaggtgagtttaagcaggattcagtcagggctccagttccatttatttgctgtcctcacagcaccactctccatcatctgtcagcttgtgttaagctggcttcccttatggacacagaacagctgccaatagcaattagggctgtatgctacttctttcatatccagagaaagagagtgctttttcctacagccattgttggtagacagttctccatgggtctcttgtgtttctatatatcttgaatagtgactctggctgcctttgttatgaactagatttttgaggttgttcatatgagcaactttggaagatagaggttatgtcttcctccagagaaaagggaagatttgtttactatccaatataataaagataatgtctccctccatagcaaaatcagacaagtttgctgcccggtataaaagatttgggttccctttgctggacacggtggctcacacctgtaatcccaggacgttgggaggccaaggcaggtggatcacgaggtcaggagttcaagaccagcctggccaacatagtgaaaccctgtctctactaaaaatacaaaaaattagccggacatggtggcaggcgcctgtaatcccagctacttgggaggctgaggcaggagaatcgcttgaacccaggaggtggaggttgccgtgagccgagatcaagccattgcaccccaacccgggcaacagtgtgagactccatctcaaaaaaaaaaaaaaaaaaaaaagatttgggttctctttatactggtggtttctctcctaaaatgtgtctacatgtgcagacatcatctagtcctcttcatctctcactgtgggaattgcactttgagaaaacaatgcaaatgctgatactctggctactgctattgctgtagatcttggtctctgactcaggagtcttgtgtcttctgccaatacctgtgaaactgtagcagctaaccctttagcttggaggcaaagtaacatctgagacctttcacagttcttgacagttatgtaaaaattctgaatccacagagccaggcagaacttgtgctttcactaaatgtttgctttagtctgctctttctcatctaaactgttttcctccaggtttgtgcaatggcatcagctaagctaaatacccttcttcagaccaaagtgattgaaaatcaggatgaagcatgttacattttagggaagctggaacatgttctaagtcaatcaatcaaggaacagactgaaatctactcatttctgattccccttgttcgtaccctggtttccaaaatttatgagcttctcttcatgaacttgcacctaccttctttaccttttaccaatggtagctcctcattttttgaagattttcaagaatattgtaattcaaatgaatggcaagtttacattgaaaaatatgtaagttttatcttttttgatcaagatttttctgctaatttaccatttttatagaggtgaagtcatatattaaattttatgtatcttttttatttttttggtaagattgtaccttatatgaagcagtatgaagctcatacattttacgatggtcatgagaacatggcactttattggaaggattgttatgaagctttaatggtaaatatgcataaacgagaccgggaaggaggggaaagcaagctcaaatttcaggtaaaaagtaaatgttttaatatctagtttttcttgttgattttaggcatttaatattgattaagagtaatacaggccccaaactttaaaacaagcagtatt

SEQ ID NO: 98210 - DNA, 1444 bp, Homo sapiens
tgaatattgatgtgagttagataagccagtcttcggtttgtttctttgaaacctataagcattaatttcacagattaaaattatgtctttgtagtatacaatttctactttctttcctcttgagtctcattttagatgccttataaatcaaaagatcccagaggaaaattattttacttgacagtaagtaggaggttaattatcttgagtttaaaagttctgtgttgaggcactttccatttttgaagttcttcacgtgtttattgttggttggttttttttttaagttttaaaaaatataaatagattataggtaaaattatatcacacttcatcaaagaaaatgattctaatggaataagaaaagcctattggttacttagcttctttctcataatgcaagattttattggtcaaaaattttaaattatggaattaaaatgtaaatatacctgtaaatatatgagtcaatgaccttactttttattgtttctttcaggagctgtttgtggagccatttaatcgaaaagcacgccaagagaacctgaggtataataatatgcttaaacaacttagcagtcaacagttagccactcttagacgctggaaagcaatacagctctatcttacatgtgaaaggggaccttgggctaaaaggtaagaggatataattttattaagtactcctttttctttagtactctggtctagaaatttttgagcaaatgccccctttcactccaatttcttaaatgttcaattcataaaagggtgcttttaatcttatttattgtctttccatgaattataggtctgggatgattcgaggttgtattgttttttatcatacagttatttgccttcctttgaccctttgatatgaagtttattggactttagactcttagagagtgttaaaccaatttacttctgtctttctgataccacctctttgagctagggctaatgctgttgtatgtttgaatattttacaattcacttaactgatcctcagttacttctgttttgcttaattatattatcttttttttatacagccctttttaaaatgtggtaaaatgtacataaaatttatccttttaaccattttaaaatgtacagttcactggcactgagtatattcataatgttgtacaatcatcaccactgtccaacttcataacatttttatcacctaaaaaggaaatgctgtacctattaaaaagtcactccttattatcctctgtcccactccctagcaaccaccaatcagctttctgactgtatttattgcctgttctggttatttcatataaatggaatcatacaatatgtggctatttgtgtctgccatctttcacttagcataatgttttcattatgtagtagcatgtatcagtactttattcctttttatggctgaatagtattcccttataaggat

SEQ ID NO: 98211 - DNA, 1010 bp, Homo sapiens
tacttcttgagggtaattcagatattctttcctggacattaatttgacagataagtgatttatatttgaggccaggcacagtggctcatgcatattatcccagcagtttgggagaccgaggtgggtggatcccttgagctcaggagatcaaaaccagcctgggcaacatggcaaaaccccacctctataaaaaatataaaaattagctgggcatggtggcatgcacctgtattcccagctacttgggaggctgaggtgggaggattgcttgagcccaggaggcagaggttgcagtgattgagccgacattgtgccactgcactccagcctgggtgacagcaagaccttgtctcaaaaaaaagaaaaaaaagagattatatttaaatgtggcattcttttctatttaagaaaaataaatggttgaatttttctgtttattggcttcttgtttttacagtgatgagaaagaagaacaggatcaaaaagaaaaattggtattgatggaagactgtgaactcattacaataattgatgtaattcctggcagattagaaatcactactcaacacatttacttctatgatggcagcattgaaaaagaagatggtgaggagttctggaaaaaataatttttgctgttcaataattaagtatctaatttatcaatcatgaatgagaagaagaaagcagtaagatataactatcatgtgaagggagaaatggaaagtcagtaaggggtcaaatttgttattcaccaaggtgtggaagggaatgctttttaaaaattatcaatgcatttttaagggtttggctagagggaattgctgtaaacttaagttacaaaatacagtgtttattattattatttttttgagatggagttccactcttgttgcccaggctggagtgcaatggtgcgatctcggctcactgagacctctgcctcccgggttcaagcgattctcctgcctcagcctcccgagtagctgggcttacaggcatgtgccacc

SEQ ID NO: 98212 - DNA, 1050 bp, Homo sapiens
acttgggaggctgaggtgggaggatagattgaacccaggaggtcgaggctatagtgaaccatgattgcaccactgtactccagactgggtgacacagcaaagctctatctcaaaaaaaaaaaaaaaaaggaaaagaaaagaaatgaaatgaaaactatacctgataagggacttttatatatttgtacctagaatatataaaaaacccttacactcaaggtaaggtggcacacacctataacttcagctactcaggaggctgaggcacaaggattgcttgagcccaggagttcaagttcagcctgggcaacatagtgagacgcccatctctattaaaaaaaaaaaaaaagaggaagggggaagagttcttatatcttaataataaaaagacaacccaattaaaacatagacaacagatctaaataaacatttcttcaaaggagatatgcaaatgttcagtaaacacatgaaaagatgctcaacagcatgagtcatcagggaaattcaaatcaaaaccacagtgagatgccacttcacacccactatgatagctataataaaaaagacaaataataactagtgctgaagagcatgtggagaaattggaagccttataaatactgccagtgggaatgtaaaatggtatagcttttgtggaaaatagtctggcagttcctcaaaaagttaaatatagaggggctgggtgtggtggctcacacctataatcccagcacattgggaggctgaggtaggcaaatcacttgaggtcaggcgttcgagaccagtctggcaaacatggtaaaaccctgtctctactaaaaatacaaaaattatctgggcgtggtcgtgggtgcctgtaatcctagctactctggaggctgaggcaggagaattgcctgaacccgggaggcggacattgcagtgagccaagatcatgtcactgcactccagcctgggcgacagagcaatactccatctcaaaaaaaaaaaataaaaaagttaaatatagaattgctgtataacctagaaattccacttctagatacatac

SEQ ID NO: 98213 - DNA, 1050 bp, Homo sapiens
caagtagctgggattacaggtgtgtgccaccacgcctggctaatttttgtatttttagtagcaacgaggtttcaccatgttggccaggctggtcttgaactcctgacctgaggtaatccacccacctcagcctcccaaagtgctggaattataggcgtgagccactgtacccagccctaaaaagactcttaagattatatttaatttatttgaaatttttctccagtgtgatttggttttcaactaattcaactaaggtgctactggtgattaaaattagagtatttagttcctgacaacacaatatgaaagatagagattatcataataaggagagtaaattgtacatgtaggcattaaagaggagattcagaaaacagtacctctaatcattaggaaccctgaagggagtttaaaagttttgtttcatgtcttgttgttgatttcattcaatatttacttctcttttaatttctacatgcaggtttgactgtgcagatcgacagttccattctattcctgctacctggcaagctcttatggataatccatatgatgttaaagaacttattcctgaattcttctatttcccagagtttttggaaaatcaaaatcgtaagaaatagaggattaaaaatttgactagcaggtcccaatggaggagcctcaaaaatgtctttcaggacatttttgtaatatcctgtagattatttaagattcattctgtctgtggattacttagtgacagggctgaactaatgctatgagtcttaccttccagggaagtgctatagggaactaagccaaaggagtcaaatttgaatcagtaagagaatttatcagactacagtgtttactagggaagcaaaaatgaccatatgctatttcagctatatataccacttaggttaaaagtgtttgagttagataaggtgaggatttagactaaccatcagctgactacaggtctgttaaccaactccatgggcaaactcatgtctttatatatacagtttcactgaatacagccagtcaatttttttttttttt

SEQ ID NO: 98214 - DNA, 1401 bp, Homo sapiens
agtagatttaagtcaacttaagaagtagatttaagtacataacaaaatattgcagtcaagatccatgtatatagccagttactctcagtcacagaaagatttctgtttgctcagaaagtcttatattatttccaagaggaaaaactgagtacctattagggtatgccattaaaactgtcctcatgctgggactcattccacatgtaaaacttctaatagctaacatctgcccaaaaaggcacttgctttccagagcccaaacccagtcttaagaatcaaattgctctcggctttcggctcggaggaggccaaggtgcaactttcttcggtcgtcccgaatccgggttcatccaacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaggttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagatcgtcaacattgttcgacagatgcggcaccgatccttagccagagaactctctggaaccattaaagagatcctggggactgcccagtctgtgggctgtaatgttgatggccgccatcctcatgacatcatcgatgacatcaacagtggtgctgtggaatgcccagccagttaagcacaaaggaaaatatttcaataaaggatcatttgacaactgaaaaaaaaaaaaaaaagaatcaaattatagaatatttaaaatgtagaatcaaattattaaatattactacatatatttctttccctatactggtatctgaaattaaatcattatcttcctgatgacacacaggtttagattaatggaaattaatctaatggtagttttcaaagatgtcttgatctttttcagtatatgaatttagtgatgtagaatgtacaaaaaaatatatcatttattaactagatatgttcttaagcaatcactgtgtttgttaggtactttacctaatcttcatagtaaaaattcagctatcctcattttttaggagttaaagccaagcctcacagaaggtaatacctagcctataatgcctttgagaaattaaatactttttctatgtttacacaacaagaaagtgactaggattatatgcctgaccatctaactccaaagcctttctagcatgccatgtttcctctgaatgagt

SEQ ID NO: 98215 - DNA, 1086 bp, Homo sapiens
cagaatgcttaacatttatacaataccattagctaatccacagtccatgttctaattttgtatttccaataatgttctttacagctgtttttcccagtttatcttatttgtaatttttctctttttcttgatgtaatgtattatgttgagaactttcctaggtttgcaccatccttgaatttttataataaacccacatagtttatggtatattgttattacactttactgatgtatcttattagctagtactttaatgatttctctactcttaagtaagatagatctttttgttctgtctttatcatgtttagtatggggatatgcaatctttaccaaataaatttaggaagggctcctctttctcttgacttggaattgcttccataatataggaattacctgagttttaaaagttaaatatagtgcactacgcactcagactgatactcacagggaaagacaaatttgtcacaggtagcagagtgtcaaggggaattaatgcacaccacatggaacaggtggaaggtgtgggcagagttgtctaggataatcacaaatacaaatagcaactattcaaataaaacaaataacatacaactatgtgtatgctaaagacaaagcacgctaaagacatgaagaaagagtcttctggaagatgactcagagagcaattttttgcaatacaattgtgttattaggaaaacataagaatggcagttcaataaaatggaagatcaaacatgaaatgataaaatagcattataagaagaaaacgaaggttgcagaagaatcaagttgagattaaaaccagtaccattacatactccataaatatatatacctactgtgtaccacaaatgttttttcaaagggctgcagccaagacatatttaaaaataccattacaaacacaaataaacctgaagcagaaactacaagaaagaaagcatgtctctccctctccctctccctctctccctctgtccctttccctctccctctctccctctcccctctttccaccgtcttcctctgatgccgagccaaagctggactgtactgctgccatctcagctcactgca

SEQ ID NO: 98216 - DNA, 1136 bp, Homo sapiens
taaggtgggaggattacgtgagtccaggaggtcgaggctacagtgagccatgttcatgccaccgcactccagcctgggcaacagaatgagagaccctgtctcaaaaaaataaggttattcagaaatataacacaaaaagtttatttgaagttaaggaataataaatctgtagattaaaaggggaaataacatacttggaaaaattaacccaagactgtcaacattgcaaaaatttatgttaaggttttgagcttagttaagtttttgagatggagaataattcagaaatccaagtagaaatgtaagaatgagtactattatgaatagactcagtggttgtaactagttgcaatgttagtttgtgattagaaggtttaaatgcaatataaaccttgtgaaaaacaggaaacaagaaaccacctttacctttgcttttctcttgtattattagggaggtgttcctgtgggcttagcatctaaaccttttcagattctttatggacacaccaacgaggtactgagtgtcggcatcagcactgagctagacatggcagtgtcaggatcaagggtaagatttcacctttaagaaatactatttattttgtctacaaatttattaccaacacttataactaaaaagtttttcagaggaattgataagagtatagaaatgttataccatacttgtataggactttgcaaaagtagaatagactttgcaaaataaagaaatcactgaatgccattttgggattttattcgttttattatttaagggaagaggacattctaggaaataaaatactatttgaaatttcgaagttggaatttttcctaaggtgcatgtatccttgatggaataatcattttcttggttcctttcccacatttctttatctggcccactctacttttattcttttttgctgttcttttcctttgtctttttcattttctgatatatcctgtgtgtaggatggaacggtgattatacataccattcagaaaggtcagtacatgaggactttacgaccaccttgtgagagttctctgttcctgaccattcctaatttggctatatcttgggaaggacatattgttgtctactccagcactgaagaaaagaccaccctcaa

SEQ ID NO: 98217 - DNA, 1763 bp, Homo sapiens
tttaaaggtatctgttgcacacttggattttcaaaactcggtgaaagttacaagtttgcatggtaagaataaaataagaatattgaaactggtacattagctaattctattactacttagcgtgtttctaatgagaagttactgaaatctattactgtccttaataaaaattgagtagaaaaaagtggaactagagatacattttacagatgtatttccttaataatataattaagcaaaagtgctaattgtgattttgacagttgggccttttaagtagcatttgcagcacaatttgcatttgcaaagttccgaatttcttgactctttcttcactaagcaaatactgttttactctaataattaagagttagtagtacccaaatatgttgaatttttacttaggatatctgtgtgattgatgaatgaattgaaaagatatgtataacttaaaataatcatttatatatagtaatttaaaaatttctatttcatgttttaggattatagctaattttattatatagtgttaaatgttgtggttgattattaagatcttaaagtaaaagtctgatttatttaatttggaattcaaagacattgttaaacttagatttttttgtaagattatcttttgagttaggtcagagagcttttacaactaccagtgttattaatctgagatttcatgtgtttgggagaacttgtgaatccctctgaaattgtgcagagactttgtatgttaaatgcattttcaggaaggaatggttacatggctttctttaaagggatctgtttccagtaatagtattcttttttgttccacaaatcatagatgtccttaaatccaattgtcttctcagttgaatcttagagaaatttttcttttgcaatttcgctttcctgttgaccacagtatccagtgcccttttctttataatcttttgagtgagtaaaaaaattttaagaaataaaggattctgtttagggaaacttttgaatagatttgatttgatgtgagtcagggctaataaaaagctatagaagaattttctttccaataagtaaaaatcctctgttttattaaggaaaaaatagctatgttttaggtaaataactctgaaataaactggtacaacaattgtaaaatagaacatatttaaatgtcaaggtgtcttttcttaagacttcaggaatttgtattgaacaaagtctcaagttaagtagcaataattatgatgcataaatgagactggcatctattcatttattttattcttttttggggtgatgggaggtttcaatccagtgcttcacccgtggtgccaccgtggctatctttttttttatcttacagttttttaggagatttcaagtcggcagaactaacatgattgatttttagtttttaaaatactgatttttttagaaactttttctaaatcaaaacctactaagttttattttgttatttatccagagattttgatgtaaaaatgccttcatttttaagattacttaatactggatttgaaaattattttggatgcttataagttttctaaaacttagataattagaaaaaatgcctaagtttatgatgttttactatgctgctttttagatggaagaaataagcagtttttactttatagtacaaataagttttgttcacaataaaatagatatcctacctggactaatactagatgtacaaggtagtggaattatttcttatattgctttttccaaaaagtaaaaac

SEQ ID NO: 98218 - DNA, 1817 bp, Homo sapiens
tttgcaaaactttttgtatgcttttgtttcttgatactggtgatgacaaaaataaaaatctcagcatcctggtgataggaagagatttataccaagataattattttacttttggaaaatgagatcaagtattaaaacatgtaatagctgtgcacgcttagagaataaagaacctttataaaatttttttacaactgtttgcaatcagtattctggcattactcagataaaattgtaagagagaaagaaaaatagatcagggcataaaaatcaggaaagtatataaaaatgaagtttggcaagttggtttagtctttctttttagcctgtgaagctcacgtctgttattaagttaataacaaaattaaaatctgttaactttgtttaggtcacagtgcagtgcatccttttgtagaagaaaaaataccaagtgttcattctgtcattagcaaggaacaccaatgaggtttcttttttttctctatttagggcatattaaaattatccttcagagtacttgtattgaaaatcaagtttatgcttctgaaaagaataagtgggctctcagaattagaattcagatttgacggttgaatcttaagacattttatattttgtgtgaaaaggagtggtcaggggaaactgttaacttggataccagatttttatttaatgatgatagagatatgacctttgcctttatgtatattttatattgttactactaaagagaccactgaggaaatcttgtaattgaacttaaggaagttagctccttttatatatttataaaatgagtagcattatctttaccacctttccactgaaaagatgcaagtcctaggactatattaaatataaatattatattattaaataatatatgtaatatgggtgtctgttggggttatgtgtgtgtaaagattggtcttttcaaatatgtatatttaaacctgtcttctggaaacaggttcttgaacctatctttaggatacagtttttgactgggatataagaaatgaaacatgtttgtttgtttcctttttgtttgtttgtttgcatcatcagccatactcatggcttatcctacgcattgttcctctcatcagctgaaactgtttctccccaataagtgagcaatcttaaacattttcatcactctttaacaaaatccattctcaatattctttttgctgaattcgtatattgtatatgctcaacatattatttgttttaaacttgactccatccagagcattgttctatagagttttcctgtatttatcagagtcatgtggtatttttcttgatgaccttaggcaacaatatagtgttatcagtcatcattttaatatgatttaaaatgtggaccacagcctgccttctttagtttaaatctaggccaagcatggtggctcatgcctataatctcagcactttaggaggctgaggcaggaggatcactggagcctaggagctcaagaccagcctgggcagcatagtgggctccacctctacaagacattaaaaaattagccttgtgtgctggcaagcgcctgtagtcctagctgctcgggaggctgaggcaaggggtttgcttgagcctagagatcaaggctgcagtaagctgtgattgcaccactgcacttcagcctaggtggcagagttagaccctgtctccaaaaatacatttttttaaatttaaatctggcagtttctaggccagtggttcttaatggatattacagatcagacttctctgtggagtttataaatatacagatatgtaggcactgctttggacttcatgaatctct

SEQ ID NO: 98219 - DNA, 1622 bp, Homo sapiens
tcaattcagctactttttaaaagaagtcctattccaattggacctttaaaatttttattttggtaatatttcaacttaagatgtattaaaactagcaattctgtggtaatcagtgtactagtcaacattaaaatgctattttgggttgtcttcttttggtaacatattctgacactaagcaacatgttttacaatttagtgggatgaacctacaaattcataaatgcttctctttattttgaaggaaaaagatacttgtctgtatacgacataattgttttactcttcagaatgtgaaagttatattaatcactaaacactttaagaagtggttctggtaggatatcagtagtcagacttaattgaaaaactgtcagcgtctgttttgtatatagggattaaagaggataactttattttttcctttggaaagaataattcttttggaattttggaattttgattttcttagatgactttttagcaatttaatgataataatttctatttttcttccaaaactatggcatgttatagtagatcttactattaaagatcttttatattttaaactgtttttttcctattctgctttttgctgctctcaaagactgtgattgatgaacatcaccaaactttttttgtggcaaactgcttattttataagtagctttatataagaaaacttcttagaaaactatgtggctggttggttccatttagaaactcttaacaggtatggctttcattcctccagttgtttgcttttatagacttggagcaaaaaatatagcaaaaagtaatcatatctggctagatagccatttctctcagattcattgctataaaaatgaatctactgaggcataaaaatatgaaacatatttaattcatctcttttgtcagtttttctgggactccaatagcatttcagtgttatagagagtgacagtgacttgaatgcatgtatatgcacatagtcaattcagagcgtaataactaaaaattcagaatgacttgttttttgaaagtacttggaaattgtgctgctacttaaatattgaaggaattcagaaagttgtgtatttatcttaaaatgttccttctcacttattctactggaattgaccatgaaaaagaaaatattatgccttatttatatctaattattgactgtgcaaactgtgactcagtggatatttgtatgccccccaaaaacattttaaagctgagcaatttttaataaagatgtataaataattttgattattctcattgtagttaagttactgttagtttggtgcaatacattctttccttcctcatccttttaaaattaaatatataagatgtatgttttgttttattacattaagtgctatttttaaaaaattcattgtgtgtatatgagctaatacttgatttgtttctgtatagcatgattaaagataattgaaaattttgcacttattttaggcccttggaaatttgtattctaatactttttaagaatgtccatttattttgtacataataaattagctttgtatatgaaaatgggtttgaatcaaataaaaaaagtgatgttactttcttcagttgatttgtaattctcagttcat

SEQ ID NO: 98220 - DNA, 1025 bp, Homo sapiens
ggtaccagctgcatcaacgtcgcccgggagctcgttagagattcagattatcgatgccgggcgcggtggctccacctgtaatcccagcaccttgggaggctgaagcgggaggatcgcttgagcccaggagtttgagaccagcgtgggcaacatagtgagaccccagtctctacaaaaaaaaaaaaaaaaaaaaaaaaaaaattagcctacagtggtggcgcttgcctgtggccccagctgctccggaggctgaggctggaggatcactttagccggggaggcagaggctacagtgagccgagatggcacgactgcactccagcctgggcgacagggcgagaccctgtctcaaaaacaaaacaaaacaaaacaaaaggaaaacaaaataaaaagattctcgatcccaaactagacctactgaatcaaacactcggggtgggcaggggtagggggcgcgtacaacaatctgtttgaacagagccctcccggggacactgttacacacttaaatttgagtgaaaaccaccactgatctaagcgggacagggaagtgtctgggagtaaaacaagagtagatacgccttgtttcgcagaatttctgtctgaagtactagtaaatgtgattctttgacactttctggtgagcggaggctgcacactgttcaggtttccttgctctgttaactctgactttcggtaaattgcttcagttttctaagcttccatttccttctatgtaaaaaagtgaaaataataccacatggagttgcctgtaggttaaattacatattttatgaaaatcacttagcacagctcctggcaaaaccgaataagtgctatctacgtcagcatttggcgtttgttgccctgggcataaaataccctaggacccctctttctatttcgcctggctcagaagttttgacgtggctactgaaatacaagacaaggcctgctacttactagtgctgcttttagtgaaagtgtgctaaaagtatttatagattttatagctttaataatat

SEQ ID NO: 98221 - DNA, 1059 bp, Homo sapiens
actctgtttttattccataggtatttaataaatatttggtgaaggaaggaatgacaaagagactctgagaggtttctgtcactgaagtatgtttaggacttttatatatattcatatgtttattgattattatgtcacaggcattctgtggcagacttttcattatttttaattagataccaagagtatggtcttttaatttccgttgggtttaagttttttctatctttgagtttttaatttatattttctgtttttattgtcgtgatagtggttctgttttgttttacatatcagccctttgccagaagttgaacctgaaccattgaggatgcaattataggtggagctagtgttagtctgacagattcgtacctgaatgttgactttggttacagagtttaactgtttgccattaaatgaatctacttagtaacattttctgagatttagaaagaagaaacagtaatcattgtgcttttctgttctctttcagctttcagaagaattattagataaatggctctcctacccagagacccagcacgtgcccctcagccagcatatgcttggttttgctatgaagtctgttacacagatggtaatgggtagtacatttgaagatgatcaggaagtcattcgcttccagaagaatcatggcacagtaagtctggggctaaatttaaaattactctttcaggctgggcacggcagctcacacctgtaatcccagcactttgggaggctgcagtcaggagttaaagaccagcctgccccacatggtaaaaacgtgtctctactaaaaatacaaaaatcagctgggtgtggtggtgggtgcctgtaatcccagctactcaggaggctgaggcatgagaatcgcttgaacctgggaggtggaggtcacagtgagccaagatcatgccactgcactccagcctcagtgacagagtaagactttgtctcaaataaataaataaaattattctttcatcattagccaggcatggtggcatgtgcctattgtcccagctactgaggctgaggcaggagggattgatt

SEQ ID NO: 98222 - DNA, 1050 bp, Homo sapiens
cacattgaatctttttaaaaatattgaagcctgactcctacctgtaaacattcagatttaattgacatgacgtgtgacttgtgctttactgttgtttgaaaaaacttctcaggtgattctaatgtgcagcaaagcctgggaacaacttctttatagtgttaataatttcttattttcttttctttttttttgtttttttttgagactgaatctcgctctattgcccaggctgggtgagattgcagtggctcaatctcagctcactgcaacctctgcctcccgggttcaaacgattctcgggcctcagcctcccaagtagctgggattacagacgcctgccgccgtgctcaaataatttttatagttttagtacagacggggtttcaccatgttggccaggcttgtctcaaactcctgacttcaagtgatccacccacctcggcctcccaaagtgctgggattacaggcgtgagccaccgtgcctgggaataatttctcattttaatcactaatgtgtattatattgattcaattctataaatatttaatgtagatctgtgatatcctggcatgttttagatgctgaggaacctaaacaaaatttcttgcccttgtggcaccacattctagtgggaagagacagacagtaatctaaataagtaaactgaatagtacattaaaaggtgaaaaatgctgtagacaaaaataaaaccagaaggggatagggagtgccgggggttgggagattgcaattttaagtaattattaggaaaggcctcaccaagatgaggtgacttttgagtaaacacttgcaagagatgaaaccactcatgcagaacatgtggatacccagatgttcaaaggaagaatattccatgtagaggaaaagtaattacagagtccttgaagtaggactctgctgctgtatttgaagtacaacaggaaggccagtatggctggaatgaagtgagtgagaagaggagcagaagatgaggtcagaaagactggagacaggaatgggttttgtatggcttacagaccattgtgtga

SEQ ID NO: 98223 - DNA, 1050 bp, Homo sapiens
cgtggtggttcacacacctataatcccagcacttcgagagattgaggcaggaggatcacttgagcctaggagttcaagatcagcctgggcaacctagggagaacctgtctgtacaaaaaactgttaaaagtagctgggcctggtggcatgtgcttatagtcacagctactcaggaagctgaggtagaaggatagtttaagtccaggaggtcgaggctgcagtgagccttgattgcaccattgccctccagcctgggtgacagagcgagaccctgtctcaaaaaatggaatatagtaagaaacagcaatagactaaatatatgttaaataatttgggaacataaaaataagtggcatttaaatataatgtaagagcactttctattttcagttgatttttaactttgttacatacttgtgttcttttagtgtcaacatgtaagatgccagtggagctatattgtgattaacctcaaattttctttgtaggtttgatccagatcggtttgatgatgaattagtaatgaaaactttttcctcacttggattctcaggcacacaggagtgtccagagttgaggtgaataatagaatgccagactctgttcttagaattttgatgatcactgttgatgagaatgggcaatctgtatgattaaagtattatttttttattattattgtactttaagttctggggttcatgtgcagaacgtgcaggtttaaagtataatttttaatctttagtaactaattgactttcttcctgactaggtttgcatatatggtgaccacagtacttcttagtgtattggtgaagagactgcacctactttctgtggagggacaggttattgaaacaaagtatgaactggtaacatcatcaagggaagaagcttggatcactgtctcaaagagatattaaaattttatacatttaaaatcattgttaaattgattgaggaaaacaaccatttaaaaaaaatctatgttgaatccttttataaaccagtatcactttgtaatataaacacctatttgtacttaatttt

SEQ ID NO: 98224 - DNA, 1011 bp, Homo sapiens
aaagcattttcatgtcttagtgtaaattttaaaaaacaggtgttacaattttataggttcataaattttgtaatggccacattgttgatcgcggaagtgagattttgtttgattagacatactgttatcttgtagacaacatttgtatttgagaatgacccgaaccactgtataaacctgttccttcgaaagaggcagttgactatggctactaggaaaggaatgtaggcaagattaatacaaaaaaatacaaatgtccacttgtaatgtactttgctgatacaagtggggtagaaaagattcagaggttcaggcctgggcgataagagtgagactacatatcaaaaaaaaaaaaaaaaaaagattcacttgctcaatttttcgctaaaattgaaagtcttttatggcctagaactgtgtgaggggtggatggtacatacctagtaggagaggctgatcttggaggaaattaataccatgtagttaatttatactctgtagtgcactgctggtaccaaggaggactggaggaagcaatgctgttctgagggatttcacaatctctagtagaggcaaaacctaaaggaatgaagtggtaattccattgccttgtgcagcatattatggggaaagagttgcaggtcagaagagaaactgagggtggaaaagtggattgcaattattaccagtaagaaataaaaaataaacagatttctctctcttttgcaagatgatttcttattgtaatttgaaggtacaagttcctcttaagttataattgctatataaaggtaaaaggataaggattattaaagctgaaaggttaaaggcatcagcagttttctttttaaatattttatacatttccttcagttgaaaagagaaaaacgttactactatcaatctctgttttagcaatgggactcaaaatttagtgtggtgacattttaaaatttaaagcataaatattgattaatattaatttaatagaaatgaacttagattttaaaa

SEQ ID NO: 98225 - DNA, 1041 bp, Homo sapiens
taaaggtttatgaattacaataaacttacatagtcatgtaaccaccacaatgtaaaattttccttgtaccctctgtagtcagtcctgtccctccactactagcctttggtaaacactgatatattttctgtccctctagtttttgccttttccagaatgccatataaggggcattatgtagtatatagccttttgtgtttgacttcttggtactagaagtcctaatacatttgaaaatcatcagtgttattgtgttttgtcagtactttgttccttcttattactgagtaatattctagagtatgaaagaatcataatttgttcatccattcaccaactgatggatttctggattgtttctagttttaggcagtggtgaatatggctgtaaacatttgtatacaggtgttggtgcaacctaagtcttcactcttttgggtaaatttaagggaaaagatcaactgttgtaccctggtaacagtggatgtatccacataggctgcataggccagtgcttgaactgcatctgatctgaatcttggccgagcactttgtgatcctcttggaatataagattatggaagtttgcgaggaccttatgtgaagccctttctcaatctcttcatctgccgaggaggctgtacgtgataacagtgcctcatcacctcctagttcccatgagatgaggctctctattgtacccttttaggtagtagctgcaggctgtaagactttagttgcagcatggcattggctcctccgcaacagagtgtcatatctatgttgtagtcacctggctccttttgttttagtattgctttacacaagggctgtatcttttactactattccttctgccctccatgtaaatggtaggctttctgaacctaacaagcagttgggcaggtctatcacattgccttctctttgccttgacaataaatatctaatagtgggattattaccgtatggtaaatgtgtgtttagttttatacaaattgccaaactcttttccaaaaacgatggtaccgttttgcgttc

SEQ ID NO: 98226 - DNA, 2403 bp, Homo sapiens
tgggaaaatttattcaaggctaacaactgctaatggaatattttagaatacctctagaatctaatgccaaaaagacacttagaatataaaagatgacatttgtgtttgcccaattacataagaaaaaagtaatcccatttttttaaaatatataattcataggtttacatcccccattcttataatcctcaaagtaaaatgtttttctttcaggattctagccccttcattttttgactttcagtgtttaagggtcattaatttgaagaaatctttaatacagttaaattgtggaataaaacagtatcttaaattcatcagagaaacttctgttcatgacacattctgctttaaccactctttctatgatctactgaaacattattttgttaatgctgaatgcttaacttgttttttctttttttcctttctcttcacatcctgaagtttcaactaacctttcaatgctttttttccttacctcttttatttgctccatttatgcattaagtggttgcttagatttaaggtaagagattccagggctggatttccattctttgttcttatgtagaatattacatatggggagttaaagagattgttaactcttggccttttaaaacccaataaataattcctcctttttgttttattttttgtcatgcaactttgtggtgtgtcttcatgttccttgagggcagatatttttgtctgttttgttcactgctctatccttgtgcctagaacagtacctgacacacattaggtgcttagtaaatatttgttgaatgaatggttattttgtaatgttaatatattttgtgaaactgaaatgtaagctaccctatcataaaaatgttatgaaatataattagctggatttttataaatatagagactttgttatgaattggagggccaattaatgtactttatttaaccctccccctgtgtaatagcctttttattctataaatggtatgctttctgatataccttatggacaatatgtcattatcttttaatcagtataaagaaattgagaagcagaaaatattcagtgacacgggttttttttttaagttgcagtatcatattttgtagaaaaattattcttttttccaaatagctgtataaagaatatatttcaatataaactgtaagagcttttaaaggtgaatataattatatgcaaaacatcaaaagctcatgataatgtttaacagaatatcagttaagaattagagatatttcctgttagaattcgtttcaataatgttttggtatcgtggaggattcgtgataaaagaaattcaactatattcaagaagcctgcctaaaatacaaggttactacaattatatacaaaacttagcatgcatttcttctttgatttttttttgtaggtgagttttatagtttattttcaaatatatattcctcccatctaatacccattatttgccatatctttagtgtagaaagtgatgacaagatgactgagctctgaatcattaactagtactaactaaggccacacaactttcccctgcccgtggtaggtagatttgattggaagagcccaggcatatggacacctgtattattgattggattgttggttccaaatcctcagtcatggtgagtaagatgtggaattgtgaagaaatccttttgcttgaaataggtgggttgcagtgaactagaccaaaagcagactgtggctgctttggcccttttaccctaaagtctgtattcaaattttgaccattgatgtgttaacctccaaagtgatagaaatacacggaaagtttaattgaagaaaaaatacagaaacacacagattctttacccttaaagtttagactagcttgcccaagctactatctcatgcttgttttctctaagccccagtatgattccttcttgatgttcctgcgtcaggatctgtttccattgtgagagacaggccaaacagagtctcctagaaagatctaatgaagaatcacacttagataagatccctgagctttttggagacctgtggattctagcaagtgtcttagaagtctcctgatgagcaatagcattatggattccttatcctcattttaatcagggtagctgattaaatgttcaaaatttaaaacctatttaagacctagtcgtttttctttctacttctctttttctctttctcagcactttttgagctctgtctttgctgctcccattgctgtcatactttttatacttttcagacagtctccagagaaagtcatcatactttaggaccagacatgtgggatttgactcagaagagacctccttgtttaaaagtttaacttttactattttatacagcatgtttgatgcttaattgttcttgacatctgaaat

SEQ ID NO: 98227 - DNA, 1046 bp, Homo sapiens
ttcttgcctattcaaataacaggtagtattttaggattttaaaaaattccacttaagccagggttggttttgatagcctcacttctctgtatacaattatgatttgctttcttaaaatttatattctgaagttacagttataaatgtattctgatttcaatggtatgatgtcttgcaattttatttagaaagtataatttgactactctagccatattatttttagaaaagttgaggtcctttttcaaaatatgttttgaagatggaaattcaaaatattagggtcttaaaatagaatcacatatgaacctgtgtggtgaacattaacccattggtagtctcaacttgagactgcatttgaactacacttgtgagtgatttttcttagctttttgagatagccagggctttctgtataagtgctaacatactcctttggtgacctccattattcccagattatgcatctttcctacacttgcattttcagttggggatagaatagtgagtggagttacggtccagctctgacttaggactatgttacatctttctcatgcctgaattcaccttcagtttgggcccaagtgggtccaattcccattggaactaggacattgcctgtggcccttgtgctgctcccagttgaatgggatacctcagccctaactttctggttcagatgtttaggaacatggcttgaacttctagcagttttcaggtaggtggttccctcataagaagatactaactaaatctgacttataaggctggcccacaatttaaaaaactaaaattttctgtatatattacatgatttatctttatattctctagttacagtggatcatatgcatagttgcatatttttatttgggaaatgtattttgcttatgatatgcttactatctaaagaaagttactggccgggtgcagtggctcacgcctgtaatcctagcactttgggaggccgaggctggtggattgcctaagctcaggagtttgagatcagcctgggcaacacggtgaaaccctgtctctactaa

SEQ ID NO: 98228 - DNA, 1059 bp, Homo sapiens
gtagagtaatagtagagtagagattgcatatgaaatgcatggcctctaatttttttccctttatttaaaccttcccctcctttgttatgtagtgtagcatattatttcccaaaagtgccactttatttcactgcatacaagttgagttttccttaaaattttttaggtgagtacccagaacatgaagatgggtgggctgccgcgtacaacacctccaactcagaagccccctagtccccctatgtcagggaaagggacacttgggtgagtatataagtagtaattgaaaaccatttcatgtagtattgtttaaaaatgaagcacaacatatttaaattattttttgaatatttgaagagagaacattttctttgtaggattgttgtttgtgtgtataacttcctcttctcttgggaaacacatttttatacttcagaaagatttgtttagaaattgtttttctagtgaattttaaatttgaggtaaaatcctagcccaagttcatagtttattgtaaattgcagtctaattttaattccttttctttcagaaaatgtatatagtcttttatattacagtttaactccaactatcctttttaagctgtgtagattataaaattctataaaacttataagaatattgagcttcaggccaggtgtgttggctcatgcctgtaattcccaaagtggggattttgagagaccaaagcgggcagatcacttgagcccaggagtttaagaccagcctgggcaacatggtgaaaccctgtctctacgaaaaatacaaaaataagctgggtgtggtggcatgcacctgtagtcccagctacttgcgaggctgagacaggaggatcacctgagcccaggaggttgaggctgcagtgagccgtgatcatgccactgtgctgcagcctcagtggcagagtgagcccctgtctcaaaaaaaaaaaaaaaaaagaagaatatggagctttattttggtcctagagttgggctctagatttgacttttggcaaaaatggccaattaatggaaaagcttgacttttttcttctag

SEQ ID NO: 98229 - DNA, 1097 bp, Homo sapiens
ataaatattgggaagtctatatatttgttatttgtaagcaagtgatttgtaagtgtttgctcactttgcacttctctttatgcctttggtgatgtggctcagttgctgctttgaggtttcagatcacactttgttatgagtacaagtttaattccagctagtgttatgacagtgcagtctttggacacagtgggaactcagtgtgagaaccatattagtaacaaaggattgggcagatataaaaagtagttttgacagttaaatttagtggctgtattggaatttagtagtctctgaaaatactaccctcttttctctgaaacagaaaaatctgcttatttgattcgaggagatacacacttaaaacttagttttgaaaacgtgacacaaaatacattaatagaatgttacatacttaatttacttatagtaacaagtagataatgccttttaaaaatcataaagatttgtgttttaaaaaaaatttttaatctgataatatggaatatgtctattttctgatttgtgtaattcaaaatggaaaactgttgttttttagtgtattatgttagttttgtatactatatacagaatgttatgctaaaaataacaatacgaagggaacacttttcttctggagtagtgctttcaattgaaaaggaatgtttgtttttaatgaattgaaaaaatctgcacattaccctgagcatcttgaattatttgctgcttatatagtaatcctttagcataagttttattctttttttcaactctgttcttttggttagtgttaagcactgaatatctaacattaaatactctaataccttttctaatcctgcctcatgtgattgcctcattaatgctgcctcttactcctctttcccctcagcccctgctggctctgctggcactcctccccttcctgctacttctgcatctgcccctgctcctcttgttcctgctactgtcccttcctccactgccccagacgctgctgctgggggtgcccagacccttgctgatggcttcacttctccaactccccctgttgtttcttccactccccctacaggtaagtatttgcttattcattg

SEQ ID NO: 98230 - DNA, 1024 bp, Homo sapiens
attacaaatagtgcatggtaggtggttagcaccatttgttgaatgaatgggagaatgaatgaattgtaggttgttaatactgtatctttcaattctttaaaaaaaaatcagtatgtgatttccacgtaaagtcatacaacttagtttttctgagcagaatttttttgaatattttagtggttatttgctttttaaaataacattgtggtgaatggtatttcctttttatttaatcagacatccttacttttaaataacaaataatgaaagttgtgtgcacatgaacagaatttagaagtggcaaaggaaaagagaacatttttgaagctactttgtgctagggaattatactagcttatacaattctcataccaaacccatggtggaaaaactaggaattgggtaaattgaatcagatataataattacactaaataatcggttgtatcatgcatgcagaataactaatctggaacatatttaataattattattttgtttactccccagagagggcaagaacaaatattagacaccatggctattgtggacatggtatgtcaacttactgcttttttctgtatttttgccaggaagccagtaagcctatgtgtgaacacctctcatactgggttcaactcattccatttttgataagccttgaattttatggagctgcagtttgtctctgtggctgtgacctatagtgatattctttgaaagagtcttgcagaagaaatttgatcctccaacataaacacttaatttaaataatgtttttatattatctcatttgattcttagaatcacgtacaaaataagattggtgatcattttcttatatcttataggtaaggaaaatgaggctgaggtgatggtcaggttaggatttgaacttaggttttctgactctaagttccatgttctttctttctgttttttttttttttttttttttaaattgagatggagtctcgctctgttgcccaggatggagtgcagtggtgtgatctctgatcactgc

SEQ ID NO: 98231 - DNA, 1153 bp, Homo sapiens
catccattgtctttttttaatctttgcagccactattggaagtaggttgcattaccttgttttcatatcacatttatggaataggcctgaagaagttaattgactagctatccaaacagccaggaaatgatggatcagagatttgaggctgagtgacctgaaaatccaacctctttccactaagcactcttccaccaggcatataagatccttccctatttcatatcctcccattgatatttctgggttttttactttctctttgggtatcttttcctagccatatggaaacatttctggtcctgtgaactggttatgctgttttatgcctctgagcctttaccctcacttgcttctctcaacttgattatctttctcaacccctgtcagcttggcaggttcccttcttcaagtccctgctgagaggtcatttcattgtagccctccttacctccaccactacttccagggaattgctacaaatattgttgggttaagattatcatgtattcttctgtttcaatagaatgtgatctccttgagagcagagacatgttcatctttttagttttattagtcttaactgtattttggagctaacagaggcattttctctttataagaaaatgcatatcctactttgtacccattctaaaggaaactgtaactgtagagtaatcttttttctttcttttttttgccgctttagtttccacacatacctggcttattagtgcaattatatatgttaaacatctgttgacagtttattagttctaggcactgtgccaggtgattgaggtgcagggaaatacaccttgggaaggagagtggaatgatttgattaaggcctgcacttttctataccatcagggaggaagtgtaccaatgagttgggattatgaaaaattgtaatgacatagcacccgattctcagaggacggttttgatactgttttcctagcaggtgtttgccacttacttagtatgaagtcagtaagtatttgtctaattaatgaatgaagaaccagtttacttgcctacaattagagtaataaaagtatccatttagagtgttgggatgtaatatttttttctctctgtattgacaaacatttaaacttgtaaccttccaaggtaaaattcagaaaac

SEQ ID NO: 98232 - DNA, 1182 bp, Homo sapiens
tcattttgaacaaaagtggttctgagcagcttctggagtaaaggccagattttgaaactgacattgaagactaatccattaatgaaacacgaatgtttgtatagcaactaagtggttattttcttagcaaaaaatgagacttgaaagttgaataggatttaaagcaggatgtcattggttttcgccagtcaccagtgaaagctgcaagctttgtagaaacagcaaaatgtttcatgaaccaaacctaagaagtattgttttaatttaatagtaaagtgcatgactatcactttaagacttaggaatgtcttaagtagatgactgcaaaacattattatagcagcactacctatattttaaaaagtcattccctaatttgaccaccctatcacagttgattgccttttggattggtctttttcatcttttcctacaatcatatacgtttctcatttacacaacgtataaaaaaattgtgtatgaggtgtgctgtgactaattttacagacgtggcaggacttaaacattagtcaaataataaacattatttgaatgtttaagtctttaaactctttaaaacattcaccttggaaaaatacatacatttcttttggtacatcttcaaagataattctttggaattatcttcaaagctttccaggtatattattttgaagatattccttggtagcaaatactcactctgcattaagtttgatgtttggaagaagtctggaataatttggaaccagttatagtgacccagttatactggggtaagaagtacagctatgaccctgttattccccttaaaatctttctgtggctcaccatggctctttggatagagtccaaactgctgtaaggcccttcctgcctcatcctcttcagcttcctgaagctggctactgaatttggacagttctttgaaagtttcttgctttcttacctttgtacttgcattgtctttttttttttttttttttggagacagtctcactctgtcacccaggctggagtacagtggtgcaatcttggctctctgccaccttcccctcctgggttcaagtgattctcatgcctcagcctcgtgagcagctgggaatacacgtgtgcaccaccatgtgcgtctaatttttgtatttttagtagagacggggtttcgccatattggccaggctg

SEQ ID NO: 98233 - DNA, 1051 bp, Homo sapiens
ccattaactcttactcttccttcaggtttcaggaagcctttcctgacccacataacaagtgtggtttatgctgtgtgcttctatagtatcttaaagcacacactacactcaattgtaaatgaagatttggtcgttcatgtcttcatgacttttgcctactgcccttttctcaatgctgagcataatatccagccatattagttaatgtttgttgaataaatactaatgaagcatgacttgaagtttttaaaatttatcccatcccataatagtgtagcttttaagataataggcattggagttcaggtgcttttccacttacttgctgtcagaatacttaatcttggaaagccagtctccacatctataaaatgaaaaacaccacctcccaatataaagatgaaatgaaataatgcattacaaaggactagctgagtaattggaacattttaagtcaaaagtagtagcttattaaactggcagttacaagaaaagtaaaaatgaccaatggcagcatctttgagtaattttgtagtgtcatttctcaaggttattgttttgaaagttcctttggatctatggttctgtgcagttgtttaaagtcagtctttttatcttacaaatggaaataggataaatttctctttctcacccaagtatatggtaaatcacatatctatatcttttgtttattaataaaaactattaggatgaaagacattctatttaatgactgaagttttaaagtttataaagtagatcagtatagaggggcacagcagatgggaagaatactgataagacagcatggtgttgatgtggctgctcccaccaggcatcagcagtctttgaaaatccatttaattcaccgggcgcggtggctcacgcctgtaatcccagcactttgggaggccgaggtgggcggatcacagggtcaagagatctagacgatcctggctaacacggtgaaaccccatctctactaaaaatacaaaaaattagctgggtgtggtggcgggcgcctgtagtcccagctacttgggagggtgag

SEQ ID NO: 98234 - DNA, 1036 bp, Homo sapiens
tgggcgcccgtaatcccagctactcaggaggccaaggcacaagaatcgctggaaccggggaggtggaggttgcagtgagtcgagatcacgccactccagcctgggccatagggcaagaccgcatctcaaaaacaacaacagcaaaaaaaaaataaacaataaaaaataagaataaaaaaacccagagatcagtacaatacagctgagctttacactgtattcaagggtaagttatcagaaatactaacactgaaaaccatatttcacaaattcttaaaatattttttcacttaaatgagtccagggaatagtaaaattttaataacccactactttcctcttaatgaatttttctaaaatagcattttaccaaattcaagaggaaaaaaatcatcaacaaacttgggttacttcatctatgaggatgtttgtttacttatagaatttcttctaattcagactataattcagaatttcttcaggctaaatgtccaagtgtactatcagagtaatttaaaatatctcacatggagatctgcttccacagcttgcataccaatatatagtaacatcaaaaagattatcttcaaactcagctaccttaagctttcaaaatggttggtaaatacgtgagcacaactgaacagaatgaaatgaataaacctgtttatcagctccccaggtttaatgaacagcactaattcttatttatgaggtaccagtatagttcccatgtgactctctgagcaatccaatttatttagtattttttaatctaagcctacgaattgaattaaatggatttttttttttttttttttttttttttgagacggagtctcgctctatcgcccaggctggagtgcagtggtgtgatctcggctcattgcaagctctgcctcccgggttcatgccaatctcctgcctcaccctcccaagtagctgggactacaggcgcccgccaccacacccagctaattttttgtatttttagtagagatggggtttcaccgtgttagccaggatcgtctagatc

SEQ ID NO: 98235 - DNA, 1066 bp, Homo sapiens
actcaggaggctgaggcaggagaatcacttgaacccaggaggtggagcttgcagtgagccaagatcactcgccaccgcactccagcctggcaacagagtgagactctgtctcaaaaaaaaaaaaaaaaaaaatctagaaagagagccagttgcatgtagtggctcacacctgtaatcccttaaagtgctgtaaagcactttaagaggctgaggccggcggattgcttgagacgaggagttcaagaccagcctgggcaacatggcgataccctcgtctctacaaaaaattagaaaacttagccagacatggtggtgcatgcctgtagttccagctactctggaggctgaggtgggagcatcacctgagcccaggagtttgaaggctgcagtgagctgcgattgcaccactgcctggggacagtaagactctgtctcaataaaaagaaaaaaaatatcgagagtccctataaactgtctgccacccacactgcttagaaaatctcaggtaccctgagtgataaatgtaatcaattttaaagatgggtgcactaactggggcggtgactatgatgatggagagaagtcgagtgttggtatttgggagatttagaaggtggaattaacaggacttggggatgtcggggaaggtgagtgaggggaaggcaaagatgactcctagtttcctggctccacagaagcgtagtaatcagataactgggagaagacactgtcatggaagccatggaggaaaatgtcaagaagcaggcagaggtaatcatcattgccaaacactacaggaacattagacaaagaactgagaagaggctcaaaagtagaaggccagtttttttcaagtgaatagtttcattggagtggtaggggcagaaggaatatggctgtattagttaagcagcattattttcattgaaacagcatctccagtgggttctaaaacatttcttagaatacattaagtggtttaaccaactcttcattgatagtgtccaggttaactttgctctacctcaggacaggttataacataaattccaaagtatgttaaatg

SEQ ID NO: 98236 - DNA, 1474 bp, Homo sapiens
gctgaggcaggagaatggcgtgaacctgggaggcggaggttgcagtgagccgagattgcaccactgcactctagcctgagcgacagagcgagactccgtctcagaaaaaaaaggacccagatgattttttctctcctaaaatagtaaattgaaacaaagaggagcaatctaaacataaaactctctacactataaactcctggaggtaagggcccatcactcatctctgtgtatccctagcgcctaacacaaggcctagctttttggatacttctaaatacatctatattctatattattcagttacacagtgagtaataaaggtaacttaaatacatattgggggaaaaattaaggtgatactaaaataacaatgtaaaacaaaaaggcccaaaaggagcatgttacatagaagtgactgatctgaactaaaaagactgaccaccaaatattgtagggtattagcaaccacacctaacaattaagtaccctaaactagcaagccactggaaaaatcaaaatgctagtaagattatccatttcaatatactgtttgtattaaattacatattgtgagttgacatcattttatttatatggaaaaaagttcatcctaagccagcaaaacatttaacatactttggaatttatgttataacctgtcctgaggtagagcaaagttaacctggacactatcaatgaagagttggttaaaccacttaatgtattctaagaaatgttttagaacccactggagatgctgtttcaatgaaaataatgctgcttaactaatacagccatattccttctgcccctaccactccaatgaaactattcacttgaaaaaaactggccttctacttttgagcctcttctcagttctttgtctaatgttcctgtagtgtttggcaatgatgattacctctgcctgcttcttgacattttcctccatggcttccatgacagtgtcttctcccagttatctgattactacgcttctgtggagccaggaaactaggagtcatctttgccttcccctcactcaccttccccgacatccccaagtcctgttaattccaccttctaaatctcccaaataccaacactcgacttctctccatcatcatagtcaccgccccagttagtgcacccatctttaaaattgattacatttatcactcagggtacctgagattttctaagcagtgtgggtggcagacagtttatagggactctcgatattttttttctttttattgagacagagtcttactgtccccaggcagtggtgcaatcgcagctcactgcagccttcaaactcctgggctcaggtgatgctcccacctcagcctccagagtagctggaactacaggcatgcaccaccatgtctggctaagttttctaattttttgtagagacgagggtatcgccatgttgcccaggctggtcttgaactcctcgtctcaagcaatc

SEQ ID NO: 98237 - DNA, 2081 bp, Homo sapiens
tgttacagggcatcccagtataactaaactgttgaaattgatataatacttgggaaccagagattatctggttgaaataagataacagttgaaataaccactgagataatgactcaaagagccaagttaccaagtgatttaagcaatgaaaatcacaggagggcttataggtatctgattttcttgtcacttttagtctgttattatagttatattaaattggtgacatagtgcagcatatgttttgaaaaaatatatgtagcggactcccatcattcatacatttaacttggggaaattgaaccaccattctacttagcgaagaggcataggctccagagagagtgagaaaggagacagaaatctgctgttccattagtctggtttctcacttgactctcatagtgtatctcattgccctagtataattctaaggtaaagaaaagctttaaaaaaaaaaaaaaaaaaaccacaatatggtatctcaacacaaactcaaatgaagaaacagccatctttcttgattctaggattgtgtacctcttcaatgaggtacttccctgtaggctcttaaaaggtcatcaaaagcacatttgattaaatgtgctttttccccatttgtactcaatttagagcctaacatccctagaaaatggaatttcattgtatatgactgggtattacttagaaaaaaaaacatgtaagttttggttggtgtttagaaagtcaccatgtttgagtgctacaggatttgggaacagatagctattcactggcttggttctgtctttctaggaatattactgtctttcacatcctgttttgttttcttccctcctagttgtggcaatttatgactatacaaaagacaaggaagatgagctgtcctttcaggaaggagccattatttatgtcatcaagaagaatgacgatggttggtatgagggagttatgaatggagtgactgggctttttcctgggaattacgttgagtctatcatgcattattctgagtaaagctcagcagggctgtgcttgcctcacaggaatagtcaggtcttcccagattatctgaaggccctggggattccactccagtaaagtagaatgaaggatacaaatgataaaaattacacttttttttttggtttattccccagtattaaaaacaaagcaagctgagtctgaacaaatggatctttctgccatcatttgtacaatgctgagctgtctggattgaaataaaatgaccatttttatgtatgtcaaaggtataacagcataactgtgtagccaaaacaaaatcagattaagactgattcagaaaaatctgggatctttctcaggaatactgtatacccttgggatttctcctcctgcagaatctgtggcattggatgttcttcattgcctgtgctaaggggttaacctcatggcccagtgggtaccctagccccttcttttcttccacttgtatgaagaggagggaaccaacatttaaataccacacttaaccatttttacaattatttcagatggcttttttcctctgtgacactgtaaattctgcattctctcagcacttgagtgcaccaaacgagtgaatgctgaactcacttgcatcccttcatgtttctgtttgtggattataaggatgatgaaatgtgaaagtctcccaacactctgagggtggtgaacgattgccacccgtttgattttaatgtgctgctgcatgagactgcattgttgctaatggccagtgtacccagatgtgaagtgtggtaggctggttcatatgtggaggtgggtgtgtgaagctagacacgaaggtccctaaggttctgaagagacttgaactgtggaaatgctcttagcaggcatcccgaacccctgcttcggtgctgttttgaggagtaggatcttggagttcagaccaactatgactatcatttccttcactatctagaaaaacgctattctactttggaagagaatagtagttattttcaagtctcctgacagtcactgggagtacaaggtttgctaatgtgctctctggacgttattaatggccagtatta

SEQ ID NO: 98238 - DNA, 3205 bp, Homo sapiens
ctgaaaaaaatccaggagggcttgtctctttgtgggtggtcactgtgatgttgggccagctcctgttcaggtccagagctgctaacgtgggttctactcagtcccagtgacttggccagaatagagctttgccaggtaactgccctgtgctaggtgaaaggggaaaagcagtagctggatatatttcaaatgaggttttgaacaagttcagaaagtggaacttgattgaaaagtgaacaagtgtagtagtgtgtgagaaaattcagatggtgtcggatgcagaagttaatattccacttaatgttatctgagcattaaaaatcatcagcatttaactgagaccccactatagagtttccttatcaagactttttggttttaaagttgtttttaatgcattgcaagttacaatagctattttgcttttagatttttcccagcactttgtatttattagctttcattaacttgcctccagtatacattccacttcgtgcttttcttaggtcatttctacatcccttattccttgttttcctgcagtgtaatggccctgaatgtcctctgagccttcagctccattatggacccaaactagactatacttggataagttaagctcttcttcgtgtactggtctataattagaaaaactgttttaaattagatgttcccattatttatttaaacagctttttgctgagaaagcttagtggattaatgaggcagagggtgttttgaaatccaataaatagttcccacaggctgggtgtggtggcttatgcctgtaatcccagcactttcggaggccgaggtgggtggatcatgaggtcaataaattgagaccatcctggccaacatggtgaaaccccatctctactaaaaacacaaaaattagctgggcgtggtggcgcacacctgtagtcccagctacttgggaggctgaggcaggagaatcactggaacctgggaggcagaggttgcagtgagccgagattgtgccactgcactccagcctggtgacagagcgagactccatcaaaaaaaaaaaaaaaaagttcccacagctcaccactacagaagcagggaagacaactatgcagaaaacagagttagtggcggtcagcaggaatgcagctggtcttttggacccctacgggatgggggcagtgcagaagacactggtgaagtcctttatactgaagacctgtggttgggagcaggggtagtccatgggtctgctgattttttttccctatttagtactaatgtgtgtgtgatctttgttttacaaacagtaccttttgggttttctgcatattttataatttttgtacagttttgaattctatagattgtcttggaaggatactgtgtgatgggtcaggcacacagtaattggagacttttaatgtatgtaatatttcatagattgcatgctattaatcatctgtgagggtagtattttttgttttattgtaagtttccctctttttttataaattaaaagatggttggtattaggaatttcaaatgaatgcagaaaatcttacatgctgtgtactattaatattataacagacgatccaagtccaaaatctgaccaataaagcaaccattttatcaagatagagggattctaatgggagaggggattcttccctcctgaagtttgtgtgtccagtccccttaaaaaaaatgaatagttgtcttttcttgtcatattaatactcgaaagtccatggtggtattaatgaaagtacactttattgttgcctttgaacttacggccaaggcaataaatcagaaacaaaaatagtgccaatgtgtcaaaatcgacatctgagagattcagcctcccatttggaataaatatgaatcttctaagctatcttgtttaatattttccatcatttagctacttcctatctccctcagaggcgcctgctgttcccattttagagttgacagtggcctgctaattttgctatgttcctaaaagttactgggtgtgagacattttcatcccctcctttttcctactgctggtgtttattatccagctagacaatattttatgcatatttaccgtgatgtctggaccgtacctgtgctccttggcagtttatgttgaagataactaaagatttttctctttgggaggcatcaaaatgatggtagtttgcttttatctttttatgttcattttcttttagtaggtgacctttctgcattaagaactgtttttatcttttactaccttttcttttctcctttgtggagacagcatgacatgtcctgaaggtcacctttgcctttgaaaaaggtttgatggaggaattcacaggtgactgacaagtctttgaaaagaatgggatctgctcacttctggtctttttggccgggaactcctgattggtgttaaggtggtaatttcccccatataagatttagaatcactgagtttgagctagatgaaatttttaaaatttctggttgtctcattagactgatgaggtgagttttcttcttcatatgaacagctagttaataacagcagagttctcactcagtgctcagtacttaattttccactgcaccacaactgtcttaactaaatgtgctgtatttttctttaaaagttaagagttctatttggtgttttcaggaatatacgtgaaaagacatgccatgttttggtaaataccatcagagttgtgtaaaggcgtgtactaagtgcaatcttaatttgtggaaataatcttcatttacccctcctaaaactacactcagtataaacactttcccataaggtgtgtgcagtaaaaatgttatattactccaacactggcaggagcacagcacagcagccttattggagagagccttataaaagtgattaaatggaggcattgagctcattacctttaagtttactttgtgctgacctttgttcctgttttgagaatctcatataattattaaaaaaaaaaaacaattaaaacgaaacggcggggcctagctgtgtataaatgatccttgctgaatatcttaaggttttttgtaagaaaaaagaaaaaccaacaaaaaaagcttattttcacattaaaatgaaacctcttttgcaacttaagaattctatggaaaagcagtttttatcatattttgtgtccatgcaccatttttcttaaaatggcttacaaaa

SEQ ID NO: 98239 - DNA, 1107 bp, Homo sapiens
acaagacaagactgctctgacgcctaaaatcctattcacaaatacgagaaacccataaatgttttagctgggtatttgtttcctacattattcttcaccttacctaatgataccaaaataataaaggtacagaggaaataagatgggcttgaaaagtgagaaaagctgaaacatcattttgggtattgtgaagacaaacttacttgctaccctcagatacatcattagaaaattcttttataatctaggctctcatagcaacaaagcacaggctagttagtggtttgtcttttagattcacttctgaccagtctgcaatattttttagtcaacacccatcttcagtgtttgtctgttgaattaaaaaaactgtacattaacagaattagatttggagaaaagtggtaagaaaaccccaggtgcgagtggagcaaaaacaggattagaaagttcttaattagaacagctgtcttcagggaagaaacttgagatcaaatttaaagctcaacattttaaatctttgaaaatttaaaaagacgacttcttcagtaataaaaggcagctccctggtttagagcaacagaaaagtcagattatccctaacacgtaaactcaagataccaccttagaaaaagaggttatttatataaataagttaacaagacacctgaatatactttgtgggattttatttaggtcaagttcttagtacacggcaacaattccaaatacaattaaaaaattaaaaagtgatgttcctccactcatctggaggtggtttaatggcacacaaggaacattactggcaacagactgctccctcaagttcccctggatggtttttactcaactcataataccaccaactctccctctgggagctaaaagtacaactggccagatcacaaattgtttacattcttttttgtaagccattttaagaaaaatggtgcatggacacaaaatatgataaaaactgcttttccatagaattcttaagttgcaaaagaggtttcattttaatgtgaaaataagctttttttgttggtttttcttttttcttacaaaaaaccttaagatattcagcaaggatcatttatacacagc

SEQ ID NO: 98240 - DNA, 1027 bp, Homo sapiens
gatggtgaacactacatattttatagatggttaagttgagaattaattatgtttatcatggatggctactaataccaagctcatgattgttgcagcctcaacgtcttaggcagtaaaacttgtctgcagcactaaagggggagaaacccttatattttgcaaactgtccattcgttaaatttattgtaacctaataccaaaaactgccgtttttcatattatttccccacctcctacttttttttttttttttgctacttgtaaaataaccccttctagaaaataagcattaactggaatgtttcaaacaattttgcttcattttactatcagccactagtgaactcttacagagatgtacatttaagataaaattagcttgtgctaagtgttttaaaaacattgtttactgttaaaggggaattgcacattatatttaactgggattgctccctccctcagttctttaaaaaacaagagtcaaggctcacaccaacttgtaggctgtgggagctttgccataggtagatacaatgtagaagtatacttttttaaagcatgaagaagacaaggaacttcattataatgtaccaggtagaggacattattattcaaaggattatgcacagctcagtgaagatgaagttacaatttttctcgcagctttgttgctattattttcttctgcataaatgtatgctcatttcattatgtgccttgctccctgattgtgcaaagctatatatatatatatatatatatagatagatagatagatatatgagagagatatattcagtactactgaggatgtttttctgaggatgtttttgttctgctggattaagttattttccaagttactcttgccagttatgtcagtaaactattgtaatggcttagcacactagtcgtacagtcagtgtaaatgtttttcatttacatgttttcattatatcagcttatcaaatccttaataaaaaaaattcatagatttcatttaaacatggggactttgagtgtttgt

SEQ ID NO: 98241 - DNA, 1052 bp, Homo sapiens
cttgggaagagtaactattcttaaggtttttacagatacccaccttagttgtaaattggatagtttatatttctgggactttttaaatgaaaatgtggaatgttaagttacaaaagacttttcatcagaaaatttcaaacaaagtaaacatggcgttttatagtcctctaaaatctaggtgctcccacccaccaaaggcatatcctgcaaagggctgtgaactatcttggtgaactgtcttgggtcccctttccatgtatgttttcttgtcactgaaaacaaacaacgctgagtttatcaagaaaatttaaattgggggatcataataattccaaccaagtgacaactctgacatcaaggttattaggagctgtacatccaattcaagttttatttgctgctattctgggagaataaacttgtatatggagaataaactaataaacttgtatcgaggaaatccataaagttataaattagcctgaaaaatatttcaggtaatggtgtggattggcctgctttgactctcagccaccaacagaaatctttgtcacctttgttcctcagctaaaagtaattttgttataaacacaaagtgactttaaacaggtaaaaaacccattcctatttttgtacattaccaaaagtttttcatatacctacagagctaactaattacaactgatttaatccactcaagtttagaccagttaaacccataggatcctgtatggttatcaatgtgatgccttgcttttcataaaataggtataattgggtcatacacttgacgagagggtgactgtttctaggggaagaaaaccctttagattgcaggtaactttcacttttttttttttaatatacactttacatttgtataaattatgcagggtactcctaaccctgtagaaatgtatgacctctcacaaagttgagatttgatccaaagagaaatgcaagtataaaagaattagatacttattatcttttaaggtttttttttttttttggtagagatgggggtctcactgtgttgcccaggctggtct

SEQ ID NO: 98242 - DNA, 3269 bp, Homo sapiens
aactcaatctttctggagtcaaccttcctggagttctccaacaagggtgtgtgtcagcaaaagcccctgttctgagtgggcgtggaaaggactccgtggtggaatttccttctcctccatccgattctgattttccaccccctccacctgaaacagagcttcctctgccccccattgagattccagcagttttctcgggaaacacctctccaaaagtggcagtcgttaatcctcaaccacaacaatggtctaaaatgtcagtgaagaaggcccctccacccacacgacccaaacggaatgatagcacccgcctcactcaagctgagatttctgagcagccaacaatggccacagttgtgccacaagtgcccacctctcccaaatccagccttagtgtccagcctggattcctggctgacctcaacaggacactgcaacgaaagtccatcactcggcacggctcactctcctcccgcatgtccagagcagaaccaacagccaccatggatgatatggcattgcctccaccaccccctgaactgctgtctgatcaacagaaggctggttacggaggcagtcatatatcaggctatgcaacgttgcggagaggaccccctcctgctccccccaaaagagaccagaacaccaagctctccagagactggtagccaccataggactttattttcatgatatctgtaatcactgctacaatcagctcacctgatcatctgtgaattcaggtgttcagagcctcctggtatgatgttattcaggtagtgtccagctatatgtgtatgtgtgtgtgtacacgtgcatgtacacacagctgtacagtgtgtgtatatatgtatacatatatgtatgtgtatgtgtatatagagagagagctgagagttattctatttattccttttctctcctaatctgaaaatgggtgttctgtattttgggtggaagaggcatagaaggggatgtgtgttgtctcttaagatttctatatcatgtggattggaccaaaaacttctaatcacttatttagaaggtatttataagtgtctgtccatgtgtagcctattcgtgcatgttgtgtattatataactaaggaatagatgtagaatgtgctatttctggttgagaaaaatcaccagaatgtttggtgtatctataaggcttttgtgtttgtttttccccagttggctgaagttagaattgcttgactgacacttcattgctatacatgaaggggcactttaaatcaggaaaatctctcagcttcatagaacgggtaactagtgcaggatggggaaatgttcacagacatcatctgtatgtggttgtgcatagaaagtaaatacatggcgtaattaactcagctgttctagctgcagtactgctgcagtgatccacccacatttaggatgtgctgacagataagctctttgcctacaatacatggataattagtgctataattctggatagttcctttttagtactgttttatgaagctttatcaacttggcttcatgatcctcactttgattgattttaagaggatggataacacagttatctctgtaatgttctgtcccagtatgtctttgggtcaccagttaccttcttaaaatatgtgctttaggtaggtgttattacatatctgtagacaattggtatatgaaatatacacatcctgtgccccaatatggtgcattatgaaaaacaaaatcattttctaaaatgcattttttgagcattgctctatagaagggaagggtgatgagagaacagaactggcccctgtacaggtgtcattaatctggttgtatatgggttataatatgtaatacaaaaagctcattaagtatgggactacatggagagggaagacagtttcatttatagctactggggctaccaggacccttgctgactgcagcctggttgtgattagttcaggttactaggtgttctgatggagtgggacagtccaagtccagtaactgacattacgttttatgcgtgtgcagtttggtataacgtggagtcagtgctctaacgacacactatacttctatatgcttttttctgtgaattttccttggtacatgagagaaataagtactctcatcaacttatgataaattggactattaggaataaaacaatctcagagcagctcctaaacaagagaataaaaatgggccatcccagcacttataaggggagcacatcttgtaatgaaagtctgtgcctattgttaatgattaccaatgcaaactgcagaaatcagttgacattgtcccacaaggaaaaagtgatgccagtaaagtgggggaagagatggtaaataattctagaatgagcaaaagtgcttaattagtacagtatactcaaggtcttgcataacccacactccacgaaaaccgcatcgtaaacagagagtgaacagcacctctccattgctacatctccagaatattgttcggttatgttcatgtggttatggagcaataagaatatataccattaatttttaggtctttcaaattgttcaccaagttttgtgtttgatatttatgaagtgatctttaacacatctgcattgttaatttaagcatgcacagaaatttgggtaatgtttgagtagattgccaagcgctactgtgattcatgaatgaatttctcatagtcttctgcctgcagttttatagtttgaggggcacccatatttgtgggttagagttagtaagaatatgaatccagttatcaaagtattcatccctgaggttttgagttttattgtggtggtgattttctcatgagaaggtagacaacacttcagtttttcttgagggggaaaaaatgtacccgctaaccttttttcacccatgatttgagccctaaaacaacagcctttatgttttcagtgcaggatttcttggaatttcttgcttgtatcaatcctgatgatagccatcctgaacagatgcttctggtctgttttcctggaatagcagacatccttttgaacactaatgatgccaggaagagagtaaggctagaggaggagactcattttaaccccagtccagtggcttgtccgacaacaggccatttccctttacattcctccacagacagaaatggctattaaaaatgttttaacctcatgtatgaactgaatttaaaaaaccactaaagtgatactttatacttctgttttactccctagtgggttttctttaatttggatttttgttgggat

SEQ ID NO: 98243 - DNA, 2814 bp, Homo sapiens
tattcagactcattccttaccttttttttttttaatgcttttgccatttctttgggcattgatgaattttttcaaattatactttatgtggaagactaaattaaaatcatttcccttaaaagttttggattcctgagccttgcatagtatattgtgcagtgagactgaaggatgagtatagttattgcaagactataattaggaaaatagagaggttcttcagttcatttgaaagacatcatggccttctatcagacatcatctgtagttgtgtaggcaaggatgtgtcctggctgtagtcaccatttcaatatgcaagaggtcactccatcattgaggaaccagtggcaccctgggctcaactattttatttttactaataattgtttttatttatttatttaattttttggtggggggtgcttttggtctgaatcacttatacaggtacattcacgaatgagaataaatggacatttttccttttattccttcattcgtatatgtggttcactaactgggctcccgcagggaagagaaggccttagtagcaccatgtggggctgaagccctttccttcagaaatgagcatttgagaattggttctaacgatctaaattctcaaaacactgagtttaactcccttattagagactcaaacttttaagaaataatttctctctcccttcccccatttaatcaatttggatggagctagtattttaaaaatgtactaaagaagttggtttacagaattcggatggctaaagaaaaacccctttgccttaccaaattactaatggtgagatccgtgtgcattttaagttatagaacctagttatgtgtaaggccaaggaaaacaaaatcacagacccaaaatgttctgtgattaagcagcaaagtccgttattgcacagagtttcagaagagtaggaaccctgctgtcagcagtaatgctttaaggcttgatcactctgtatttcttctcctgttacctcagtctcaggtgccaaatgagaaggccagcacagctaaggcctgcgcccctgaagcagccaagacagggtcaagttaaggtcaggggttgttctctggaaacacattaacctcggtgacgcctgtatcccaatctcacagactaatctttttgtgtaattttaaaagaaacatgtgaatgtccggatggctattagaattcagccctataatgagccttctagttcactaacccatgcattctcgatgtcattcaaaattgaaaacaaatggtttatcttggatcctcaaagtttgttcaaagagcctaaaagatgtacctaaagtttttaaaacaagggtccttcctttcctcttttcaaagtacctgaaccaccatcgtgcatgattagctccacgaaataaactaccagatgtgatcatttcagctacccagatgggttggttgttggcaaatgctagctgccatttcttgatacattttctttattctagccttccagagcttcctcttaatttcttctggctttttctgtatgatatttttacagtcttttgctataatgtttacaaagcatttctttatgtattttccagtaaaacaaatgtaaagaatgtcccccctttacctgcattgctggacttctgtgcatgttggatgcaattgtctcacaccaacacgagtgtgtgtgtcaagcttattcattcctgtgtgactgtgcacgcctgctcaacattctcatactctcctgtgtcagcttactagcatcaaaaagccatcctcattccaccaggaagccctcctaaacccagttatagcatctgcttgatgtggatgcagtcatggactgaaaggtaaactggagccatcacatctccccttggaagtccagtgctcagaggaccgccacagagggttccatgtagggcaggctgtgtcaaagtcatacagccaaggtcagaagtcatgcatcctgtcaccattcaaacagcttttgcagccggacatttttcctagattgttagatggtctagctattttactgtggggtaaaacaagttttctgtttccttcttgcccgcacaatcagattttagccttcctgacattgtccatctttatgatcaccaccaacttctgcatccttttcatgcatgtcccagactccctgctttttagttttacacaatcaaagcttacctctgtaactgttttgtttgttgtgtttttctctctcccactccctttttatactccttttaggccagaatggagtctatgaatcggccctacacttcacttgtgccccctttatccccgcaacctaagatagtcaccccctacactgcttcacagccttcaccacctctacctcctccgccacccccacctcctcctccaccaccccctccaccaccccctcctcccccactccccagccagtctgcaccttctgcaggctcagcagccccaatgttcgtcaagtacagcacaataacacggctacagaatgcgtctcagcattcaggggccctgtttaagccgccaacacccccagtgatgcagtcacagtcagtgaagcctcagatcctggtaccccccaatggagttgttccaccaccccctccccctcctccacccccaaccccaggctctgccatggcccagctaaagcctgcaccgtgtgccccatcccttccacagttcagtgccccgcctcctccactgaagatccatcaagttcagcatattactcaggtggctcccccaacaccccccccacctcctcctatccctgcacccctccctccccaagc

SEQ ID NO: 98244 - DNA, 1336 bp, Homo sapiens
actctgttaaccttgatgaactttgtttctttgaaatgtagaaggaacgtttgggaatttctcaagatgtgaagatctattttaacttggatatcttgatctaaaatttcacaaaagtttctttctcatttactttgtaaaaattcttatgggctactttatttggccttatggccatataagaagcataaatgtattggccattactctaatggcctataacttgtcaggatatgtttaagctttgataaagtttgtttttctttagttctccaagggacttagttggattttgtctttaatcttgcagcatccacaaatccagaagaaatctcaatatatcaaatacctttgttgtgatgatgtgaggacactgcatcagtgggtcaatgggatccgcattgcaaaggcatgtctccttttgatttgatgatggaataatgaggtgtttgtcgatgatatagttttcgttttcatgacaactattctgactatttcatgttcatggatttgccagtgcctacgtttttcaggcctaagtttcaagttttaaatgttgtcttttttccttgtttatagggataaacttttaacatttggtatacttggaataatattgctggtaaaagcttgtgtagtatcaaagtgatttattttggctttggagaatgcattatatgattcttaaatagtagagtttagcctaagcaaagtaagttttggaaaaattaaattactttaagtaatgatcatttaccaaccacatttggagcagtatcctgaagagtgctaaaaagctgcccttggatcaagaatttggggtgaaaaaacattaatgtttataacaaacagaatcaagtgttgacttcttgctgcccctctaaaaatgaggagaaataagaatagattataatttatggtattagaggaatttttgaactatcataggtattaattttaatacagaccatcaatcagtaaacagaaatatgtcccccatttcaccttatccttctgtatcatactcagtaaagtttagatgtcaccatttcctgtcttctctttagtatgggaagcagctctatatgaactaccaagaagccttgaagaggacagagtcagcctatgattggacttccttatccagctccagcattaaatcgggatccagttcttccagcatcccaggtagttcaaaatgcttcaaagcactattttgcgattaatatgaaggtctctgtagagactgatagtagacctggaaatttcaacttgattcttaaaaaccggagccatacttaattcctaaattataatcaatagatgcctttttaaa

SEQ ID NO: 98245 - DNA, 1325 bp, Homo sapiens
ttcttacttctctggtcactagttgagcctatctcagttctctttaccaaatttgaaatcatagttttatttgttgttttttggggactctttctggagtagttttgtttatttttgtttgggaagaacagcacagctctctgggattacaggcttttttatcttgtttgggtaatatgcttcttctgctaagggccaccctggtgtagctatcacttcggtgcttattggcaccaggactgttttaaacttttttacagtattatctcatctagtcttcacaatagtcctatgagcatatattgttgcccctatttaactggtgaaaacctccccccaaccagttgcgaatcactatactttacatatgcattataggcactgaacgacttgatattttcttgttctttccagagagctctattatacattattgtttttaatgtactagactatattaatagtatctttaaaatgccaacactccttaacaagttagtgttcattgtgaatgacaaaacagtaagtaaaatgggctgcttttttgttacgttaatgattaaagaagaaacatttatggagcatctcattgtctcgtgtaaatagcaataatttctatttagtattagcaaaagtagttttgattctcacctagaaaatgttaaccaggtatatttgcttgtttgtgcattattattaattttatctttttggtgtttttatcttaggtctctcgggatctggtgtgctttctccagctggatcatgtcaacgtttattatggccaggactatcggaacaaatacaaagcacctacagactattgtctggtgctgaaggtaaacacatatttctttttaggaattttaattgatgttagacatagagcaggttattggatattttagaactgttgagattccatcaattatactgtttttgctttattctcaaagtttaaaaaggaatggtgaagtgtggtaaggaaaagaagcatgtgctatatcatagcagaccctgggccaattatctctaggtaaggagtgaatattagattgtaagctttgagttgtgagatataaaatgtatttgattataaatttgagattctcatttaacaccaggcttattttaggaaaacttagaacagagccgaatgtaggtcataaatgtgctttagttcttttcctgtacttactcagcaaaccatcagagggcactgtgtccaagttcaaatcagactggctgttatctggtccagaaataatttttgtctctttttttccctgaactatagtcatgatagcccatgtatgtattgtgac

SEQ ID NO: 98246 - DNA, 1123 bp, Homo sapiens
tattatgttaacttgaatttgtactgaagtctttaaaccagcatttgactcgggaaacaaagcacattaacaaatttcaaagaatccatatctagaacgtgttctttaacatatgttcagtatacaggacatgttctttcatttctaatttggaaattagaaaatacatatatgtttaagattaaacaacagtcatggatcaaagaagaaatcatcttggaaatgttttaaatgccaagaactaaataggaaatacttgatatcgaaacttataagatgtaactaatgttttatttttaagggtgggatgggaaaatgtttaagactgaagaatggtgtcctgcaagtcagaaagcctagattctagtcctagttcttccatatatcagctgtgtgaccttggttatgtcattaacataattaaggcatatttctttgtttgaaaaattagggaataccagataatttttaggtgctaaaatgtcggttaagattatgtggttctgaggttaactacttcacaaagtttcatgtctttcatgcaactctaatgaatactaacaaaatacggatattttattttgggacagagagaatctttgaagaccatgaaaacttggttgaaaatcttcttaattggacaagagatagccaaaacaagcttatatttatggagcgtatagaaaaatatgcacttttcaaaaacccacaggtaagaccaaacaacttacagaggtcaggatttgtaaatatgtctcctattttattcgattactgctaagttagagttaaaagactggtaaacacctggttggagcgatatacctgcaaaatcctataggagcatcatctactactgctgctgctgctgctgctgaggtggaaagtcagctggtgcccacgtgttaggccctaaagaggttcccagtcctccagaaccagatggggtgagccgttttggaagcagaagtatagctctagtgagttaccaggtcttttggctctgtaatccagagctgtgttgaacccagctgtttatttggtgagtttgtcatctcatcaaagaaaagtacttctctactccagccatttatccagttgacacttcttttggaattacttt

SEQ ID NO: 98247 - DNA, 1032 bp, Homo sapiens
aaaaggtgatatgtgggcctcttcctggtttgggatttttttatcagttttttggatttgtgaagaattgccttgtttatgtaatgtacttctaagatatggagagatacaggggcatttcttcctagtaatatatttttcacatgtagtattttttgtgggtaaaatgcattataaaaggagtaattttctggttctgaattctcctaaaggagtaatcataacattataaccttatctgttatatttttaaaatgctttaaatttacttacaggttatttgatgtctgatttttagcctatatttttgcataatgaagtcattatttgtgttttaatttatatacaaatacattaatccaaattttatttgatattggatcagtgcctttcctagaatgccattttttagtgttcatttacttttctttttacctgttatagctggtgatcagagtccacatgtctgatgacagttctaaaacaatgatggtggatgagaggcagacagtaagacaagtactggataacctgatggacaaatcccactgcggttatagtttagactggtcactggtagaaaccgtttctgaattacaaatgggttagtaatatcattgctttaattgctttctaatttttgtgtaatttcatcagttttcatgctgataaaaacattttgagttatctttatatatatatatatgtttttattttattttattttaattttttgggggatggagtctcgctctgtcacctagactgaagtgcaatggcacgatctcgggtcactgcagcctctgcctcctgggttcaagcaattatcctgcctcagcctcctgagtagctgggactacaggcgtgcaccaccacgcctggctaatattttgtattttttagtagagatggggtttcacctgttggccaggatggtcttgatctcctgaccttgtgatccacctgccttggcctcccaaagtgctgggattacaggcgtgaaccaccacgcctggcctcatctttatatat

SEQ ID NO: 98248 - DNA, 1011 bp, Homo sapiens
cctagaaggcagactggctctgcagtctgcatgtactacccattttcccaaagagggagggatcagcaggagtcagctgggacacgcctactggcacggatgatgtctttacctccctgctccttttctttttctttttttacattttctttgtggagatatttcactcaacttagggaaaagatatgagattaattatagagaatcattcttgctttgtctactttatgttttaaacacataaaacctccactgacttctgttattgcctttttttgtttgtttttctcttttctgaacaagcactcctatctggacagggaaacctcccttcttctgagaaacattgcaggaaaaccttctcatttgctgaccaaggtgatacttcttccacatgcatgtaactatttactgccttgtaggtagaatatgatttctgtttttgatcatgctcttatattattattttcttactctagcatctttgtcattaatatactttttcttttacagatggtaattatttactgatcttaatgactgtcaggcaatattgagagtacaaaatattttcagtaattttcattagtttttaaacttttgtaaatgcctaatagtcttcccaagtatgttgcactttttctagtttaacactgttgcattttaaagtctaaaaaacattgctttaattgtaacttttactgctaatggttgtccatactctgggtttctttagcaaactttgcttcctagttcttgtttatattatcacctcctcatttaattaaaacatttactcatataaacagaatcttagttaatattaacttagtcaaattgaaagaggaagctgcaattttaattgcccggttctctgcccttggaatgttttgaatcagtccagccagattttcactgggctggtattttatatccatttgaaatattttagccattgtcatcattaactagggaataatacagtagggaagctgagttgctttctacctc

SEQ ID NO: 98249 - DNA, 1836 bp, Homo sapiens
tacatagtaattgtgtagcagtacatgtttacccattatatttgaatagctaaaaatgaatgggaataagagcaatgaaagttatagttgctcttttatttttaagtgaaagcaagtttattagagaagtaaagaaacgtggctgggcacagtggctcacgcctataatctcagcactttgggaggccaaggcgggcggatcaccttaggtcaggagttcaagaccagcctggctaacatggcgaaactctgtctctaataaaaatacaaaattagccgagtgtggtggcccatgcctgtgatcccagctactcaggaggctgaggcaggagaagcgcctgaagctgggaggcagaggttgcagtgagctgagatcacgccactgccctccagtctgggtgagagagggagactctgtctcaaaaaaataaaaaaaaaaaaaaagaactaaagaaaccaaagaatggctactcttacaaattgtgctttttgttctttgtttttcccaattccctccctcctccttggctgtgcattaacctcaaactaaattgaattttcagaaattactacttacctagtgtctttatggaggagccaatcagtcttacctttaggaggactacacaatctagttaaatgaggacctagggatagttctctatgttcttgttattgtttgactttgttagtgctaatcttgatgaatatgtccaattaaaaaaattggaccttaggtttctttttttttttttaaagaatgggtgagaggggcatttatgcttataaagtttaccttgcattaaaacacagctttaaaaatgcagacaataaaataccatatagcaaacttaacatagtatagatgtgagcaaagattatattgtcttctgtaacatgtttttaatcttgaagtagtgtattttatctatgaccgtgtatgtactttttttttttcttgagacaagagtttcacttgtcgcccaggctagagtgcaatggcacaatttcggctcactgaaacctctgcctcccaagttcaagcgattcttctgcagcagcctgctgagtggctgggattacaggctcctgccagcacacccagctaatttttgtatttttagtagaaacggggtttcaccatgttgaccaagctggtcttaaactcctgacctcaagagatctgcctgccttggcctcccaaagtgctaggggccatgtactttcttatagggggtgctgctctagtatttgtttgcattagtttctttccaaagaatttccaagaataacttaacctgtatttagatttataaaatataacaatattttctatacttttactcagctgtattgtacatttttttaaatggtgataagtaactatgtactgttaaatactaatttggaattttttcatgagaggccagtccaaattacatgtatatatcaaaacaactacaatttaaggataaatgaaatacaattgtattaacttatcttacaacatgttactgaaaagttaaggggagaatgatagggaccatgccatttacaaattattttcacgaaaacagttacttgaattaatttaagtgtgtgacacttctgaatattttgttcatgtcattcatttgctctgcaaattctttactgtgcagtatactcctatttttattctgataataatgagtgggttaataaagttttactgaaaacaggtgtgtccattaggcaaaatattgatggatatttttcgtcttggtgcagctatcattgaattgatcagaaatacttggataagcttttaaaaatgatgtcgtcttattctaaccg

SEQ ID NO: 98250 - DNA, 1054 bp, Homo sapiens
cccatctctgcgactctccgtgtaaggacatttaacaattgtggaatgtgggacttttgttgttactgacattgtaccatgcttgcaaggcatcttgcattttcaacttcccaataaataccagtaactctccctctcctcttcattgtggcagcccagaatgtccttaacattttctgaaattcctgcttgaggacagagctaccctcttttgagaaccactggtctcaaatatccctttgccctctttctaccctgccacactccctcacactgcgaccccagcagcctcttaatcatcctccaggactgtagctttttcagaattactttattaagccgctaatttggggttagatacccgtctccttgctcacctaccacttaacacactgttttgtagttgcaagttggtctgcatctccctatttagactacattctgtgaggcaaggaatgcccatcttggtcacctttgcatctctaatgctggcatggttccacactcaaaagttggagcctaaaaaatggttgaatacatgaagaggaaaacagagaaataaaataaatcaataaaatggattgaaaataagcccttgactttgtgtctatagttggtaaataaaagaaaatataagaaggccctgtttatatgaagctgtatgcatttttattaactcacaacataaaccaagactgaagcctgattggatgccatgcccaaaccataatttttttttaattaaacgtttaaaatatatttctaaacagaatggccttactcagttacagtaagatctccatagcagagcaacccacaaagacacagcactgatttttttcccctgtaatcaagggtgaaaaatatacaacttgtttctgaaccaaaaccacaatttctgcagtttaaaatgtttcactgataatacggccctggtagaaattatgtagttttaaaactacataatttactctccttagtccttcagctgtgcaccactcttctcatccctcttgcatccttccagtaaccagtttcaccccacccctgcccc

SEQ ID NO: 98251 - DNA, 1016 bp, Homo sapiens
atcacaccactgtactccagcctgagtgacggagcaagacttaaaaaaacaaaaacaacaaaatttatttgtatttattacttgttaaaattttggatatttttggttaactaaaatatatgaatatttcagttttttctttttatactttttaaaattaatgtggctaacaaaattttaaattacctttgtgatgatttctaacaccatctttactgtccaagtgaaatttgtaaataatataacctacttacatacctacttttttatatgaatgtaatgccccaacacctatgaaggagaaataatgaaaaagaaatttataataaataatatatctgttttagtatgtaaatgcttagctgccactattaaaagacataatgaagtagtcaaaccttacacctacctataatcaagaactttgggtttaagagaagtgagatcagaagcctttttttttttttttttatacaagaagtgtaggaaaaagaacagaaatatgagtggaccccagaactgaaacatgttataagtgatagcagataatgacatacttgtatatactatgagaaaaagggaaataatcttaattgaagtagggataatgtgctgagacagtttataggcaagtagagaaaatgggagcatgtaaaattcttgcaaatgagataagattatttataattgtaatgacaaaataatttcagtgttataatgtgggatgagatggtagtaataaaatcatttgatatctgattttttttacagtgtagatttttcatcatgctatatattttatttctttttttttgagacggagtctcgctctgtcacccaggctggagtgcagtggcgcgatcttggctcactgcaagctccacctcccaggttcatgccattctcctgcctcagcctcccaagtaggtgagactacaggcacccgccacctcgcccagctaattttttgtatttttaatagagacggggtttcaccatgttagccaggatggtat

SEQ ID NO: 98252 - DNA, 1051 bp, Homo sapiens
gcatgcaacttttcattactattttgtttcattactgttttgtttcacttcattgatctttttctcttcctgcatggtaatgagaactgcccgtttcacctcctttacctatcattttcttccttactgcattttcacagcatgctatttctctgagatgttccagcaagcaggccaagcgtcatattgacttcacagaagaacaggctgagctgacacctgtaagttctataaacatgccatggcatgacttaatgaagaggaatgcattcattagacctccaaatgatgaaaccttttcatataacttcagtttttcaaataaaaattaaaccaaacttaataaattagcaaaaacaaataagcaactttagatatggtacaactgaatattaatactcctggtatgattatgtaggtggtagcataattgatatagatgatttttgtattagaacctgaaacaacatgccttctttattctgaaactaagggcttttgtaaatttcttaagatactaacaaattgaattgttctttacagcagagctaccaaatggaatgattcttctgcactgatgcttaactgaaagcctagtttctttcttaaaaaaatttattctttggtcattttttttgccatgccatttgccatggttggcaaatctggatgcttcagaggtgtactgtcccatacggtagccactagccacgtgtgcctattaaatatttaaaatgtggttaatctgaattgtgtgctgtaaggataaaatacatactggacttcaaagacttactatgaaacaaaaatgtaaaaaaaatctcgtggccgggtgtgttggctcatacctgtaatcccagcactttgggaggccgaggtgggcagattacttgaggccaggagttcaagaccagcctggccaacatgacgaaaccccatttctactaaaaatacaaaaattagccaggcttggtggcacatgcctgtaatcccagctactcaggaggctgaggcagaagaattgcttgaacccaagaggcggaggctgcag

SEQ ID NO: 98253 - DNA, 1670 bp, Homo sapiens
agttattcatgaacagatttttaaaagatggaatttttttcagcatgtgactggataagatagggaatagatttgcggtaacaagttcaacaaaagctgagtttggtgaaagagaattctttattgagttgttttcatcaaagagatggtaattctgtcatagggtagcagcaagaaagaagaaaaatggggcaaagttaagtcaacctttccaataagcttgtgttgacaatattctaatatgggataaaagaatctatttatgaataatcagtactaaagtaaaatcttgaattttaactattacttgacatcattgatttttttttcgtaacttatttaattctttggattaatttccatcagtaggtaactcttggtacccacccatgtgcgtagctttgtttttggtactgtggagcacaaaaggagtatgaatcatggtggtttggagataaacttgagttatttcaaagaaagcgaatcttatcaatctgaagaataaactttcatttatttaaaatgaaacttatctaagtggtatatattctatagagaacttgaaaactgatttctaggccggacgtggtggctcacacctgtaatcccaacactttgggaggccgaggcgggcggatcacctgaggtcaggagtttgagaccaccctggccaacatggtgaaaccctgtctctactaaaaatacaaaaaaaaattagttggatgtggtggcgcatgcctgtaatcccagctgctcgggagggtgaggtaggagaatcgcttgaaccagggagtcggaggttgcagtgagccaagatcgtgccactgcactccagcctggcaacagcaagactccgtctacaaaaaaaaaaggaaaaaaaaaactgatttctattttgtgatacctgggaattatatttagccaccagctacttaatatgtatcatttcatgtcctttagatttacctgctaggatatgagcaatattttattagggatgtgctttcttggccattctttgttttgtatgttgatattccttccaatcagtttacagtattttgagttggattaagatgcgtgagggacaagttataaactaatcattaaggatcttctaataccgtatgcatgtctttctgtctgtaaaatgtgctcattataaaagttcatacagtataggggcaaattgaagtaaaacgtgaaaagttcctctctcccagcaagcgcacttcaaatggtatctagtggtatccatgggtatcactgtgaatactgcaaagataccagtgctcaatggtataatgtttaatataagagtttaatgtaaggtttggtgagtaaaccaggactatagcagggaaaggagttaaaaagccttatctagctagcctgttcttttgcctcacctaggagtatagaaaggtggtttaacaaacccggaacttgcttccatttgcttttttcctaggtctagtctgttctgattcaaataaagtaaactgaggcaagcttaatatatcctgaactcatgtatcaaattgtctttaagtgcaaatacagttttaaaaatattttagtttttcatgcatggcgttaaatagttctatgagatatgttacggaaaactatcctctactcacatacacatcatattctgcttccagagg

SEQ ID NO: 98254 - DNA, 1208 bp, Homo sapiens
gtgaagttacttcttagtaatttttaaagcagccactgtggcctttatctgttgtattccacctagtcaagtttataatattgacctgtcagtctgtaattttttagacttttgacttctctttttatgccctcagctctttcagtattgacatctctaccaaagcattgatcatattaacaatatattgaagcctgtggtaaaaagttgcacagaggaatgtggttaaaaccatggaacagtataagatttttgtagtgtttttgtctttgaactcataatttattctcctctgattattacaagccttaaaagaggaggactgtgtacttctaaaaatttatcttggaatttaaaacaaaaaccagaaatacttaattttatttgctttaggcccaacaaaatatattcttttgcttcatcacctgcatttattaactgatttataatagaatgtataaattctggaaacattatgtgttgttcattgcagaagctctgaatcagggagagactgtggatctggatgccttgatggctgatctttgctctatagagcaggagctcagcagcattggttcaggaaacagtaagcgtcaaatcacagaaacgaaagctactcagaaattgcctgttagccgacatacattgaaacatggcaccttgaaaggattatcttcttcatctaataggatagctaaaccttcccatgccagctactccttggacgacgtcactgcacagttagaacaggcctctttgagtatggatgaggctgctcagcaatctgtactagaagatactaaacccttagtaactaatcagcacagaagaaccgcgtcagcaggcacagtgagtgatgctgaagtacactctattagtaattcctcccattccagcatcacttccgcagcctccagcatggactctttggatattgataaagtaacacgccctcaagagctggatttgacacatcaagggcagccaattactgaggtaaataaatggaactttttccctggtattttgttattaaaataaaggagaaattatattaaaataattttaattaacttcttaaattcttctacatttataatttgtcaaagatacttctgagataggtttcaagagtacagaaggaatatattatcagatatggtagtggcacaaagatgatttagaagaaatttagtttctttttt

SEQ ID NO: 98255 - DNA, 1037 bp, Homo sapiens
ttttttttaacacattgaagaccatagtgctacatggttatacgtggctaattttgggggtgcgatggggcagaaattcctaagaataaagcttttccttttattgtttaaaacatttggatcagtgtatttgaagagtatcctgaagactgtagatgggactgttaagagctgcaactgcttacctgggtgaaatcaaaacaaagcatacaaaaataaatggattgtttaacatctctaacccttagtttatctctttatttgagtttacaataaattaacataatgtatttgaacataaaatagcaatgcttttgccagctttatatatttgagaggctgtgtaaaatttcatctggatgagttttgttgtgaaatagtttttaaaactccagactgtatgatctctaaagctttttcatatgctcttcttgctattaaggtatttttcatgctttaaggcagatgtcttaaactatatcacttatgtcttataaattggctttttgaaaagtatatatgtatttgctcttaataaaatgcatactgtttttctgctctaagcagagctaggcataatagagaaatctaagataggtattctgttctccacaatagagaggatgccagtttaggtataaaatacgaggaatcagtagaagatgacactgaagacgcagggaccacaaagaagcagaagggtctttgagttgaaaatgggtgaacagataaagtttacaaaaggaggaacaagtcatccctttagatgagaagaaaaacaagatcaggaagccaaggatttaccattatgttagactattaaaatttaagccccatggtgaagaatggtgatagctagcaaaaattggactgtaaacatattcagtaggcccagtattattgtagaatcttaagtcaattttgcaatggtatttaaaactttggccgggtgcagtggctcatgcctgtaatcccagcactttgggaagccaaggtgggtggattgcctgaggtggggagtttgacaccagcctgac

SEQ ID NO: 98256 - DNA, 1027 bp, Homo sapiens
ggaggacctttgggggaggggcaaaatagagacgctcaatagcttttaactcttgttgagtctgaccttcaaagattgtctccgttattttgctttttgtgtggtgaatttcccagaaaccagatgcagccctactcaagtaagtacaaaaagcttaattcatgattttttgggttagacattttgtataatttagattgctgtctcctgtttgaatgtaataaagaattatttgtagatgttgccttatgataaacgttagctttatttggtagaagcagcagcttatttttcagactcagaggtctcactaagattatagagtatgtgactgggtgaaaggagtggagtagtgggcactattgggtgtgttttcacaaatatttaactctttattttccaaagaggtgtttttaaccattgtctttgaggatgattatgtcttttggttttgctgccctttggtgctcaccccataaatacttactagattggcatcgtggataactgtcacactattcacagattcttggttacacattgtagaatctcatggctttggttgccttggtttggaagtaattgaatgtcaacattagtattgttaatcccaaacacttaattttaggaaaattaatattagtgaagcaagatgtgacctcaggcagataacttatcttggactcttaattcctttacctataaaatgagaagtttggattagatcactgcttcttaaactgtttcactgaacttgagaatttcagagattctgcagatgtttgactttaatctcaataaaaatgtattttaaacttataataataaaaagtggccactgtatgacgtacactgttttaaacactttatatgtgataatttatttaattctcgccataaccctatgaaatagagtctattatttgagaaaataggcacagacaataagttgcccaaagactgcagagctatagtggcagagctggatttgaaaccgggcagcctaattcttaagcttgtattctta

SEQ ID NO: 98257 - DNA, 1016 bp, Homo sapiens
cttaagaggacaactattcctttctcccaggactactgtgagaaccaaatgatatcatatatataaagcactaaacatggaacctggcaaatcgtaggctctaagcaagtgttacccaatctcatatccagtacagggagggcaaacctttgtcctttcccatttggcagttatggcctctgggctgaagatttgtaactctgccaatgcctgagcacctgtggagggtctggaaggatccctgggtgttggtttggttcagagcaacagtggtggagccccatgacctggttttgaaaccatgcatcatcacttcctagcacggacaactttctaaacctctctgtgcttccgcttcctcatttgtaaaatgggaataagagtacctgtctgttactcctattgtgggtgtaatgaaatcatccatgtgacacacttggagcagtgcctgatacattgaaagccctcaatgagtataagtgagtgaagtgacagggcacaagatttgaaatcaattggccgagcgccaccattttctggctgttggactttgagcaagttattattgccatcaaaagtaattgcaaaaaccacaattacttttgcaccgacatcacacaagctgactagatcccagtcttcatctgtgaaatggggctaatccccactttcaagcactcctttgagagcaaatgaaggttatgaatgaaggtggtgctcagagcaggctgcttccctgccagggttatagtccagccaatggactgaatgtgcttggctgtcctaggactgtacccagccttcataattctctcaattccaaacacaggcctgccaacgaacgtttagaacccaagttcactgtgaattgggacatgcctgcatctcatctgtccattctcttcaggtgctggggtcatgctttgctctcagcaggcattaccacttcattttgtttctttcctgtaaaggggaatacatattttatttaaaagttactcatcttgctctctggg

SEQ ID NO: 98258 - DNA, 1043 bp, Homo sapiens
gcctctgcattttccgcctccagttctttgaaatttcatgatgtctgtgggtttttaaaccatttattgtcctgtgcactttgagcatttattagagcctttcaatctgtagattttcagttttgggaaacattatttctttatccttcgcctattctcaagacacacagtttttcagttgttctctttctggttctgttattgcgttttggaccttctggagcactcttctaattttcttttttttggccacctattttccctttctttgtctttttgttgtattctctgtaacattttctaaggtttatcttaactttctattgactttaaattttgccatcaaaagttttatttttaagagctctttgttgctttatgaactttgttttattccttttaagcatagctattgtatgggtgcaatatttgttcatttctctgagggtataaaagtctttttgaagttttcttctgctgtttgccttattgatctttccttagggttatttattttttctttttatttatgttagtctcctctggcttttatggtacaggattcccacaaatgctgggtgaaccttacattgttcatatttgagtgagtctctagtctgtccttcgtgattggtggtggttttccctgtgaggtaattctgtgtcttgttgggccccttaaatgtctagatttataggtttggattttttttttaactgattcgtgtctctatagagcagcagttccttaaccattagtctcatgacctttttacacacttaaaaattgaggactttatagactagtactgtccaatagaaatataatgcaaatcaaaaatacaagctacatatgcaatttaaaagtttctagtagctacagtaagtttaaaaacgtaaagctgatatttcccaataaatccaaaatatttttaacatgtaactaatataaaaatcgagcaatattacatttttttatactgtctttaaaatccaatatatattttatacttagagtatatctcaattcagactaatcatat

SEQ ID NO: 98259 - DNA, 1017 bp, Homo sapiens
tttttagatacttaaagtataagtggttacgtcaatgcgtggtcttacagagtaacatagaggccatttttccaatggatttctttaaaattgtagcgttcctcctttttattttaagaacttggaagaaacatttgacactaacctcaaaatgtcgcttcaactgggtgcaatcctatttacatcaagaaactggagactatatttaaagcaaacaaatataaaaaagaaaaaccttgggcagtttaagaagtttctcagaactcagagtgaagtataataatcttttaagttattatccaatggcatgagatcataatgtggttaatactccagcttccccttagctgtgaagaagttttgcaattatcagttttcccaaaattatctcaaaaaataatgaagcccttgacctgacatatgactcttttcttctgactctttacccaagttataaagaagtgtctaggtgcccctggtgtagcaagtaaagcctggagactcccagggagccctgggcccctaaatggggcagactggggatatttcttgttcaccgaggaagtggggttgcttacgcttggacactgaaaacacatctgtgatatattcaatgtacttcatgtccaagcaatataaagacagtggtcctttacattgtgacattgaaatcacaatcactcctttctgaagtggctacatggctgtcaaaatcagggttctttaaacaagcttcagaacatgccactcttccctaacaagacagaataatttggtatatttaggaagattggaggttaagcgagtgagattcccggaggatttgtaagaacactgtagaagtgttgggggtgggggagataaatgtgatgagttagaaaaataagtaatttgcagatttagtgtgctgatgatttaaaaagtgctgtaatgaatgttacaataagacaagcaacaaagaataatgtgatagacaatgatacaataatgtttggggaggctccatgtcaaaggcat

SEQ ID NO: 98260 - DNA, 1125 bp, Homo sapiens
aaaaatcttattctggtggatgggattttctaatttagcatagtacatctcaaatataaaaggctaaaactcagttgaaatataaatgatgtttgggagcaagctacttagggaatgcatgaataatgcttgttgcattccttttattatagtttattcctagattatcttacccttttgaaaaaaaaattccgtttccagaattgtaaggtaaaaatgcttgtatagtcccattaatttgatacaaagttctgatagaagagttcaagaatgtttaggtttgcctttacatcatgtcagtacccaataaaacattctccgcatgatgcagaacgtactgcagtattttatgtgagagaaaacagtaccaagagagaaaacataaatgaaattctgccagactgctgtggaatttctgtgagtttcaggtcaatgtatgtggttccagaattaaattaactcatgtggaaagaaccagccttaagaactttagtatgagcatatgtgtcttttattattctactttattattctcttctcttttatgacctctaggttacaatatcccagtacatactacctttggctctctttgaatgtcagctgctgttgaacacagtggaccatctacctagtaccttgtgaagcagatgacttctccatgatagtgtcatacgtttgatgtgttcagttggggaaatacatgtctatataggttaggccccaattttctggggttcaacactgaggcatcttaaggtaaccaaaatcaggccaacaacaatttccagaccaggaatactgtggtgttataggctacagctttaagggtcatcacactttgcatgctcagaattttaaatttgcctcaggatcaagcatttgctaatagccaaaggattattaactttaaaggactttaaatgtttaagtgattgtgaaataatggttagtgcatttttaaaagttttgtctatttttcacaggctaaagaaatcataattaaatattgtttaaccttctgaggaaaacagggccttttccaaaaacagagaaatataaaattttattagtttcattgactcgtagagttacctgtctatttaatacttctatttcttacgt

SEQ ID NO: 98261 - DNA, 1083 bp, Homo sapiens
accacccccatgatccagtcacctcctgtcagggcccttccttgacatgtggggattacaatttgagatgaggtttgggtggggacacagagccaaaccatgtcactgactttgcatgtgacctccatcctcaacattgttatgacttattagattcaacatcaaccattgcctagcagtagtctcttgggtcttgggtcagattcgcagggagcaagagtaccagctttctttagtttatctctgtaagccaagccaaacaagcccttggctgcctttgagatatgtgtatccctgagcaatcagttgtgttgagtttgaggccagtcacatgacatgtaaccctggttccttcagaaactgaaaatgagtcaggtaataacacatatatgtatcgttgcattttaatcatgattactcctgacatatttaatcaaatttgtacagttctgcctcgtttcaggacacattggtgggatttacaaccaggaataaaatacacattgggagaagttatgatccagtggagagataacagttaattaaccaaaacagataattttctaatagttttgaaaagagtatgttcatagttgtttttcatactattgaacttcattcttaatatatggcttcattttgttaaagacggggcttctaacaaaacttttcgaaagcacatcttgtggattactttaatggaaagtattttgttataatagtcttaatggaataattatttcacagccagcaaggctaacggagactatttgtagattgaggtatgttttcaaagcctagtggattagcaaacagttgaggaattagggccaaatgccttcaaatgcttgtctcttcatttttaaaattaaagttgatatttgaatagacagaaaatttaagtaatgaaaatctttgatcatcttaatagcagatatctttaaactataaattaactgctaatttaattcactgtaatgctatgtgaagtgagtgtctttatttaaaaacttgtaattttgctgaaaatatgctgattcttaaccacatgtaaccttctggttatttcattttgccttttca

SEQ ID NO: 98262 - DNA, 1052 bp, Homo sapiens
ccagtgctggatgggaaaccactgatagaacattaatttcttactttgctcattagtttaagattacagtgttaattattcacaagagaagaaagtaaggatatctttttttttttttttgagacggagtctcgctctgtcgcccaggctggagtgcagtggtgcaatctcagctcactgcaagctctgcctcccaggttcatgccattctcctgcctcagcctaaaagtaaggatttcttacttcttcttcacatctccccctttagagactgtaccagatttaagcctgagaactcattggttccttctggtctaattctagagacatgtgtaccttacttatggatacttggcaaggtaggcattagtatttggatgcttatcttcacaaacctgagtgaggttcattgtgagggtagaattttggagaaaaatgcctgatttgataaaaaagagtttttcagtaaaggaccacctaatttctgccttctggacagacttcacaattggggatacaagtggtattctaattgtgagcatcatcctggtttccattccacccctagcagagtgcctgccatgatggtgctttttttttacttgataaagggattcacacaagggagatacaaggtgagcctgatgaatcttgttccccaacctagaagatgctcagcctaatgaaatcacctcaaaaggaaacaggagccgactggatggcacttgcactggtaaaattttggaattttgagcatcaaaaaagaataacgactgtaatagattgcaatatattgaataaataaaagccattgagtaagtgatacacttagtgatatacaataataccacttagataacatcataaaacatgaaatacttagggataaatttgacaaaatatgtgaaagatctgtacattacaaactacccagcattgttgagagaagtgaaaaaagactgatgtaagtaaatgagagatacagtttttatgagtcagtttttatgtcattaaaaatgctaatcttcaaattgtttatatataaatttagt

SEQ ID NO: 98263 - DNA, 1025 bp, Homo sapiens
ctgagagcatcactggggcagctgagtgagaatagagcaaaagctgttgctctgtctatatggttttaaccagggttgttttattccagggataatgggaaggttggatcaacacccttttctcagttgattcttctcattgatacctttgcctttagcactgtgtaaactcattcctgcagtaaaatgactttttaaatgattgctcacttgtcactaacttgatctgcattgtcacagacttaattataaaacttttaattctacttagtactgtaacataggatagtgttttaataggtagaataggattgttttgctatgttagattaaatatggagggggtgttcatatacaaagaaccatcagttgctttttccaggaacattatatcattgttttaacaagtaaaagagatttcatttacattgtttccatttacaaagctttttctcagagtttgtcttttggaagtccacactctttgttttgtaataggttgggaagcaacatggctctaagcaagttaaccctgttttaaatttattcctttattaattttttggaatagtaatttagttatgattcacaatttcaatgttatctttaatgtgttaacttctagttttagtgtatgtacccagagtagatacttactaaatgttggttaaatgaatgaagattggctttgttaagatttttggagagagctccttctgtgttgtaaaggtgctcagaagggtgattttttttctgctgctctggtttgatttttgcattatatttttgtagttaaatattaatctctcttttgaaatccttaattgcatatagatttttaaagttgatctttattttatggttctttgctttaaatgttccacttaattttaaatgggaaggatttaaaacaagctctaaactagtatagaggacatgtacatatcttgaaaaatgacctgttataagcctgtacactgtggcatttactggtaaggtttctcatcatgtgcatgtgaagagaa

SEQ ID NO: 98264 - DNA, 1054 bp, Homo sapiens
gatgaatgagcattggtagtttttatctttcaataaatatttgcacttaacctaagttgttgaatttattggcataaagttgttcaaagtattcccttatccttgtattatgtatagactctgtcataatattatctgtcattcctgttattggtaatttttgtccgaatttgtgtcttctcttttgtattcatgatcaatctgcctagaggtttattcttttaaaaaaattctcaactagcttttgttttaatttattttctgtattatttctgctttctagttcattgatttccactctgttctttaccatttccattttgctgctaactttgccattcaatttcctcttctttgtgaagaggtcattgattttgagacctttcctcttatctaatataggcatttattctgtgctattagtttccttctaagtgctgctttagcagcatcccactgactttgatatgctttgttttaattttcactctgtacaaagtactttctaattttccttttgatttcttcattgaccctgaattattcagaagtgtatttttcccagacatttaaatttttctggagatgttttgttactgatttctaatttaattctgttctggtcagggaacatgcttgtgtgacatgaatgctttcagtctgttgagacgtacatattctgctatcgttggacacattgtttgatagataccaattcggttacattggttgataatgtttttcaggtgtgctatcttgagtagattactttttttgatgattttttgtttgttgaatcaaatattgtgataagggttttactatgttagtggttgctgtaagatttatactctcatctgtagcttatgaaaatctacctttaagtgatattaaagcactttacatacagtataagaaccttgtaatagcatgtttcagtttctgtccttctgatcattgtgctattgttgtcgtacgtattacttttagcatgttataaacgtcaaacaacattactattatttatgtttaaataatgaattatcttttaaat

SEQ ID NO: 98265 - DNA, 1067 bp, Homo sapiens
taaccaacatgttaaaaagttacttatgatagctatccaaaaaattgctgattgatagatagtatcttttctctggaaataggttgaatttttaaaaatatttttatttccacatatatatgtgaaaacaaaaagtagtatcacatctttcattttgtttttgtttacttgaaagttgcattctcggctgggcatggtggctcatgcttgtaatccaagcactttgggaggctgaggtgggaggatggcttgaggccaagagtgggagaccagcctgggcaacatagcaagactctttctctacaaaaattaaaaatattagccagtcatggtggtatgtgcctatagtcctagctactctggaggctgaggcaggaggatcacttaagcccaggagttgaaggctgtagtgagctatgatcatgccactgcactttagcctgggtgacagagcaagactctgtctcttccaaaaaaaatctatattctcataggttttcgttcttgttctacaatgtgaagctcattgagttttctagtggttgatcttatgtgtttatatttgctcagaaaataaaaactagaaaatgtgactgtcattatttgtgtaaaatttgaataaagcaacaatccatattaacagttattgaaatattgtgtattgaaccagtgttagcaatccagcattggcaacatcctactttatttatttataagtttttgcaaatcagtatagtgatagaaatgcatgaaattacaatacttggagaactttttataatagggaaagaagctagtgacagaggtgaggatttgttcatgtattacatgaaaatattaatttaattggtttcctttaaaacttttgtataaatggcagtgatagttacagaactaggaaagatagttcatgcttaaagagatctggccttctcttttgttaatgaatgactttaaagttgaaatttgcattaagaatattaatgtgataattttcaaagtacccattagtctaacacttttaggataacaaaactaaattctaatgaagttgacatgtggaagaa

SEQ ID NO: 98266 - DNA, 1032 bp, Homo sapiens
ctttcttggacaactgagattgtctatttattgtgattgggactcataggcttttgagaggtaaacctgggtgaactttcttaatcagtcaaaaaaaatatgtatatatatatagatatatgtatatatatatgtgtgtgattgatggggtgagagtgatgaaaacatgtaaaaggcagaggcagttactgcatttagtgctcatagctcagcaggaagttgctgatatgaactcgttgtattcatattcgcttcgtgttagtgggcagtgctggcagggttctcaaagcccctgactcctactggatggcatcactctttttctaccttagctgagcaggcactgaccaaatgctgaaacatgtgactgcctatgagtttgcatagtttgtgagctagggcagggactgtgcttaatgtatcttttatgtttttgcataatgtcttacagtgctccacacatggtatacgcctgtttttgtattggtagcttgatcattatgactgtctggcaaattacactgaatgctgtacaaggaatcatattgtttccatctggtagagtaagacaaagactgtagaagtacagtcttttgtagaaggcttgcatttggtttatagattgtacttatattttggcagaagttttcttaaagtggggagaatgcttctcaggtcaggaaaacttgaataatgtaagtattcccaaatagaatgtcgatgttcgaagccattataaaatgaagcatagtgattaccctggtttataccagaggtactccattatttcccatttattaaccttggtgaaacacacacttccctttctgcttttattcctcagtcaccaagaaaaattgctaaacaaaaatagaaaataattcaagtctgcctgcctgtgtgagtttgctatttgtaagccctggaagggtgtggtaagcagtaatcatctcctcctccccaccatcatgctaaccaaagtgactttcctcaaggcttctgatttaatagaatagcagaagaatattagaa

SEQ ID NO: 98267 - DNA, 1031 bp, Homo sapiens
gactaatcaaaatagtttttacgtgtagtttggatgtggaaatgctaccactttatcactgaaattgctggagtttcatattgaaggtggaatgcacttaaaatggggtaacacacaagggaaaatttggcaaaatgatttcatggagtttcagatttaggccagtgatagccagggcccttaggagaagtagatgtttcccttttgtatttaatatgaataacattaatattaaaataaatgtatgtgtattcctttgtattcacaaaggaatgttattggatgtgtgagttgtcagttattctgggagatgtttaattcagtagcaggaaatggagcggccctggaatttgtaggaggggctttctcctctttgaggagccagatgtcatggttaggaggagaagggccatttttgcattgcatgtgtgagactggaatccccattttcacccactttaggcacttagatatgggattaatggtgcagatccatcaactaagagccctgtgtgaataccgagcttaagtctggcagaaggaatgtgaagcagtcctggaataatcatcaggaaagaattactgctcacctttgttccactgcccacccccccgcaccccaccccagatgacttcaaggtatcttaattcagcaagtgttcaagcaagtcattcagtacagccccagctctcacaaaatcttctctaccacgtttggcacgtctaataatgattataggcattgctacaaattcaatggtaatattgtaggctaccaggttagagacctctctaacttagtctgtctctttctcttctttccatttctcctcctttttcttccccttttccttcccccacttctttccttacatcctccttccttccctcctgcctgttttttccctccctttaactatctctctctactttccttccttgaacaattaaaggaatgcattaaagcccaaacaacaaaactgattaactcttaatgcttatctttctgaggaatgataatctatatgaac

SEQ ID NO: 98268 - DNA, 1129 bp, Homo sapiens
tagaacatccctaatgcctagggatttggtggtgtcattagtaatagtagcagtcatggagagggtagtgttggtagtataattagaaatgagcttctacatctcctacaagtttttcttataattagtagtggacttgaacagtcaatataagtaaattctcctaaagttaagtattatgaaatgctgggagaaaagttaacctgtggatttcataggtatatccttaagtcaataatggggccacaaatggtctcaaatgttgccaggcagtttttcactgagtgtattttctcaagctgggggcatgtttaatggaatatgtagttaatttaaaatgtcactgtctctaagagaaatgtaagactctatttccccagaagagatacaaaaaaactataaagtttagaaaaccttaaccaatgatattctgccagtaacaaacccacgcagatttttactaaattgacctctgtgtacttagaacattgtctgtgctctgattagaaattttggtcaatggaaaaactgccctattctttaaaatttaaatattctgggctcctcttaaaacttggattagaacatgaagtgctttcttctttttattttgtactgaggctctgtatctaggattctaagccttttttttttcactttttatttttttactatacttttactttttactttttatttttttactatacttttactttttactttttatttttttactatactatactgggatacatgtggagaacatgcaggtttgttaaataggcacacacgtgccatggtggtttgctcacccatcaacccatcatctacattaggtatttctcctaagactatccctcccctatgctcccaccccccaacaggccctggtgtgtgatgttcctctccctgtgtccatgtgttctcattgttcaactgccacttatgagtgagaacatgcggtatttagttttctgttcctgtgttagtttgctgagaatgatggtttccagcttcatccatgtccctgcaaagttcatgaactcatacttttttatggctgcatagtattccatggtgcatgtgtgccacattttcttaatccagtctatccttgatgggcatt

SEQ ID NO: 98269 - DNA, 1051 bp, Homo sapiens
agtcaccagggaacatgacatctgtcatacatttctcctctttaccttgatcccataacagctgttacaggtctcatgtacaataaatgtaatgtggccgcagcctgtcattacctctttccagatagtgattgtaaaatgcctgggtatcccttcaactttatgggtatgaagggtaactgagccaatgtagccaggccaatgaaattttaacactcatttccccaaaggcaaaaggccaacaacaggctagagttaaggtgctttgcttcatgaagtagaggccggtttgaaacatgaaatttcagatgaaaaatgaaagccaaagtgggtcagagttcttaattcaacttcaagctaggtggagaaatacattgacaacagagagccttacagatcagggtaagacggctgcatacactgagactgagacaaatatatgaccatggcaaaaaatagaaatttgcatgtcgaaggccaccacccatgcagccatccattgttctccatggttatctacaattacagaggaaaagaaatcgatgctaaaccatgttggaattgagttaggctcaatttttatctctttggtaactctgaattttctctcttcagcccatcttaaattatttactttctctttcacaatgtgagccatgaatattttgtttcttcattttgttaatttgccaattttcctttgagctaaatgccctagcaattttaatttttcattcgggttggaaagagcaatgacccttttttttccattattactatcacaggcctgggcccagaatactactttttatgaccagcagtgttgagcctataatggaattgcaaagtagagagtataatatactgatattgacttgtgttaaacccagtggtgtgatcactgataatatttatatgtttatgtgtatacatccttgcttttgttggcttgcaactaagcaccagagagaagaactagaaccataatatggatagattgtgaacatgagaatgtaaaaaaatgagagagagtgctatgtgaatagggcaa

SEQ ID NO: 98270 - DNA, 1125 bp, Homo sapiens
tctacttttcaagacaccaagtgagaggccaaccaggtaagccactgaaagtttttctatttattgcaacatggtttcccctttaaaagtgaccgctaaagcaggaaggccacgcagaacggcacagaagaaggctccctcagtactcaataatttaaagagagatcccagccggcccttcctacaccaccacggctgctaaaacccaactttcctctcctgctaggagtgtgtgtgtgtgtgtgtgtgtgtgtgtgtgagtgtgttttgaaacagaatttggcggtgttcatatgtcacatatggactgaatcaaaggtttaaaaatactacaaagcctttgcattacagtttttgggaattttttttccctgtcttgaagcagaacacatctcccttgagtttctccaactagccagtgaaatataaatcatttgcattccctccacttagctacattgagcaatgttaactgaagggcttgggaaagacaagagtttagttttggttttcagatgctgtagattctttggagaatgactggttatgcttcagaatcataaggctcaggctggtggagcaagttggcttgtggctgagataggggcttggggttgggtgctgctggcaaccaagacggttggtctcttctctcttcatccatgtgttgtctgggaaagtaaatcgtacgttcttttagaaattattattagctaaaacaaattgcaggccctcgaaggtctctcactcttgtgaagtggttagaaacttttgagtggaatttgttctcaaccactgccaaaaagggtgtgtggacaggctgctgtggagataagcatttcgaggcccagaacagtctggggaccgcatttgtggggagcggcaaggggtatgctctggaaaggggaatccatggggaatgcagtggggtttgtgcttccttctcggaccactctctagagtgagcctccctacccctctgagaacagtgtctggaatctaacaacaaaactcttagcagctgctacaggtgattggagatggagaaaccatctatggaggaaatgggtgaaagaaaggcgaaaaagccttcctgaagtgccctcacccaaggcacttgcaagg

SEQ ID NO: 98271 - DNA, 1511 bp, Homo sapiens
gctctgtgatcccagtatcctgtgtgatcagatacttagtctatgtgcctcggtttccttgtctgtaaatgtgtttggtaacaatacctacttcatagggttgttgggctatgtcagattatgtagaatactgtttggcacatatgaagcccattctgaagtcactgaatctttaaaactgtttcagtggggttagtggaatctcgtgatcgtagaaagcacactataaccattgtggtaagttgatttttatgagatttaaaaaataattcttattctcagttcttccaccaccaaacctctgtgttttgtaagcaccatattatctctcgccatgctcttcttcagagaatattctctgctgagttcttatcttagatttatgtctcccttgcattttttccctccttcttcctctgttttcagtattcttacctcctattttctttttaatctctcatttcctttccttttcctccccttccatccttcaacactgagagtgtgctcagcagggaacaccgtgtttaaggcgctctcccgaatgtgtaataacttctactctggcactaaggcccttcagcagctgaactcaaaaaagtcatcataaagacaaaatagcttttacccagcaagggtcttaataatcccatttccctctgggtcttcataaaggagtcattatctaatccagaaaaaaaggaggggctgggaataacaaaagagaagctctcggtagcacagagtgcacgaggctgccggccagctgagtgcacgtggccgtggtaccctgctcccgcctccacaaatcctgcgataaccagtaaccagttctggcgagtctttcagcagagaagataatgggaattgcaaattactagaccgaatgctaataataattgtttggatacaggagaaaaaataaaacagatgttccccaaaggcattctaggggctacagaaaggaaaatgaggagggggttgagtaaagagaggtttgctgaaaccaagcacaagaaaatccaataccaacaaatggcttagtgatgaagtaatagtcagcatcttcctggtggtacagataaccaatatttaaagttgcctttggaagtgtgggggttggagtgaaggggacaaaacccctgagataaattaattttactagtattaaaaataaaatggccgagcatggtggctcatgcctgtaatcccagcactttgggaggaggaggtgggcagatcacctgaggtcaggagttcgagaccagcctggccaacatagcaagaccccatccctgctaaaaatacacacacacacacacacacacacacacacacacacacacacacacacacaatagctgggtatggtggtgggcgcctataatcccagctacttgggaggctaaggcaggaaaatcgcttaaacttgggaggcggaggttgcagtgggccgagattgtgccactgcactctagcctgggtgacagagtgagactctgtctcaaaaa

SEQ ID NO: 98272 - DNA, 1069 bp, Homo sapiens
catctggttttctcagcctctcactcttcaaggtatttttgacatttcccctggccatttgcatttgccataaatgggcttcccctccccactgccttgttttactttcttgtgaaaggaacaattaatctaattgaagtcctggaagttctgtcttgttccggctctccctctctcttccatactgcattttcgttccaagggagctcctgggtttggaaagcactcactctccaaggaaattagcctgctttctccttttattttgggtgcatgcttcaaattggatttggctctgcaggcccataaggtggatacttcccaaaagaaaactgcctgggctggtcttccgatcacagagcacagcagcaatgccccagcaaaaaggggaactgagcaagaaagtcaggagaagcagccaactcagctgtggagacagagcagtggtcagcacacccaacctcgtgtttgcccgggttcttcctacgtgcagggttaactgcaaagattgccccaaagcctggaaacagggccctgatatgaaagaatttatcctgggctgtggcccctgggcccttggctccctgtataccttgaactctacatcccaaaggttgagacggttgctgagtaaaccccagatagaccttttcccctaaccgttgcttattaactttgttccattgaagcttgctgtctgcttggaaaatttcactcacaagccgcagctttgcctgactcagtgcaatccaaggccaccatctctggtgaacttcccttgactcctccctccagccacttgcagaaatgcaaatcctgggcacccacaggctgtttgggggcctgtatagaagctgtgggcagaaaccagaggccactgtggtactgctggactcctgcagccaaaggacaaaagggcgagactacgggccgtctgggcaaacagagagaagccactttattccctgtggagtggaggatgctaggatgttgctgctccggcagacagaggcctttcgcttgagtcatcagccaacagactgaatgttatggttttagaaacccatac

SEQ ID NO: 98273 - DNA, 1079 bp, Homo sapiens
agtaattgattcctcacaccgagagaattcgcctgcctttagtgtcaatggagctgaaccagagtcttggagggtgagcgagacatgtaaacagtccgtggccgagctgtcaggacgaagccagacacaccggagagtgaacgaggggggaaatggtggaacaaataattgttttattggaaaggaaaggaataaataatatttcagcccaggaactggcagtttgaaagagatggttgagagcttggagcagaaggattcgtgatgcaggttttaatggaagagattttctttgtctcaaagtaggaggtttcgtccccacccgacccccctctcccattatcatcattattatcattaaaataattactgtaacaattacagttgatgagacctcaggtttatacagcacctttcatctaaaagttcaaagcgatttatctatgtgtcatcttttgagagtggtaggagggtaagaaactattattttggggggtcatctgctgggaaactgaggtccaagcagatacaagatttagtccaagcctcagggcaggctgctgggttaaatggtggggtactgagttatcttcttgggggccttttctgctgtactcttcactgcctgggcctttatacacacgtggctcttgaagctcatccccggcactgatgcctcctcccacactgccagggcctccactggtcgctacaatattgtggccaaccagccagaagctctgtgcgcaaaacaaacagcctgcttctggctgtgagatgaataaagatccttcaaggtctgactcacacagctcccatcctgcttagagacttcctgtaatctggttccctttcttgtagaagctcatgtcctttctaaacatctttcttcatggtcttatgaggctctagccaggagcacccaacattcctaaatgcttgcttcttccacccccaacaaaccccaacctgttctctcagaatggaaagggcatttctgggatggggagagaaggtgaatgctttaacatgcctcacatggcccgggctgcctgtgcagcatgatgcttcagaatgca

SEQ ID NO: 98274 - DNA, 1008 bp, Homo sapiens
acatcgattgttaattgtccgaccactacagagcagctcgttttaatatagtcatgacatgaatgagacccaagctcccctttgcccctcccctgaggcaccttggatcttggagggagaagggggcacttcgttggctgtggtacaataggggctagtgttgaggtcagcaacaaataaggggtaacattgttttccctgctggcaatcagcaaggcttccttaaggattgaaataacttacatttctggagtgagcagctgagtaattgagaaagaagactctgttcctcttttcaagagaatccctctctctctctctctctctctctcatacacacacacacacacacacacacacacacacacacacacttctctgtacctccaccccactccccaattcctcaattgctgctctcactctaataattatgtagagcaagccagctgtgcctccctaatttatgagggcttgaaacgtgcatgtgaagagtatgttgcttcaagggccactccagtagcaacaaaaacctcaagagcagggggatttggggccaaacatttaaataacccatgtgacagaggccacaaagaaaggcatcttcttcttagtgctacagttctcttttacatacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatggtgagtgatgtcatgaggcattcctcagtagcttggcctttgcctgttaattgctttagtgatgataaagaggaagaacaaagacttcaaagctcctatgagttcttatatgacccatggtgactttctcttcttccc

SEQ ID NO: 98275 - DNA, 1032 bp, Homo sapiens
cagttcttgtgctttagattgtatttttaatctgtatgatgattctcttatttatccatagcctgatttcttttaggtcccatttagtttctctcagacccagaggggttgtcaagctccatgacttgatgtagttgtttttaaaatgtgagcatataattagggtcttttaaatgaggaagtgcctgcaaggacttgtccctagaagggaggcagcatttgggggatcccgaggtatgaggttggaaggcctaactgcatttgaccgtctgctttccccagactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtacttgtgcagataccagaggatgtgagagtgtgtatgtattgctggggtaggagggtagctcctcaaatacagtaggcagaggacacaaagaaaataaacacagcatacctgagaactccattcattcattcatccaaacagatgtgtatgccaggcactgggttacatgctggcatacactgatcagagggagcctgcccctgcccttgtggggattactgggcctggggagaagttgtttggccaggatgctgtttgccctatcactatagatatccaaggaacattatataagctgtttggatcttcctcattcttggcacagggaggcatcagggacatggggggcattctcctaaggggaggtttgttgaggtgctagctgcacatgacagcttctcatgatctttgctattggagagagccctgccaggaaggttttgcacagagctatcagaagaacacataggaaaatgtcactaccaggaacagaactcaaggtgccccagatgctcggcagcatctcttcagaccattgtttgctttattctgaataaaccttgcagctcatgttgag

SEQ ID NO: 98276 - DNA, 1031 bp, Homo sapiens
gtgacctctgctctaagaaggatattgcaaagcagacaacaggaaagggagaaacaccacttagaaactccagggagtccacagaggttctaacagtaagccctggggccatttgtcattgtctcttctctctgcctctccaaaaatccatctcctcgcagcctgcaaaacttccagaaagttctgtataactggcatcccctatctttgaccttaatcatatactttcgcctattgctatccacctgtttctcatacgtgtagacagcactatgtactacttattcaaatgtttagtaatgctgagcacattgtaggtcaccaataagtgcttactgaattgaatttagccagtgtgtgctagctacattttggtcatatggagactgccattaagaaacaccatggccatcaaaggaatgacatccagcaatttccaaatgggtttggcattgtgggaggggaagtaccttaaaatgttggccatcctcctcatagagcaaaaggtcaggactcggtgcataagcctaattgcttgggcagactctacatgccctttgaccccttagtgacctgagcaactaaatacacaatggagcgagagggtgtggggaggggatgcctctatgagtgtgacttttggaactagggcattataagtgagttggattgaactggacaggagtagagtggagtagattcaaccttgtttctttaaagcagcatctgcttccacagtccaaggcaggccatcatttactaagaagggattatagctctagatgttcaatgattgagaaaaatcgagtattgtcccttcatatttgcaaaagagagaaaaaagaaaaataacctaacttttcaaggtgtctgatttagtgtaagataatgtgagtttaatcgtccaatggaattgcaaactgatactaattacaagtatgtctcagtgaatcacagatacaggttggaagcaaagtctaatgattgtgtcctttggaaaaaaacaagacactgccctgtgttgggaatgg

SEQ ID NO: 98277 - DNA, 1036 bp, Homo sapiens
atggcaaaaaccacaaggtaaatccatgatcctaccttaaaggcacattggaccagggcaggagggatgggatcaggggagctttaagccgacctcctacaggagagagggccttgtgtagtcaggctcagataattgatggaggcaagggtcgtgctggccttgaaaatcttctctcttaggctaaagcgattggaaaacaccgtttctctgacagccagttgctgttgcatcttgcgcagcagagagagagagcttgcagagtgttctctgacttcaaatgaaggagaaaatatgtccccagtccacttctccccacccaggattcactgaacatttatggcctgagtcccttccacatgctgggttaacaatcacaaaaccacatgatactatagttcaggagttaccgagctctggaaatgaaagggcacaaatcctgagagggaatcacaatgtcctggagaagaaaaaggacaataaataatgaggagaaattcagtttgttggggatgggctctgaactggcaatcatgcttagcggcgaggcattgaattctctctgctggtgcctcccgcatctgcggctcccggaggtgtggtctgtgtgggtgatgtggggcttttgttgtatacatatggatgaatgtctggcactccactttcttaagacatgacattctgggtctgcagctggcacaggcgatgtgctggctctatgtgtatatacacagcacactcagcccatgggggcttattgcaaacagccaggggcttgtgtgggtaggattggggtatctgtgatgggaacacagggcacgatgccccctgcagagcaggagctggtgcagaggtctggaaggagagtgtgatgtctgggggattcctaggggctgcctgtccttccctaaaaaggaggtagggagggaggaagagggtctctcctgtagcattacagttccaccaagccctggtctgtcagagtgtgaattatcaaaatggggcacatgtggccaagcctagggaggccaaagat

SEQ ID NO: 98278 - DNA, 1648 bp, Homo sapiens
ttaccaagcatccgttgggaatgcccagcctgaattggcactgggtgccaggagcttgggggctgagacctggttccaccccacccttttcaattataaaccggtagatctcggaagctcagctagcagacgagggccagaagccaggcaggggtggtccccggggagaggagtggggctcacctgattgtctccctgtccaggcgcaatgactaagcagcacaggcccagagggatactgtagcataagctgttttaaaagcatgcagatggaccaggatgctatttaaaacatcatttgtaggaaatctgcttttggaaataccttagcactgcacattttcatagaatgctgtcctccctggctttatccctggtattcattcttcaggaaagatattcctgaaattgaatttagctttctggttttcagaattatttttctcaactttttcataatggatatattctctctcttttgcctcctctttccccacttggctagatttagttccccagcagccaaggggtaacttgagagtttttttgtttttgtttttgtttttgttttactgaattagtcgtgcccaaataaatggagttggggcagaggaaaagcccattctcttccccattagaaattcatcctttgtgtacttagaaggaggcaggaaaatggagagcctgccaattaggcatcgccccactctccaagctccttcaccccactgcgggtgtggtggacgcccaggggctttccttgtctcccctgcaaggatggtctcagctgccccttcattagcagatctttcgttcagatatctgtatttaatgtgcagattccccctcattcacggtgcgtcagcgcagctctctgggctgttggggttgaagtagttgagtgaaccgtgccaaatagatttgtcaagtctgccgcagtttgatttgatgccatggggggaggtgggggttggggagggacttgggggcagtggaggaagaggcttcgtccatgccgagtgccaccactgagtttctctttgtagctgctggatggtgggcactgtgccaagctaactggtgctaagtggtgggcttgaaagtgaaattcagacaacaggagttagcagaaaagcaaagcagagatgaaggcaaccgcctgctctgctctgctctgctcagagcagagggaaggtttgcaaatgccttcccggtgtgcagggaaggaagagggaatagtgacatttgggacagaaatgtgggaactcgatttcaactccctggtcactgtcaacagcaatgcagcataccaaagaccagggaattggggaagtcagagaaaaacaagtttaatgagtgctcaaggtggcgggggagggctgtcctatgtctttgcaaaacactgtttacaatgtggacccagacggggctgaggcaaggcctaggcctctgaaagaatgccttcctttttactgccagtgggtgagaaagactaaggaactcttttccagcctcccctagccaggcagcagcctgttcttggtctcttcccatccaacaggtcatcatgaggtcgcctatgagaaagtggtcagtcacactgttgctggggcattgcaagcctcctcctggcaaacgcagcctggtt

SEQ ID NO: 98279 - DNA, 1382 bp, Homo sapiens
atatattctataatatatattacattgaattatattgtccatgccttgtggactcacaggaatggtcaaaatgcactgattttctttgcctgggagtgtagataacaaccaaactgggatgctggatagcagctgatttaattggcaggtcccccactcccctagaggtgcaaatcagaaaatccaggaaatgctgatggttttcaggttctgggctactgaaaacaaatcagaggtctcaagaatcaattgaaaaatgctggattatattcagaattcagagaggcacccaatagattatccagaccactttgtgccctgaatcgctttttaaacttggtttgcagagatgcacttgaagaaatctttatgttcaacttagctctttttaaatacgcacacacatatatttttaataattacaacataatcaacactagcatcagaaagctagggtcaccttgaacatacttgtgattttcctttgggtagtaaacaaccatactaagatctttcttttaaaacaaataaaaagtgggccaggcatggtggctcacacctgtaatcccagcactttgagaggtcaaggcaggtgtatcacttgaggtcaggagttcaagaccagcctggccaacgtggtgaaaccctgtctctactaaaaatataaaaattagccaggcttggtggcgcatacctgtaatcccagctactagggaggctgaggcaggagaattgcttgaaaccgggaggcagaggttgcagtgagccaagattgtgccactgcactccagcctgggtgacagagcaaaaccccatctcaaaaataaataaattaaattaaataaataaaaaatatatgtcctctgtgacatccagcttctaaagcagatgttaacattcctatctgagtataacatacaaggcaacccaccgatttttctcagatacctcactgcaaagttgtcatctgaaaattgttggcctgaaggtgggacttgggagtagtcgtggcttttggaacttaaactctcccacctgtgcaaagacccacttgttacttgtgacctggcttacacgctaacatttgtcctgggtgctatgcaagccttggagggagggccagtaaacttaagtgtctatctgcaagcctattatcgactttattttcctgaaggagaaaccaaggtatctaaggtttattgatttgcctataatgattcagtgagttgtcagggaatagggaataaaaccaatttcctggcgtcatttcccatgcacacaaccccttaccttgcaatgcctagactggaagccaagaatccatctcagtgaatttgatcagaaaacatatgaagggtgattctaaaaccacagaagcattg

SEQ ID NO: 98280 - DNA, 1027 bp, Homo sapiens
tatactttgctctagttacttttttttttttttttttttgagcagagagcacaaaaaagcataaggtccatatggcagttattgatctgggccatctggaaagccaggacttgctcccaccatgtaggatcagaagctgttccaaaaagccttccctcccataagagatgtattggtcagatggggacagggatggatttcattacagggcaggactacagtgagaggaagctggagcaggactctgaaggactgtctgcaaccctgaccctgccacaaagatcagagagaaccaagaaagtgttgattgacacagggccattgtaggtagagggtgcccctcatcatcttgtccgctcatgggtgggatggcatcaagtaactaacaaaaacaaccgtgaagcactttgcaattagaaaatgctctgcaaatattcctaggtgcctgcaacatgaggaagagggagtgtcaagttcaagctagtgagtgaggtctggtagccctaaaagatgatatttttacttcattttaaacagatattctacttttctctttcttccttagcttctcaagtgttttccttcttctgcctgctctcagcctggaggcaaaattttccttccctctaaaagtttctgggaagaccactgataattttcaagtagaacagtgtgagaaattaattttttttacagtgtttctttaaaaagcccaaaacaacatacccactgattatttttaagcttgagggaaagaaaatttgacagaactttcccatccccttcaaagactgctcaagtggctgaactacaaacaggggtttcaataacatggttttgcatcttacgctacaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacaggtgaggtgggggctccaatgaggttgg

SEQ ID NO: 98281 - DNA, 1058 bp, Homo sapiens
gatagtgtaacaaccagtacagccctactggtgtgaacccactagacatcaggtgagacaaggatgactccaaagagaactcctcttttgaggagtctcatttgttgagccctcactatcttgcttgtctgctaaaggagaaccattcttatccttagaattcacagctctgatagtttttcctgttaagctgtgtgtgtatgctacagcgaagtgaagatacggcagtcatctgggtgatggagcgcgatagttgggttaatccagcagttacctgtgacttaattgtgtttccctgtgtctttcaccgccaccaatttgagaaagtataacagtgatgattctataagatagtgcactgtatcctctataactggagtgcagatcagagacaaaggcggaaatgtaaaaaggcatcttcaaccgttccctcaaaactcaggggctccgcatttctggatgggtcccatcacatgggaaattcttttcatttatcttcggagtatatccaagttagataaaaacaataattggcagaatccaaaagtcagtcacattttaaatcatactgctaaagtcaccaagtatgaggacatttataagaaaccacaaattttggaacacctggcattttggctagaatgttaagcttgacagcctcaacttacagtaaattactgatcattattaaatgttcattaaacaaaatgagggaagattggcaaagagactagagaagtgatggagacataaagatataggtagatggcaaaatctgtggaacctgcaagcacagccgtttgacagttagaggaactacactgatggagtggatgactccagaaaatggctacaaagaagaatgggaggaaagccaagaataaatgctgaagttatgtgactgaaaaagcaataatttaatgcatatgctttggggattgtgctttcatattattgtgtgggtgggggacactgttggtcggggttagttgaatacagaattctgacattttaatgaacttgtttttgttttatggagagaagaaggagacttggag

SEQ ID NO: 98282 - DNA, 1897 bp, Homo sapiens
acttcgagctgggtactgttcctaaaatggctcattgggagatgactggccttgagtttgatttatacgtctctgagggtgccactgcttctacaccaagtcaatttgagggaccaaaatgctgccacacccatgggtatctagcagagctgcctggcacttggcctctagaagagtattgctgtaagtcctggatacattgttaagcccaccattttagtttcagaaagccagatttcagaagcttctcctggcactgctgacaagaaggggttgcctctatcccttctaaacaggtagcaagagttgtctgctatctctgctgttacgtgctttcacagcagtatgatggtaaatgtttaacaataggctttttagggattaaaaaataaactgctttttaacgtttgtcactttcagtggtgtaaatacccttaccatagctgagcttaagctaccaacacaacatcaatggagatggagttgagaagtcagtaagagagcattatatagtttttttttccattgtgcaaatacagtagacagaaatgactccagaagtatagctactgataaaatgtattaagataactagcaagtgttgagttttgaggatttgttacctttgttttttaatacaatttattgaattatagctttatataatttaatttttactaatgaatacatttaacaactggcttgcaaaacacttgacaagcagctctcacaagctggtacaccttggatctagcacagcactgagtgactttgaattctcctgtacttctggcctggacctgagacctccataagcactggagaggagaggggtgaattccggaaatttagtagatcagtttgccagggtacaataggaaaaggctagaaaataaaagagggaaagggaccttcccttctgcaggcttccttagaactgcttctcaccccaagcactggcgtgtcccttcttcccggtgggggcagtgggacagatgctaggagaacacttggagctggcctcctgacacagtccacacttgcttccctggagggtcacagtgcctgatccggagaaaaacattttcatatttcaagtgtttatctcttcagcatttgagtgctcagagagattaatatctgaagatcaccacagcctcaggcaaaagaagagaacacttaccccagtccagccttaatcaccctcccttctctgttcactgcaataatgtttaattaatataatgagcctcctgcacgttgggaaaaaatacttatttttataacccagcctggatttttcatttcatttccactcctttgagactgcatccaattaattcatggttgttcccaacccccatgttttatctgaatgtaaagaaggtttgtggggtctgtgtaggtgtgggtattctagtgttaatgtgtgtgtgcatgagtgtgtttgtggtttctgtgcatgggtgtgtgtgtgtgtctgtgtggtatgtacctcagcagaggcgcttggaataaaaggatatagccggggtcctctgcaggctggggaggttggctggctcttattcagtgtctgtcctcaggttcattctaatgattctggcctcctcccttgactcttctaagcatattttctctgggagtgtctgagggcagccctacccaggccacaaggccaccaattactgagtcacagctccaggggagcttaagtgacctccctttgaccctggcctggacctctgtttcttcacccgttcaccaccgcctcctcctcgtccagtcctggccttcacccgaaagcccctatggttgacctttgctactggttgggaattctagtctttgtcctccttccagttgattcattataccctgtggtttgggagggctt

SEQ ID NO: 98283 - DNA, 1021 bp, Homo sapiens
tggcttagctgcctggagtgtgttcacaccagcctctggggaccctgttccaaattcagtgacccctgctagctgcggaggaacactcagtgttctctaagaggccactttggctttcctctgtagtgacaatgacataggaagcacccccttactaggagatggcatgtttcctacattctcaggtgctttgaacatagacagagttttgagaatgatcaaagcccagcctttaagaaccgagacaaaaactcatagggcgggcaggtatctaaagctgcagcattgaatattgtagccatgagccatgtgtggcaattttattttaattaattaaaatgattacagccaaaacttcggttctgctgtcccaccagccacattccaagggcacagtagctacactgtattggtcagtgcatagacagggcacgtcactgtatacacggcatcatcacagaatgtattggacaacactgctccagtgctttggacactcacatgagagcaaccaccaggggcccttgatgattctttagttccctggttttggtatgaaccaagaagcaagtaatggagggatgtgtcttctgtgggatcccttgatggagtgttcagtggctggtatctttatagctgtctcattctccctcactagataactacagtaaagtaagcaagtaacatggcattagatggtgtaggaactattgcgattaatcaaaaagagcattgtaagtaaatattaatactaagtaaggtcaataatcatcatcattgtgattgttgtgtcatttttattgtcaggaatgagacaaagaagatgaggtaaagggtactaggccaggtcagcttcagaatcctccagtgtgtgttccccctaaatctgtgctcttttattcgtgggttggccttgtgaaatctgattacagtattacttcaatgactttcaatcatgaaagtgatagaaagaaaacaagcgaagctgatattgaacagagctttgactgcctggtcaaag

SEQ ID NO: 98284 - DNA, 1034 bp, Homo sapiens
agaaaaggatagaggcccttctttaaggaaggtagaaaaacatcccaggctttgcagaaaaaaataacagcaggaagaagctttctttaccctttttttttttttcctgcaaatcatgattggttgagtcccccagcagtgtgtggattgataacgaaggggcagaatgacaagacagcctcaatggcaaaaccttcatgaaagccggcagagtgaaaaaacagctctgggtagattcctgcaagggctaggactgaaaccttcatgtccacaaaatggtctattgtaaaccttgagaacatcttgctaagtttatccaaagtcagtgtttcccttaactggttgctaatttgaggaccttagcagagataggcagaccttggaaggccagctgagggctgactcatgttttaagcatggactatgcaaagagactacatctcctacagcactaaatattctttcagatggtcgttctagtaggagggcaagatgctagccaggagatgtgcgtgttggacagatggtgtgtttggctttgtgatagccaggaggatcaagctggtgatttatttcagggtttggtgaggtgtagacacaactgattccattgctgttgggccagtcgcagtcacgtgttcacatgacacttaagcagctgaagccagatgcggccgtaaatcgccaggtgaaatatcaagagacctttccagagacagcagcaggttaaaatgctgaatggccctgtcctctgtacttcctcttcacccttttgaactcctgttgttcattcccaggcgattgttttccctgtatcattggcaacaacagatgttttgggtcaaggacccagcgaaatgcctcccaagtatgtcaggtccaggaggagaggaattgtatctctgggacattatttcttcaatctctttcagcaatggaacatatttcctttccattgtctttttcttggaagctgtccattgccggcatcatagccatcagctacaagaacaggcagggctggttcttagctg

SEQ ID NO: 98285 - DNA, 1288 bp, Homo sapiens
tggacacagtaaagagcagaatctgaattgggaatggagaatttcattcaccttggcacgttttacatggagatctgagttggtaaccagatgaacctagtgccatgggtctcttctttctggctgagacctgtttgaccacagcatgcaactctgccttgagcaaacttttctgtttgagagaggagaggactgtgtgttccatctaacctagtgactcatatactattcctcttatggtcaggacagcaggagtcctctcttgatccgggcataaaatcagccttttcactcaaaaaatggaaacagagaaatcagggggcaggcaaggtatggaaagttgatgttgaaacactgccaaccataggcatttacattgttatacatttttcaaattagagtgtttttcttttcccttataaattaatcatgcaacaaaggtaatctcattctttgggagcaatcactgtacaggtaaatctttagtgaaatacaataaaagtggcctttggacctggagttattagatggtcgcaatcttttatatttggaagtatctttcattttccgcctcttactgatttcttgccatgcaatattattttaaatttaaatcatcctgtgttttctgctgtgtgtgtgtatatacatacatacacacacacacacacacacacacacacacacacagacacattgtgtgccaggatgtgagtcagtaatgaagaaaagcctggaagaaaaagagatctgtgttgagaagggagaaagagaagaaagaatgaataaactgtgttgtcatgtgattttttaaaaagacccttttttgtggttgttatgagtcacattttaaacaatgtagcctgggtgtgcattcttttcttttcttttttaaagcagtggctataaacatggtgccgtcatgtatctttttctaggatttgagctttaacaaatgaaaaaccgtgtgtataaaggggggaaaaagaaccgaaaagtggtgtaattaaggtgatggattatttcctcttacccaatactttcttttttcaataaaggaaacaagaacaataaagaagccagtaaaaatatatgaagcccataatcagagttctggggtttgttgaccaggtggttatttttagcagctcaccttggaggcaagagtttttgttcgtgttagaggctgtggtttctgagcagagcacgggcagagagacgatctggtgccctacctgttagagactcacggaaatcccagctgggtgcacctgtggaaggtggttgt

SEQ ID NO: 98286 - DNA, 1931 bp, Homo sapiens
ctgcagttctccacagttctcatccagacaaaaccaggagaaagtgcacatccacagctgtctcttgggcatagaggggagcagtattaagagaggcccattttgggggtaatgctggctggcatttgactctattccttaggctttaagttctgtttctttggtgccaactggccaatctctgcattttgcacccccttctctcctttcccattcccaccctcaccctctattgcctgcctcccaaggctttgtccaccagggtaaggtcccccatcccagggcctggcctcacattccctttctccctggactcccttcctcccacgcctccttctcctagaagcacttctgagatgcagagagggttaaatggtgcttttgcacataaccgtctgatgaaaggcagagaagtgttcctaacccctgccggggttccagataggcagctgtagtgtgtgaatcctcctccttgcccccacccccttatgtctccagctgccagattaaggctaggtgttgctgagcaagaaagcatggagatcagatgtgtgaagcgggtaactgcttggcggccatccttccccaggggacacagaggtgttctttgtgaggttcgctggagcatgccacctctcctgctacagaggcctgacacgtcccctctccatcagtttaccactcatgtaaacaactgccgaggccagcttatctatgggtggaagaaaatgtttttcaccaacttttctctccaagaacacagggacaagactcagtttacagaaagtagcataagtgccaccaaagagtgtgaagcgtccgagacttcagccagtcagagatctgaattcggaggcatttaaaaatgcctctagatgtgggagcaatccacatggtttctgccaacttactgaaaacatcccggcgcctcccgccacaccatgctcataaggcagatggaaagagtcgtttctcagggatgcctttgtgcttgtgcgtcttttttccaaacacatcagagggcgtgaccacattcttctactatcttctgtaaacttctctagaggagccaacctttttcgtttgtttaatctcacaaattaaataaacctttatgtgaaatgttcctccaccagcacttcatttttaacctgtacagaaaggactgtgcagacaggccagtcctaaaacaattctgacatgcaatgagccttttttgaaagagaaagagagaaggcttacccttggtgtctttcaaaacacttcttctggaaacctgggtgactcccccaggtccagatgatatttcataaagcagctatagtatatgctttctcatttcagagattcagtgagaaactgacttgactgagacacgccaatcctcagacaggttcagacagaaataggaggcagaaaggaagaggactgtttcctcttccctccctacttggttagagcaaggaatctgcaaacttgttctgtaaaggccagatagtaaatatcttgggttttacaggacatacagtctctgttgcaagtattcagctctgccattgtggcataaaagcatccataagcaatatgtaaacaaatgagggtgtctgtgttccaacaaaaattgatttacacaaacaggcagtgggctggatttggccaataggccacagtgagctgacccctgggttagagcacaggctgggattttgtccacctggttctagccgtgactctgacacttgctagcagtgtacagttcctcaggggaccctgggccatctcttgggtttcactgaatgcttctctgcccttctccacaattatcctccaagtgaaaccaggagaaaatcacttgtcctctcaagtactcaggtctccctttggagggtcatgaggaataaacaaaattgattcatgtgaagcccgtagac

SEQ ID NO: 98287 - DNA, 1475 bp, Homo sapiens
accaagagttgcttgtaggggatcaggaagggtttgctagtcatatcctctcttttctaacattaacgttatttctaacctcttgacattaaaacatgaattcacatagtactatttctcatttctccaaacaaatgcccaaagaaaatgtttaaggagccagtataatgtcccccaagtagcttttgtcactgaagttttctacatgttgataatttcaggggagagaaggataagtagagaaggagaagagggtcttacttaaagtggagtttgtctttcaagtagagcaggattctgagagactatgtctgtgtctctgattctaaatatgtaatccatgtactaggatttcaccttcctccagcaggtccccttgattctctccattgtgccctaacattgtctcttatcgtaagaaacactgtaagagaaacatgaaggcttcatccttctccagcctgagcactttaagccataggttgtgtattttgtgttggaaaccagcattttggctgaaggaaagcagacttttgaacaaagatgatgtagtgatggagggaatgtgggtagttgtgaccatgttctgcttgacaaaaatttctgctcccacctctgtggtctggtcaggtacttctttagagggaaagctaatccctgaggatttatcacctcccttttcttgatgggtgagctgcagcctcattaggggatggccctcactgtggagccacatgaaaatcagagacaaaccccaggacaccctttggggagagaagggatgtctctgaggaactctgggggcatcccttaacactttgatgtttcctgtgcatttttgtaagctcatatcgaaaatccagcagcaggatggttgccaggcagcagatcctcttggtgacctgaataatgaattgacaccagttgactgtgacttgcaagctggccacttcaaggagccatttccagcaccttgctttctcttcctctctttctatgcataatttccaccatggccacaaatatgagagagagagaggcctttctcagctatggtaatgaaactagtaaaagacagaattagtttggggacaaagacaaagagggcaggcaataaggtgggagaagaggaagatgtataaagggacattcaggggatcctgggattctggggtcatttctaccccaggggttgtggatgtggctgtcaaggtgtgtgcagagcaacacatccttgtcaaagctctgccaatgttgtgggacttctggtcacccaagaggtgccaatgaacctgcaccctagcggaaggggattcatacagcaggagaaagcagtgattaagagctaagaagttgagcaggctttgaaatattttccaagaaaaatgttctcatttttctatcacttctgagaagacattagaaggtctgacccacctcccacctattccccagatcaaagagaggagttctga

SEQ ID NO: 98288 - DNA, 2390 bp, Homo sapiens
tctcagcctagcaacactcttctgtgtctctccaccagggggcaccctcctgccagggaccgagcccacagtggacacggtgcccatgcagcccatcccagcctactggtattacgtaatggccgccgggggcgccgtgctggtgctggtctccgtcgcgctggccctggtgctccactaccaccggttccgctatgcggccaagaagaccgatcactccatcacctacaaaacctcccactacaccaacggggcccctctggcggtggagcccaccctaaccattaagctagagcaagaccgtggctcgcactgctgagggccgaagcaagaacagcacccaaaacaaacgagaaagactgcaaacatgttgcctcgattttgcacttttttctcctcgcctagtttctgtgtgaactctcagacatctctttcccggatccccaaccctgagcactcttatcaatcccaaccatcctccttgggttcattttggtttctggtttttctttttcctttttgttgattccaaaccaacaaacccaactctaatgctgcatcttggactatccgaagagatccacccccaagcactccacaactcaaggctcagctggttttgttccagagactggttcgcttgttttttccccttgccttatcccatacctcctctcagtgggcagtctgccaggagacgtgaggggaagcctggatctgtgtgtatgtacatagtagacatgtgtgtgtgtgaatagctctctgtgtgtgggtgtgtgagagagcggctggttcattgtgtgtgtgtttgggcgaggggtgagtgttcagagagggcccctttaactcttatgttacttctcctggggtacattttacaagaaaataatatactgtacaagttttgtttacttggagaagagattgaagctttttgttgccttatctagctctggctgggtttctgttggctgtcattgtcatctccaggtacctaaagaaatagaggccacatgggatgcagtgtggcttctcccatccctatccccaacccacctgacccaagagaaggttcccctagcacactcaaacaagacccccttgtcttctggtgtctttgaaatgtcaagataacagccactgggtgtctgcggaaccacctctccagccctaaagcaaatctgtctcatgttgccttataaaagagaagctcataatgaatgtttagcctttatcagttacatccaatcttggaataagtcatagagaataacaagtctgggactgacgtaggaaaaacagtagtctgtttaagttgagaggaggaggaggtggacgagagaagggaggagagggaagaactgaaatgtctcctcacccagggtggttattgggcccaacttgggatggggttgagtacgaaggttaaaaaacatatactttggtattatattggtcattgtaatagcagttgtaaaatatggggggaaaagggatcatttgctttcctttcatggtgttaatgtgtgcctgaatctatagccgctaaaatgtaaggctgtccacctgacttatttaaatattatcagagaatagaaagtaatcactttttaagtgtacctatgtgctgccccttaaaacattcatggcatctggcaaatagacccttgtaggctggcctggcatattcagatgttgccgcatcatcacagagaaggtcaaatgaagatgtaaccattgctgctcatgtgtcttctctaagcaacaaggggagcgggatgtaagagagaagttgctaatgatactgtacaaaggatggattaaataatgaagtcaatttcattgatagaaaatgcaaattttaagattctcagtgtatgaggtctcagcctcgggagcatttattttttactttcctgctaaaaatccactggggaggtataaaattcactccaaagaagtttgcctgggccaaaagcctccaggttccttctgagaacaaaatactaatgattttttttttttttttggctgcttgggagagactttcagcattctttcacgatatccagatatgtcccttcagcacacacactcaactttctcatctggttcgtttcatcctcccgaaagaacggtgctctcccactcttactctatttcaaagagctactctgtctcaaccacagcagccctgccaagaaaaggcaagatgaaaggctagagcatgtgctaccttgagatttcaagaagtgtcctacctcagctgaagatggagaaacggggagtggagaggggatcagcccagggtaccatgtgatgactaatatgccactcattaagggcttttacctcggctgtccacatccagtcatgcatttggggccagg

SEQ ID NO: 98289 - DNA, 1033 bp, Homo sapiens
agtgaatgagttgaaggcctagctcgggctgataaagcttttgccttagtagaggttttatgtcaacaccttcaggagggaagcccttatttctgggttgaactccccttccatgatattatgctagcaattgccatcacttagttcctggcgaaggcagaaaaagaaaacaaaaaatcagcattgtcattgacaaaactggatgctgaagataaagtaaaattgtcttttcccttgtcccacatttttgggattaaagccagaattgaataggaaatacagtactatttctgaagttgatagccgatctttaagaagaccctgtctttaaaatgaaactagcaggcaaacacctaaataatcgaaaattaccaaagaacaacaacgaaacaagaaaacctaaagatttttacttcctattcttattcctttccttattactgtgacaccccttgcattgctcagttgcctgtgtgtcaaaataacttgtggacgttggaaattatttgaaaatgtattgtgtggaatgtaataaaatgatgatatttttatacaaacatgtgaggttttttttccctttgcctgtgagaacaaagttgaaatgtaggctttgagcaaactgatgcttccaaagtttacacatcaccttctgagctacagggcatttctgtgggaggtaggtgggttttctccttgaggctgaatgccaacttttccttctttttatttttattactgcttgttaggatttttatccaatttgtgcagctgagacaacttttatgattggtgtgggattttgcaaaagttgctaagtgctaaattgctaaatgagattccacgaaatttctcttgatgacaaatccctggagattagattctactttcaaagggctccgggagagtggtaccagctaagctgaatcctgtacccagctctgcagagacagatcacttcctttgaagaagcagcagtgacatcttacccctcacctacccaattattacttccacagggatgtgaatctcccat

SEQ ID NO: 98290 - DNA, 1734 bp, Homo sapiens
tttgttcagaagttgccttgtctccctcaaccatcaccctcttcaaagaaccctcatcagaaaggccctcgtacctttctcatttccttcctgtaaagacaagggaattctagaggagaggagagcatcagtgtttactttacagaggagcaaacagagacccagggaggtcaatgactggtcaaggctctgacacctgaggcagaaccacatgggaggtaggcattccgcccccagcctagggccctccacatcccacgccgcttccttcagtgcagggtgatgctgccactgaccaggcttctgagtgtctctgctgtacactccagatgacaagcctgtcatcagcttcaagcagacctcttaatccactgctcagggttggcatggaagggactcttcaaagaaaccagcacattagtgacctgaaatgatctgtgtcccagggctgtcttaaattatttacccaaaagtaaccagtggtttggggcagacttctcactttcctggccatattgtgaagctcctttacaatgcgggaagtaaacagtgtcgaggccaatatactcatacaatatgctctgtgtagacacagagcgaaggctgagaattttctgtaagaaactgcagaaaagcaaactaatgaaggaatgctaatcccaaataatcttaacttagaagaaggaagaaaatgagggagagaggaaagataaaaaaaagtgtctgtgtgtgtgtgtgtgtgtgtgtgtgtgtgtgtgtgtcagagaaagagagagtgagaaagaatggaaagggccataagagagggccttcttatttgaggactaaatcattctcagtaggaatttccaggcagcaggttggagtgtcttgggggtgtttcccctgagcagcatgtgtggtcttacactaccaggcagtgttccagggaaaagcttatttcattagaagaggttgggtttgtgactggatatggcgttcaccctttgtgccgtagtgttgcaatgtattgacaagcacactagagaatatttgactcttccagggtggagggtgtttctggaacagtcttgtgggtgttttcataactagccaccctggtctctcattccaaaaaatcaggacagcaggagatcagtgagaccttgaatcatgcctcaccgtgtacctactctgtctctcgatgatgcagagagaagggacactgaccaaaataaggtgactttttggcctgagactgatcttcatatgaaaatgaccagagttttgtgaagttgggttgtatttgtttttaagcagtagctactgtgcccacttgattactcaagctctgtaaaaccccttcccatcattcattcagagctgacctctttctctcactgtgctgatctgcaacagctggggaagggatgggtgttggagatcgggaaggcagaggtctgactctcacatagatatatgcaaggtggaagatttgtggcaaagctaggtgatcgctttgaattccttgatgagcctgatacgaatgaatgcaagccaaaagacaagagatcaggtgccatgtttgaaagcatttctatcaatcagacagataaagggaacagaaatcccccgatgcccaacttgcagcagcctcaattccacagtatcctcctctacactcccacattttccttcctgatagtggcccaggctcatttgcccaatccctgccctggactccagcagcacttg

SEQ ID NO: 98291 - DNA, 1104 bp, Homo sapiens
aaggcacagtggcaggggttgcttggcactgaagacccagagtttcttcttagttctgtgttactggttgtggttggaggaagacacaggtcatctgaaggagaacaatccagtaatgtccataatgaatgatctagaagtagaggtgattctctagctgcctgccagaatggggagtcattctcgtaaagattgcctccctgccttttagccatggtgatagaacttgttattaacttgtttttattttctttatattatagtggacatcccagaaatacatgagagagaaggatatgaagatgaaattgatggtgagtactgttatgatttagcaggtaatcgtaaaattcaagtttggttataaaggtgtcaacaaaaataatgctctgggtatcggagggcccaaatctagaactatcagtcagaaatatataaaagaatctggagaaaaatgagggaaccatcaatggatctgtcagggtcaactttagaggtttagaaagtttattgagttcctctgcctaatctgaaacagatcccctctttccagtaactttttacctggatggactttgaatctgaataaaccctttacaagtgaaagatcagctcctccatacgtgtcatagtctgaatcttttgaccttctcccaaaaatggcctgagtgaatgagcataatgtgaatattctcccagacctgctgtggtttctggttccctggcttgggggaaaccttcctcacactattcaagattccaatttggagcttcttgcaagatttcggtttctttttcacactgaccatctcgtatctttatatttattccaagttctatttttccactgcaaacacatatacttcaagaggctagagggctgctgagcaaatatgtagatgtaatttcttccctcaactcagaatagcacaggtctctctctgggcttctctgagtaccagagttgatctccaacagactcaacagcaagattccacttaaagaataactgtagactaagattgatgaatttaagaggaacagtttatagagcagctgcttttaacctgcctttaatcagaaacttcatgcgtagttatagaa

SEQ ID NO: 98292 - DNA, 1234 bp, Homo sapiens
gcactttacaaatattagttcatgtaatcctcctaacaacccagttgaggcagattttactattatccccatttcaaagaggagaaaactgaagcaaagagaggttcaatagcttgcccaaagttacacagctaggatgcggccaggctgggctttgaacccaggcagtctaattccagagctgctgctgctaactactgtgctctgaagagcctctgggctggggaggctcagtcacttcaccctgacataggcagtgcctgcaatctctcatgaattttatgtatcgcagatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaactt

SEQ ID NO: 98293 - DNA, 2895 bp, Homo sapiens
aaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgatttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcataagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagagatatttttctgcatcgtggttttttttttttttttttttctctgcattgtctttattggagacaaacagatccgggataagggtgaccaaattgtcccactttgcctgagactttttcaggtttttagcactgaatgtcctgttgaaataggatagttccctcaacccattcacaggactcatgatagggtggcttgcttactcagcctgcagctctcaaccccttgtgggagggggagaacacaggagagcaggcgcagaggccaggatgagcacttttgggcaaccggcaggagcagaaccctgtgcgggcctgcggcagagtctaggggtcgcccatgacccctggagccccagagggcctgtgttacagtgcgctcttctagctttgccatccacggatggcttaagtgttaaacagctcagtgtagagtcatgatgacagcctcttgcacccacactcaggttcttgtct

SEQ ID NO: 98294 - DNA, 4479 bp, Homo sapiens
agtgtcttgcataggactttttcctttctcctccaggctctcatctcagcttcagaatacagaatcctttcccatcacgcacagctttaaaacttttatttaaaaatttccttccccaatgagctttcagaatacttattgtagattttaagagaaaaggtatattaatttatgctattaacatcacctcataaattataagttttatactaaagctgtatcgagtgtaatgaattatgttgcctatgtgtttaatagctaaatatatatgagcttttttttttttttttttttttgacaaaacaaactagtgaagcacctttttacactggatctctgccgtgtcaaggtgtatagctatcctttgctaccttgcagatatataaaataaaaggatatcctggggcctcaaaatgtagaacacctttagaccatttataactgttcctagaactgttgagaatcatgttctttagtaaatgatctgtggtttacacttaagatggctagaagcttagttacagggtacatagaaatacatagatcaagtaaaactccaactactgtagctggaatttgtaaactaagtttgtaagacctcttttatttcctatggagttattctttaatttacagtttattctgtaagttgggaagtaaaatagagaaaataataaatctagatgttctcagtgtcttattcaggaactttttatccctcctcactaaggaattcccactgtgactttaaaatagaactaaattacttgtgtgcatgtatatgtctgtattttttacacacatgcaaaaatatacattgggggcacgtgtgtgagagatatgaatgtgtgcttatataaaaatagataaaggtaaccgaatgtattgtagaaacatgatttatttagttgagggtattggagttactttctcattgtctctgttgtataaatacaccaaattaatcattatgttatcttatgttaaaaggctagctctgatatcatgtgcattttatgttaacctttggattaacttatattatgctatgttcataaaatgacatgagaaacaggaggttctaagatcagcctctcactttcgagcataaaaataagagagggagacagacagccccagacatgagctgtgtttatctattgtggtgatgggaccacagatctattgaatcttttttatgttaattatagatttctttatattcgagtaagaaaatattgttgatcatcttttcttggtgaagttaagaaaaagtataggcctttcataaacaatttttggaaggggctgctttgtttaaggagttggtgggatcatttcaccgtgcatatttcaaagctggggtgatttcatttatttccaaaatttttcaaaaaacttttactcagttctgctgttatttattaacttaagagtgctcccatccccatatttcagctataggaaaattgtgctacccctgattcatatggaattaaaaaaaaatacatccctttattttgagttttaagttgttattttgctatacatttattactggagtatctggtggtctgaaatagtcaaaagtagagttggtattaaatgttccaatgacatttatttttaatacttaaaaaatcatgtactttgaaatatgtcaaagcaacttctgataatatacctgaatttgtagttgtctcttgagcatcatttacttcatcttagatatagtgaagatctaggaaagctctatatgctgttcttttctacagttgtatttttgcagcatctcctggtttcattcactcttgttttgggatttttttttagatctgcatatttcttgtacatatgcatgcaaatgaaagaagggagtttgtactggtgccatttctcccttcagttgctggttaatgggatttgctagaaaaaattctcccggttgaagggtgaaaacagacccttatgtgtatatctgtacagagatgtgtatatgggatgtggtggcactttgctgaatgtgaacttgccttgtcaatggaaagattgaaaagtattatgtttatttatacatttgtataaatctatatatacacgtatgtatatgtgtgtgtatagataaagctatatacatatatttcccttaaaaatgtgtgtgtataataggtaaacagcctttgttaagcaagattaatgtctatggaaagttctggattattctgtaagccagaggaggtgacagtctagagtacatcatcagaacatactaaaatggaagtcctttggattatagttttgtttatggatattacacaatgaatgcttgtctgaacagttcttacttgccagttccactattcttcatcttcaccaccttctactggtcagtctttcatcacttaaaaaaaaaaaaaaaatcacacatcattgtggtttttttcccccttaattctgtctcttctagccagaagcatctggcttaagcatatttcatcaacttctctgttatttcttttaaagatctttatctctgaaattttcccagaagatacaagttttggtaatattatcaataggaattttgagacttgggcattcatctttgtctcaaaaacaaacagaaagccaaccttcaaataaaacaaatttgaaagttttagctcaataatttggggacattttacttaaattacaaaagaacataattatgattttatgatcgatattagtgttaggtttatttccacacttactgtcattaatttgtcatttacatatttttatttgctttgtagtttaatcataacttcaccatttacattttaatggaaagcatacaaggtcacatgttagcctcttgaattctgtaactaactcatttttctcatgatgaaactgctttgatgaattcctgtgtgatgaattctgctatatttccttttgacttttctcagtttgtgacattctgtattaactttgctgcagctctctagaaaacttgcatccctatatattgtgcctttaaagctcttatgcacacacagacaaaagtgtatatatacatgtcagagcatgtgtacatatgctttcgtatgtactcacacagtatgtctctagtatatattgtgggagtagatatatagatattcaaaggcaatgaaatattgctctccagatatatatgtatataaatagtgttgatataactgtatatacacatgtatatgtatgagttttaaatggcaatcttttacatttagcaaaatgctgcccctactggaatattgtcactgcagtggcagttgtatgtaatgatttaaaatacattatcaaaagttatttaaagaacatttaaagtctcatctaaagacatccacacactatttatttatcttccttttccttttattgttgtgtttttcttaactgaaagggagactgtcattttaaaaatgccatctgtcccatgagagtaagaaagagctggagattcacttgaggagctttgtgcatttttcctctctctgaagtggagatgttccacagaccagactgtttatttcacttataaagcaatcctaatatttccgttagtgtatgtcagccaccatctcctagatcaacttaattcaccaatttgcctcctcctttcattaataaataatgattattgagatcattttgcctgggggaagttaactactcccatgctgcagggaaatatatcacctaattgttattttgccttgttcaaaattcaaatttgaaagaaggcagctctctcatgaagctgtcttaagcacattttagttaagggccctcccaaactcttttttctttctttctttctttcttttttttttttttttgcgagttccaagttgcatgtgcttgaaatagatttaattcttattccccacagtttaggtatttttcattagtacatcaatttgacacactgaatgcaagactattaaggaagaacgattaaatattattttattttgtgaagagttggcagcagattacatctcaagaacttgcagagagaggaaggtagatggacaatcctaaattgtaagatgttacaaaaaacagtgaagtaagagtactcctgaagactaaaatagagaggctggggtttgagccattttactgagtagcttagctggaacctgatatcagaagtagcctttaacaaaaagcctcttggcaattgtatggtactaacaactagagtactgaagtgtaagttgaaaccaagttgcagtgggaaatcaaaggtgaggtagcttatttgaaaccagcaaatgagacaggttggacagttttaaaatctcttctaacaaagaaactgcacggtagcaaggactagcggttctcaaagcccttctttttcagtgttctcattcaccttggcacccaagtatgtttaacaggccatgcattaaaaataaatacaaaaatataaaagcc

SEQ ID NO: 98295 - DNA, 4832 bp, Homo sapiens
tcccaactaccgaagaggctgaggagcttgaacgggccttgcaggctgtaacttctctcgagtgcctgagtaccattggggtccttgcccagtcagatggtgtgccagtccaggagttgtcagatagaggaataggggtgttctccacaggtactggagcttcaggaatacaatccttgagccgagaggtgaacacagacctaggggagctattgaatgggcgtatagtacatgataatttttctagtctagagctggatgagaacctgctccgttctgctaccttgtcaaacccacctacacccctggcagggcagatccaggggcagttctctgccccagccaacgttggccttacttctgccactctgatcagccagagtgcacttggggagagagccttcccaggacagtttcatggacttcatgacggcagccatgcctcccagaggccacatcctgcccagctgctgagcaaggcagatgacctaatcacctcacgacagcaatacagcagtgatcactcacactcctcaccccatggaagccattatgatagtgagcatgtgccgtctccctacagtgaccatatcacctctccccacacaacatcgtactctggtgataatatggcagctaccttttcagcagagatgcccatcatggcgcagcacttgctcccaacccaacttgaggtgccacttggaggcgtggtaaaccccagaactcactggggcaatctccctgtcaaccttggagacccctctccatttagcaaccttctcggcgcagatggacatcttctttccacttccctatccacgccacccaccacttcgaactcagagaccacacagcctgccttcgccaccgtgacccccagcagctccagtgtgcttccggggttaccacagaccagcttcagtggcatggggccttctgctgaactaatggcctccacctctcccaagcagcaactccctcagttcagcgcagcctttggccaccagctgagttctcacagtggcattcctaaggacctgcagcccagccacagctctatagcccctcctacaggcttcacagtaacaggtgccacagctacaagtaccaataatgcatcttctccctttccctcccctaactgagggtgtctgtgtgtttgcaggcaggtggggaacccagtgttttctatctttgtttcctctttagcacccctctccccttttcctaaagaagatataacagatggggatcagaggggcaccccccttcccagttcaatgagtggccctgcagtggacctcgctacagtgttcacatgtgctccttagcactggtgctcattccctcctggcaggcccactccgccccagtggtttccttagtggttcagcacagtgactggataggattgatttttagcagcaagtcctagaagtggaagatacctcagaataccagtgccctttactatttcctagtattcagatcagtgctttccattctgttgccaggtttttacataggtggttctagatagaatgatcttattaattgagttcctgtataagagacagcaaatggtgtgtggcaggtcaagattctgacctagcaccaactgctaaacaccacagtgaggccaggattccattcgtaattgtgatcatgtttaactaaaagaaaaaaatgtgtcttttgactgcctgtgagtatgcgtgtgcccacgcgtgtgtttttgtgcagtgcaggaagcagctgtcccattagtttgatttttttttgttctccccttccccctacttaatgagtataaaactcttacttttctcctgtcctacatctcacagtcctaataaggttggtccttcttttcctcaagtttcctgaatagggagggtggtggactggtcgtgtgagtagcacaacctttttctgctaaaagttagcccaagaagaaacagaacatagaaagcttggattcccgtcagtgaggtagggatgtcctaaaaagcttgcctgggatgactgcaggctgccggggttctggggcctgatggtcactttgtcttttcagacatttgtttgtttctaaatccctctctcatggaatacatttgcaagatgtaattaaagaaaatattttgatgtgaaaaagcaggataggtcagatagatttgaaaagatgggatctgtcaactccttgatccatcttttgcttttgaatttttcatgtttacagtagtgattctttggtaagatttgtaaaatgttaagacacttgtagaatcagtgtaccagttgtgaagtgatgtgtaatatctgaaggatacacattttaaagtttctttcaaagcagaatatggaaattagatataaattttattcgccctttggtccttttaaaataattcaagtacttgggtttaagtaaatttgaaaatagctttgggaaatgtttttaaaatgccaggattttaggggttaaagatcatatggggtagtttaggaagtttgtgactatgagatgaatttgtgaggtttcttgcctaccttttttcccccccagagaagggtggaactagattttaaaggcatctctactctgcttttgctgagtagtttcactgtcccttgagataccattggctatttatacctgagtctagtctaattcacatatatatatattttaaaagttgagagaacatacctattgatgtggttcaataattcatttgtcagggaatatttgatcttaattcctttctaataggtagtgattggatgtattttcctacttcctgtatgtaatctctttatgccatgctagttctaaccagtcccttcttttgaaagcttttctttctctgctttttaaaggaatgatggtgatcagcaggcattatgcagataccacgtgcctgaggttatggaggggaaatgtcacatgactgtatgaaatcattatatgccctattttgtatttattgatgtttctttttgtgggccaaaaatatgtttgtaatatatttagtttttttaaaatcatggtaattgattggaagatttatttttaatagctttgccttttttgcagagtgcaaaatttctaaattataacttatgtcataaagcaaaattatatttggtatcaccataaatttctattctgaatggtgagaacagataatttgaatatttctcacctgtgagtctatattagtaagcttttttattttaatgtactgtaatgaagtggtcacgagtagttacctcggctcaaaaatgtcatttagtttgttaaactattttcacaaccatcataagcataactagataactgtccattcccagcagttcagtttagtctccattgtgtatttaaaggttgtcgcagagcagcacattgacttcctcatcagccctttgacaaggaagggaaagtcgtgggtagtcgatttgaactttttctgtctacttgtcccctcatgttagctgcttgaaattcttcagttatgatacaaagctgagtttgcagtaagttgcacattttattgtttgcaattttctgttttatgtgcatttaaaagcccttctctgctttctagtaaggaggcatgaaattatcaggaatgttgctagttacagcttcacaccaaaaactttgagtaaatacattttcgtttggatgcccatgatgaaagctgaggaaagtggttgaggaattatcaacaacaaacttttcctcttattttatctagttcaaaacagatatcaaagtttgcaatttgctttgctcttgctgtttcttatgagtccctttttggaagagaggagaacatctataagcccagagagatctgtgtttttcttttacttaatagagccattctcgtctattagtaggaactttgctattaatatgtatagaaaggaatgaagtggcttttactccagaaatatgaaaattagtatcttttaaaatagcacttatgctatcacaaggcaatactggaatgaaaaacaaatcttatataaggtcctaaataggtagaaactagcttttattctagtgttgaacccaggagaaatagtggcaaagaagtttcactctgtttctgcagttctttgggactatttataaaggccagttagattgtgttactgtgatttaatttacaaagttgctgcagttaatggatacattctgtgctctgagaatctgaattccattctaatgtgtgatattcactggctatgatcagtagtatctgaagaaaagatgggctttttctcctttactctctctacataattattaatattattttaattaaagtacttaagacattgttttttcttctgtaaaaatggcttagcaatttgcacatctgggtaggttatgtagctagtaaacaactcaatagtaagtagcaattatacttaacccaccaagtgacagactatgcaatggaaaaattttctaattatcgtcacatagcttagacagcaaaggattattttctctggtgacctaccatgtgtgatataactgctttataaatgacttcctgagcaatttcatgttggcaggcagtgtggtgtgtctagtgcccctctatgagaagactataatttaatcagaaacaaatagtaggcatggggagcaagttggaaagtgaggttattattttttttccttaaaattggtgttactgtctttagtggcttgaggctaaagaaagctgatactttatctttgccaaataattatttataagatttatttttaaataagcccaatctctcacctgcagttaagaatcatc

SEQ ID NO: 98296 - DNA, 1050 bp, Homo sapiens
agcttgttttttgattttggttgtttttttttttgagacagagtctcgacctgttgcccaggctggagtgcagtagtgtgatgtcagctcactgcaacctccgcctcctagtttcaagtgattctcatgccttagccttctgagtagctgggattacaagtgtgcaccaccatgcccagctaatttttgtattcttagtagagacaaggttttgccatgttgaccaggctgatctcgaactcgtgccctcaagtgatcctctcaccttggcctcccaaagtgctgggattacaggtgtgagccactgtgccctgcctgacgttagcttcttttcatgttgaatgaacttggcttggtggtattgatgtgaagataatgggggagttatgggaccaacagtgtcctctttcccaggagcccatccacgccagagctgagtgctgatgagttgccggatgacattgccaatgagatcactgacattccacatgacttggaattgaaccaggaggacttttcagatgtcctgccacggctacctgatgacttacaagattttgatttttttgaaggtatagtcaatattttgactcaaggaaactggttttaaaaatgagtttataagaaaagaaatagtgttttgagatgtgtttatcatattcctcctcacatgtaatgtctttcactgtagataggaaatataatgccactgcagctattttaaccctttcagaagataaggaatgtgcagtttgtttaaccatctcataatttgctgactaggtttataacttgtttcttttttctttggagacagagtctcactctgtcgcccaggctggagtgcagtggcacgatcttggctcactgcagcttctgcctccgggttcaagcgattctttcgcctcggcctcccgagtagctgggatttcaggcatgtgccaccacgcctggctaatttttgtacttctagtagaggtggggtttcgcagtgtgggccaggctggtcttgaactcctggccccaagtgatccacccgccttggcctcc

SEQ ID NO: 98297 - DNA, 1054 bp, Homo sapiens
atgtgatggaaaatcctttatgtaatccctgacttatcaaatgctgtttaggatacttccatagttaaaaaaatacatggtagaaggccgggctcggtggctcatgcctgtaatcccagcactttgggaggccgagacaggtggatgacaaggtcaggagatcgagaccatcctagctaacatggtgaaaccccgtctctattaaaaatacaaaaaaattagccaggcgtggtggcagacacctgtagtcccagctactcatgaggctgaggcaggagaatggcgtgaacccaggagatggagcttgcagtgagctgagatcgcatcactgcactccagcctgggcgacagagtgagactctgtctccaaaaaaaaaaaacaaaaaaacaaaacaaaaatacatggtagaattaatgcgatccctacaaccaaatttctttaggtggttagcaagaaaaaggtggttaaaaaccagaatggttaaaagggcagctcttagataataaactgttagaattcgctgccctatttctggtatgacctatcttttatgaaattatgctatgtgtttcctcataactgtcatgtcatttactcagactttttagtaagtaaaggtaaagaaatgaatttttttcctcaggggtctctagtcacttaaaatttagaagacactggtatattaagtgtctactgatgccatgctaagaaggctgtttttgaaaacactggattaactctgtccttactgttgaaatactgtacttagttcagctctgttggaattctcttactctaattgtgtgaagtatgtgctcacatgccacaaaagttttaaacctgtgcattcagctacatttcctaattctcgtttaccctgtctaaaatgagcctaatgtgtaatcagtttttcctttctctccctgcactttccaggtcagatgatgatgatgcggagagtaggagctccagggtgactcaactttgcacttactttcagcagaaatataagcacctctgccgcctggagcgggcagaatctcgtcaaaagaa

SEQ ID NO: 98298 - DNA, 1007 bp, Homo sapiens
tagcttagcctttttgttgtaatgtcattttaaaaacccgattgtgtggccaggcggtggctcacgcctgtaatcccaacactttgggaggccgaggtgggtggatcacgaggtcaggcgttcaagagcagcctggccaatatggtgaaaccctgtctctactaaaaatacaaaaattagctgggtgtggtggctggcgcgtgtagtcctggctactcgggaggccgagacaggagaatcgctgaacccgggaggcagaggttgcagtgagccaagatcgtgccactgcactccagcctgggtgacagagtgagactctgtcaaacaaaaacaaaaacaaaccgattatctttgtaagaatagaaatgagattcatcaggagacatttattcacaccatgatagtacttgcaataggtatgttgggttatgttattttgtgtagctttttagtttaaattttgaataaaagtaaactttttctaatttgcaatatctcctgtctaacccaggtttggactggtctgaagagagcggagaggaaccagaggactcagagcaggcctcgccctaccaggttgcatggtccatccgggaaaccctcagatatcaaagacatgcgtaagtcttctgttctgtttttattcttttttttttgagacggagtctcgctctgtcacccaggctggagtgcagtggtgtgatctcagcttactgccaccaagcctgactaattttttttgtatttttagtagagatggggtttcaccatgttggccaggctggttttgaactcctgatctcaagtgatctctccgcctaggcctcccaaagtgctaggattacaggcatgagctaccacgcccggccctagtttccttcttgaatgaccactgtagcagattgatatttcccactatatatgctgatacttttatgttattagatctagttttattgtaaaataaaggtaaaaaaagacttcactctaaaaaattggtggtaaaa

SEQ ID NO: 98299 - DNA, 1401 bp, Homo sapiens
atagagacggggtttcgccattttggccaggctggtctcaaactcctgacctcaagtaatccacccgcctccaaggtgctgggattacaggcgtgagccacggcgcccagccaacttaatgttttataatgtctcttattttcttatttaacctcgttattgggatgttgatttacagtgaagaatccattgcattagtaagggtgatatcttagtattttgcttcctgggtgagctagctttgcttatttctgtttgttaactaggccttttgatatttttatagacaatctgcttcatcctgattctgcggcattccaaactgtggtatccttgggggttctcttaacattgctatggtgcagaagatttaaaatcaggtatggctgtggggccagaagtccctcagtgaaattctcaacttaaatctgccttatactctctgatttatcatttgggtttctttttttgtggtggccttttagctgatgttcacaaggaatagagtcacgtgatgtatgaagggaaacatatacacttctctgaggttgacaataagcccttgtgctcatatagccccaaactgtgcaagcagaggcgactcaacggctacgccttctgtatcagacacgttctggaggacaagactgcccccttcaagcaatgtgaatatgtggccaagtataacagccaacgctgcaccaaccccatccccaaatcagaggatcgtaggtaagggctaatcatgagaatcaatccttgatttcattaacaggcttggaattttttcttttcttgttttttcttctcttttcttctgtccttcatttctccctccctcccttcctccacctatataaatgttgaattctgggggtaatctaagtaatctatggaatacttttaaagatgaaatatggcaattttttaaaatagagtaataaatttggggaattacttaaagtatgtttgagtgtcttctatttaattgatttcatggacttctagaatttttaaaagattttttttccctcaaagttgctgcttgaagtcttgaaacggatttgtttggtttatggccttataaagtaattcctgacttttctacctagttttctcatttgcctaaatgagagaaatttaaataactaattaggtgttataattaatgatagcaattttggagtttaaaatctatgcctagaagttagtaaaggatatatacttactgaagaaaattttaaaaaactacttgaatcagttagatttatttcctatcagacttctcaccagtgtttggcatgttttataaccttaccttttttggttaaaaagtgttccaaatagagtatgtttgccataatttggaaacactattttcacattaagggtcggttttgc

SEQ ID NO: 98300 - DNA, 1150 bp, Homo sapiens
gctgggactacaggcgcccaccaccatgcccagctaattttttttttgtatttttagtagagatggggtttcaccatgttagccaggatggtctcgatctcctgacctcgtgatccacccgccttggcctcccaaagtgctgggattacaggcgtgagccaccgcgcccggcttctaatggtagttaatattaagtgattactatatgctggggttacagttcatgaaatacctaatttaattatcctaggcaactcaatgagatacatacaattacaatcttccctttacagatgagaagactgaagcctaaataacttgcccaaggtcttatacttagtaattagcaaaaccagatttgatccccctctctgatacctaccagagccagtgagtgatctttctgctgcataaactatccttacctttctaatatagcagggaaggaactagtgtaaagttcattgaaattcctaatgcaaacttacttgtacagtgctgtctgagtacagtatatggcacatactagacattcaataagcattattttaaaatattctggttcaaacttgattataatgaatgttgtttatattttcgagtgataagcagttttctcactgcttctttctcttccagtcacatcagttgatagattttcatcattcctcagtctgattttactattttttacataggtaatatagatgtttggttcttaaaatcaatatagtcatctgtttagtgtcttattacattcttatgcttcatcaagttgaattaaaactcatttaaaaagtacataacatggaaaaacgtttttaagactttatgatactctaaatatgattttaacagtatccactctttctgggataagtaaatattcttttcatttgcattaagtatattggaaaacaaacattctgataatttagtaggctcatgttagttttatttattttattttttgtcgagggtttcattacattgcccagcctggtgttgaactcctgggctcaagtaatccttctgccgtggcctcccaaccttctggtattacggtatgagccactgtgcccagcctcacactaggtttttttttttttttttgagagggagtctcactctattgcccaggctggagtgc

SEQ ID NO: 98301 - DNA, 1038 bp, Homo sapiens
ttgaagtgtttttgtgagtccccgtggacggtagtgttgcatggttttgaaggcactgagcagtttgtagaattgataggctcactttagagtcctgggcatgtttacctgacttgattggtaggagcagctgctggttcattcatttaacagattagcttctctgttgtagctctgagctttgcaatagagacacgttctctgcccttgaggagtttttagtctattggagaagaaaaataagctgacatttacaatgccaatgtgaatgttaagtaatagcttagcctggaggaatattcttctattctggcctaaagggcaggctaggttttaaagtgagggctttgcaggggaagtttctgtcctaagcgaatgggaggagttcggcattccataaggtgtgacctgtaagtaggaatcaaagtttagggacaaaagagtatcctgtgttgcaaattgtggttctgttacctcccaggagttggaggaggaggggaataaatagtgagagggaaaggtcagtctggccaggtcctaaggagtttctgtgttaggggaaggagtttggatttcttttacgtgacaagcagaccctgaaagtctttggccacataaattacttgagatttagaggatttgagttatacagagtaggaaaaaggaggacaagactgtaattagaccagtgaggcagctcctgacaagagatttgaagagggtttgaactaaggtggtggcaatggcaattgagaggaggtagcagtggcagaggcatgttaaggaggtaaggcgatctcataggtggactggatgtaaatgtgggactcatcctcacagacggctgctgaaatggtagaagtagacaaatttgggctagtcagtggttcttagtcttggacacttctccagaaaaatccacatatgcagttgtatacatttggtttgaaacctggggtaggcttggtaccatggctcacaactgtagtcccagcactctgggaggccaaggtgggcggatcacttgagctcaggagt

SEQ ID NO: 98302 - DNA, 1023 bp, Homo sapiens
atatccggtcatttagcattgagcttaagaaaatcttgatatttgagattgtatggatctgatacaaaaatgcaaattacatttaatggttgttttaagtttattgattaattgaaattgtttattgacatggacatttttttaaacatgtgtaccaaaaatcgttacttctattatagtttgtccttatttttagagcatatactggatggaaaaaaatcattcttagtcatttttcttggaacattttaaggtttgaaaaaaattgttattgccttataatttgatattttaaaggtatattgttgacttcacattcctaagctttccaaaactatgtgtacaaataccaaaaaagttttgtactttttcccaccctacctcaaacatgtattaatttcctaacctgatcgcctaatgggctactttatttcctgaaggaatgacaggtttgatgtttttaaaagttacattccatttgaaattaataaaagattttcagggcaaatactgaattaactttaaactactaagggaatatgcttttttattattaagtgttagtttaaaaagtaaatggttagtataattacaagtctgaaataatcaagttttctttcctctggaagatttttaggaggaaatttgtatatcccattccaactttttctcagcaaatcatgttgctactatttttagagaaataaaaattttagtttagaaggaattaaacatttctgagagcacccaaaattaatgacatttcaaaaaaatgctaaactatttattcatacctgagatgttctctgagggttagcagctctcactatccaggtttggtacaatggttatggctaatgaaaagtcatttatatttgaatacagttagagcaatattctcagacacttttctttccccctcccccacacctggtaactggtaaaacaatggttgaataggtgagactgggttggaggcagcaaattgtccccagtgctaagtcagtttaacttacacatgca

SEQ ID NO: 98303 - DNA, 1037 bp, Homo sapiens
agagagctgctcctctgccctccgaaacgacaactttcctaccatcttggaggcagagcaaaggggggccagggggaaaagtgcacccgctcccgataaagtacaaatttttacttctcatctctggaaaaaagtccacaccggccgtctacacccgcgcctgggggagaaagcagggaagaaacggggggtgcatgagaaacgttttcatttgctccagggggaaaaatgtttctgcatcttctgatggaaagaaatctttacaagacacaggttttccggtggttattgttttttattttctgtttttaatttttttcatgttagtgacagtgatattttaatatttttttaagccagtaataatttttctccattacagggctaagttctgtggctggtggtcagtttgtaaatttatacttaaagagacttaatagtaacttcatttatttgtctggttatgttattgtatatataaatatttatgttttcatatattgcatataaaaatttgtgttacatgttactctcagaacagattgctgtaagacaattgtaaaaaaacatgtctttcgtctgtttctcaaagcaatgtaaataaaacctatggactgtccagaaaggcatgatacagtgtgtcattttccacagtgcagataaaggcagctatcactggggatttaaaaacggcccctgtttctggaaattctgttatgctgcccatacagaaaggatacagtaaaactggaaagagattttaaagacagccttagatttttcttgaggtaaaatagcttattaagaattatatccgggcatttaatttttttatttatttagattctttaaactctagctagatctttggtgcattacacatgttgctatctgctttttgtgtcacagaattgagaaatgtggctatttttgttagttatgttagttcagaacttccaatgtgctgccagcctgtatgatagactttttgtatattgcagtggatgtcatgaatttacttttttaaatgagcaaag

SEQ ID NO: 98304 - DNA, 1032 bp, Homo sapiens
cttaaagcacattacagacacttttcatcttaacaattggaaaaaacaagtactagcaagtgaattgcttaagattacatagactagcccaattctagagagaaataattcaagtgtatcttattgtcatcttgttgttaagtacagacatattcagatttcaccagtttcccactaatgttctttttcttttttcttttctttttttgagacaggttctcactctgttgccaagctggagtgcagtggcacaatcacagctcactgcagccttgaactcctagacacaagtgatcctcctacctcagcctctcaagtaattgggactgctgacttgaaccaccatgcctggctattttttattttttagtagagatggagtcttgctgtgttgcccaggctgctcttgaactccttgattcaagtgatcctcttgcctcagcctcccaaagtcctaggattacaggcatgagccactacatttgacctaatgtcctttttctcttccagagagttaatctttccttgtctttcatgaccttgacatttttgaagagttctagtcagttacttggtataactgtccctgagtttgggcttgtcttatgttttctcatgattagatgagttaatatatttttggcaagaatctcagacatgatgtcctatcagggagtacatgatgtcaaaatgtgttattacagacagtttatgtagttttgttttctttctttctttctttctcctctcctctttctcctcttctctttttccttttttttttttttttttttttttgagactgcgtcttgtgctgttgcccaggctggagtgcagtggggcaatgacagctcactgcaacctccacctcctgggtttaagtgatcctcctacctcagcctcttgaatagctgggactacagtcatgcataaccaaccctagctaatattttatttcttgtagagacaggttgcactatgttgaacatgctgagtttgaactcctgggctcaagccatcctgccgtctcag

SEQ ID NO: 98305 - DNA, 1031 bp, Homo sapiens
gagcttgcagtgagccgagattgcgtcactgcactccaggctgggtgacagatcgagactgcctcaaaaaaaaaaaaaaaaaggctgggagcaacctagccttgatctgaggtatatcgttatgtggataaagttaaataataatagaacatatgcctttctgtagctcctccagctacaattcccataaagcataaagtggaaatgtattgtgtacttagcaggaactaaacagccacaccctttcatgggatggggcttattttgtatctgcaaacctgggggaaatggagtaagggaaggtgtatgcgtgggcagctgcattcccttgggaaaatggggttattcctccgtaactcctgtgtgtgtcctctgtgaccgttactctctccttgtttatccatcactctcctagccaagtgcatgtgtcaatcttttttcaaaccttttagttccatatgagatgggatgggctccttactccttttactccccatatctctgatggttttcctctaatgtgcttacctaataatttcctctcacatcattcccagtcatacatgaagtgcatcttctacaggttcattgacatcgtgtgtattatagaagtgataaacaactattaaaagtttactttgtctgcacatccttcatttggacttgacttataaaatatattgccctagccagacgtggtggctcatgcctgcaatcccagcactttgggaggctgaggtgggtgaatcacctgacattaggagtttgagaccagcctggccaacacgatgaaatcccatctctactaaaaatacaaacaaaacaaaacaaaatgccggtcatggtggcaggtgcctgtaatcccagctacttgagaggctgaggcaggagaatcacttgaacccaggagacagaggttgcagtgagccgaggtcgcaccattgcactccagcctgggcaacaagagcgagactctgtctcaaaaaaaataaattaaaaaaaaaaaatatatatatatatatatatacaca

SEQ ID NO: 98306 - DNA, 1047 bp, Homo sapiens
tattttaaatgggtaagaatgggattttttggccaggtgtggtggctcacacccgtaatcccagcactttgggaggccaagacaggtggatcacctgaggtcaagagttcaagaccagcctggccaacatggtgaaaccccatctctactgaaaatacaaaaattagccgggtgtggtggcatgtgcctgtagtcccagctacttgggaggctgaagaaggagaatcgcttgaatccaggaggcagaggttacagtgagccgagatcacgccactgcgctccagcctgggcgacaaagtgagactctatcgccgagaaaaaaataaaataaaataaaatgggttttttgacattgttgaaaggaaattattccaaaaatcacatttaattttttacattgaaaatactgcagttatggtaaaattccataattgctttgcaggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggtaagtatcacctgtgacaccagaaacaaaagagagtagtacattatgtatgttagaaaccatttagtaatatatttagtgaactgaatgttttccatttgagaattttgcctcccccactcctcctcctttttttttaaacaaaccacaagtgttattagttacataattgatactgcttttaagaattattacctgccgggtgcggtggctcacacctgtaatcccagcactttgggaggccagtgcgggtggatcacctgaggtcaggagttcaagaccagcctgaccaacatggtaaaaccctgtctgtactaaaaacataaaaattagccgagcgtggtggcgggcgcctgtaatcccagctactcgggaggctaagacaggagaatcacttgaacctgggaggcagaggttgcagtgagccaagatcatgccattgtactccag

SEQ ID NO: 98307 - DNA, 1034 bp, Homo sapiens
tttgtgtttttgagatggagttttgctgttgtcgcccaggctggagtgcggtggcgcgatctcgatctcgggtcactgcagcctctgcctccttggttcaagcagttctcctgcctcatcctcccgagcagctggggatacaggcgtatgccaccatgcccagctgatttttgtattattagtagagatgggatttcaccatgttggctaggctggtcttaaagtcctgactgcaggtgatccgcccacttctgcctcccaaagtactgggattacaggcatgagccagtgtgcctgggcatgttgtaaaacttttaatcagaagtctgttaactttttttgtacttgaaaacaagtactgttttattttctgaacatttcattgtggtctttgctgcgtgtaggtttcttggtgatgcccttttcatctgtttctagttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctgggtgagaaatatgaagctaggatctaggctttcctttctttttttagttacaagttatgtataaaatgtgacaacctggattctccaacatatcccccagtttattttcatatatagaccaagatcaaaccagaagttgtaggaaatagaggaatccacttatcactaagtatctcaggcacagtggctcacgcctgtaatcccagcactctgggaggccaaggcaggcagatcgcctaagtgcaggagtttgagaccagcctggccaacatggcgaaaccccgtctctactaaaaatacaaaaaaattagccagacgtggtggtgtgcgcctgtaattccagctacttgggaggctgaggcaggagaattgcttgaacctgggaggtggaggttgcagtgagccaggatcacgccactgcattccagcgtgggagacagagtgagactct

SEQ ID NO: 98308 - DNA, 1847 bp, Homo sapiens
cacctataatcccagcttttaggaggccaaggtgggaggattgcttgagaccagtagttcaagaccagcctggtcagcataatgagacaccggctctacaaaaaatttttaaaatgtggtgagaggatagtttgagcccaggagttctaggctgcagtgaattatgatcatgccactgtagcctgggcaacagagtgagaccccagggcaaaaaaaaaggtggggggttcttttatttaattgcagttcctctaagcttcattttttaaagtaattcagaaagggaattaattgtaaaaaaaattttttggtaaaccaggtaacagaaactttctttattcccaaaagcaccatagtaaacaccgtatgtgtttctcagaaagacagaatccattgatgtaatggatgcggttggaagtaatattgtggttagcacaagaactggagaagtgatgaggattttgccacgtatgcatgaggacatcaatgaagagtggatctctgataaaaccaggtatatgctatattgttttccttaacttttacagtttatttaaaggaaattttataataattttgaagaattatcttttatatttgcaaattagttactgaatatagactactggaatctgagttgcttatataatgtgataatactgactttaatagtcctaggtcaatccctggatattgtatttactttgagaaagatattttttcctcccacatggagaaattcaagtagattgatacattctcaacttatttcagtttgttcattagagaaaagaagctaggctgggcgcagtgactcacacctgtaatcccagcactttggaaggccgaggtgggatgattgcttgaaaaagaagctgaatagaagagtttgcacaatataattttgataaaatatttagagatactcatgctttgtaaataaaaatgatttgacttttttagctgtcagatttttttgtgttgtaattttaagattgttcagttagctgaaagtataagaaatcaaacttttttttgtatgatttaagggaagaaatcaaactttcagatggtattttagttttaggtgaagttcataaaatctattagttcatctctaaaaatatctggaataattacttgtatctaggtgtttagatatttgacactttaaccagtactgtatttaaataacatttcttgttgatttaacttgaaaattatagttacttctttagcaagattccacaatggtgtaatttctgttttctagatttgcctatgatgggctaaaacgtcaaagacttaccgagccaatggtcagaaatgaaaaagggcttttaacctatacttcttgggaggatgcgctctctcgcgtagctggaatggtaaaatttgaaataaatagtgttaaatagtgtttgtgattatcaagaaacatctttgccatgaagggggggatgtatatttcttcccttttttacttttaccaagattatgatttaatctccttccattttacagacatctactgaggacatatgctagatattatgctattaagggatataaagaccagagacacatcattcctgcatcctacaatcttgtagtagagaaagttgcacaattcagcaattattatatgcagctatgagtaattatataaggagtaatatgagtgagagcacgtaggaggaatgcctaactaggacaggcatatcaagatgccttccttggaggttgcagtgagccgagatcgcaccactgcactccagtctgggtgacacagcgagactccatctcaaaaaaaaaaaaagctgccttcctacagaaggtgattctta

SEQ ID NO: 98309 - DNA, 1022 bp, Homo sapiens
cagtatttccaaatggctgtataatatataaccaggatgtagagttgccaagtagcacattaaaagtgctgacgccctgccatttttagtagagaaaagggttgcagggaagaagttcactttcagtagtttaatttcattttggtgtatgcaatttttttattcaatagtgcctgctaatcaaagcagttatttggtgttctgtttcagagcagaataaaaaattgcattgactattagaataaacctaaaaaccaggatgttttatttctgagataaatgcaaagtactagatcatcgtattatgaatatgaaaacttaacaaaattcagttttaaaaaataccctattctttgcctgttatcaaatgtataatttaatgtttttatataatttaacatttttatatattgagttgcttgtaatcacaaataaatacaaatacacatttttttttttcattgaaatcccaggttgtagctgcttgtgccatgccagtaatgaagggttggaatatcctaacaaactcagaaaaatccaaaaaagccaggtactttattgttattcaatgtagtaccctttcataaagcagaaaattgcacattttggtatttagaccttcccatagattaagaatttaatatcaaactcggaagaagttggtgtgctcagcttctaggagcaatagaagtgagtactacatagtagagaaggtgaagtcaggagtttatggtattgagctttaggatcagcattaaaaatccttctttagtaacttgctcaacttgtgaagaagggtgaatctggacttactaagctactactatactatactgggattgattgtgtttgtttttattttgaattaatgtgaatattttctgaggaccattcagcaacttttgatcattcggtattgttaaaagttacaattttctttattttttgaaacgaggtctcactatgttgtccaggctgggcttgaactcctggcctcaggtgatcatcctgcctcagcctcc

SEQ ID NO: 98310 - DNA, 1023 bp, Homo sapiens
gcataaggaatgtcagctaggatgaaggctgggacactatctgtctttttcactactatacctgcatcctgcacaaaggaaagactcaacacatttttgctaactaaatagtttaaacactggaaattgatgagattgctttagaatgaaggctgaggatgaggaactaactctagaggaaatttgaacatgtttatagactaaaaggaggaagaaattgcagagcagggtaggtgataattggcagagcagggataatcccccttactgggcaaacagaaactgggaaaaccttcagccacagtgggaggtgagtcctgggtagcatataggagccaaagacagatagccagctagataatgtgtagtgaaatctctaatccaaaggaggggagcgaggcaaagaagaagtccaggtatgaaaccactggggacattgtggacaatggttcaaaatggatgtgggaagtcaagtcttcagcacagtggaaggatactttatccagtttcttccacataaggtgaagtcacgccaaggatcctgagatcctctgaggcagcttcagaggagacgggttagaatcaaaggcaaagaaagggactgaaataagaatgaattaagatagatagatagatagatagatagatagaagtaataagatgctgtatgtgtgtgtttcagcaataacagcagtgaagtcaggttattctaatgctttttttttttttttttttttttttacttctaggcttgtgagaaggttggcatgcagatccctcgattctgttatcatgaaaggttgtctgttgctggaaactgcaggatgtgccttgttgaaattgagaaagcccctaaggtacttgatacctaaaattctacaccatgctgtagaaggtagaaaactttaaatcttgcagcaaactttatttagaatcaatatcgtagtggagaacctagccctctttacttctatctataaatttaattcttttgtacaattgattctcttcatttcaaaactg

SEQ ID NO: 98311 - DNA, 1030 bp, Homo sapiens
agagcttactctgtgccagcctggtggataggtactgaagatagaaaaattcaaggaattaatgcagtgagggcagaacgggcttataaacacataattggaaatctgtaagataagtgtaccagaaaatagcaatcaagacacctcaaaggcttgggctggtgagctatctcagaatatctcaggaacatttagtagacagctatgcttagaacatgaaatgatagaatgggtattggtaggaaataaaagcagaaaagacaactttattttacataaccattaatgataagctcactgttagtcttgcagtttattttactgtgtggtagtgctttaagtttgatcctttctatgtcatttttttttaaatggcaaaactgctctctgcatagaattagaaagtccaaatgtatacaatagctgctgctgcttagctctttgacattgtacaagtcagtatctctgagactgagaattctcatctacagactaagtgaaaatatcagaacctatgagtgttcaatgacataatgtatgtgaaataatttaaagccataaaacattaccaaacagttggtgattgtttttttccctacaataatataattctttgttttatttttagcaatatgttaaggatacctgtaagaaaggccttagtaggcctttctaagtctcctaaaggatgtggtgagtattttcttaaatttgcattcgtggatattagaccttatttttgtaaatttataagtctatggcatagtttatcaaagaccctaaacccatgattttttaaaataaaaatagaaaccggccgggtgtggtggctcatgcctgtaatcctagcactttgagaggctgaggcaggtggattgcttgaagccaggaattcaaaaccagcctggccatcatagtgaaaccccatcactactaaaaatataaaaatcagctgggcatggtggggcacacctgtaatcccagctacacaggaggctgaggcacaagaatagcttaaacccgggaggtg

SEQ ID NO: 98312 - DNA, 3914 bp, Homo sapiens
ccttgcattcgacaagtttgtcggcaatttccgtcagccgaccagagggcggagctgaggtcggcccagcccggaggcgggaaggacaacttggacccgcagttccgccggaagtggccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtgagcggacgggctgagtcggggtggcggggaggtttctccgcccggggccggggccacgtggcgcagcgtgtcggctgccgcgggagggagggaggccgggcccggggccctttcgagagggaggggaaagcgccccgttgccgtctcccaaggccctcgtgtggggcgagcccggcctccggggagcggttcacgagcaaggaaaggttaaaatgtgctttatttacacttaattcagccaggtgtttccgcatcgctgcccagttaatacatgttaagctgtagatagagcaacgccagacattgcagtatttgaggtctacttagtggcagacatttctcaggatagcgcggtgacccaaacatatggtttgatttgaaggagctaataagaaaagaaaagcattaaagcaaccctgctggggttagtgcccactaattaatgtgatgcatacggtatttattatttattcgctggcgtttgtttttcaaaggtgtgtgtgaatgtttctgtgtccttggcaggtatgtgccatcacaagcagatgtggcagtatttgaagccgtgtccagcccaccgcctgccgacttgtgtcatgccctacgttggtataatcacatcaagtcttacgaaaaggaaaaggccaggtaaaatcatctttgtatagagctgaagaataagactgctctcgaagtttatcaggatgttcacatgacaaaactggacccaggctactttagttttgttgggatattgtaagctaaatttttctgtaaccttagaaggccaagagactgaagccctccattttttcacagaacaggtagaacatggacagcagcaattcaacttttccccacactgccctgccaatgtgcctcgaccttgacctggggggcccacctctggggtgagagggtggctcattcattcagtccttggccattcttctgaaactgccaacaagggtggaagtttggggaagtggactccagttcactaagaatggaactgagcatacttaatgaaatctcaaacagaaatgttcatactgaaagagtaaatcatagtgagtattgaaaataatgtctcacatggtactaatgcttgtcgggtgaggagttgaacatatgacagtgtttacctgggcgcatgtgaaagggtaaattatgattgcaaaagggatctagtgataagtagtgattaaaacaagttattttgtattttctggaaaaggatgttatactagctcaatagtggttgaatttaaatgtttttcaagcctgccaggagtgaagaaagctttgggcaaatatggtcctgccgatgtggaagacactacaggaagtggagctacagatagtaaagatgatgatgacattgacctctttggatctgatgatgaggaggtatggcgtcttctataaagaacatatcggccaggcgcagtggctcatgcctgtaatcccagcatgttgggaggctgaggcgggtggatcacgaggtcaggagttgaagaccagcctggccaagatggtgaaaccctgtctgtactaaaaatacaaaaaaatgtggcaggcatctgtaatcccagctactcaggcggctaaggcagagaattgcttgaacctaggaagcggaggttgcagtgagccaagatcgtgccactgcatccagcctgggcgacagagcgagactccgtcccaaaaaaaaaaaaaaagaatacatcgatcagcaattgtatcaatgtggttaagccaaattgcctggatttgaatcctggctttaatttatatgcctttttcaaattctgactggttgcatgatgaataaaatcaaatcaccatctttcggctgagttcgtgatggatttgcttttttctgattaagccagtcttttttgtgatgaccccactagctttaagcagaggaacaaccagctttctgaagtggattaattttttttctttacaggaaagtgaagaagcaaagaggctaagggaagaacgtcttgcacaatatgaatcaaagaaagccaaaagtaggtcatttgtttttaacttcatttcatgttaatgtaagtaatctttttcaaagcttgaccttgaagtaatttcctccacattccttgaataggtcaatattttaaaacctgtacaggttcttccacagctactggtctgcagctgttcttatggtagcagttgtggcattcctctgtgggaaagaaactgttaacacaaacacctctttcttagcaaaacagaaagtgggtatatatgtgtgacagacacaagatgtatctgtagttttgtttggctaaggagatagtctcaaaacaaattgagatggatttgtttgtgtcttggagtagggtgaaaaaaatacaattcattatttgaataatgctgtttattgtttttagaacctgcacttgttgccaagtcttccatcttactagatgtgaaaccttgggatgatgagacagatatggcgaaattagaggagtgcgtcagaagcattcaagcagacggcttagtctggggctcatgtgagtttaggctttgcctttttttttttgaaactaacatctggaatttgcctacagtttcaacctttcctacaagacttttctaactaggatttttcttaatgctctttttagctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagattacctttggctcttgagtatgttacataggagggtggtgtatatattcctttcattttgggggaaggaattaaatgaatatgtgattcctaaataccccaaatttggtttggcattgttgttagaaaattgcagtgcaggccaggtgtggtggttcatgcctgtaatcccagcagtttgggaggctgaagtggctggatcgagaccaggaggctgataccagcctgggcaatggggagagatcctgtctctacaaaaaatataaaaattagctggacatggtagtgcacccctgtattcccagctatttgggagactgaggtgggaggatttcttgaacccaggaggttgaaactgcagtgagccaaggttgtgcgactgcactccagcctgggtgccagagcaaggtcctgtcaaaagaaaaaaaattgtagtgcaactttacccacttgtgatgtccttagcagtgcctgatg

SEQ ID NO: 98313 - DNA, 1223 bp, Homo sapiens
atatcattgttatgactttacttgattctttcattacattgtattatgaaatatttcacatgacttacatgactttgctgaaacatagcaaattctcgggcttctagctaatttaatgatcaatggctctaatcagagagctcatttgtggttactgttttccgtttttgttttttgtttttgtttttgttttttttgagacagagtctcgctctgtcgcccaggccagagtgcagtggcatgatctcggctcaatgcaacctcaacctcccgggttcaagcaattcctctgccctcagcctcctgagtagcggggattacaggcatgagccaccgcacccggtttgtgggtacttttgatggcattttggatctgggtttcatcctgagagaaaacatcaactgaaagactgctgtgagccacaaaataatggtttcctgctgttacagtaaagctacgctgtgttcattccatccttgacaaagtggcatattctgatcttgtgataatgttccaccaaaggagtttatttattttgcagcaaaagatttgtgtagattagttcatttcttgtgatgaatatcagtacaacataatcaggctacttgctatgatctcactgacctgctgtaatccaactggctaaagaagcaatcagttgtttttcttaggaagagatacattttgtttactctcttaagtttgatgaatatatcatttactgattgcttgagaaataactaaaaagaagtggtcataatgtgggaaattagtaaagagcatccagtgattctgagcagattccacttaccatacctagaaaacaggtctctattttcaaaaatcaatcttttatttatttaaggctgaaagatgtgtgcatattcttgtaaatgttcaaataacaagttaaaatagctaaacttttttttaacttactgcattttgggaaatctaacatatttctgaggaagtctcgaaatacgactttatttctttcttttttggaaacagagtctgtctccaggctagagtgcactagcacaatcatagctcactgcagcctcgaactcctgggttcaagtggtcctcccacctcagccttcccagtagctgggactacaggtgctcaccaccacacccggctaattttttttttttttaaatttggggtagagacagggtcttattatgttgctcaggctggtcttgaactcctggg

SEQ ID NO: 98314 - DNA, 1083 bp, Homo sapiens
cttccctgcatttagccatctaccccttgttgggagagcccagataccaattattctaacaagaaattgatagcgagattcaaaaaggcaacaacaacaaacaaatgggaaggcccaacaaaccacaagcctttcatcgtaaaaatggggagccagtggcggggagctgcattacaactcaatttataacttttttcccaccttgtaatctaaagagggcaatatcagctttcatctcggagtaccatttttttctactagtttctcaacagtgagccttccacaaatgatgtttgactatttctagatcacaactccttaaaagacagatttatgagctgtaattatgtaggtaaaagctgagaaaattactgaaagttctttgtccgcccaccccagcaacatgctcattttctctcttgcagtgttttaggattaatcagcagctgtagcgaaccctgtaggatcgtccctaaacacttttgccaagaccaaaaatatgaatctgcagacagagcattttgtaaacgatcaggagtccttttccttttttgccagctggtagttagtcaaatgctgttttgtaaataaatcatctgcaggaatcctcatcaggtccactgtaaatgtgtcagtttgaggaaaacaaacaggaaagcacttaccagttaaatttctgtgaggagagaagctattgtcatgcctgggtgtaccttcccggttccagaatgaaatggagggtggtgttcagaacggctgcattcctcattccacttttatctggcttttgaaatgacagtgtagagaagaatgatgttgggttttgaatgtggttcttcccttcccccacccccctccataaaaattcatcatgcaatcctggagaaaagtaagcaatgaacatactgtacaaattaattctttcgaccagcctatgtttgtgtaagaagtttgttttttgaatggaaaccactgctactagctgttctgctgcagactgaaaatcggtaatggatgggggtcacccagccctcctttgtctgggtaggcttttgcttatgaaaaggcaagttaaattagcag

SEQ ID NO: 98315 - DNA, 4195 bp, Homo sapiens
acaggtgtgagccaccacacctggccgctatctttatttttgtatggtctaacttcagctcaaccatgtgatacctgaaattgcacattgttaggccatgaaaggtcagctgccagagaagcacaggattttgtttttttccgctgttaaagaccaagtctaggaaatctaaagcaggaattctcacggtggaggtcgggggtagggggtgcactttttcaaactacaaatatccctctgccctataagaatgtataggcttccacacctacccgcaatcccttgattcaatcttggcatatttttcagtgttttgtgagaccggatgaatagatgtcgtcagtgaagggggtacttagtagagctctgctagtttccattcctttgcgttagcagtattagtatttactatagtctatactatgttctgtaatccacaaaatcacaatttcatctgtaaaagccattattgaggagaatctcaggaagttttggttactttacatgagtttatttttggctatagagcaggaaccattgagtagcaaagaatatgaaaagcgacaagagaaatgacattgatcaaggattgtcctatgtgccacgcatagtttaagcacagtacacactgaaacccaggaaagtgtaagcatttttatgttttagccaccacctaaaacaattaaaacatatgcttgcttagctttgaaattagtctaagaaacaataaataaaaggaataataaataaaatatctctgcaaatgtgccttatagtttgaggtatgtttgaagagcttccctttgacaccctaaggcatgacttgcagttgatctgttatgcaaaagtagctgaagtgctcaggtgtactagagataagccacctgccacctctgagcattaagggtatagtagataccagccaggctgtttggtgcattggttaagctggtgggtcagttaattggagatctattaagagagccttttgtgtaagtggcagagttggggtttggctccagacgttctgacttcaaataccattatcttaagaaacttaaccattgggctatccatctccttattggaagagatatttatagaattgagtgtatgaggggaagggatagcaaaacttctgccaggtagaaggatttctggacagttttgccactttctaaaaaaccatttgcaaattttctgaaggctgttatggctagtatttcaaggggtttcttttcatattatttttatttttaaaaatagagacaggagctgggtgcggtggctcatgcctgtaatcctagcactttgggaggtggaggtgggtggatcacctgaggtctggagttcaagaccagcctgaccaatatggtgaaaccctgtctctactaaaaatacaaaaattagccagaagtggtggcgtgcacctgtagtccccagctacttgggaggctgaggcaggagacctgcttgaaccaggaggtggaggttgcagtgagccaagatagtgccactgcactccagtctgggcgacagagcaagactccatctcgaaataaaaatagagacagggtctcactgtattgcgcaggcaggtcttaaactcctgggctcaagtaatcctcctgcctcagcctcccaaaatgccgggattacaggtatgggccaccatgcctggtctcaacaggtttttgacagaagaatgtgtgcaagcaggtctatagggccaactgggctcagagatggaagatacacaatgccgctatcatattattctggggactaggatctcccatttcatacaaatagcatttctccactaatgcttgaactatcactattagaaaactgttcttttgaagatattacattgtaaaagagaagatttatattaatctaatgaagctttaatagtgagaaaggtttgggcgattttaagtgggtcatcccctcccctcccatcaaccccatgagaaaaattggggttgccaacttggcctttcatcttttgatatcattaaggttagcattattctttctctttcttgcatgacgttaaatagcacatttctcccaaacatctaaaaactctgatgatagaaattttagaaatagacatttgggagaatattatatcatcaagtcatattaatttttgtcagtgatcattctaatctttttgttgttgtttgaaaaaaaaaatctatccggaacaaaagcattggaagagagatatacaaaaggacactttcttacaaagaagctgatttatgaaaaacaaagacacttcaatttttttcctcctgtcatacagggtgatgactatcttgtgtaaatgcctttcttagggctggctcttcagggtagtcacattggagattagacttaggaggcccttacttggttaaactgtgaggctggagacacacaaagctttttccagagactgaaatggactcacatggcaggctcagtagccctgggggtcacagcgaggaaccatggcaacccagccatacagggacgttttcatccacttaaagcagagaattcttaaaggcttctaaatgaggacgaagccttgtctagattcttgcttctaattctgttttgcccgatgcagaaagtgattcttgaggatacttagtgggaaagtctgcggaggacttagttctccatcttttccactaagatttccgaagttctaattacctgtagaaatgtggggaacagcttctgttttatctctaatttgaataaaccttcacttttaatatgccaaatacgaattcaaaagagatccagatacaaagcatttttaggttggttttcttaactacaatatactggctcagacacaaggcatgcgcggggtgtgaagctttggggggcaaagcaagcactcacctctctgaagttgccggtgcctgtggctgctgcgggaaagtgcgtggccaaagttttcagggctctgggctctgtctgaatccttgtggtttaatgatttctctgggaggacgggtcacagctgccctgagtctaggaagaagtatttcctctctttgcaacaaagggaaatacataatattttaagttattgccctggaaaaggaaatgtggtttgccagtggttaagtaaatctgttgtacatcagttagtcaacagcatctgggtgacaccattgttggccctgatttaagagaaagggctgctgtggacattcaggtcactcccaattacctactctaattatgctacttttctcattaaactgcagataattgtggctatgatgtaagtgtatctggatttttccaaaatgccacattttaggaaaggaaaaggatcagataagacagcatattttctcaacctctttaaacttgttcagctgctacttttgcatttttcattaggaaattggtagcctgggggctcactgcagctgtgaatgtgttttgtttgtgaagcagtgttttctagagtttgaattaatttccaacatttagaagtcagaaatcttagccatctagattatcggctcctcatgaaaaaattagcagatctgggtacactgggcccatgtcccaacagggatactgttcgaggtgtctgcgtagtggcttactcccagcaccacctgcccgcttttggcagggcattgcatcccagctccacacctttctcctctgtcctcctcactcatggacactgtctggatcctccagcaatttacactttcaatttttgtatctttttctaattcttttcctattgagtttcttccatttaggaaaattgaatatgcagaataagtcactgggtgcttatttttactgcataaggagctttagatttgttcattaaaagaaaatgaatccccagtgtttccctagtaaaacctgaatgcattataaagcattatggaattaacaaaaccaaccttgctgagcttaactatggaatggaagtatgacgaaaggccgtgtagtagggagcagtccacctaggtataggcaataaagggactactgtctgtagggaatttaaaaacgataataaaaccaactaaagcccttctgctttttgttggcaccatgtgccagcaattctcaagtcaatgatgaaatactcctcccctcaagagacctcttgttggttttggtttcagttgtgaacaattactgtgat

SEQ ID NO: 98316 - DNA, 1034 bp, Homo sapiens
gctggagtggaatggcacgatctcggctcactgcaacctccgcctcctgggttcaagcgattttcctgcctaagcctcccaagtagctgggattacaggcacctgccaccaagcctggctaatttttgtatttttagtagagacggggtttcgccacgttggccaggctggtctcaaactcctgaccacaggtgatctgcccacctcggcctcccaaagtgctaggattacaggcatgagcactgtgcccatccaaaacctttttttttcaattaaaacagttgcagcgaggcatggtggctcacgcctataatcccagcactttgggaggccgaggtgggagaatcacttgagtccaggagttcaagaccagcctgggcaacacaaggagacctcattttgaaactgacaaaaatcattctcaaccctccccccgccatttagagaaaccagtcttgacattttggcatatttttaatatttaaaaaatatctatgtgagattaggtcatacatggagttttatagcctacccattttacttacatcatgagcattttttcgtgtcattacatattattcacaaacatgcttttaatagctgcataatatcatactctacagagttctttaaggcattttaaaaagtgacaactaaatttattgccacacacaaaagtttcagtgctgtcaaacctgtcttccaagcaattactggtttatcttatgctgaaataaagtattatcaagttgtatcctaaaggataagtacattttaagaaatattaaagtaaaagacaaaaccttagcacaggctgcaatttaggcaaaataaaaagagaatctggtgttatctgtcaacaatttagaaagctttttccataaaattaaataatgacgtgatatgtcattcactgtacttgtagcagcataattacaataatgagacttatttaatataatgagactatattttaaaaatgttattccaagcatgctacttcgtggtgctttgctattaagctacttaatatt

SEQ ID NO: 98317 - DNA, 1023 bp, Homo sapiens
atgaatctgttaagaaaagttcactaggaagattgtgtgaaccagttctttggaagaatgaaatttgtagctgctttaagatcatgcaaacggccaagtgtggtggctcacgcctgtgatcccagcactttgggaggctgaggtgggtggatcacttgagcccaggagttcaagaccagcctgggcacatagcaaaaccccgtctctacaaaaaataaaaaaattagcccagtgttgtgacacatgcacctctggtcctagctacttgggaggctgatgtgggaggattgcttgagccaggaggttgaggctgcagtgagccgtgatcacgacactgcacgtcagcctgggcaacagtgagattctgtctcaaaaaataaaaaagatgatacaaattattacaaccttaggactcggtgaagctcaataacatttattgaatgtattatttacttgggtacataaactccttaaaattgagtgtgaactttttctggagaaaagatttgtagtttcatcagattctcagtggttgggtttgtgatcaccgcccccgccatccccaaagattaaaagccatgagtatacttaaaagataaatactctgggtcacataaatctaccaacatttaacctctgtcctgttgctgtacatgcgtgcatttgtactttaatggtaacagaaacaaccccaccaccaccacctccataatgagcctgaggatcgcattgccaagttgacatccatgcttttgtgtgtatggaaatgggttttatactcagatggatataggttcgagtccctgttctgctagttaataattatatgacgctgattcaggaactttatctcctgtgttttattttctctcctctaaaatgagagtcctacctcctatgttgctgtgaggattagaaagaatgtatgtgacctccttagaattccttctttactctcataactctgttacaggacttaggttgctgtgttgattggggttcacttttagagaacagaatcta

SEQ ID NO: 98318 - DNA, 1367 bp, Homo sapiens
tgtatttttagtagaaattgggtttcaccatattggtcaagctggtcttgaactcctgacctcaagtgatccacccacctcctcctcccaaagtgctgggattacaggcgtgagccaccacacctggccttaatttttgtattttttatagagacagcatcttgctatggtgcccaggctggtctcgaacccctgggctcaagcaatcctcccacctctgccacccaaagtgctgggattacaagcatgagctaccacacctggcctatgtattacttctataattaaaaaatagtaaaagggtgcccgggaggtgatggccaccccccagcagtgtctgggctctcctggcaggtgtgatgcttcagtacatctgtggtcagaccattgtcaagcttgtgaggcctcctgtttaggtacacagtatggaaggtcgctatgccatggctctttattctgctgcatcgaaacagaataagctggagcaagtagaaaaggagctgttgagaatagcacaaatcctaaaggaacccaaagtggctgcttctattttgaatccctgtgtgaagtgttccattaaagtgaaaagcctaaatgacatcacagccaaagagacattctctctccaaccctgatcaatttgcttgctcaatatggttgcttaagcaatacccaaggagtcgtttcttctttttctatcatgatgagtgtccaccgtggagaggtaccttgcacagggaccactgcatctcctttagaggaagccacactctctgaattaaaaacagtcctgaagagcttcctaagtcaaagccaagtattgaaattggagggtaagactgatccgtcaatcatgggtggaatgattgtgcgcatttgagagaaatatgttgacatgtctgttaagaccaagattcagaagctgagcagggctatgcgggaggttgtctaaaagtattggttttctaccatcactgaaaattcttaaacttggagcaacaataaaaagcttccagagcagaaaaaataataataaaaatactacttgaacaaaataataaataataatctttagcccttcaaatttctacttttcagccaggcatggtggctcacgcctgttttcccagcactctgggaggcttgaggtggatggatcacttaaggtcaggagttcaagaccagccttgtcaacatggtgaaattctgtctctactaataatacttggataaaaattactagaatacacacggcagattaacattcagtatctacctaatctctttctagtgtgctctcttatattgaagatgaaagatcaaagaaaaaaaattctacatatttcagactcccttgcagctagggc

SEQ ID NO: 98319 - DNA, 1020 bp, Homo sapiens
ccttgtgatccacacccccacccttggcctcccaaagtgctgggattacaggagtgagccaccgtgcccggctgattttctctttaattccaaagccgccagcaagttcaggagataaaagcttagtcaaataaatttttggttaccatatggaaaatgtcatgttgatataaattatttattctatcacccaactatattgataacattaaacatggcctttctatctgtcattctgccccaatgagactttcatttctttaacattatacaaagtaaaatcatctacctctggaatgattttatcattattaacacacatatacatgcatacttatttatggttctttatatgcactaaagaagctgggaaaattttagaagatagtaaaatgaaatggttcttcctttcttgtctgggaggggctccttgctctggaatgatacttcatatataaatacagtgtttctccgtggtcttccttttggatttttggaggttggatgggaagggctgaatttcggcacacactgaaaacagcttatcttgtaggagggattataatatcccaaacattgtatataagtggcattttgagatttcctcagaaatgtattaaaaacagagagaaaaaaatgattgtagcaagtattcagccattttacctttttattcaaatatttagcaatttcttgggcttctagtaatttagtgatcaatggctccaatcagagagttcattcacaggaatattcacactcatttgtttcagccttaaataaataaaggttgattttttaaaagaggctgtcttctaggtattgcaagtggaatctgctcatattgattgggttgctcttcagtaatttcctacagcatgcacatctcttcctttttatgtttttctcaagcaatcagtaaataacgtattcatcaaacttaagagagtgtcccaacagaatttcgttggaaaagctgggtttctttcttgctgaggtatacagttgatgagttcttta

SEQ ID NO: 98320 - DNA, 1033 bp, Homo sapiens
gcagtttttgttttgctttttcagacaaggtcttattctgtcatccaggctggagtgcattggtgggaacacagctcactacctactcagcctcctgagctcaagcgatcctcccacctcagcctctcaagtggctaggaccacaggcacccacgcactacaccgcctaactaatgttttgttttatattatattattttattttatagagacagaggtctcaccatgtcgaccaggctagttttgaactcctggcctcaagcaatcctcctcccacctcagcctcccaaagtgctaaaatgataggtgtgagccactgcacccggtgattttgcagtttttggaaaccacaagtttgatttcggtgtgaatattttggaagaatctatgaaacaaatgcacttcatctgatttctcagtaatgttgatgatagatttacttctgaacctcttggacgtgtgtatgttagaagttctccacccaattgatacggaattaaatagctgtgaaattactgtaagaagaaccgaagcaacgttggaaatttggtaactaatgccacgttggaagctattcatgccaatgtagcattgcttcatacaggtacttccagatctaattgaatacatccagtgggaaatttcgctttgcgtgattttttggctatccttctcataatggaccccagttttagttgtcagagtaacacaggcacagctgcttgaaggtcttgaaaatgaggttaacaaatattcagcttttggtgggagtttttctcaagttgttggaatagaatttggactcaattcagatgcggaactgggacactgaatgatagataacagatactgtgaaagttcaaggaccatacgaaaaaaatttaccttcttgctgctataaacaatatattgcacatgggaaagatagttacgttatgcctgatagttgttcttgaatgtttgacacagaaactgtacaagtaccttccacagtcatcatgaatcacttttaatcgataaaaattttgtaggg

SEQ ID NO: 98321 - DNA, 1165 bp, Homo sapiens
cccacaattattttaaaataatgatttggatggggcatgtgcatgaatccctttatgcttaaagaaaacattttactttttaaagacctaacatgccaggcttcggggtaaaagctttataatgacctcacctgactgtaaataggtagaatgaagcacacagtaatagaatttgggaaaagacatagtccacactctaaattggtgaaatctcaattcttttatgacccagctatgagatcttgttttttccaaatagcctttccttaagacattagcctaatattagcttaaatggcttacaaaatgtagacattattggagtgctttctagacacaaaagagcaggttttggtgttccttaaaagaaggaagcatgtgaaataacacatactcagcacttttttctccctggaccaaatatgttgggggaggaaatgaagtacatacaaacccaatcctgatctctaaggtcctttaaatatgtttagatgtgtaatgtgtttagatctgtaatgggttaataaagaattgagggggaaattacaacttttggagcttaaccttatagataactaagctctcccacaaaacgtgcccattgccagtagacggaaatctggtttgtgcggactgctgatctgatgcagaatggcactccctttgatgttttatgatagtatcatgttggaagaaaaattttgccaactaaactataacacaatttcttgtaatttagtgtttttctttttttcttttcttttttctctttgagacagggttttacactgttgtccaggctggaatgcagtggtgcgatcacggctcgctgcagcctctacatcccgggctcaggtgattcccccgcttcagcctcctgagtagctgggactacaggcatgcaccaccatgcctggctgatttttttgtagtttttgtagagatgaggtctcgctgtttcccaagttggtcttgaactcctgggatcaagcgatcctcccgccttagcctcccaaattgctgggactacaggtgcgagccaccatacctggcctatttttatttcatactcagtaaaagagcactctcagactttgacacatttattatgcattgatcttgtgaatgcataaaaagagacatataagtaaaattggtttaggta

SEQ ID NO: 98322 - DNA, 1004 bp, Homo sapiens
ataagtgaagtaaattagtggaaaagagaccaaattttaagtaagtaatgtcttacatgttttttgtgtcagaggctggtttaattgattaattttcctcataaatgtgagaagtcagaaaatcaatttctcataataagaagtaataggtaagtaaatattatgctagcattttgacttaatgaagcttttttcccctcatcttatggttttaaggctgtgatttcatttttcagttattgattttaatgattaaattttttccattgcagaaattctcataacatgttatagaatgattgttatatattttccaacagataagaatgcttaaattaattgaaatacaaaattatttgtaattctgttttcggcttaacaaagcagcaaataaactgcattaaattttttacttaaaataatcataaattatatgtacattgtgtcagttaatacattggtagggcatgaaaattactgggggaattttaaaaattctgaatcctaggctcaccctagctctactaaaattttgggtattcagcctggtttgggaaccatgcagtatgtaatgttgaaggattatacttttaggtgagtggaaactggaaaactatttatttgtagagaaatctaaacagtaataggaaaaaaatccctcctatttatctggcttacataattgtcagaagaaaagtgttttgtgtttcagaggctaaattagttgttctgatttttagcaactgtgttggataaattatttaaaaacctgcctctctatgagctgagcagaaaatgccatgtggtgtctttacactcatgataacagagaatgagacgttgtcaaataatctggggtttgatatggaaacatgatggggaaattaatgagctccattagagtatagtaaatataccataacaatatcttagaagtaattggtcttcgcaaattgaatattgtattctttgttactaaatcaatatctaatatctctaataag

SEQ ID NO: 98323 - DNA, 1030 bp, Homo sapiens
ggccggtggctgcatggatgtggggaggtgggtgagaagtaataggcaaagaattcagacaaatcaattctgtattttagattcagggggtatatgggcttgtttgttacatgggtatattgcatacctgctggggattgggcttctagtatacccattacccaaatcggagaagtcgattctttaagacattgtaggctaaggtaaggactttgaattttatttcaagtgagatgggagagcatctcaaagtttgagcataggagttaaatcgtctactttgtgttttaaaaggttcattctggctgctgagggaaaaatagttggtatagagatttaaaaattttgttattgtgatataactcatacaccataaacttgaccctttaaggtgtataattcagtgatgttttattatgttcacaaagtggtacaaccattgtctaattccagaacattttaatcaccctaaaaggaaaccctgtacgcactgagcagtaactcactcctcccttctgtcaccagcccctggcaaccgctagtgtatttcctgtctgtatagatttgcttattctggatattgcgtgtaaatggaatcaaacgttgtgtggccttttgtgtctggcttctttaatgtagcgtaatattttcacggttcatccaggctgtaacatgcatcacgacctcgttcctttttatggctgacaatgttccattgcatggatatatcacattttgtttattcattgagcaatttatggatatttgggttgtttttactttttgactgttatgaatagtgctgctatggatatatgtgtacaagtttttgtgtggacgtatgctttcacttttcttaggtttacatgtagagtggaattgttgggtcatgtggtaattgtgtttaacttttttgagagggtgcctcaccgtttgtcaaagtggctgtaccttaccaccagcaatgtatgagggttccagtttctccacgttcttgtcagcacttgttgttgtctgttttgttttttgt

SEQ ID NO: 98324 - DNA, 1055 bp, Homo sapiens
aactagaacatatttctcctatctagctttaattttgtattcattaattatcctctcccaatttctcttccctgacttcttcccagcttctagtaatcagcattctattctctagttttacgagcacaactttgatgacaagattttcttcttttatggctgaatcgtattctactgtgtatatataccacatttcctttttgtgtgtgtgtgagatggagtcttgctctgtcacctaggctggagtgcagtggcatgatcttggctcactgcaaccttcgcctcttgggttcaagcaattctcctgcctcagcttcccgagtagctgggattacaagagtgcaccaacacacctggctgatttttgtatttttagtagagatggggtttcaccatgttggccaggctggtctcgaactcctgacctcaggtgatccacctgcctcagcctcccaaagtgttgggattacaggcgtgagccactgcgcctggccccttttttcttttatctgttgatggacacttagattgattctatatcttagctattgtgaacagtgctgtagtaataaacatggggatgcagatatctccttgatatactgatttcctttcctttggataaatacctaatcagtaggattgctggaccatatggtagttatatttttaggtttttgagaacatttatactcttttccataatgactataataatttgtattcccaccaacagtgtgtaagaattcccttctctgcatccttgccagtgtgttattttttgtcttttcgataatagctattctaattgaagtgagatgatatctcattgtggttttgatttacacttccttgatgattagtgatgttgaacattttttaatatacttgttggccatttatatgactttttgagagatgtcttttcagcttatttgcccatttttaagttggattatttccttttgttgtcattgagttgtttgagtattccatattccaggtattaatcatcttttggatgaatggtttgcaaatattttctcccattcttc

SEQ ID NO: 98325 - DNA, 2263 bp, Homo sapiens
atttggtttgctattaataatattttgttgacaatgtttgcagccttgtatttcaaggctttggagaactgtaaaagcagtgaagtaatatggggcccatatctagtgaagtatttaacagaaacaatggaagccaaaagaaagaaaacaactgccacctagaattctctactcaatacgtatatcttttaataaggaaggtgaaataaaactattttcaggaaataaaaattaagggaatttgtcaccagcagactctcactaaaggaaaaactaaaaaggagttcttcaggcagaaggaaaatgattcccgatggaagctcagagatacaggaagtaatgaagaacagtggaaaggtaaatatgtaggcaatcaatctaagtgaatactgtcttgtgggatgaacaacaatggcatataaattgggaggggagtaaatgatgttaatttctaaggactttgcattgtttataaagagaataaaagtaacaagtaattttaggcgttgacagttcagggttgctcattgtaatctcttaccaaaatagactatgaaaagtctgtaactaactacagagttaacagaaaaggaaaaattgaaatgatgaaacgtagtccacaagaagacaagaaaggagaggaaaagggatagttgtataggcaagagtaacagattgaaaaagttaaatacaactctatcagtaatacattaagtgaaaataggtttgatgcttgaattacaactgtattcaatattttgtcagaggtcctagtcaaagaaataaggaaagaaaaataaaaatgataaagattggataagaagaaataaaactattatttatacacaacatgatggtggacataaaaactaaaaagatatctagataaaccattagaatcaataagtgattttaaaaggttgttacactaatgtaaaaagaaagtgtatttttatatacagataccatgcagaaaatgagataaaaaatcatttacaatagcatcaaagaacatcaaaatctagggaataaacataagaaaatgtaagatctttaaactagaaactataaaccttgaaagaaattttcatgttcatggattgaagaatcaatattgtaaacatgtcagttctgcctagattgttatatttatccaatgtaatttcaatcaaaatctcagagaagtatttttttttaatgaaaagccaattccaaaaataaatgtgggaaagtaaaaggctcagaagaactaggataatcttaagaacaaagtgaatagatgtcctctatcagatactaaaacttatgaaactttagtctttagtctttaaaatagtgcagttttgctgcagagttagaaagaccatggaaaaaaaccaggaattccagaaacagacacatttatggatgtctgatttgtgacaaaggtgctgcacagcagtgaggacaggactttcttcaataaatgatactgggtcaattgaatattcatatggagaggaaaatgaaactttattgccgaatcaccctgcatataaaaatcagttagaagtagactatgatttggctacatgttgtagccaaaatagtaaagcttctagaaacaggagaaaatctctatgactttgatggtaaagagagatttctggccacaaaaagcactgacaaagaaaaaaagataaaaccggactgcaataaagttaaacaatggaagatgattaagaaagtgaaaagaagctgcagagaggaagatggtacttgaaacacatataattgagcaaagaactggtgtcctgaatagggaatttctacaagtccataaggaagagacagaacatccatttgaaaaacagagagacttgaacagacccaatgtaaaagaggatatccagatggctagtaaatatgaaaagctattgcaaaaattacagattaaggccacagtgatataacaataaacatccttacaatagctaaaattaaagagactgacaatagcaagtgttgataaggagataggaatactgctggtagggaatataaatttgtacagccactttggaagactggtcggtagggagtactaaagctgaacatatgcaaattttatgaccccgaagtttcactcctaataatgcactcaacaaaaatgcatgcacattggcaccaaaagacacatacaagaaggttcttcatagtattattagtaatagccaaaagctagaaacaacacaaatgtccatcaagagtagaatgaataaat

SEQ ID NO: 98326 - DNA, 2767 bp, Homo sapiens
gttacagccagatgtggctcgaaaatattaaatggaaaattccagaaataaatgggcaaataaattgcatgttattctgagtagcttgatgaaatccttcgctgccactcattgtcccactcaggacatgaatcatccatttgtccagcgtattcctgctgtctgcccattagtcactcagtagctgtcttggttattagatcaactgttggatatcacagtgcttgtgttcaagtaacccttattttacttttattacagtatattgttataattgttttatttcattatcagttattgtcattaatcccttactgtgtgtagtttataaattaatctttatcataggtatgtaaggaaaaacatatataggtttggtactatccaccgtttcaggcatccactgggggtcttggaacaaattccctgcggataataggggactactgtaatttcttccatttacttgtctgtatgtttttaaactgtagtttgacatgaaaccatacgtgtggtttttgcattcctcatttttttctaaatccagcgccatagactgctcggccacaccacactcattttttcttaatatgtaacgtttccccatgttattaaaaattttctaaatccagcaccttagaccactcggccacactaccacactcattttttcttaatatgtaacgtttcccatgttacttaaaattctttgtattattttagatagctgcatagtattacatcttagagcctattataattgaagtcttttactgttagaaacttaggaggtttccagttttttgttatgctatgataatggcatcttttttgcatgaatcatttacctttaagactatttccttaggctgtacttagggaaatctcattattttacctaagggaaagtagttttatggtttttagatgcaaatttcagaattgctttatagaaaagctttcaattcataattttaccaagagtatagaaatgaatccattttgtcgaactctcactactgaatactgtccatttaaaaatattccatttcttttttctttatagcatttgttcagtgctcagcacaggagtttgaccagacagagtagacgtcaaatatgtaccagtagtttgatggaacgtttcttacaggatgtactgcagcaccacccatatcattgtcaagagagcaggtaaagtagttgattggaataatatttatacgtagttatatgttacagtaggtgtttgtgttcatgtcccaatcaatactttaagtgaatctttgagtcaaggaatataaagtaaaattttagtaactttcatttgcaatttaaaatttttcttagctgaagtaagaaatttcactacagaagatatggactacactatgtttttttctaaataaaagtcttaggctaataattatatatcattaagatgttttataagtatgttataggattaagcagggggaaaaggaggaagagatagttttttttgtttgtttgtttttgagatggagtttcgctcttgttgcccagggtagagagcaatggcacgatctcagctcaccgcaacctccaccacccaggttcaagcgattctcctgcctcagcctcccgagtagctgggattacaggcatgtgtcaccacgcctggctaattttttgtatttttattagagttgaggtttcgccatgttggtcaggctggtctcgaattcccgacctcaggtgatccacccgccttggcctcccaaagtgctgagattacaggcgtgagctaccacacctggcaaaatggtttttaaaaggttagcaacagaaaaactggtgacaatagcagagtaaggacaatcaagtcaaaactgagtcaaatccacattaatagaactctttgctaattctgaggaaaagaggtagccaaaagaattgggtttttaaatctgtctgtattttgatagcttttcttgtatccatttgttttagttgtttttaataaaaataattattttgataacatttaagagttaatgccctatgttaaagaaaaacattggtagaaaatcagattaaatattataatatgtttgtagctcccgctgtacaagataaggtaaaaatcgatcattagcacatctgtgcagttaactgagatgtgcaccagttagtagaaaaagggataaacttctttgccttgcaaatcactaacatagaccttagaaatggcaaaaatattttaatggggaaaagttagaggaaaacaagatggtttcttagctggtgggaagatagaattagcctatcctggggtcagtataaatttccaggttttttttgtttttgtttttgttttttgagacggagtcttgctgtgtcacccaggctggactgcagtgacatgatctcaactcactgcaacccccacctccctggttcaagcaattctccctgccttagcctcccaagtagctgggattacaggcacccgtcaccatgcctggctaattgttttgtatatttagtagagactgggttttgccatgttggccaggctggtcttgaactcctgaccccaagtgatctgcccaccttggcttcccaaagtactgggattacaggaatgagtcaccgtgcccagctccaatgtataactctcataagcagtgcttcagcaaacatgtttttacatgaattttttttttcttttttttttgagacagagtctcggtctgttggccaggctgtagtgctatggcacaat

SEQ ID NO: 98327 - DNA, 7279 bp, Homo sapiens
taaccagtacccagttactgagtattcaggttgattctagtcatttgctattacccctccctccgctcaaaagtagcagtaactattcttgtacgtgttcattaaacacatgagaaaaccaaaagtggaattagaggtcaaagggtatgtacattcttaattttaatagacattgccaaattgctgtttgtagaggttacaaatctacatagaggttaaccagtaactgttaactgatctatattcctatgaacaatgtattaaagtgcctttgtccttacacccgcaccaaaacaatgtgttaagataataatagctaacatttgtgaatgcttactgtgtgccaagctgtttctttgttttaatgctctttacatgtaacaattaatttactcatcaaaacaatctcatgagggaaaatagtgtaagattccctttttttggaggcagaaactgaagcatacaaagttaagtaacatatgtcaaactttttgctatttactactctgataactgaaaaataatatatgattttatttgtttagtttttcatgtttaggggccatttgtatttaagtagcaattggtggagccacctccaccttctgcagtaattccccctctgtggtccatgcagtgttcagcctggggtgactgcctggattccttgtcctttaaggatagtccagaacagaaagcaaataacatttattatgcctctattttaatattttaaacagacattagaatatgtttatgagtttcccccctttcgttttagttcaacacaagatgagacacatgtgaatactgggtcatcgtctgaagtggtgcatttggatgatgctttttctgaagaagaggaagaggatgaggataaggttgaggatgaggatgctaccgaagagagaccatccgaggtttcagaacctattgaagagttacattccagacctcataaatctcaggaaggcacgcaggaggtttcagttcgaccatcagttattcaaaaactggagaagggacagcagcagcccttggagtttgttcataaaattggggccagtgtgagaaaatgtaacctagtagatattggtcaggctacaaataatagaagcaacttggtacgccccccagtgatttgtaatgctcctgctagttgtttacctgaaagctctaacgatagaccagttacagctaatacaactagtttaccaccagcagctcatttggattcagttagcaaatgtgacccaaacaaagttgagaaatatcttgaacagccagatggggcctctagaaatcctgtgccatcatcccatgtagaaactacttcattttcgtatcagaaacataaagaatcaaataggaaatctttacgcatgaattcagataagttggttttgtggaaagatgtaaaatctcagggtaaaactttatcagctggcttgaaattccatgaacgcatgggtactaagggctccttaagagttaaatctccttccaaattagcagtaaacccgaataaaactgacatgccttctaataaaggaatctttgaagatactattgcaaagaaccatgaggaattcttttctaacatggattgtacccaagaagaaaagcatttggtttttaacaagacagccttttgggaacagaagtgctcagtgagttctgaaatgaagtttgattgtatctctcttcagtcagcatctgatcagccccaagagactgcacaagacttaagtctttggaaggaggagcaaattgaccaagaagataactatgagtctagaggttcagaaatgagttttgattgcagttcctcttttcattcactgactgaccaatctaaagtgagtgccaaagaagtaaacctttccaaggaagtacgtactgatgtacagtataagaataataaatcttatgtttctaaaataagttctgattgtgatgacattcttcacttggttaccaaccaatcccaaatgattgttaaagaaataagtcttcagaatgcaaggcatattagcctggttgaccaaagctatgaatctagtagttctgaaacgaattttgattgtgatgcttcacctcagtccactagtgactacccccaacaatctgtaacagaagtaaaccttcctaaggaagtgcacattggtttggttgataagaactatggttccagtagctctgaagtaagtgctgattctgttttcccactgcagtcagtggttgacagacccccagtggctgtcacagaaacaaaacttcggaagaaggctcataccagcttggttgataactatggatcgagttgttctgaaacaagttttgattgtgatgtttctcttgagtcagtagttgatcatccccaactgactgtcaaaggaagaaacctgaaaggtagacaagtccacctaaaacataagaagcgtaaacccagtagtgctaaagcacatcttgattgtgatgtctcacttgggacagttgcagatgaatcccagagggctgttgaaaagataaatcttctgaaggagaagaatgctgaccttatggatatgaactgtgaatcccatggtcctgaaatgggttttcaggctgatgctcaattagctgaccagtctcaagtagccgaaatagagcgtcagaaagtggatgttgaccttgagaataagagtgttcagtctagccgttcttctctgagttctgattctccggcttctctttatcattcagctcatgatgagcctcaagaagctttggatgaagtaaatcttaaagagttaaatattgacatggaagttaggagctatgattgctccagctctgagttgacttttgattctgacccgcctcttctgtcagttactgagcagtctcatctggatgctgaaggaaaagaacggcacattgacctggaagatgagagctgtgagtcagatagttctgaaataacttttgattctgatattcctctttattcagtaattgaccaacctgaagtagctgtttatgaggaagaaactgttgatctggaaagtaaaagtaatgaatcttgtgtctctgaaataacttttgattctgatattcctcttcattcaggaaatgatcaccctgaagtagctgttaaagaagtaattcagaaagaagagtacattcacttagaaaggaagaatgatgaacccagtggttctgaaataagttcggattcccatgcccctcttcattcagtgactaattctcccgaagtagctgttaaaaagctaaatcctcaaaaagaagagcaggtacacttagaaaataaggaaaatgaacctattgattctgaagtaagtttggattataatatcatttttcattcagtgactggacgttctgaagatcccattaaagaaataagccttcacacaaaagagcacatgtacttagaaaataagagtgtttttgaaacaagtttggattctgatgtccctcttcaggcagcgactcacaaacctgaagtaattgtcaaagaaacatggcttcaaagagaaaagcacgctgaattccaaggtagaagtactgaattcagtggttcaaaaacaagtttagattctggtgtccctcattattcagtaactgaacctcaagtagctgttaacaaaataaacagaaagaagcaatatgttctagaaaacaagaatgataaatgtagtggttctgaaataattttggattctaatgttccacctcagtcaatgactgaccaacctcaactagcttttttgaaggaaaaacatgttaatctgaaggacaaaaacagtaaatcaggtgattctaaaataacttttgattctgaacaacttcaggaagcggttaaaaaaatagaccaatggaaggaagaggttattggcctgaaaaataagattaatgaacctagtacttataaattaatacatcatcctgatgtttctgtccaatctgtggctgatcaacccaaagtagctattaaacatgtgaaccttgggaatgaaaaccatatgtacttggaagttaagaacagccaatatagttgttcagaaatgaatttggattctggtttcttgggtcagtcaatagtcaatcgacctcaaataactattttggagcaggagcacattgaactagaaggtaagcacaatcaatgttgtggttctgaagtaagttttgattctgatgaccctcttcagtcagtggctgaccggctgagagaaaccgttaaagaaataagcctttggaaggatgaagaagttgacacggaagataggagaaatgaagctaagggttttgaaattatgtatgattctgatgttcttcagccagtggctggccaacctgaagaagtagttaaggaggtcagtctttggaaagagcatgttgacttggaaaataagattgtcaaacctacagattccagaataaattttgattctcatgaaccccttcagtccgtaactaataaaattccaggggcgaataaagaaataaatcttttgagggaggaacatgtttgtctggatgataagggctatgtgcccagtgattctgaaataatttatgtttcaaatatccctcttcagtcagtgataaaacaaccacacattttggaagaggagcatgccagtctggaagataagagcagtaattcttatagtcctgaagaaagttctgattccaatgactcttttcaggcagcagcagatgagcttcaaaaacctgtcaaagaaataaatctttggaaggaagaccatatttacctggaagataagagctataaattaggtgattttgatgtaagttatgcttctcatattcctgttcagtttgtgactgatcaatcttctgtacctgtcaaagaaataaacttgcaaaagaaggatcataatgatctagaaaataagaactgtgaagtctgtggttctgaaataaaatgtcattcttgtgttcatcttcagtcagaagttgaccaacctcaagtgtcttacaaagaggcagaccttcagaaggaagagcatgttgtcatggaagaaaagaccgatcaacctagtgattcagaaatgatgtatgattctgatgttccttttcaaatagtagttaaccaatttccaggatcagtcaaagaaacccaccttccaaaggtggtacttgtggatctggtgcccggtgatagtgattatgaagtaatttcagatgatattccccttcagttagtgactgacccacctcagttgactgtcaaagatatcagctgtataaatacagaatgtattgatatagaagataagagctgtgacttttttggttctgaagtcagatgtaattgtaaagcctctactccctcaatgacaaaccaatgcaaagagactttcaaaataataaaccggaagaaggactatattattctgggagagccaagttgtcaatcttgtggttctgaaatgaattttaatgttgatgcctctgatcagtccatgacttacgagtcacaaggacctgatgagaaaatggtgaaatatattgattcagaagataagagctgtggatataatggttctaaaggaaaatttaatttggaagacacttctcatcgaacgactcaccgactgcagaaagctcacaaagaagccagtcttcggaaggatccaagaaatgctggcctaaaaggtaagagctgtcagtctagtgcttctgcagtggattttggtgcctcttccaagtcagcgctccatcgaagggctgataaaaaaaaacgttcgaagctaaaacatagagatctagaagtgagctgtgaaccggatggttttgagatgaattttcagtgtgctccccctcttccatctgatactgatcagcctcaagaaactgttaagaaaagacacccttgtaagaaggtatcttctgacttgaaagaaaagaaccatgattcccagtcaagctctgttctcaaggttgattctgtaaggaacctgaaaaaagcaaaggatgtcatagaggataatcctgatgaaccagttcttgaagccttgcctcatgtacctccttcatttgtggggaaaacatggtctcagataatgagagaagatgacataaaaattaatgctctggtgaaggagtttagggaaggtcgtttccactgttactttgatgatgactgtgagaccaaaaaagtttcttcgaaggggaaaaaaaaggttacctgggctgacttgcaaggtaaggaggacactgcaccaactcaagctgtgtcagagagtgatgatattgtctgtggtatttcagatattgatgacttgtcagtggccttagataaaccatgccatcgtcatcctccagcagagaggcctcctaagcaaaaggggcgtgtggcttctcaatgccagacagcgaaaatcagccatagtactcagaccagttgtaagaattacccagtgatgaaaagaaaaataattagacaagaggaagacccaccaaaaagtaagtgttcacgtttacaggatgacagaaaaaccaaaaagaaagtcaaaattgggacagttgaatttcctgcatcatgtactaaagttttgaagcctatgcaacccaaagccttagtctgtgttctttcttctttaaatattaaactgaaagagggtgaaggccttcctttccctaaaatgaggcaccatagttgggataatgatattcggtttatatgcaaatataaacggaatatctttgattattatgagcccttgattaagcaaattgtaattagtcctcccctgagtgtaatagtaccagagtttgagaggcgtaactgggttaaaattcattttaataggagcaaccaaaactccagtgcaggagataatgatgctgatggacaaggctctgcttcagcgcctttaatggcagtgccggcaagatatggatttaattcacatcagggaaccagtgactcttctctgtttctggaagaatcaaaggttctgcatgctcgtgagcttccaaagaaaagaaatttccagctaacatttttaaatcatgatgttgtcaaaatctctccaaaatcagttagaaataagcttttggaaagtcaaagtaaaaagaaaattcatggaaagagggtgacaactagtagtaataagctaggttttcccaaaaaggtttataaaccaattattctccagcaaaaacccagaaaagcttcagagaaacagtcaatttggattcggaccaaaccaagtgatatcattagaaagtatatttcgaa

SEQ ID NO: 98328 - DNA, 1181 bp, Homo sapiens
aaaaatctgttgtcagtaggctaaagaaggcgaagagaacagctaaagtgcttttgaactcttcagttccaccagctggtgccgaagagctgtcaagcgctatggcaaatcctcctccaaagcgacctgtgcgggcttcttgccgcgttgcaagaaggaggaagaagactgatgaaagctaccatggccgacagaaaggtccttctacacctgtgagagcatatgatctgagaagctcatcttgtttacaacaacgtgagagaatgatgactcggctagcaaacaaactgagaggtaatgaggtaaaatagaagttggttttgtgttcaggctagttgaggattcagtacttcagttgaaatatatttggtactttgtgcacacagctttcccagctttggtgagaaaactaatcttgaactattttgctataaatattatttttcagaatttttatattcatttaaaattagtgtttagagtcctttcattttaagattcagaaacagcctttgtccaacattttctgtagaagaacttcatcttaatttatgtcacaaaataatttagcaccgtatatagaattttgttcctcaaatcatatccctcttattttttatgattatctctctcatgccagcaaatttaacattgtgagaatgaatatagcaaacttattaaaaagaaggaattataatgaattatgtcaacttttgaatggggttgacttaaatgaatacaaacaaaatataagttttctttctttttaaagcattccagaaaatgagattccataatctttaatacagtttttaaaaactggtgattttttttatgcatagcacaaactcctcctgcttcatttaaattggatctgcaagtctctaacttttatcatttggacacatgcacacatacagtctctaggttttttgggttagccttattagatcttaaaggggaaaataattttgcccatgtgtttaggcattcccccccttttttttaaccacctttactctcttctacatgaagagttggtggcttaatatgaaaatccaggttattttgtggccttatcccctaaaaatattttaggcattaccatatcagtttttatttttatgtttatttattattattattttttgagacagagtctcactgtcttgcccaggctg

SEQ ID NO: 98329 - DNA, 2246 bp, Homo sapiens
gttggtacagatgcattcagttgtcattcattcgtgttaagccaagatcctggatcttctatcattaatgttaagaggaaacatgaattacaactatattgtatgactgccatattttattgaaactaaggtcaatgttgaaccatatcttgatttcagaatttaaaatgtgttaccttagaaataatgaaatatagtgtaacagttggtttctaaatgtggttttatttcaggggccattatttaacctgtgtgtatgctatgatggagttcttttgtgatttctttacttctaaatttaaatagtaattatgtttaaaaacaaatgtttttgtctttagttgcaaagcagcatatatctcatttccttcaaccttgcctcctcatacacaaatatattttcatttcttaaaagatcactgggccagtagttcaaaataatcctccaattttaatttaggaacaaagctttgtcctactgactaggaagtaaacaaacagctgatatataagatatttgtgggtattggtgtcttttttccctatggaatagacacatagttcccttaaatattattaatagacattctacagtctttcagtgtaagtttaaaagcaagagatcaaatgaaaatgtgtactatgtacctatgatgtgtcatatcgtgattacatcatgcagagagaacagttcctgtaattcaagtaattaaaatttcaagttgtaaaaatgttaccattttcacattggaagcccttctaagtaccattttcattgggggcagggagaaggtttatatttaaattttatattaccagacataaaagtacagtgcagtactgatgattttgtttaaagtttttgaaatgttttgtttactaagttcttgtaatcattattttagacaagcttgaaaacttgaaattgttgaaacttataatttaaattaaattggaaattactttcagaatttggtagtatacaagatgtgcccctttgtctaaataaatgttggcttaatttgcagaatagataaaacaattgatgtttttgtgtgttcaagaatgcattaaattcttttaatagtaaaaagtcaaattacgaccataatgagtattttaatcttgttcttgttcagtattttgcgtagatttttattgtaattgtcctgagttctacagtatgtgaacaatatcgtgtgaagtgtgtttttgcatttgtgcatttaaattatttatgtaactagggctgtgagtaacactttttttttttttttttggttaaagaaaagctatatttaaatattcaaataattatatatttccatgtaaaactaatgtgaagactaatgtattttttatattgcagtgtaaaagctaaacttgtttttgatgttatcaagataaaatttattaaaccttgaaatttgtctgttctctcttcatgttagaaactttttctgggaatacttgaagaataagagaataatggcctgagagataataaatgagagaatgtaaatgttgatgccagtgagaaagtagtttaaccaaagatatacagattatattcgatgcagtagttatttcaaaggattaaaattaaaccatttatttgtctggtggagtggtggattagcagcttttcactttgtgtacctgtattgaaagggcccgtgaacaagactgagttcatgaggctgtatctatatcactgtttgacacctactggggagggagaacttgggagcctccactaccacagcaagtattataaaatacaagaaaacatgagaaagtgtatgtgtgtcagtgaggtaggtgcctttggcaccagtagtactgacttccagagtttgttggcctagatgttattgccaggataaacaacatcctaatctttttttttttttcctttcttgaggcagagcctctctttgtcgcccaggctggagtgcagtggtgcaatctcagctcactgcaacctccgccttccaggttcaagtgattctcctgtctcagcctcctgagtagctgggattacaggcatgcgccaccacacccagctaatttttgtatttttagtagagacggggttttaccatgttggccaggctggtctcgaactcctgacctcaggtgatccacccaccttggcctcccaaagtgctgggattacaggcatgagccatgacgcccggcccctaatctttataataaaaaatcatggtcgggcgcagtggctc

SEQ ID NO: 98330 - DNA, 1605 bp, Homo sapiens
agatcaagaccatcctggctaacatggtgaaactccgtctctactaaacaaaatacaaaaaattaaccgggcgtggtggcaggtgcctgtagtcccagctactcgggagggtgaggcaggagaatggtgtgaacctgggaggcggagcttgcagtgagccgagatcgtgccactgcactccagcctgggcgacagagcgagactctgtctcaaaaaaaaaacaaaaaaaacaaaaaattactacagtgaaaatgtaaaatggaagtccattttcagcaaagggcttctatgtaaagaaaatatagtttgttgttgaatctttaagtaatataaacttaaaattttctgtgtttataatttattacatgaatgttgtaatttatttccaggtttaattattttaaggttaaaaggtgtgtgtgagtgaacatcttgagcccttgctgagtgccagagattgttctaagcttttaacctgttatctcatttggtcttcaaaggacctttatgagttagatactgtaattttcgcaatatattaaatgagaaaattgtggcatattgtagtttatagttaatcatcattcccaccccccagttccaagccagcactaatctactttctgtctttatagtatatccttttctggatagttcatatgaatggagtagtaaaatatgtggcctttttgttggcttctttcatttaccccgatgttttgtcattgtgttgtagcatggatcagtattttgttcctttttattgcagaataatacttacagttcgtttttaatgaaaataataacacagacctggtctcctggtagcaaatatgagaaaaccactaggtttgggcctagctgttccctttatgcctctcctatgtgttatccttggtaactgcccagacccaagaccagacaggaccattgccttctagagttctcttattccatacctggatgcttgtgcttcctcccttggactttttgtccctttactacccttcctggcattcttttcactgttctgtgaattctcattttcagtgtcaacacattaccctgtgttctcagtgctttcacagtgggttgctggcaggtaattggaatctgagaattttatccaagttgcccattattctaatctccataagccacagagccaggaactgctgatggtgtactggttgtggcgaacactcttttttgaaaattactctcttacataaccacagcacatgccatcaaaatcaggaaatcagcgttgatctgataaaaccatctactccacagaccttgttcgggtttgggggattattccagaatgttctctcctggtccaggatttgatccaggatctactggcatgactctaattttcttcagtatggagcagttcctcagcctttctttgcatttcatagcaaacttactgaagataactagttttttttttttttttttttttttttggtggaaactcagtttaatgtttctttataatctgcttttgtaggggaggagcaaaaattctgtattcttagtgttttgtaactggagccgtgtgatgtcaatttgagtaaatatgatagaagatatcca

SEQ ID NO: 98331 - DNA, 1005 bp, Homo sapiens
ctcgtccttctcctgctgcctccgctcgccgcctcgtcccggccccgcgcctggggggctgctgcgcccagcggtgggtatggccccgtgccctttgcgttggctttcccgcggggccctgcagaggaaagcgaagggcgcgcgggtccgtgtgctccgggcttgtccccggctcggcctttccttccctccctgcctgtctttccacccttctcgttcccaaacccccattcatcccagttcacttttggaagtccatttctgttgcattcgcgaaaaacccattccaattcttgttggttccactgggaggtgtttagtggatcctgggtccctcagcgatctctgtgcaacttgcggaggggcaaccagtggatgggaaatacagcgagggagcaagttgctacttgcgtggtggaaccttaatgtgaatgcggggaggatgtagtgataatagtggtaatgggctgtttcctcaaatttcgtatccggcgcattcagtgcggttggaattaaggtgggggaggcacacttcggggaccaaagaattaaggtgctgaagacatacttcatgcacgacctttggttctgatttctcaaagtgcttgtcattataatgaacaattaatataataccatcttctatatattgatgattggaagtcactgaaagcagaaagctggctttgtcaggaaaataaaaagaaattgggaagctgccagcatctgtatccctacatggcaaagtatgtttgctcatcttaaagttaaaagagaagggaattgtccattttgttaaaagagtcgattaatattcggtatccataaattcagtactcaagttatcttaggagcgttcttagctcttggatgggatgccactaggcagagtagagttgtgcttctgtggactcagagaaggggtggagatcgggggcaggacccctgaacatgttcatttaatgactcttcttccctcaagttcattctaccccccccccaaca

SEQ ID NO: 98332 - DNA, 2981 bp, Homo sapiens
tgagttcacaaattttactgcagcattttattaagaaagcaattaatattatgataggggagaaactggaaggaattaacttgggatctactgggataagactgttgtttctcttctctgactaaactggaactagaattttctgatacctgaaatgatatccatgtatctttcaggtacattgggcactgaacagtagttaagtgaatgtgtttatgattctaacttgtttctgtgaggctttatgtaagggtgcagtattctgccttgatataaaactgtctcccatgatataaaaactgctttcaatctgcacatgcaagattgcttcaagaagctatttggctgcagtgtctccatcagtctttccacttagaaattgagtgtttaaacagtctgtttctttaattgatcagtaggaggaaaaaaaaattttctgttgtattttcaataggtaaacaatttgacatttaaaaagattatggtgactagacacaaattatttgcataatatgaagaccaattttgattggcataattcttcagtacctactctgcattgattatgagcagttgctttactttcaggttagttcagaaagtggaactgatatttaccaaggtatcagtagaagacaaatgtttaatatccaaagagtttaagggatctttttccctgtgttactattctttacttgaattaatattattttgaaccccgagcagatttaaacaatggattatcggttcttctgttgtttatcgggagcagaaaatagagtctgtatgttaaatgtttcattttgatctgtacttgttcaggtgagaacaacagttagcaattaactgtctaaacatctagaatttaagaaagtatctgcagtttacatcattgttttttattagttttctaaaatataggtgagtggtaacagtatttatccccattttacaaatggggagctagaaatttaaggcttttgggtgattttcctatgttgtaaagcagctaatataaaattcaggtgacctgaatgtttaatttttactattttttacaagttaggtctctgagaaagtgctttcttcaccttgaatattactggagaggtgaactttctttcacattattttgaagtggctgctacccaccgtgagataaatgtgtctctgttctcagccagcccttttctccataagctcctatataacttaatggggtgactaataggtcatgtctaactcatttgtcttattgataggagaaatgggtgttgtctttaaagaagagaaatccaaggcccttttgataaaatgcattgaggcttttatagctttccttatgaatgagaccttttagagttaagtggttagttctcaaactccagcacctttgcttaggatgctggaggaaggaaaaacagctgcctcaaagcctgtttcaaagaatgctcaagccctcctcagcagagacttgaaatttcagtggcactttttaataactcagatgtttgaggctatgactaatgcttgccttatagtttaaccttatgtggctgttttctttggtgggacgtggtttgactgtaatatacctgacttccgtgataataaggtttgttaaacctgtacccaccgcttacctagaggaatagttgggtttcttttatactgtactttgaaaagaatgtttctacagaaatcgtatttgaaagcatttttcttattagtttaactctataaacatttgttgcacctttctcatatgcaagcggtatgctaagtattcaaagataagagataaaggttaaaaggatgaaaagacatgatctatcctccaggaggcaggaaaatgagataagcaagattctaaaagtgctcccgtacaggtatagacagtgttgttgtttggtgggtgccttgaaattaccctttgtgttctgtgacctcccttttacttctgtttttaagcatctcttgaagtagttgataaaaagtgttccatctgctttctgctgtatcttaggatgacttgcttaataacagtgatgagagacacttgccagttctgctgctttagaaatgtttcagtaagaaagtatagaatttcatttctgcttttatgtaaagaagtttttaatatctgtgttatgtacctttttttccctctcctgatttcattgcactgaagcacattttaatgaaagccttagaaatgctgaatcactgtgcctttctcatggatccctagactgggggtagaggtggaaatggaaattcccaaatataggttgcaaggccaagctccacatttatgtctgaagaaatttcgtaaatgttcaatgttgatcaatctttattactttatagctgtgaaagttaacatgtttattaactcttccagaattggtgagtgtaaaagcagattgtgcaaaccacctctttgcatcctaatgtttctgaatgccttaatgtttctttgtcaaacaatgttgaaaaatcttttttatctgcatagagtgatgtataaccagttgtccaaactgtgccattttttaaagtagaagtgggcactcctaataattatgccaggttagtaggcataaaccaaggtagtctagagcaggcagggagttttgacaccttggatccaaatgctgtattccttgatttttggtgcttactcaaattcaagattctttaaagacaattttattttctgatgatttattataaattctttcttgctagctaggaagtcagattcctgccgtgtagcagtattagggtctgaaatggaaaaatttaattttgctttgtgtgatattgtgaaatgtatttggtaattatcctgtttcctggtacacagcttcgaagaccgttggaatctccagagtgatgagtgtctttcatatgccaatgagatgatgggtggctgggggtccctaaatagcttcaggatgggagctggtcaccagaaa

SEQ ID NO: 98333 - DNA, 1036 bp, Homo sapiens
acaaccccaaagagagaggcagaaggttgagttgatcaccaatagccagtgatttaatcagtcatgcctatgtaaggaagcatccataaacacccaaaagactgggttctggaaacttttggatagctgaacatgtggaacttcctggagggtggagttcctggggagggcattgaagatcctcgccctatgtgtctcttccatctggctcttcatctgtattctttgtaatatctgttatgtaaatggtaagtgtaagtaaagtatttcctgagttctgtgaaccgctctagcaaattaatttaagggaattgtggctaccctagtttatagctgatctgtcaggagcacaggcctccatctggggcttgagattggcatctgaagtgggcatttgtaggcttgtgggactaggccttcaaccagtggatctgacgctgtctccaggctaagagtgtcagaattgaattggaggacatcgaggtggtatgtgatggagaatctgcagaattacttggtgtgtggggaaaaccctcccatacgtcagatgtcagaagtgttgggttaagtgttgtgtgagactagagaaggaaaaaacattgcttttttcttatatctcttactttgttatcaagatcgatcgttttcacttgtggagacttttatgggcgtaaatggaattgtatgattactaaatataagcattttattaaccattaatgcaatatattaataaaatggaccatacattttaaaagcaggagaaacactttagattcattcattcattctgagataatcctatgtggtctgttcctaggagagttaaggaagcttttcctgaaactttagtcaaaaactacttgtcctgctgggcgtggtggctcatgcctgtaatcccagcactctgggaggctgaggcggttggatcacctgaggtcaggagtttgagaccagcctggtcaatatggtgaaaccccatctctactaaaaaaatacaaaaattagccgggcgcagtggtgcgcacctgtaatc

SEQ ID NO: 98334 - DNA, 1104 bp, Homo sapiens
tcctgctaactatgtaactattagtgtcattctgtcttcacttattctcaggctttgttagcagggtggaccactgtccttctctttacagttggtgaaaaaataacccaggaggccaggtgcagtggctcacacctgtcatccaggcattttgggaggctgaggtgggaggatcacttaaggctaggagtttgagagcaactcaggcaagctagccagaacctgtgtctacaataagttaaaaaaattaaaaagaaaaaataacccaggagcatttgcccaatggtgatgccctgtgtgaaggtaaatcatgcaggaagagagctctccttcctgccttcctcatctttctcagccatgcccctcagttttcccagctatctaagagtgaaccttgggagtcatctttgactcctccctctcctgcctataaatagtcgctgattaagtcttgacgtgtctcccatgactccatccctcccctcttctctgcattgtgttcttgtcatcgcctctggtctctctctctgtcaatccatcagtcccactgctgacagattaatctttatggaacacttatttcatcatgtgactccctttatccacattcagcaagcataatttcagctagatgaattttcctcttggagccagggagaggatgtaaaagtctcttgagaagaactgctgctttccttcttacaccacacatttgctgttcccttctcctttcagcacttttccaggcctgtttacccaaaggtcagtccatagcaggttataattttggatgattctattcatttctgtccaaaccctggggctagttatagaaaacccctgtgaccagtggcaagaaccgaatctatcaggaatgtgttcttagactttcaagtccaaattctgttaaattcctgcttcagaacatcatgtcatctccatctttaagatctgaataattaattgcttgtagaatatcagttttctaaatgaaaatattttattcctttcaagaatgtatacaattataaggctttattcatacaaagtattcagttcacaattgatatgggcaccctttaaccttatgaaagactcattcat

SEQ ID NO: 98335 - DNA, 1264 bp, Homo sapiens
gcgtagggacatagagccaaatcatatcaaccctggactggtgactatgagagcaggatgtgggaaatccgtccccatgatccagtcacttcccaccaggtccctccctcaacactggagattacaattcaacatgatatttgcatgcaggcacagagccaatcatgtaaaccttggaccagtgactatgttgctcttgagctttgatctgtaattatatagctgggcacactcacttttgcttatctgcatgacagtgagggagtcatcctgccacattaaaaaaaaaatcttagatggtagtgagaacaaggtagtcacgtattcctggaccacttctttttgccctcagtggggctaaagattaaatttagaagtagtcaaatccaagcacagctagagacatcataaagaacattccagagtcatggagatagaggtttttgagtatctgttgaattccagtgcctgttttagaacctcctttcccttagtgtggttatttaataatttactgcatcaagttgtagtctgaatcacttagtcgggtgctttgtgctgtcttttaattgtaagcaggcctgctaataccatatactataatagctgtattgcagatgggctccattaacaatgtgaatcaatcaatgcttaagagagtcctctctccccatgtttatccttgctttttatgttttcaggtaagtagaatgcatgaaatcaactttagctcaactctccaatgcattggtaataaatataatatattgcctttctatggaacctgaatggttttattgaggcactttcatatctataatctcacatggtccttgcagcataactgccaagatgattattatttctgtgttctggatgaggaaatgcaaccagagaatgagtcaaaagcccaaacaagtcaggtcagtttgctagaggtcttaagaattattagcgtgaccaaaacgaccaggactgtggtttatagacttccagtctcttgtttcttttttcacacatctgtgggttgaatagggaagtttctgtcctttgtagacagctttcttcttgatgataaagacctgtgaactaactgcagctgaactatatgcatgtgtacacacctcacttggccttcctctatgaccagctggttttctcatctttttttttccttccctaaatgagtactccagataaataaccttgtttaaactactagcatttttagaatattttgcttatctgcttacctttccttctt

SEQ ID NO: 98336 - DNA, 3709 bp, Homo sapiens
ttgagttaatttttaaatggtgtaggttaggaaccaactttattttaattttttgcatgtggatgtctagttttcacaacaccatttgttgaaaagaccatcctttcccttgtgaatgttttcccatttgtttgtgtctttaatttctttcattctttttcttcttctttttttttttttttttgagatggagtctccctctgttgcccaggctggagtgcagtggagtgatcttggctcactgcaacatcgcctcctcggtttaagtgattctcctgcctcaacctcctgagtagctgggatgacaggcccccaccaccacacctggctaatttttgtatttttagaagagatggggtttcaccatgttggtcaggctggtcttgaactcctgacctcaagtgacccacctgccttggcctcccgaagtgcgtgattacaggcgtgacccatcgcgtctggcttgaagtagtttccttctatctgtttttgcatattttatctcataagtttctttaaaagggagaccagactatgagtagaataattgactggctgtgcaatagatagccagttttgggtaagacacttatatctagatttaaatttcctaattttaaaaataaggaggttgggttagatttgggaatctcaaactttagtgtgagttggaaccacttggggaagttgttgaaaagattttgagtttgtaggtctgtatggggtctggtggtttgcatttttataagtctcaggtgattttgatctggatgcgtttgttctctagaatcccttatggctctaaaattctttgaaatatcctccagtaaaaggcatttgggtatttattagaggacatgaaatgagggtatgggccattgaattagggattgtttgttattccaaatcatggttgcatttgtggacaagctgcctcctgagatttgggcatgttagatggagagtaggaattatgaagtgaggacatttattgcttgaaaatgaaaagagtagctgccttcaggagtggctggtgtgagatgattcagggacaaaagagcttttgcaaaatagaagcagaggagaggggctaaggaacagtggtcagcagagaggctgttggggggatcacactgcctcgatttatcactaggaagtccagaaagtcctgatttgccgccaggaagtccagaaacagacagtctctggtctgggaattctaaacaggagtgctgggagcctagagcaaaggaatgttactggaggtgaaaaactgatgaccaatttgcatacacatgcacacttacacctgtaaagttagtataaatatgtcatataaaattggtggttactctggtatatttacttacatggtctaagaattcagagttcataaaaatataatatgaaaagtgaaaatttctctcccagcacgccccaaaggctgttacatttctgtttttagttctcacaacgttaaataatttatctctaccctatttttagatccttcaacctaagtactatcttttgtctgcctgctctgaaaggcaaagactgtatcacactatggtgttcttccccttttcgccctaccacttcgatttttcttccttacttattttgaatttgctgtggtcattttacatttgaaaaggacttggagcagcgggacttagggttagaattctgtgttcagttgttgtcttctgcccctggggagaaaagtaaacttggagactcagcaagaacagctggaacccaagtacccccatttaaggatttgccgggagctcctgcttggcatacaaagcctcagaaggttgatggtgagggatggagagacattttgtgaaggaaaaattgcatatttcctgctctgttatttttttttaaagttaagaaggggccagaggaggaagagtctatacagattttgttgtggtttcatcaggaagccactgatgggttttaaacaaggaaataacattacctgatttatattttaataagatcattatggcagctctctggaagacggactggatggggcaagagtggctgcagggataccagttgggaggggtttacatttgtccaggcagtgatggtgtggactgcactgggtgatgagcagaggaattgcagggatgcaagtagatttgggatacattttggattattgtaggctagaagaggagaggagttatagtagacagattcccctaaagatgtccacatcctaatctccaacacctgtgaatatgttctcttgcatggcagaagacactttgtagatatgactaaattgaggctactgagatgggagtatatcctggattatctgggtgggcccagtgtaatcacaagggccctgatacagtcagagagaaggagatgtaatgttggaaacagaggtttgagtgatgcgaggaggggcccacaagccaaggaatacagacagcctttagaaggtggaaaagattaggaaacaggctcttccctagaacctccagatggagccagccctgccaacaccttaactttaaactttagactttgattttggacttttgacctccagaagtgtaagatgataatttatgttgttttaagccctgacatccagggaaatttgttagggtagcagcaggaaataatccagcagtcaaaaatgactactattctttgtcctggggaatagtgctgctatgtcccaatgtggggccgaaaaggaaggtttaggaggctgacaggaaactgagcctgttcagctcaggaggactgttggtcatctgtgtgcatatgttaatgacctcgttgtccccgggatcaggggcaggtcaggatgagatggaaatgtgggagccttcaccaggtaaatggtatgtagagacctcggggtttcacccatggagagactgtattacgtgaattgtggaaaaacagcttagtaatttctttcagaggctacatagagacctattccctctcattgcttgctgtctaaattatagttgttttcttttgagtcatcaaatgacatttcaaaagacaatatgaagctgccactttgggagaaagaaagcaatattaagcagctttttcgaagatcaaatttctggactctgtagatagttgcaatatttcttctgttattattttttgaaggatacatatgagctcatttgacagatttaaacctgtagtttaatttggggggaaggcttgtatggctatatatttttaaaaatctagttcttttcagttggattatatttaactgttgaaagaacgaaacttcccatttttgtttgcatcagttacttcttgctgttttgtttcaagggccttggtgacagctgaaaataagctttgaaaataaagttgaattttgactgggcatggtggctgacgcctgtaatcccagcactttgggagggcgagacgggtggatcacctgaggtcaggagtttgagaccagcctggccaacatggcaaaaccccgtctctattaaaaatacaaaaattagccgggcgtggtggcacgtgcctgtagtctcagctacttgggaggctgaggcaggataatcacttgaacccaggaggcggaggttgcagtgagccgagaacgcaccactgctctccagcctgggtgacagagtgagactgtctcaaaaaaaaaaataataataataataaaaagaaa

SEQ ID NO: 98337 - DNA, 1119 bp, Homo sapiens
cctctacttttggaaaaaaattaatgtactgtaagtagcttttattttgagctcttaatcaagtattaatagcattatgttttctctaattatggctaattaaatattgcccagatatagttatttgcttatttcaggtaattaaaaacatcatctgaaataaccgtaattgaaataatataaaattgtaaaaattgctctgtttgttttttattctttggcactattacaaaattttgaagcactgtgaatttttttaaaaattcaagaaaagtcttcttgctgtcatttggtgacttaagtagcagctcggagaacagatgtaggaatgaagtgatttatataatgcttcagaatctttttgttcctgaatttcacaatataaactttaattatgaaattggtaagagattttgagaaacctacattatttagtaggatgtgggatatatcttaatttctgtgacttaaaatgaggtctctaagatgggagatatagttagtaaataaaaataaataagtttatgcctttaaaaattcctaaaatgagatattgtatatgacaatgtatatgatgatgtatgcctaaaagtagtgacatgtttgaaatattagaagcagtagagatatcatgacttccagaacatggaagtgaactttcggaaaatcaaagataaacattatgttgtttcttaggaatgtttaatatatatacattcatgcatgtgatccatgtggtttgttagagagctgtgtcttcatttgctgatcattcttttgaaattttaacatgtatgtgcaagacataagaaagtgatgctcttggacttgaattctttttgggaagtttatagtgcataatatctcttggttttcaaagtgacactgtcctaattaaaaatgttgattttaaaacccgattagtatgttgctttacaattgacttctataattttttctctgttatcttaggtttctcatttaaactctagctctatcagacagtaagttatccacagaattatataccctcctttattcatttactaggatttttttatccctaatatgcccttatttactcattcatatgtctctcatttactcacttgtccatta

SEQ ID NO: 98338 - DNA, 1079 bp, Homo sapiens
ctggggaagcctcagggagcttttacccgtggtggaaagcaaagtgggagcagtcattcacatggccagaacaggaggaagagagatgggacgaggtgccacacacttttaaacaaccaaatctcatgacaactcactactgcgatgacagctccaagggggatggtgttaaaaccatgagaaaccgtcctcttgatcaaatcctcatgatcacctcctactagaccccacctccaacattggggattacaattgaacatgagatttgggtggggtacaggtccaaaccataccatagtttaaaggatttattctttatatctaactgcctattcacaactccacttgggtatgtaatgtgcatatcaaacttagattcagagtcctgaattcctaccaccacctccttctcctgcaattttccccatcttaataaattgcttgctccttttggttactcaggccagacattttagagttttcttgtctcctctatttcattataatccatgtctactctgtaagtgagtcctattgactttgccttcactatcttcccagaatctgaccaagtctcatcaactctattgttatttcccaagtcaaacccctatcacctcctacctggattattttgcaaaagtctcttaaggctactctgcttctcccttgccctctgaccactttagtgcatagtccgcacaatagcttccagtgaattttaaaaaatggaaacctgatcatatcattcctcactcaaaattctcagcaaattactatttcattcagaataaaaggcagagttcatacagtggcccacaaggtgctacacaattgacgcctcattggttctgtgactattgcctgcacaactcctctagtctccctccacttgacccacactggcctttttattgctattctttgaatacaccaagtgtgcccctgcctcggggcttctacaactagctgttccctctgtctgggattctctttccttaggtatttacatgacttgcaccttcacctagtctttgctcaaatatcagcttttcaaagactccttctttgaccatcct

SEQ ID NO: 98339 - DNA, 1053 bp, Homo sapiens
cacacaccctaaaatgtaaaccctggaaggccagggcttctgcttgaaatgtggtagacacacgtgattatttgcttaatgagtaaatgatttcatgtatgatgtagaagccaacaaggtaatatataatctgaggaaatagatatattcctcagatacataatagacatattctatttttatttctatatgtcttcaaggctccatctaattttctaggttcacatttagaaaaaaaaatggagttttaataggcctaaaacattacatggacgtggtgagacctatcatttgcgtatgaaaataggagattctgcatagtggtcagtattctaaatgttagttttaaaaattgtgcaaatacaggttgagtggttgatcgtttccagagctctgtggaagttcgatattagagaacatgaggtcacgtatcaatattagcttttctacatctagctttgggtaaagtatgtgtagtacacatttgttttgagtaaaattgtgaaacaggacagttgtgggcctctatgttgaggaacaggccttaatcatgttacttaggaagtctactggcacctgcatttttgtaaaatggagaaatccatttttggcatgactcccaatgtgaaagttactcttttcatccaaaggggtagaatacaacccatccatagtcgtagatgaggtcagaattcagtgcaaaggacagagccagacatggctgaggaccagagaacactgaacttttcctaatctgtagctgtagttctctgtagataaaagggatctctgccccagtaatgtgcaacttgctgagggtagtcaaggaaagcaaagaccacttaggaatatcattgtcaaacagctgtatatttaacatgaactttgagcagtctcataagcagagcctgaaaaattctgcaaatggaaatatcagctctggtatagagatcccaacataaatcactgggtagaaacagtatgaaacctatcaacaaggatcagtgaatcgaggtatttcaggagaagagagctctggcctggacaggtctg

SEQ ID NO: 98340 - DNA, 1061 bp, Homo sapiens
ggtttgctaggtagaacaatgctaaaatgaactgtataattactgtaccataattttcattttgtatttcagaatttctcattcttaacgaatccttgtgtagtcatcataaagactcaagttaaagaaccttctattgccttggattgatatttgcattgacatgagtccactggattgttatagtcaaaattccaaggaccagagtaggcagactagggaagtaggactccttaaggagggttgcctcacatgaggctttttttttcttttagaatagtattcacattatataagcaaatttaaaaaactgccatgtaatgagtcacagacactaagcatggtgcttggtgtcttgctttccaaaacttatattttatttccattcttttatttaaattatttagtgggtgttcaataattctggctagaaagacaaaatatgttcttgctttatgacacaagtgttagcagagagagaagtgttccttggagttgtgcagtttggtgatgtaggaattgacgaggaaaaagaacaaggtgaatcacacctcagctactagattaatgcaccacattaaatgttactattcaggaaggcagttaccaagaagcttccatggtaactgttgtcatagttgtatttttactcatctttcaaaaaatatatgaaagtgaaataatactgctgtagtgatacttgtgctgctttacccattttaaatagcaagtgctccaaaggcttgtaattcagtctttctccttagttggcattgccagtttaatatccagcaaacattaatcactaacagtaaatgtatagaagacgtttcatatacatgtccaaggatgctttgtcagtgaaagtgtattgttacagagtcctccagggttgctaaataatcactagggaaaatcttagtttgacctcccccatacccaccataagattaaatgtagcttctcttctttggctggccatgaagaattttaaaaagaaatatttagtgtggctaatgtgattgactggaatatgtatttggattatcagtgcctacttc

SEQ ID NO: 98341 - DNA, 1049 bp, Homo sapiens
tgttactgtattcttttttctctttttcctactttactgtctccttcctaaatgactgagctttttcactgtggctgagctacattggtcacattattattattgctattttctttgagaatgggtctcattctgtcacccagactgagtgcagtggcatgatcttggctaactgcagcctcaaacacctgggctcaggtgattctcctgccccagcctcctgagtagctgggactagaggcatgcaccaccatgcctggctaatttttgtatttttcatagaggcagggtttcaccatgttgcccagcctggtcttgaactcctggcttcaagcgatcctcctgccttagcctctcaaagtgttgggattacaggcatgagccactgcgcctggccgtcagttgcattattgtattatttaatcctcgcacacatcatgttgttaagctattattatttgtattttattgaccggaaaacattgaggcttgcagatgtaaggacttctggcataagtatggcacttttttgtcatttaactaaaactaacacctcatgtttcttcctttgatctatgaccttggacaataacattagttaatctctctctgccctttaaaaaagtttcttttctataaaagggtaataaaaatgtctgctgtaccaattgcatggggtgctgtgttctagatagacatgacagtactttgagatgattaaaatgtaagaaatgtgaggcattattatttttatcataacacaaacctgtgcaatcaccagtgtatcaatttagaatgagggattagaacaaaattacaattaaaaatggtctgttgatattttcttttggacttcaaaacttttaagatatatttacatatttggatttttgcattatacagaaaaagattcacaagctggactttcatgtttctctagctacaggataggtccaaactagtcctctttagaaaaacctctgtgattgaaaagaagtgacttcttttcctcaaacttatttcaatttaaagttgacattttattctca

SEQ ID NO: 98342 - DNA, 2268 bp, Homo sapiens
agcttaccacccaggggagggatgggaaagggagagacagggaagcacaaataaagtgcttccaaagccctgaacgtgaagactgtgtgaagaaagacttcatgaaaagcattgcaggtgggacgcctttgaaggatggggagagtttcaatcatcataaatacagggaaggcaaagaggagcatggggtagtattggggggaaggagggaatagaaagtactgggagggagatgcctggtgtgttcatgctggtgtccagttaccatgcatgaagcacttcacagatgatttgcagcacccactgtgccttaggaatgcaattctggaggaaggacgttagtgagtcaaggaagtacagtgtaggtgtttcatttagccttgttctttttttttttttttcctgatagtgtgacaaaggagagttttatgttagctaatactttgacaaaactttattgatttgttaatttgcaatattcaagatgcttctgtgagctataataatctttaacatctagtaaataggattcatgtttagatggaattatctttgtagtttgaattaagacaaaataatgacaatatttataaacatatgactcttaaagggggacataagctctcagtattcacaaaaggccaggttctaagtgctttctgaagttacaaggttgtactctcccattttactgtcatattctgctgatacatcatttagagaacgttccaagaaagttctaattcctgctgaagagcagagcactgacatgatttttcacttaggtgtgcagaaagagttgtttagctttatgcacaaaacgggctgaaatcaagctttaattagtcagacttttgcataattcgtcacggtcactttgtaagtccagcagaatatgctgttggtttttatcttagtgggttcattttcaaggatgtgttgtcttattagctctttgctacccaaatatttagattttcctagcaaaaccatgatattgtatctagtctcctaaagaaatgaattgctatatgatgatacataaggaaatgaactgatacataaaagttattcgtcttaaatatcattcttgataataatctgtcttaaagacaggaaagtaagttaaggttcttctgtctttttgaatccataggctgtccatctggcccaggcaagcttccagattgaagccttcggctccaaattcattcttgacctcatactgaacaagtgagtatttagacataatcttcttaagaagcaggtgcaataaagctttgtttttataatatcggtttagtcaaaataatgtctgttgtttaacaactattttctagcagattattatagagcatgtaaagtataaaattctgaatggtgaattatatatttttttccgaaataaaagatatttaacatgttaagcatctcaaacccagcacttacatattataattttaaatggaataaatatttgaagtaatccagttaattaaatgttaattataatcatcactatatataagaagcatgataaatttactgattcaagtataatttgactacagtctagaaatttcttccatttactctttataatgcaattcgcatgacttctgtgggaagaacagagtaagtgatgacttgcaaatacctattttgagaagattctttgctttataatttgctctaatatggtttcttagaaattttggtcctgatgaaaatttacccgattgtctctgagcatgtgtttgttgatatttaaatgctgtttcctaagttcaaatcagttgtacagatgtctttgtacaaagtgtgaacaagagctgttgacttaactaaggctcttcagcctcaaatagatctagcagtgagcctttctttggtgaaagagattttctatgtggttttcttgagttacagaaattatagtcagtattttaagcttttgtcagtattttgatcaggactgcatctttgcaagaaaaatacctgttaatgctatcaaacactataatgtaagtgaccacaaccaatatttgagaaattgcaaagaattataaagaacaactattaaattttttgtatgccaaattctgtgagctctgcagaaaaaaatgcaaagtcagcttgggtgttccttaccaagtgttattgcagctttaagtcagaatgaatcagcagaactcagaattgcctatgtaaaggtattgcaggttttcctctttggttgagttccgtttcaccatgctgtgtcagcag

SEQ ID NO: 98343 - DNA, 4069 bp, Homo sapiens
agcagacagctacactgatatagtttcagttagcttaaatacagagcccaaccttcttgctgactgacatggttaattcattcttcattcagtcaacaaacatttattgagcttctcgtttgcgtaagacactgtgctgagcaacacgggggaattcagagctgtatgaaagaatttctcgtcttcaagagcctgtggtagagaaatgagattacagtgtacacgaatagtgttaaaacatgatagaaagtgacttgagagatcttggtgatgagggaaggttttctggggaaggtgggattccatgggactcctacaggaggctgccttggttttgggtcccctggtagcagaccctgagacaaggagggaggagctaggaaagggtgagttctcaagctgtttactcctctgggcagctgggattctcactgagagctctgggagtctgtggactcatgccagagagttatcccacctagaggcagggagctagagttttgtccactaactgccaggctgttgttggctgaagtctgtttcttggggcagtaacactttactacctcctcctgggtagagtacaaagccctcaggcccagggtctcaggcagttccagtcagctgccttcagtgtgtggaagtgaatgccaagggcatagtggcagggcccagtggagcccatagcaggtgctttagactttgaaaggtgtgggaaggagaaagacgcagactccacaggaagtggcaggcagaggtgtggaagcccaaaagcaccaaactcctggggtgagtcaggactggtgaggccccctctcttaaagaacctgaattaccaagctgcaaacagaaggcaaactgcctggtgggagtccctggatcctaagggggatattcagctttatttggctaaatgtttttttcagctctgcggatttggagattgaacttaaatatggttgtaagaaggaacatgtggagaagaaacaggcctcctgcctcatttttctcttgtggtcgagtaagaccaggacaggagtcaggagctgtggctggggacagcttgaggcaccttgacctataccagcctgagctgtggtgttgctgtcttacgtcttggtttctaaatttttgtgattcctgaatccagattggcaggccttttgtgtcattgctggcctttttctctccaactagcagcccatcatgctcactgctgtcatttctcttacacatctgagagagggaatcagggaaggcactggccttaggaatttggagtcaagacttccaatttcacctctgcttcagagagctggtcacacactctgggccttagtccgaaggaattagaggagactatgtgaacattgctttccatttcaggagtctcggggtttatgatgctgctaactcgaaggttaaatgctttacttcccagtttcaagagatctgcagaaggaaggctttctattatggtgatagacactgtgccaagccctatgtgtacccatagtctcctatttaagttcctttgataaccctgtgaggaagatgtgattatccccattttactgctgagtaacatgcgggctggcgagattcagtcacatgcagggactccagcatgggctgtctgcttggagtctccttcaccgtggctgctgtggtcacagcactggactaccaatttgcaagtgagctgaacctaattctgatgattgcatatctgttcacattaagtgagaaaaagagtggaattattttggtcaatttgtaactatatgaggaaaacacggaaggtcccaaataggattgaaaataatgctgtttgttgagtagaaccatctgttatgctctgtgtgtctcccactctgcattcgtacgttgaagttctaacccctagtacctaagaatgtaactatatttggaatgaagtctttaaaaaggtaattaagttaaaatgaaatcttttgggtggcccttaatttaatattactattgtcatgaaaagagaaagtttggacacagacactagtgtgttggaggaaagaccatgtgaagacacagtgagatggacggcggctgtctgcaagccaaggagagagccctgtgaataaaaccagccctgctgacaccttgatcttggacttctagccttccgaactgtgaggaaatacatttctgttggttaaactaccagtctgtggtactttgtggcatccttagcaaactaatacaccgttctaattcacttattgctcacctattgcagtgagacattcagcattaagtgctgcttgttaatgggtaaaactgtttgtcccttatactatgattttcaagtgctgttttgagaaattgtggtttcttttgcatttaggtactttaggatgattggaactgttttggtagttttgaaaaagtgtgtgatgataaagaatcttaagaggcaggtatccccaaagttgctgtaaatattgattgccactgtgctgtgtgcaatatgatgtagtcaaatattgcattgtatatgtcctagaggcctgatagtattctaagctttctagtgctggtaggaatgagttgctatggatttttctctcctgaagccaccctttcctgtctgcttctaaactttttaattctagagtgccaggtaactctttttgttgccatattttctctgatcagggtgatcagacatttctggtctgagtcaacccatattgaatgccttgggtattatcatttgcttttgatgactcatctttatgctggtagatcaggtccagaaaatcttgaaaacatatacaataaaagaaatattgtctaaattttagtagattctggttctatttacttagggtgtctatgcaacctactttcaaaatggtttgagaatgacttgcacaattaaacataacaagattattaaaaataaaatcacaaccaaaccattgatacttatatactgattcttgattttcatagatgaacaaaatccagcataactcttgggtggtgaaattcaatggatgtttgccctctgcctgcccctacccctgcttgcctattaacaataattattgtgagtgactgggacccagggagattaagcaccaggctagagaaatgaggagggccacaggagccagatttagattttctaggttctgggagatgagaaaactgggattgcccagaaaagaggaccctgtggctacagtctttagcaggagaataaaaagtatggcaactaagaatttgtagcaaaatcaaaagaatttaattgttgatgggatcatattacactgtttatcttacctaggatataaaagacatctctagtgagtcaggagactatttcttgactggtggataaaaggagaccctttgcgggtatccaccccaatgcagaatgtgggcaaataaaatctgaacttgactcattttttcagagcacttcttggtcttttgaagacaaagacaaataatgtataaaaattccagcagaagttaattgtgacaaaaaattgaaaagcacagagaattagatgtgaccaagcatctgagataagtttattacagtagttactgaaatgagatcttaccttttagtgggttgtgtaattttcattatctgatacaagaattttatctctctagagatataaatgtttccttgtcaaagaggaattatcccttgacgcctgatgtagtagggcattcaatagcataatggttaatgtgtgcaaccattatttttcttaaatgggtttctcatattgaccctctgtgttagccaagtgtataaagttctttctaacctgagttgatggatagatttccattgacagaagccattcatgaatgattccgagcacttttatttcacaaatgtttattgagtgcctgctaagtgccaggcactgtcaaagtttgcctggagaagtccttccctcatgaagcttatagaacaatggaggaggaaagacaaatctgtaggcatttaatgacaatctgagaagtactgtgatggggaaagtacaggatgtttttatcccac

SEQ ID NO: 98344 - DNA, 1030 bp, Homo sapiens
ggctttttatttatttatttttttgagacggagtttcgctcttgtcacccaggctggagtgcagtggcgcgatctcggctcactgcaacctctacctcccaggttcaagcaattctcctacctcagcctcccaggtagctgggattacaggcatccgccaccacgcccagctaatttttgtatttttagtagagacagtgttttgccatgttggccaggctggtctcgaactcccgacctcaggtgatccacctgcctcggcctcccaagtgctgggattacaggcgtgagccaccacacctagcctatattggctttttaaatgaaacaatttctacaaaaagtttcacgtcctttaatataattacaaatatatttttccattttacaggaatatctttcaaataagaaggtggaaatctctaatacattgtagagagcacatttcatttcttcctcctttcttttttgcccaagtgagttcacacatccaataaatcagactaaactacatgtgaccagaaggatctcacagcataagaatagattatatctcttgtaaatctccaggatttcttgtttttcttgaatgtccccctctcatctttattgaagataatggacagataaaaattatgcatatttaaggtatacaaggtgatgttttaatttttgtatacattgtgaaatgatcaccacgctcaagctaattaacatatccatcacctcagatggttatcttttttctgtttttgtgctgagactatgtaagatctccttttgcaaatttcaattatacaatacagtataattaattatagtcaccatactgcacattacatccactgaacttactgattctgcaaaatggaaactgaaaccctttgaccaaccaagggattcttagaaacttactagtgtctgaggctctcccttattactgttcatatttattcattaaggactgagctaatacttgaccctaaaaaaatgtttgctctttaaagctgttcagtggtaaagggtttct

SEQ ID NO: 98345 - DNA, 1140 bp, Homo sapiens
tactatgcagccataaaaaaggatgagttcatgtcctttgtagggacatggatgaagctggaaaccatcattctcagcaaactatcgcaaggacaaaaaaccaaacactgcatgttctcactcataggtgggaattgaacaatgagaacacatggacacaggaagaggaacatcacacaccagggactgttgtggggtggggggaggggggatagcattaggagatatacctaatgctaaatgacgagttaatgggtgcagcaaaccaacatggcacatgtatacatatgtaacaaacctgcacgttgtgcacatgtaccctaaaacttaaagtataataataataagaaaataaataaaataaaaaaaatttacatgtgatcttactcctttgagaggtttagttaactctgttgctgtgaaatcactaatgttctcatgtctgaatggaaacatctagtgacaacagtgcttttagaagtaaataatatgtctattttcatgcagctttgaattcctgggttctttgtatacgtttgattcagtgaactatgaaaaaatgagcaaaccttaagacaccatgaagtattttcaataaaagcagtttgagacaaggttttcaggttggcggattaaaggaatcaaactgttccttcacccagcaccgtgaacaacacccgtactacatttttcttgttttgagtttatctctcctgaagatatgctgtttggaagtatttttttattattaaaatattgcacgacttgtttgaaaatttatttttgctggttattttttatgcagaaaattctttcttcctataaggcccagaatataaggctagcttaatgccttgttgtgttgatcagatactaatatcagtgtagatgatctcgtactcattgttgcattagatctattgtcatggtagccacaccatataggaagcaaaagaaaactagtgtttttgtctctttctttgaaggcaacttcctggtaagtaatgattaaattatatgactctcaaagtacaaaaataacacaattccttagatattactccacatttgtgtagcaccaacatgcaggtagttagccatgataatggatattatgttcatgaaaaatcggtgctcaaa

SEQ ID NO: 98346 - DNA, 1038 bp, Homo sapiens
tgaaagttgggtttcagtgttttcctgtttaaagtcaatatatcaaagaaggctaagaggtgagccactcacttttttttttttttgacttagttgtgtgtagtgtttgaattgcagggatttatacaggctactgaattgaaaagagctttgattgtgatacctcagtgaaaacgattacatgtatgtttgtgtatttgtttcctgtttccaagaacaacttgtagctttttaaaaatgagcttcctttttatcatgacatgttgaggttagataaatctttaaatgtcctgcaatctaactccctagctgattttcgaatctcttcttatccctattgagagctcttctggtgtattcctgaacacttccagacttaggtagctgattcttaaactatgctgattgctatcaagtacttttttttttcatgtcattctgtaacgttttatcccctggtttcaatttttgcacttaaagcaactcactcatggagactgagcattaggctacttcattcagttatcagcacctcctggaaattggttcctgacattgctattgtcccaaagataacagccaaagttctgttcgtatgtgtttacctagaatataaaataagaatacagatcattttccaagagtggaaaattataaaaagaacttttctaaggcatgaaaaatactatattttaagcacataagaagctatttatagtttcttcctgccagtgtccagtgctattaaacagcaggagatttttatagtctgaaaagggatattttgagtctataagaactttttgcaaggtgatagcaatctcaggttgaattctgccagattttgctgtctcaatatgatttacaaatgaattgaagttaatactgtctgttaagagagaagttaatacctacccattattaaatataaaaccaatgtgttaaatataatttagttttatttctaaaatttcattgaaatataatgttttagcattctggttagaattgaaatgcagtaacacaaatatgttttta

SEQ ID NO: 98347 - DNA, 1083 bp, Homo sapiens
tttaaagtctagagttctcagacaagacaaaataatttatttcctgttaaattaacatatgcctcatagaggctaccagatttcatgaaatttcttaccaagtctcttctagacaagccttttgtttttgcctcaccacaacaatttctgcaaacaaaaggtggtatctttctacacggttattctttgtcatatttaagcaacttttgcagaggaaaaggcttatgggtggggattcattaccacatgctgaccctggaccctgtaggatggtaggaaaataaagtagaagcaaagcagaatagggatgcaaaaagtagtaacttcagctgaaaagtgaaatgtagtgggctaagcctttgctctcaaggttcaccaagtggagctgatgtttcgctaggcagaagaaaacttcagtttaggagtctttctccaggccttgtccacctactcacactacaggctgtcatggaccttaacgttcctaggttcccactgtttggtttttactctttcaagcatttcgtcagttatagcttgaaatctgtatttccatattgaggtaaacagagtaccttcatttggattttaccttttagattgcagatctagtctgtttatttttctggatgtttgctctctgaagggtaaagcccgtcatgcttaatcatcatttgcatttttttcttaacttctctgctgttcacaaaacaatctaattctttaagcaggtgtgtagtcatgtcccttggttttatctaagtaaaatgagaaaaatcttgttttccaatcaatcatacttgcattttgacatgaaacagcaggtatttgtcaaaattaattgttagataaacctgtataagtgaaaaagagtgggatggctgaaatcatttttaaaaatggaaaaaggtgctcagaggatctgaaaaatgttggattggattgtaccttaccttgcaataaaaggagattcacatctatttaaggactcttgcttttcaacattcacatagtgagatataaatgcagggctattttttttaactataagaaagtatatttaaaatttgaccattgataaaa

SEQ ID NO: 98348 - DNA, 1053 bp, Homo sapiens
ctgtcctttttatgggatggttattttggagagtcttgtttgcttttctagtgtccacaggctggtatgatctctagcctttataggcatttctcttgacccagaattttgactctgctagaccacaagcttctggatttttcctggagtggccacttcatttttctacccctgtcatgagttaccaaccttggtgtggctttcctggatgtgaatcagttcatttaggacttttctcatatcttctctagtcctaaccattctggttcctggaactgatactgatagtaaattcgccataatggaccatatacagttaatgctagcatttctaccagggttctaaaaatgtctggttttaagattaaattaaaaatagtccctctgaaagacctaaatagaatagtttctctctttttctgtgtcagtctctttgggatttggctgcttctggaatcttacaaaggttttgcttttgatccaaacactgcaaggcactttgtgaatgtgagtaagatagtctacatgggctgaaaatttaagaccatttaatgaaagttgtctggctgcaggaaaaatgctcatttttacaaattgtcttaaagttctgatttatagatctgttctgcatttttctactaccactggattttattactggcacattatatttaattaggatagaaggaatgtgtgtgctcataattatttaaaatgatttcaggacatatatttagagaatcgagtgtaaatacttaataatagttaaaagataaaaattcagttttagtattatgcaaaatgtctagactctataattagcctggagtagattaaattatgcacctctaatcactattttatacatgtctttcaaagtgacatcaattgtcatcaaatttgcttattataagattttgctggatgagtacttatattttcagtatatttattttttagtgtctttgtgattaaaaacatgttagcatgactctcaggtttttaaaatttgttttaattacaattaagtgatggttttctaattgtgttgtc

SEQ ID NO: 98349 - DNA, 1027 bp, Homo sapiens
actcatattcactcttttagacttagaagttttcttggagaccctataattcaacattcttggtttttgtaagggagaagactagttggacaatgttagttacttctctgagatctcagagatggtcagctcctgggtgcctgtttagttcaggcattcccctgtgacaggatatgacagcacagtgaaaaagggccggttagcacgctcataaacaacactgaatctgaaagtccacaccagttggaagaattatcctttccaaagaagctacaaatgactgatagtttttccaatatattctgtaattttcagaggtatcttagcttgttattattttaaaattgtacataatttagaagaatgaaaattctgtttgttagagaaattagttgtgatttaggtaagcaaagcacaatcatgacttttttttaaacaatcgaagtcccagtgaacaatttttgtgatgctatgaaatgtgctcagaaggtgggcttatttgaaggtcatttttctaaatgataacttaaaaaaatagttgccactttgtatgatagtagttttgtacccacatgaagaaagcattaaaaattctctgttctctttctcttcttggtaggttgtgttcttatctaccatactggtttgagattactgtagaagtatgtttctaattgctacattgtgacaattacttaaacatatctactatttaagaagaaccagcctggcaaggtggctatttcttctaataccagcactttgggaagccaagaagggaggattgcttgagcccaggagttggagaccagcctggggaagatagtgagactccatctctacaaaaaaataaaaaagataagccactcatggtggcacatgcctgtggttcccagctacttgggaggccaaggtgggagaattgcttgaacctgggaggttgaggctgctgtgggtcgtgatatttctaccaccttctagcctgggtaacagagcaagagcctgcctcaaaaaaataaaaaataaa

SEQ ID NO: 98350 - DNA, 1034 bp, Homo sapiens
gctgagctgagtagttgtagtggagcccgcatggcccacaaaacctaaaatatctactccctggcctttatagaaaacccttgctgacctttgctttatactcttccttggtgattacattttatgacattccaactgtttagggcataattgtggaatttttataggatctgtctcctcaagttacttgccttttggtttgttctgtattaattaacatatcaatcagatcctgaataatgtgaataaaaagagttcaccgtccgggaggcggagcttgcagtgagccgagatcgcactactgcactccagcctgggcgacagggcgagactcagtctcaaaaagaaaaaaaaaaaaaaaaagagttcaccgttggattgtctgtgtcttgtcttttttttttttttttttttttctgcagattggggagtaatttattcctggatactgtgtgaaactcgatgataacctgtttttgtttctgtactaaccatggactgcagctatttctggtttgcatgcccctcacgttcatttattgagccgattgtttttaaacctccaagtgtcttagatgcagaaatcactctattttctttcctttgtagtggtttgttgtcttctgattatgtggagattcactacgaaaatgggaaaccacagtactctaaggtacggttaccggcgtcggcaagtactctagtataagtgtgcttatcatagagttgatcagtgcacactgcgttgttttgacgtctgtctcagtaaaatcacctgtgctcttttacaatgatactatttttagtgaggagaaatttattaaaatatacaaatgtttgaggtaacgttaggtattcaggacaaaaaatgtttattgttttgattatacatgcagtaccttttgtgatagtataaagagctatacagttccatatcagcacctgaaagtagttagtaaagaaggatgaggctcatggccatcgaatctggattagaagactggatgggctgttagaacggttctttagtgcaa

SEQ ID NO: 98351 - DNA, 1152 bp, Homo sapiens
gtatgtaagaaacagtgacctccgtcagtcagggtgaagatccccagaatggctacagaaagaaactctgacttctagggaatcaacaagtgccactgaacctgagcagtgtcccagttactggggacaccagaaaggaaacaaagtggggaaacctcactggatttttgtttgtctttttcctagattgctaacacatgtcagcataaaagtagcacctttcccgtatgtggacttgtgccatataggtaactgggattttcaatctgatggcttctcagcaaatgtttataggtgtccttcattataaatactgctcaggaggccctggcatgtctcaggatttataacatttcaatttgtaattggacgtgttttccagcctttgagttttgtgccacagattaagaactttcatgtatcattcttattagttgtcagttcttgccttaggttgcatttgggggttgttgagtctccctaaaagttagtgctgtggaaagtgagcagaaaagctaaatcaagcgcgggaacaagcttcctggcatttgtacaaactgaagcttctgtcagctgtgccagggccctgagcactgcagatgctgaatcatgagcctggagtagacaagattgcagggaactttatagactcagcaaacgagccacatttgcaggacacagaaacctgatccagacttctcactaaggcacttagttactttttttttttttttaaagaaacagaatagctaattggcctccagaggtcatttgaggtcccaaaaggagaccttatcattaataagacactccaaatctgatatcagttgtaactaaaacttaaaaggtatttcaactctagcaaaagaaattgtgttcactgcagtttgtttttgtgttcactgcttttctctctttcatgacccattttcttcaaacagctcatatacccaaacttacgtgcttcatagataatgaactaacagtctgttttttatgtgtctgtatttatgtacatcagaaaaacccaagatgatatggtgcacactattttatatcaagattttttaaatgtagcaaaattttaaatattttagcatatattaagtaatcttctaaacctttaatttttaaaaatttcataatattatt

SEQ ID NO: 98352 - DNA, 1055 bp, Homo sapiens
agagggttgtctaggttttcccatttcaccactaacaagcccctctctcattcttacttctcactaagaaaagattaatgtcttggcttttacttttattgcatggacatgggttaaaagtgcttctttccatgtgaagcaaatataggagctcgagaggtccaaaagaagcgtgtaatatgaatgctaggtatcagtccaagaataaggaagaacttttgttctgcacttgatggagcaatagcttttgtttaagttcctaccagtgctttgcacataatatataataaaactattttgttgatttttttacaactttaaaaagtaatttatttacttttcttatttaaacaaatttattgggatataacttatgtatcataaagcatataattgtttttagtatatctacagaattgtgcatccatcaacataatctaattttagaatattttcatcactgcataaagaaaccacaccacctgttaacagttgctccccagtctctcttttaccaaccataggtaaccactaatctattaatactttctatctcaatagatttgcctattctggacataaatgaaataatataataggtgggcctttgtgactagtttcctttttcgtccctagttttaatgagatataattgaaaaatagaaattacatatatttaaggtatgtaacttaaattgtatatataggaattgtatgtattattcaaaacatcaggttgatatgttggtacattgtgaaatggtcaccacactcaagctaatgaacacacccatcacctcacatagttatcttttttttttttgtagtgagaacatttaagatccaccctcttagcatgtttcaagtactatatatttgttgaccaactttgctgatgagcctatttaaataagttaatttttagcatttcagttcttataaaataataagcatcaacaaaacactatgaaagtacttttcaaaattaacatatttctattaagtcttttttggtgagctgctaatacatatttgtaagtgcttactaatacttt

SEQ ID NO: 98353 - DNA, 1026 bp, Homo sapiens
tcatattgtatgatgggaatttgctaagagagtagattttaggtggtcacgccacacgcttaaaacgtaactgtgaggtagaaataagacatgttaatttgattgactatagtaataatttcactatgtatatcaaaatatcatgttgtatattttagatatacacaacttttttttttgagacagtgtctcactctgttgttcaggctggagtgcagtggtgcaatcttagctcactgcaacctctatttcctgggttcaagagattctcctgtctcagcctcccgagtagctgggattacaggcacgtgccaccacgcttggctaattttcgtatttttagtagagacggggtgtcaccgtgttggccaggctggtctcgaactcctgacctcaagtgatccacccacctcagcctcccaaagtgctgggattacaggcatgagccactgtgcctggcctgatatatacaacttttagaaaacaaaaaagcagaaaaaatattgatttaccttgtactgtgacctttttgaggtcatagttcctgttctaggtactagatatgtatcagtgaaccaaacagataaagatccctgcccttatgggtcctgtgttctcttctcacctttattcttttctttatcagtataaccacatcacccttttagaatgttctttgtgctttccttatcaaatcatcatcacagctcagttcaagctcgcttctaagagtgaagggtttttggcagcaggagagcatggattgtgatcaggtggagtaggtctctgtgcgcgtggctcctggctgggaggtagggttgatgcagagtggaagagattggaggagtgcgtgttctgaagaccctgtccagtgtatgagtaagggagggtgggccctgcagaagtcagtcagagtctggccgaggtgctgtattggagtcagggtattttcagacacacgggtctgcctgtcttcccttttctgagtgtttccccacctctttctgcttcctttcctttattttt

SEQ ID NO: 98354 - DNA, 1050 bp, Homo sapiens
ttgatggcagttcagaatttataagcgtaaagataccactgtttgcttcttcagaaccagatggttttagattattctcatatataaagaatctgttttcttacagatgatattgaatttgcataattagaaatttgtatagttgtacatggttctggaataattactttagagactgccactgagtgaatagtcctatctcagagtaattttctaatctgtctgttgaatttcaaacatcagttatatcaggtataatttgcatgcatttgatgtatacttttataatttttatagcctccatgctgcctaatagagtgctggggccacactgggactccatgcagatatgtgaattaaacttgtgacagtgtaaagggatttgttcagttatactctttattttgaagacacaataatgaagctcacttgctatttcttgccatttcctgtgtttgtttattccctcctttgtgtggtttcttttgtgctagtggcatgtttgaagatgataccttcgtgtatatgatagagccactagagctggttcatgatgaggtgagtctatgccatcagttgcctgatggcgttctactcctccagcaactttgtctttgagaagaaaagagaaaagagtgtagatttcaaagtgcctttgtacatgttaacttatttcaaacttagagtagtaccctgagttttgaagttttaagttgcacatgccaggcccatgtacccgtaaaggatagtaaaagacatcaaacataggttttctgaagcaaatcctagtccttcccagtctatgaaaagagcagagaggatattttgttttgtattagccagcctccttactttaaactagctttcatagaagtcattatatgaaaaagatacttgcacacacacatttatagcagcacaatttgcaattgcagaaatatggaaccagcctaaatgtccatcaatcagcaagtagataagtaaaatgtgatacacacacacacacacacacgcacacgcaccatggaatactactcagccataaaaagg

SEQ ID NO: 98355 - DNA, 1050 bp, Homo sapiens
aaattgggctgggcgtggtagctcacgcctataatcctagcactttgggaggctgaggtgcgcagatcacgaggtcaggagtttgagaccagcccagccaatatggtgaaaccctgtctccactaaaaatacaaaaattagctgggcgtggtgacgggagcctgtaatcccagctagtggggaggctgaggcagaagaatcgcttgaacctgggaggcagaggttacagcgagccaagattgcacctttgcactccagcctgggcgacagagcgagactccatctcaataaataaattaattaattaattaattttgaaacagctaacagttagataggctactgataataaaagctgaacagacaaacttttattgtcttggttatggcgatgtatgtatgaatatggggtaaatttcaaagttgatgcagaaaagttttaaagggttggtgtttgaataaacctctgtcattttcaactagtaactataaaaattatcaggtaatgaagacagcccacttagataaagacattttgattaagtaaaatgttatttatctcactccagtaaggaaagataatctgtgtacagcaaaattattcgactcattcagcaaaaactctgactttgatttctggctttgattaatggccctggtaccctaacaaaatccacaaagaacaaaacacagattcccaaataataactatttaagccttagagttttttaaatgtataaaatgagataatttttaatgcattcatagtagggcaattttgtagatttgatgaattaataaatgtaggtgacaatgtctattaaactgtcataaggatttataaatataaactattgttataatgtttaaagcattggttttgcattgtttacttgtgatcatattattcagggcctgattgttacatgcaaattgccttctctttgccttccttcctgttgcctaccttttggttatgtaatgatttgtcctcatccacactatgggtagaggaaaggaatagtgctttaaactttagtcgatttttt

SEQ ID NO: 98356 - DNA, 1050 bp, Homo sapiens
ttctctctcaaactatgctaccaatttcctcttgccagcaaggtgtgagagtgcttttggccttacaatggtaattaactatggatatcgtaatttttaaaacttcatcagttttatggcaaaagttggtgcttcattaaaaaaaatgcatgttgaaggaatatgaaagcattcggcatgtttttacatgtttattgactttttgtgtttcttgtgaatttcccatttatagctttaaagaaagctaagatttaagagtaaccagtaacactatgtttttatctaaactggggcaattagatgatactcttttatttaaaattaagatttcaataagacatacttttcacttttgatagctaaaaaactgacatataaatattcccattttaggaaggacattagagaaagttccaacactgtttcatagaggcttgttcacatcttgctttctaaattgcctacaattgttttgtttcagaaaagcacaggtcgaccacatataatccagaaaaccttggcaggacagtattctaagcaaatgaagaatctcagtaagttttaactaaaaatagcgattatattttatgtagtatgagcttttatctggtggagctcagtagatatgcaggcttgttggaagtggaattggtctgatatcaggggtgaacatcgtggatcagcactggaatgagtggtggctcttgtgtaaagaggcatggagagtcatttccagtgcagactaaaacatgaagactttgagtaaagctgccttgggaaccagaaagtgtggtcaaatttagtacagtgatttacagtgaggttcatcctgaaatcttcctggcagtttgctgctcttgagccagcttggattgcctccctctcatgctctgctccagacacatcttaagtgtgctaatgttggaagaagcttctttttgattgttggggcatgtgattttatttctgtatattactgctaaaagtctttaataatttatgcaaaagctaatgccatacattattttgaatgctaaaatgaattagaca

SEQ ID NO: 98357 - DNA, 1082 bp, Homo sapiens
attgaaattgctttggaattatctttaagtctttgttttactttaaggaaaccaaaattagattagtacatggtatgataaggttgtgcttcatgctaaaatgatgtgaaattctaattagctggccctactcagagaatgccttgaaactagaaatttaaaaaaatagtgacttaatttatatttaaacttttaagtttctactttaatggatgttttccattaactatcagtttaattgtgttgaatatcaatagaatacctcttacttttgtatacacatttattttctgttccagttgcctttaaatatattgcttgagatgttagtaagaagcaaaatttatcagaacacatataatttaagagaggtcctttttggtggaaaggaaagccagatgtgtaggcagtcattttagacagtaaaggctaaaatatgagtttctgaaggactttaatttgcttgaaaccccaagatagtttttttatctgaattatttttgttgattggaacattgagattttttttcccagctgattctcaatcttgagcattgtggcatgttgtgaaattatggcttttgaagcctaagcttttttcaacatccattatataaatacttttagagtagtagaaataataattaagatatattcaatgtctttgaatgcacaaagtgcattctcaaatagctgttaatctatagaatctgttctcaaacctttacttgcaattccaaatctcttgttctaccataatatatcaggaaagtacatgaagctatcaatcaaaagagcaaatctcagtaactgtgcaaaataggaaacagttactactaagtgttaattacaattaaacagttatagttttttggtaattgttaaaacagcatattttttgaatttattttttaacccttctcaatggtaaacatttaaataaccttattcttatgaataataaaatagcatacttcttaaaatattattttatatgtagaaaatttctacacaccatgtcacatgttctgtgatagagttccttatttaggctatcaaatcttttaagggtaaattttaat

SEQ ID NO: 98358 - DNA, 2069 bp, Homo sapiens
ttgggaggctgagacaggagaattgattgaacccgggaggtggaggttgcactgagccaagattgcaccactgcactccagcctgggcgacagagtgagactccgtctcaaaaaagaggaaagcttttatttttgagtggtaataatgcctaaaatagaaattgcctaagatttctactatttaaagaaatagtacttcttggctaatagaactaaatatattccttttgctttaagacagagttacattctaatccataatagtcccaaatacgtatgacattttataagaattttttttttgagagctgaaaaaaattttttgaggtatgctttctatgagatgaaggttgtttttaaatttgattgccacttcagtagtatatcagaacttactggatcaaagtacttaaattcacatgttgaaagtcaaactgaactagaataattaatacatttatttctgaatatgtggggatttgctgctgggctttaggataatcatctcactgagagtactcatcttacaatctttatactatacgatccagaatagttattttgataattctcaccttcgggttgaaaaaccaaattctaatcttattttttttcaaaagacagttttcttaaggattgcatgtgttcaggaaggaaaagcaaccattttaaataaagattgttttaaactgatcagaaatgtgaaagtaagttttgttataaatggtgattgcatatttttctttatatgcaaaattagttctaattcatgcaggaaatagaaacattctgcctacatttgcattcaagcttatccctttaattcagagtgatttaacgttggctgcctgaaaaaaatgcagatatcttattttcaataggtatcacattatcagtggctttccattagaaaagaaaaatccctcaatttggtaaaaagtatcttagtacctggctggtggaacctcatttgcaagccaattatagccttgataagagtctgcaaacatgtctttgagctgcttaagttaaaaataaatattaaaaatcttattctaatagaaaattggttgagattttttaaagtgcataaagtgcatgaaaagcaaatgttttgcgtacgtgttttgctacatacttaactatgcgtcaataaatgtaaatatgtgaggataatttaaatatttttcaatttaaacctcacttggttttccttacttaaaaaccactacattttatatacacctaacaaattttgagttttcattaataatcatgatttgttaggaatatatataaactatttaataggaattgttaactgaaccagcttacctcctccctcaacctagagactagaaggatttaaattctagctgtgtgatcttgagtaagttatttggggataataaaacccacctcatagagttgtgaggagcaaatatttgttttaggcgaaacacttacagtttctactaaaccctaggtgtccaattaaatggcacttcaagttaacaaatctagtggtcattgttctgtccttgtcttactctctcagcaatattggacacagttgattaccctctttttttgaaaattttatttcatctcttggcttctatgacgtggtagctctctcacctcactggctatttcttcctagtctttaaaatctgacctctggaattatgtgagtgccgcagggcttggttcagggctcttttctctttgtatactctctacctaagtaacaacttgcagcctcaagtctttaagtgggatcatgactttaaactcgttattccctacttttagctctagccccttaagttctgtgctcatatacagaactgcctatttgatatctctattttagtgttgatttgaatagaacttctgaatcagaactcttagttccctagtcctaaacttctcttcttctagtctctcttattattttaagtggcaccacaatcccccatccattcaagttcaaaacctaggagttatcttttaattcttctctttcctcaccttccacatcctatacatcatccagtcgtgggagc

SEQ ID NO: 98359 - DNA, 1046 bp, Homo sapiens
aatgagactttttaaagaaacaactgggcttttcttaaatatatggtggtaacagagaagaaaaaatggattgaagcagagtatgtttggagaatataggtaataccaaaaaaaatttttttaaggacacaaatatattttcttagtgttcccattggtgtgatatttcatacttgatttctagatgatggaaataagtgcagtccccaaataaaactaatttggaagaataaaatatgtatctccttacaaagacttctaactgtacaaatcttcaatattgatatgttttcctcacttattttgtgaattacagaaaatgcttaagattttctgcctttttcctgccttaggttagaactctatagatatgaacattatatattatgttccaatgaatatttaagttgactagtcagaaattaaatatagaatattactccatatgttgtaatgtaaagtgctattttgcttagctaaatatatttttatcgggtattttattgtgtgttccttcttaaatgcgaaaaaaaccccaccattttttataagttgccaaatatctaaatgatacttatttactccaaagagctgccttcttttctgccttttaagcagtccacaaacctccaatcatgtaaatattcataacatatgtatgttatgtacctggtgggcacagctgcacaaaactataacatgagtggatgtgcgtcgagtatctcatatagagttaggatagcatctcagtgccaatttacacctggtttattaattttctttaatttcagctcttgtttatcttctcagaggaaaaccacaagtgaatgtggaaaagagaatcttaaccacatcttttcctctgcaaaagctgtttacttggtagcatctctgaattagtcatttcaacatgattgaatagagttacatcatgcaaagtgtaatttttattttgggttaccacataaggttctgaagctgaccactaatttttaaaagacattacatttaacttgtttttgttgtaaagtcattatataatagct

SEQ ID NO: 98360 - DNA, 1870 bp, Homo sapiens
tcagatttacaaggagcagctcaacaccagggttgtcctggtggctgtagagacctggactgagaaggatcagattgacatcaccaccaaccctgtgcagatgctccatgagttctcaaaataccggcagcgcattaagcagcatgctgatgctgtgcacctcatctcgtacgtactcatttcagcctttagtgtagtctttggtctgacatttatccttatcccttttttggttcagttaagttaaatatcagaaaatagtgacttgaacaagatttctgtgggttcctttgtctgttagataagaagcatggagttaggatatcccatgctgggatgctgatggttctgtagtcacaatatctacctttagagcccataacttccatcctcaagatcaactcacaatctaggatgcctgctggccctccagccttcattactggcagcgggcatgacatgtggggagaagggcaaaagggtactccttccagccgagctgactgctgtaaagcaggtttcctgaaagcttgcacatgtatgtttcatgaacaaatcatttgctaggtgttagtcacatgggccacacctagctacaagagaggctagcaaaatgtagtccttttagatgaactattcagttgagtttctactactaaggaaaaagggttctatactttctttttaatataataagctattctcttccccagtcatggcaaagctattttcagatagtcctctaaggttctgtcctggaatcaaaccaaccaaaccactccttcttttcctcccaccattaccgttgacttcctgttttttcagtctttaatcagcaatttttaataatcagcaatattaattctttttaatcactgctagatattctctactagaaaaaagtcaagagctgtgtctgtttatcttggtgttttcaattcctgtgctagtacatgatgcttagtaggtacttggtgcttgctcaattgaaattacgtaacataacaaatttaaaggtaattatgtcataaattttaaggtagttgaaataaagtttttgatttcttggaggaggatggtttgggggtgttccatgtaggagggtagacatattttgggagagtatgaaatgatggtccaccacgttggttttctgatagcactgctttttcttaaggcgggtgacatttcactataagagaagcagtctgagttactttggaggtgtctgttctcgcacaagaggagttggtgtgaatgaggtaaattttaccaattagagtttcatctttgcatctgttctcttttttccctatggcccagtttacatcctttctcgtgcttgtttagaatgatgacatggcaaatgtagcatgagtggcttatgttattaataaatagaacccaacgtggtccttttggttcatagtgacatattttggtgtcataatgacaatttttcgtatatatcaggcaaatgcagctgaagattggcctggagacttttaggcctctatagataagatgttaagcttttataagcttattaatccttctctgactttttttttgttataatgctcctctgtctatgttaaatttaactcattaaaatcaaaggatttctgatatcagtactgtatgtttttttctccctatgtatatattttcattttcatgccttctacctacctatctgtagaatgaactcaaacacctatttccttaatctcattgttcagattttaatactttcagttttataaaggaaattcttaattggtaacagcacccaaaaagcataaccaattatatctaaactcttgtcaatactgaaatatattataccaggttatctcaatagcctaca

SEQ ID NO: 98361 - DNA, 2331 bp, Homo sapiens
ctcatgatctgcccacctcggcctcccatagtgctgggattacaggtgtgagccactgcgcccggcctaaaattctttatttctttgtgacttgtttgtttaggtagctatttcattggttctaaactttgagtttaaaaaatccatttggaagtctatctttgcatatacctctctctctctatataggtatatatagatagatgtatacctctctctatatatatacgttgatatatattgctctctctatcgatatatcgatagagagagaggcatagaaaagagaaacaggaaaaaattaatgaagagaagagcccatcacaatatcaatatgtcagtttctggtatcgaagttaagttgtaattgtttttaagtgattatgtacacttctgttttagattgctctctttcactaaaccttttagcatagtgttcattcaagtctcttgctcatcctcacttcaactctaacaaattgaattctcttctctaacttcgagcattctctgttagaaaacttcagtgatgatatgttgtgtttgtgcaacagagctttaaaattcacagcacataggtacaccgtctagtgtgaaccccacaaccactctgggagatagacaaaaaggtgttattcccatttagaggtagaaacactgagacccaggaaatgctaagttacttgcctatgggactctctcatatgacagatcttggactagaactcaggctgtctgatttgtagaccagggtacttttcactaaacattagaactaggaaccaaattgagttgtcagagttacaaaaataatgaagagaggcacaatattacttcttgccagctgttttcttaggaattaacctataattctggaaaggataaggaactattgatttaaaagaaattttgttctgtaagacttcacattccgtgtctatttgactgacatggaattggtaataaagaattattgtaggagttgtaataccaaaaaaatatgtgactttctttgtttcctttttcttctgttgcttttattgttttattggaccagaatgtgactgcacagaatcctggggtggctgcatcatggaggaaacagggtaaattttcattatgcgtgcatttgatatatgccttttgctaaaattgctgtgtagagttagaaacaaggtctctcgggtattggtcttttaggctaagcacaatataaaatgaataattaattgtctgatatttttaaactgaaagatctaatttactttgtattttaattttttatttaaggttggtgataaaagtaaaatgtattaccttctacttcttattaacccttaaaggaagcacatgattaaaggcttctaagtttagtggaggcattaattttttagtacacttagattaaaagttggttatctacctgaagcagtcagtgaaaatcaatttagtcatcaatttacattttaaggaactcgtaaatatatatgtttacggtaataaaaattaaactttactgtttataaatcaataaagctttttaaaaattaagacagacttattgtatctaaatcaggtagtcttctagtgatagacatttgaacattccctcacttttcttttgtgaatactttgggaactagagcagcttccccagagctgctgttgcttcagtgaaccaaggcctggaaatattgccctctttcacagggacccctgcctcatgggagccactgcccccagaccccctaagccataacccactcctagtagaggggagaggtttcctcacccatgtgcctcttttgctttctttgccatgccagacacctgctcaacacaccaaccatttctggtcctacctccgtccctctggttgccagaggccctgacctacttggacagagctcctttgttttcttccaccagccctcctaggagtccaactcctggggaggagtgtgggcatgaaggtttgcacagtaggccattatccctgctactttagaacgcatttctagaaatagagtttaaaacgtgaaacccttagcttccacggttccctattactccatagcttagtaatttatggcttaaccaggctttttgaggactactataagaagataacacctataatattggttctatagggagatgtcttctgtcttctaaattaatctctgaagtttttacaatgactcttcataatatatataacatataatatctttaatatattttatataataaaatatataaaatgttttaaataagataaaatgttttaaagttaacatgtattttctcaagaatacatttctatatatt

SEQ ID NO: 98362 - DNA, 1110 bp, Homo sapiens
tccaatgtaaaatctagtacgttcatgagctccttttattcagaaaacagaggcaaaaaaaaaaaatgcttgactttaatgagatatagcaaataaaaattaacaaactttaaaatacagcctatttgaagaggttttgtaatgagctttttaaaaaacatttcaagcctggtcacaaaagggcttgactgctgaggaggttgtaatgtagcccccaaatctttgattttctttgaaattccatctctgcaaactccaccacaggtacttaagtggcaatttgaacataagtcccttgtcaaaatttgtgtagattcatttggattcaaagtgaacattttgttctaatttaggggttttaattttcttctctgatgattgcttttggtaaattatttacatagttgattctttgtttcctcagggtgtcccattctcgaaaattttcaaagtgcagcattttggagtatagagactttttacagagaggaggtggagcctgccttttcaacaggccaacaaaggttagtaacttagaaagcatactaagaaagtatattatttctccagtgttttacagtgcaacagtgctggatatcagacgcctgtcttggaaagcaggtttcttgtcaatcagattaatatttagttataaaagtccttatcatgttaaagattgagtcctgtttaaatgaatgacaaaaccatagattcagcattctcagtctctggtgtttcagtgctagctagaactcccaaatcctcccttccaaagagcaaacaatccttcaattaaaatatctttgagattttcatgttaagatttttaccctgctgctaagagatggtgggttaaattaagataaaatattattttaactaatttctctgataaaaattccatttctccttgacattctttctagggacaagtattagtccattttcacactgctataaagatactacctcagactgggtaatttatagacaaaagagttttaattgactcacatttccacatggctagggaggcctcaggaaacttataatcatggtagaaggtaaaggggaagcaggcatcttcttcacaaggtggcaggagagaga

SEQ ID NO: 98363 - DNA, 1033 bp, Homo sapiens
gtttccaggctacttgggtgggactccccctgtggaaaagtcctatgagcaaaatcagcattgcacatctctgtgttattttgatcaggaggcaggagaaactggaaaagggaagggctgactagaacatggcctgcactttataccaggctcccccttctttccttcttaggactctgcctccatcctgagacgggtcactatctccaacagtgtggaaaacatggcagtggggaagattcctaaagcacagaaaatatgcacacatataatgtaaaaataatacacacacaacacatgcatatacatacattcaaaacgcttgggggaaaaagtcacttctttgatacatacatataaactattccactggcatccatagttgtttattaaccattgtactacgtagtttaaaaagacataattccatatttactaactttttaaaaaatagatgatttatagttatttttatttcatttccaagttattagaataattttctcctaactcatagacaatttcagaaatccattgatggatctttatgcatatgctagaaaccttaacctttccaaacaagtgagagttgtttcctcaggcatgatgcttataattagctcctaagctacaaggtgggtaaaattagccatgtacattacaattcaaaaatgccagcagctcacattagttcattattacttatttcacccattttgaacactttgaagcttttggatttctgttgcattgaaatcaacgttatgaaaggcaggcaactgactttcacgacgcaaggtcactttgaaagtcctgtttcttttttccacagccatactaagattctacacagatgtcaggcatcaagccaccatctcctgactacgtagtgtcacttaattatgggtttaggaataaattatcctgttagttaccacattagttactgatttaaaaaaaaaggttaacattatttcgctgctctctcagtttgcaaagtattaaacattttgcatagcaatgagctatattt

SEQ ID NO: 98364 - DNA, 1042 bp, Homo sapiens
attcgtatgaatttattaaaatttgattgtctgtgtttagcaaaagaaagtttaatatctatgctaataggtaattcagtgaaggttgggtatatatgtgaattcttcagagagatcttaaatgtttatattatagtgttttgctattttgtcttaagccaaaccagaatttcttctttaggtgatttccgtcacattgttttctgaaaatagtactctgaaacagtgggttttgaaatctgaacatttaaagctttggttgatgattcatctttagtgtagagggtagcatctgggtcttgtttctattctgcaataggatattctgtcttgctaattcttaaaaagagtttggtgttagttatgcgagagtataggcattgtcggtgagtctaagaatgttataataactctgaaatattatgtaatgctaactcttaatattgaattttgatttgcagtttcagccacgagggtatgaatgccgggatgctgtgaacgagtgtgatattactgaatattgtactggagactctggtcaggtatggcgcactgagtttttggtaatacattttacttgtacaggttgagtattccttaccacagtgcttggggccagaagtgtttcagatttaagattttttggattttggaatatttgcatattcataatgagatatcttggggatgggactcaagtctgaccatgaaagtcatggatgtttcatatacactttatacacatcgcctgaaggtaattttatgtaatattttaagtaattttgtgcattaaacaaagtttctgtacattgaaccattgaaccctcagaaagcaaagatatcactatctcagccacccatgtggacaatcagtggttgtttggcatcaccatcattcctgactctgaatctgtatgctaccaataggcaattactttcttgtacttattcacacctaattacttaacagtaaaaaaaaaaaaattggacatgcattaagacattgaaaaaataatatgttcaccaagcagcacagtaacat

SEQ ID NO: 98365 - DNA, 1098 bp, Homo sapiens
tggaacctacattctgctgggtatagaaaggcaagtaaataaaaaatcagatggtggtaagtacaaagcataaaataaggcaaagtggaaagagtatagggtaggatgtgatagatagggtgatcaaatatttctttctggaggacatggcatggaagcagagacacaaataagaaggagcttgtcagtaaatagtgagtacagaagcttaacttctccatgaaatggaatgaaagcaaggatagctggagaatagtagaaacaaaaaggaagtcaagaatcagggcaggtagggacatgtaggccatggaaagaattttagatttcattctaccttcattttaattctgacattattttaaaagcatttccccatactgttacacagtttttatagttaattcttttcacgattgtatgagagtctgtcatgtggatttatcagttgatttatacccagtatgggtatttagattttggcagtttattattagtagtatagaagtgaacatctttgtgcatttttaaaagagtgtttcttgttcagggttagctcctcaggacaagctcctaaaaatggggttacctgttgctaggcattgtgctttccaagaggctcccaatagagtacacttggcagtcaaaatatcacttttattattgaaaatggccaagttgaaggctgtagcttaatgtgagggctaaaagttatctttaagatcccagttcaggctatagcaacaggttactgacaaaattgggtccagaaggacaatgtatggcacggggagcaatggaaaatgcatggtttatgtgggtaggcttgcttataaaagaatggcagaactgtggcggaatgcctagttcttcttcccaagcttatcattggtcagtcactccacctcccaatgatggaagtgagtaaggagtaggggagctggggttacactgagttccttaaccagaagaaaaaatgaggagagagaaagaagggttcctaagtaacatttttgtaaaggtgttgatatatattatttgaaattcaattcagatggaccctcttaaagaaatggtacagtgaaatatgttcaggccgtg

SEQ ID NO: 98366 - DNA, 2851 bp, Homo sapiens
taagtgctttggaaaagaaaaaaaaacaaagaaaaaaacttgtagacttctctaaaaataaataaataaataaaaagcccttaaagcccttatcctaaattggcacagccccagagagtgccagcattggaggggctgcagctttgaagagcataggttctataaaggcctctttgggatgatgatatttgagcaaagctctaacaaaggtgagggaatgagccatgccgaaatccagagcgacaacgggaaagcaaaggcaaaggctgtgggtggcagcatgactggtgtgtccacgtggactcacatcagccatgggtgaacagaaaatgatgtcacagagatgacggggtgagaaagtataggagcagatcatgttgagcttggaaggtcattgagtaagctgggaaacagaagatcgatgtgatttggtatttacctttttaaagagatcactctgatagcaatgtaaactctaaggtgactaggatagaagcaagggactcaggtgggaggctattacagtaatccaggtgagaggtggtggtggcttggacagggtgtgagcagtggaggtggagaaaaggggtcagattggaattatattttgaagatagaactagcaggatttatggacagactagatggaggaagagtgagagaggaggggaatagaagatgactatggcctttggcttgaacaattggaaggatggaacatcatttactgagaaggtgaagactgagggaggacctcagtgcacactgctgtttcttatttatttgccatgcctgcatatttttttctttttgtatttgttttaaactctgtagcagggcctttgacttgatctttttccattctcttaaatgtagtcaataaaatgtacagagagtaactttggggggaaatgaagtatttctttaaaaaatgatttgataaatagacctataaaaagaaataaccatcacatcacagactgttctagtaacatgtctgcagtttgaagaggtcagaactattaatataatggagatatagcacttactttgtgttgaaaggcagagtatttcttctgtttcactaaagtagcctataggtaaaatgtcatgatgtcaaatgcagatttgacattttcagagagctgagcaacttcttgtaaattagtttcttgaatgtgaccgttctatgtaccaagctgattcatttccttcattgtccattttaatctcttctacttttaactctgtaggcaagtgaatgtgacttgttattctggtccatctcaccataaacagaggaaacatataaaatgcatgcactgtgtggcccttacttacttattttaccaataataggataaataatttgaattaataacgtatttaaggagttgcatgtgtttttctcaatgtttctagttatatatatccaccatgcttgcattatatatagtatgtacattatctgaaggtacctagcatgctgaatattaactaaaaagataatattttgcagtgcccaccaaatcttcataagcaagacggatatgcatgcaatcaaaatcaggtatgctgggctataaattttaagtgtaatttaaaaaggattcattggaaagtttttttttccttttttgataaatattaatataactttgaagggaattttactcaagtaaattattatagtgggattctaatttagagttgcttcatgttatgccaaatattaaatatatttacctctggtgacaaattgtccagattaagagaaaaaaaaaaagaatgtaatggctgaagaactgggagtctcatttattgagttgtgaccatctttcagtaatttcagcctgcctggtgtgtgaaagaaaatatgacaatctgtcatgagttttttttcccctgaagccatattataacctacaggtgagtatcatgatgtcaaatgcagatttgatgtttcctaaccatccatacacaaaagaagctaaaaatcattttggtgtctctcacagaaatgtaccaatttttgtttgctgtaaaatttcaaattgtagatgtttagtttacatttagagagctgtacaatgagttctgtttagagttttaaagttttaactcttattcttgagatatttgtgatccttactggtcactataaaaatattagggtatgaaatgaaaaaactttatccaagtgaaccagaaggagacattgtagtaaaaacattggggaagacaaactgactctgtgtgcctcacatgtgtgctcctgtccccagggccgctgctacaatggcgagtgcaagaccagagacaaccagtgtcagtacatctggggaacaagtaggtcgcacctccttgcttggcggttacacataccattttctcttaatagtgttcttctctgccagtcttgctgagagagatgcacagcttggagtgatgttttaaaaaaatctagaaaggatgagaataaagagaactgtgaatcttagtcacaaaaactatagaaaacaactgcttaagttgggtacttgtcagaactgagcagtgccatttaatggctgtggctctcagagaaggggtgttgcattcatttgcaaagattgggttgagtacagtgtgattatccagccacttgtgtgatttattttgtaccttggttttaacatttgaccccctttttttccattaacacacacacaagttagctttctggtttttaccgcaggaaaataccagacttattttttaaattttgtcatttactgtctcacttcaaagtgaagagatgcatgtacttcctgagatgcagataggtacatggctgtgattcttagtacat

SEQ ID NO: 98367 - DNA, 1128 bp, Homo sapiens
ggtaggaagtaaggataggagcaaaaggtcttctccctgtcagtctctaaccttttatccagaaaacaaaatcctcccagccactccctagccagcttctcctcacatcttcacagcccaggggccacttttaactctaggaagacgagaagggggaatggataggaaagtgggcgtcgagaatgggagtaccaagaatagatgagacagcagtcatgatccacctttcagggctgggcactttgctgttccaaacaaaactgtgatcctcttagcaaagaaggaggaggttatcacctaccaatgatatatgatcaaatgtttttgtttagaaagaaagataatattttaaaaatttgaatcaatgtggaccgaatcgttttgattttttgagcttgattcctcctgtctggtctgtttgttttctttacacatgttcagtgatgtgttctgtggattcttactctgtaccaatcttactcgagctccacgtattggtcaacttcagggtgagatcattccaacttccttctaccatcaaggccgggtgattgactgcaggtaacatattaaatattagaagacctaataagccatgagaattacaaatttcacaaaatgaaatttcaaaaaaatcagaaatcaaagatttttctagtttttacaagaggaaagttaatttagattttattatcacctttcatattgacagtcacttaaaaagaaacaaagttgtatattgacttgcagcttacatttgctcaaaattatactagttagtagtaatatggccttctttgtcatcataattttaggagtagaattatggtgttcattctaacccattattaaagttttaagcattagagtatgccactattttgaacactgtgtgtgtatttattttgtgactgaaaagaaaaagaatttaagctatagtttatgaagtgtatgtctggtttggaagatggcttaacaaatacctaatcatatatagaaaatatttattaaaatagtatgtataccgataagcaaacatttgatatccagttgtctgtgagtacaaggcatgtagatatgaggcttatttttgtttagtcggggagtcatattatattccaaataggt

SEQ ID NO: 98368 - DNA, 1022 bp, Homo sapiens
gtttatgtttttcaattatggataatcagatcttctgaagtaagaataataattttcaaaatatttttcatttgctgtttttgttcatcgtctgcttttttctaccatgctacatctgaaagccttggagagctaatgatatatttgcttcttttgttctcatatagatacttctctcctttagtcttaatgttgggtcttgaaaacacgtgaagatttagaatatactttgtgcaaatgacatttttcttgttgatgtgtactgtaataatgataatgaaagagtgtttctttttcatgctcttttattaaggaaaggtagggaaaggggaagaagaagaggagtaagaaaatgctaggagaaatccacatccactgacagcctcttcggttttgtgaagagcaagcctcattcatggaatgatgttctaagtgtggtgcaaatagttatatgggtatctttcttgttttagtggtgcccatgtagttttagatgatgatacggatgtgggctatgtagaagatggaacgccatgtggcccgtctatgatgtgtttagatcggaagtgcctacaaattcaagccctaaatatgagcagctgtccactcgattccaagggtaaagtctgttcgggccatggggtaagtaggtatcaatgtgacagctggaaccttcatggtctggcatggtcacagtgactggactttaatttcagccattctcctagccaacatggtgaaacaccatctctactaaaaatgcaaaaaatagctgggcgtggtggtgggcacctgtagtcccagctactcaggaggcttttgcagaagaatcgcttgaacccaggaggcagaggttgcagtgagccgagattgagccactgcactccagcctggcgacagagcgagactccatctcaacaacaacaacaacaaaaaaggccaaattcagccttgttaatcacaatcatggtattagaatatttcagattaaaaagcttccttgtttgattttatcatctctg

SEQ ID NO: 98369 - DNA, 1569 bp, Homo sapiens
cagttacttctgaacaaagtagaaaaaagtatcttatcagacatttgtatacttatgtaatatcatgattcaatttaatttaagaataacatgaataattcaatttaagaataataataaataataagataaataattgaagaatttcttccttttactctttttctttaattaatgggaaaaaatgttacacaatttgatctatgcattattaccttgtgtctagtgatcaagaccatgggaaactttaaaaagaaattccaaatagcttttaaagcttcctccctgcccccgtgtctcttttacatttatcactattattctacaaaatacagtgaaaatgccatatctgttcctttttcttcacaggtgtgtagtaatgaagccacctgcatttgtgatttcacctgggcagggacagattgcagtatccgggatccagttaggaaccttcacccccccaaggatgaaggacccaagggtttgtgtgattttggtttcaattcatggaatactgaattcgttgacactgttccaatgcaccagtataacattctaattgacttaagaggagacacataagaatatctgtttttgcctttaaagtatataatttatgttactgccaaattaaggattctgatatatcatatttttaaaatgtgtttgaattacttcttagtctagaactgagattgggaagaagtaaatatacacattttctttaatacagtattctttttctctttaaaccttattctctttctgtagtcacaaattattttgcagttcgtctaagctatgccatttttctaatagatcaaatctttttggctgacatgaggctctggttacttttcaatgttggaatctctccggaaggaagttgtcaccttacaagctctttttgaacattcttttgactaggaaggagttggaattcttcatagaactttcattcttcaaagaaaatgtgagagatctggacctttgttttaatcagtcattaagaggagagaaattagaattttgggattagaaagagactcaggggccacctaggaccactctctattttcgcagatgagaaggcccagaccctgaggtcaggtcacttactatagtcacccaggtagtgagagacaaggccaggatcaggacctaagtcctaagtgcctgatctcagactcttgttctcttcccatccattatatcatcttttttttttttttttttttttttttgagacaggatcttgctctgtcacccaggtaagagtgtagtggcacaatcatggctcactgaagcctcaaactgcaaggcccaagaatcctgccaccatgcctggctaattttttattttttgtagagacaaggtgtcactatgttgtccaggctggtcttgaactcctggcctcaagtgatcctcccgccttggcctctcaaagttctgggattataggtgtgaaccactgcacccgcccctcttacatcatctttttttttttttttttttgagacagagtccgactctgtcgaccaggctggagtgcagcggtgtgatcttgg

SEQ ID NO: 98370 - DNA, 1522 bp, Homo sapiens
atcttataatgtagtctgtgttatcaggagtatggtaatcatttttcattattctcccgattctcaacccctcatacaattttcaaagatctagaaaacccatcagtcacaaacaggcctactacagcatctgttacattgtacctaagaaaccaaggaaatactagaaccagtttttatatacagggatgacgttgtacatcagcttctttatcatggtactgctaacagtttttttgtaactgccgtgcttttctctgacaggtaggaaaatgcatataggattagtaccatttagatcagcttagttttggatgaaagtttattgaaactctctgaacttcagtatagtttatatgggaaaagatgatttcagatgcagatgaagctctgtagtcctcaattcctgaagagatttaggctgattcaggcgcatgtgaattgttcagtaatagtgggtgtgttaaaacacattttatgcatttgcttaatatgcccatgatattaaaattctgtaagaatcataatcacaccctcacagtctatttctgttctccttcttctatttctaaaagggaacgtattccacttttacacttagtcttttgttactttaaaactagaacaaaaaattcttggatccaccttctgaagttagatttagagaagatttaagctctaacaagagaagccaaggttcattctttccaaattttctctccacagtgtttctgtgattttttttttaagatctagatgctatttcctcaagtgatgtataaagatgcctcaacggatgagcagagctaaatttacttagactctgcctttttttctttaagtagagtagggggttattaattgtctggttctgtaatatctattccctgttccttcacccacccatgcctaaaaatctttggaggcattaagtaaagaaagtcacattctagagaaagagtactcacagctgccttttgttttgttttgctttactctctccatttaatgtggtagtatcccacactacctttaaaaaaaaataacttttttgatccttcaagtaatacatacttattgtagaaaaatttgaaaatacggaaaatattaaaactcagaggtgctcaagataagccttattgggcctggctcagtggttcgcgcctgtaatcccaagactttgggaggccgagggcaggtggatcatctgaggtcaggagttcgagaccagcctggccaacatggtgaaaccccatccctactaaaaatacaaaaattagccagacacgatggcacatgcctataatcccagctacttgggaggctgaggcacgagaattgcttgaacccaggagacagaggttgcagtgagccaagatcgtgccactgtactccagcctgggtgatagagtgagacactgagccccctactcatcccccaaaaaagaggccaggcacggtggcttacacctgttatcccagcactttgggaggcccaggcaggcggatcacctggggtcag

SEQ ID NO: 98371 - DNA, 5058 bp, Homo sapiens
tgtattgaaatatggagctacataccaatattatacactagtatataaagagtttatttagtatttacttttcttgtcttgaatggtagtggaataataaatccctgaagaaagcactttggtccatggaatacaaatgatgactttgatgcctcctgcctgtgaagtatcaaaagatacaggattttaaccccctttggaatcacttgggggaaataatgcatcttcttatttgagaaactctctaaaaataaggaaaaaaacccactcaatttcaaaacagcacattttcaaaatgtctgaagcatgacatgtctataaaggaattctacatataaaatagaaaatcttaagaaaaggagaaaatttatagtttttgatattttatacttaccaaaaattctgtcttttagcacaagtaaacctaggtagcagggaccaagactgaaaataataataaaccaacaagtaatggaaataagcaagtaaacaaaaatgaaaacattctgctaggtaataaacagattccacaaacacattatactgaaaagtaagtgtatcaaagagttagggagcaaagttaagttcctaataaaaggattgtgttgtcagctagaagctttaagcgttccatctccaggtttggtaggatgagaaggaaaataagatatatcatcgtgtgtccagcatagttccttgaacaaaaaaaaaggtatttagtaggtaatgaatgaattaatgaataaattacagaatagataaattagtgtagaagtagaatttttttcaatgagatgataaattctttgtagctatgaaaagcagctgcaacctttgttttcaaatatgtcccctataaaaatccacccacccgtgagctactcagttaatttatgtcaaggtgatgcacaagttcctacttgccaaaacaaagttcagcactctctaaaggaagagaacaaaagcaaagcagaatcgacaaaaagaaaatcttcacatctttaagagacaaccatgttcagtacaatgacaaagaatcaaatggcactttacatgtatttgcaggatactgtgtcactcaaagtaatgggagggagagagaacagggagggtagggatgcttttgaaaaagctttttttcccacttttaacttgctttagcgttaagagtacttaccagctaataatgtggaggaaattattctttctcattggagattacagaatatatctattcatcttgaatacccacttgaagcctctgtagaaatgtctcgtcctccggttgtatttctaaaacctacatgattttgtcttgtttctgcagtgagaaattacatccatagcaaagacaaaagtctttttaaattatttttatttatctttcatatagttcttacaatttctaaaaaattaacactcatttagtatcacaatttatgggagagggttttttgtatttttaagcatatgtggcttatataaaaattgcagaagtcataggactgtcatgtattgcagctctgagaaccaatgcctgaaacttaagccaaaaaaaaaaaaaaaaagttatgaccaggcacggtggcctcatgcctgtaatcccagcactttgggaggccgaggcaggcagaccacgaggtcaggagttcgagaccagcctggccaatatggtgaaaccctgtctctaactaaaaatacaaaaattagccgggtgtggtggtgcgcacctgtagtcccagctacttgggagggtgaggcagaagaattgcttgaacccgggaggcagaggttgcagtgagctgagatcatgccactgcactccagcctgggcgacagagcgagactccatctcaaaaaaaagaaaaaagaaaaaaaagttataaaataatgtatatcagttaatttagtattctgaaagcaagggttttctaaggtctttttaaaaatgaggcttcatattttgaatacctttcagtcccagtgtttgcctccataacttgaaaatcggagtagttcaggtggttttgagttctaatgtattgtcatagtggggaaacattgctgccaccttctgtgttggtcttcttcccttagccttcaacactctcgggggacttttctgttctctgttgtgtccccatctttttgtttgtttgttttttaagaaaccaggttgtgcttagtcaatgataaaactagaatttctccctcacattattatcttgtgataagataaagcagtatacagttaattaacagggttagaaatccaagattctttctcttcctctgggaaaatatttagctaaaaatgtcagtgagcccaattgtaagccttaaaaaatggtggctttgagtcgtggatctttgtttcgtttcactgtctcagagcacacaatacatgtgaagggcagccttgttgaagctaatctctgttttcatgggaaaggtaatttgaagccagtccttttgattcctatagaaatatgaaataaagtgtatgtatgtccacacacttgtgtgcacacaggcacagacacacaactgcaaacaatgtgtcttccaactttaacaccaaacttcattttgcctttgtagcgggaaccttggggacctccactcattccaggcccattttccaggattggaaagctgtacacagagaagcagtgacataaagttattcagattctcactctgatagtcatctaccacttggtggtctgaagcaattaatacggtttcccagagaccctaactttctataagtttatccacttgagactactaataaacaaaaaacaaaatgtctaaatactatgacagaaatccaaatattgcagacttatctgaaatacgcttttcaataacttcccaggtaaacatgtatttacttttaaagctattctgtcttgaatttgtaaggatctttgcaaaactgaatgatatattctgaattttgaaaagatgtagcttcttaggcatattttacagtttgagaattttataaacaattactaatggttcattacttttgtaattaaaatacagatttgctgttatgcaatttaaattactttttaattttacctcacatctggtaggaactataacaaattgaattatttatgtatttataagtacgtataagataattatgttttttaaaagtagggtgtgcagaatttgaaggtaaattcacagttatcctcaaatatcttcaatgtgtatgtagatcttaatttcaaatcttatagcaaaaaaattcaatatttagccaactttcaaagcatgtcctgaatagattattttgtatgttagtgaaattagtatgtaatttcctttgttaaaaaatctccattttccctccacacagtgaatatggccacaagcaggctaataggggccgtggccggcaccattctggccctgggggtgatttttggaggcacagggtggggaatagagtaagcatccttgccagtttcagagtgtttctgtgtggtgcctgatgtgtgaggcgatgcctgtacctgactccatgtctcgtcctgttgaccgtgtttcctgtggtagtgcaccttgtggtgtgacttggatgttgcttgtgtcctgtggttttcttgtgtcatgtagaaccttctcctgtctggaacaatgtggggcataacataacactgggtgtgcttccgatatcttcataattaaggcaatagtcccaacacttccattgctcctccactttgtagaagtaattttaaaatacagacttttttttaaaccatttattggcaaaaatgcttttatatgtgtgttttcttaggattcttgtaataaagttaatctgtgccagtcaaataaatttacatatataactagcaattatcaacagttataggaccttttaaaggtaataaaaatgatagctactaatgttttcttcatttatttagaatgatataggaggctgcagcttaattttttaaaaagaagatatttagcatactgccttcctatttttcctataaaataggttaataattcaaaattgaagtctacataaatatttggaagcaaggagcattaagaatgaaaaaatatttaatccaaacctgtataaccataagtgaacagctgcaaatcacctggtgggttcgtcttaaaagtagccagggtgtaaataaatatattgtgtgccacttgcccattaagctgtcacagaaatacagttctcctgatgctttgatttagggtgctctgtacttgatccacatcctcagaatagctgtcagttctccagggcacattgcttcctgagattgctaatctgtagattaaaatattatcatgatttttttcttctctctctaattagaaaaagaatatttaagaatggcagacataaccctttacacagtcttttctgtctactgtggtggtggtggtaacacttcaaagtggcccaggaatgaattactagtatcttcaggaatcactagatatctttgactcacccatcccaaatcatgggcttattgtgaatatcagatatgtttttctatagtcccattagttagaacaaatgggtgctcctcttacacactggaattgggagacccggggaccaaaatagcattaagagggaagcaggttcatagttcacaccttgtgttgaagatgacatgagccttctttctcctggattcaaggactttgaccagacttagatcttccaactcacatctcatctctatggactgtgaagctggttagcacaggggaagctagaaatactagaaaagagattttgtttctccttgtgtattagaaaacaaagaccataacagggataaaaatatttagagacaaaaactttgtcctgtaaaatttccccttggatctgttgactggattgtatacagaagaaacattcctttttcagggccagctccatgcatgcatttatgtgaaattcctccttgacaaatggtagttttctgaaaatcatcccaaatgcattttttaacattatacattggctgtaactttggtgtc

SEQ ID NO: 98372 - DNA, 1157 bp, Homo sapiens
ggtttatgagcactagttttctcttagcttactgatttttttccccatcaaattccaagttttagcataattgctcaagaaatatagttttttaaaaaataatgtagtacaatatagattgtctcaacatttcttagtttaattgatagagtaatgttcattcagtcactaagaattccatggacagttttttttttaatttctccttagtttataagtcaggaatcatttttcatgaattatgtgttgattctaatcctagcctgttttctgaagcggacgaagtgcaaatcatatccaaagcatagagtatgtacatggttatatatttttttaatatttgttttgaaatttgattctctgttgaattgtggggaggaaatacatgtaagtagaataaagtttctctaaaacagaagttagcaaacttctgtaaaaggccagatggtaaatagttttagctttcagcctacagggttgtctgtaacaacttctcaacaatgctgtcttagcatgaaagcagccataaacaatatgtaaatgaatgtgcatggctatgttccgataaaacttttttgcaaaagcagacagtggggctagatttggtctgtgggctccagtttcctgacccttgacttataggatatgttttagggtcagacaaatctgtgttcacatcttgccgctatcactcacaaacttctagaagcctgtttcctcatccattaaacaaggatagtcatagttcccacctcatacgatttttgtaaagatcaaaagagatactatatgtcaagtgttcagtactgtgtccagcacatagtaagtgcacaatacggtagctgtttaaactatttttatggctctcattattattattattattattggtgtatctctaaaggcaactgagattcgttctctagacggtcagtggttagtcttaagagcatgtcacaagcccaggagcctaaagagacctgcaccccgagactgtattgcagctgtcctctacctgcccaccaagcactggatggtctccgaataaaaacacattatgcatgcaatttgtgtgctgccaaaagtggcatccatttatgtacacagttgagggcactgatgtgagcagaaaagagaattttttacacagaaatgaa

SEQ ID NO: 98373 - DNA, 3621 bp, Homo sapiens
gttagtaacaatgggaactttaaagctattctcagttgaatctaaggaatctttttaccatttccccaaaattacccaaatgagatttatgcttccttatatcttgcctttggaaccccattttggtctttaccactgtaaggatagtgaagaagtgtatctttgagagcaaggcttcaaaagtcagatctgtattgacttccttctgactgctaagttttaactgtttccaagtggggaattaaaaagttagcattcagaccacttttaggtgctttttggaagggcattgtagcagaatgtgtttcctttcctccatgcccccatttgtgagtcagatggagcttgtctgaatgcgatggtgttctctctgtgcttttacttatttgatacatgatactgggagaggggaagagaagaaggatgtgtaaagacagcaagtggggcctatttgcttcaaattctgtgaaaggtgaatttaatggaacttaattgtcaatggtgcagaaactttagatttaaaggcatataaatccaagcaacgctcaccgtagcatctaaaatgcaattaagctaagtaaataaaggcaatttaaatgtttagccgtcttttacacaggatatttacttcctgaaactgcttaactgcctttcccttgtggtaacgaaagtggttggttcatatgactctcttcccatgatcctttgtcacaggtcctagtgccaccaatctcataataggctccatcgctggtgccatcctggtagcagctattgtccttgggggcacaggctggggatttaagtaagcaacgccgcatgtcttcttctcagtggctctggcatttctcttttctgcttacataaccaagttttgagttcctgctacaagagcttaggttctgtcagtcaaactgcaaaaaataagtctttttattcagaaatgggttagaaatgaagaaacacggaccctcaactgtcattttcaggcaagtggaaatgtagaaggaattcatatacactgatttttaaggagaacaacgaagttctttggtagaagacagtccagcttgtaagagcaggcactctgagatacattcatttctacacaggaaatcgaggaaaccatgtagttggaaataagtggatgtaaattgcttgtatctgtttaaaacttgtttgtagtccactgatattttgaaattttcacaacctaagtaattatgcaatcattacttgtatttttcatatgtaacatagtatatgtagctttgtgatttgaaaagctttatagtttaatgaaaacagattttaaaagtatttgtataatcctcgaccaactgaattggttttaaatcagaatttgaaaaatgtggctttgtgacacttagtattttctaatcaaggactaaatattgacctgacaggtaggcctggtgtgttttcatagtgaccttttagtttggattgcacactgcttactgaactaagattgtttaaatagacacactgggtattcacaaataaacttcaattgtgatcaaaatttttaaagctgatttatccaggctggctatttctacactccagaatcattggataattgctttttataccttttcatgctatagtgagttgatgattatgatttgtaggtaagccctcctgtgcctcctgtgataaattttcagccagattcacagaaacaaatttaagtgggaaataagaccattacccaaattcaaaacccactttgcctgcatctggttactcaaaagaggaagcttttgccctgaactatctgaataattgccttaattataaactttatatgttttatatttgggattttgaattcaatatgtttcagccagttaaagtgttatttttagaagctgattaaagaaaccaaagatgatttaaatacattcaacattttctgctaatttgttatcatattaagatttattgagtaagtctacagttttggagtgcctttaacttgaaatagtattataaaattatacgtcttttctctcggtatatttgtagagttgaacttgtttagtaatgtagtcttggcatcagtgtgttttcaaaaacacactcataaaatggacaactcatatttaaatttattgttttggtattaataaaatattgcccacatagtgagtcacgcatgtggcatctagtaagaaatatgttttcgtttgggcggacctaattcaagcaaaacttttcttagtgttccactgctacaaaaaagtcattgaacattatagtactgccatactcttattattttataatgcttccttgaactttttcattagtatgcctcaagaaaaataaatctggatcatgcccaggcttatgcctcatttggcgttaagaaatcccggtttcaaaggcctggaaaacagtctattacacgtctttgccgtctagccatatgcaatgccaaatttatcattgcagtgtttcgagagaagagcacactattctgtagcaggacctcaaaacagtggcctggcctagctcacagcttgaattgcatgtttctttggggaaaaatggaaaagcctttatcactgtgtatataagtggattaggccctgtaaagattctttatatctgagagagagagagatctcgttatcacaagaacagaaaacaaaaggtgggggatcagcacttagtgagatgagaaacagcctttgctgactgctgcctggttgttgctgtgtagggacctgtactgctgagctgagtcaaagccccttcctgtgccctgtaactctgataatcactttcagggagaactgtgtagaaagacacacaatagggtgaagtatttcatgccccgaagcaaagaaaacgatgaagactaagaataattccagaacatgtaacttcaggagtttaaatttggagaatgtgctactcctgggtgactgttggttgctacatgaggaccttaatttgctttagattttagtagtaactgtgtggtttgtgttcagctttaaataacacttctaccttgtaataaaaggcttttggtgctgaatgataatgtttagattttcccaccacttggacagttctggagattactagtctggagataattcgtaagtataattatttgctatttgaactgaaagcctttgggtttgagttcaatgtaaatgtttaaaaagaaattcctttagaatcagaagttgaaaatagtttgtacaaaagattgttctaaatgctgctattgggaatccctcctgataccaggtttttatttctagaagaaaagttggtaaggtaacctgaacaatttgagggcatgtcaactttttgattaaaggaaaatacagtaactactcagggaaaatactatattttcctaatgtcacatttctttaggtgtactagtgagtagtttagatgtagaagtatcatactatacgtgacctgcccaagtataaatgagaaatacagctatgctctaagccctgaccttgtctgccattctttaaagttctttccttaaactattatttcctctgaaataggtggtaaaaagcatgaaaatgtgtgcatgtatgtgaatgtgtgcacatt

SEQ ID NO: 98374 - DNA, 1352 bp, Homo sapiens
gtggcacaccaatttgctctacttctatatctgcatttattttcattcaccccatgctcctgttcttccccatcacccacacacaagaataaagttatgagctgtggtgcagaggattgcaaacctctgtcctagttgactcatggagactcatgacacctacccaacattaaatgatgatactgcttgattcgactgttagagctgttgcttttactggacattagaaaaagcaggaccattttagtagcatcttccctaaagcttaggaaaggtgaaaagtatatgaaaagagaatttcatatctccatttaaaagtgaacaggattgtcttcagcaccttaggcgttgctatttatctgatattccctaaatttgaatgtagggttttacatgcacattagtaggtgatggtggtaggaaaagagaaattctaggtgatggtaggaaaagaaatgaaggtaatagtgacatggtttgttgaaaattgaaatcaaaaggactacaggatgaacactgagcttttccagtgataccgtaacacctcagtctgtagaacctcatcaccacgtcttactctcccgctacttgccctgtccatgggattcagtggcaaagtggatttcatcagtggccatactggcctggcatagctactccttacattaaaagtgttaatttaatattaataagtctgtgtaattatcatacgtgattccttctctctgagaagttatttgtgttaaaagctcttctgagcctgactctggatttaagagattctgtctggcctacgttccattttattggacatgttaaagaaaaggctgtttatgtactcacacaaaatgaaaaagagctatatctagactattaccagcaaagttaagagttatctgaagctgggcatggtggctcatgcctgtaatcccaggctgaggtggacagatcgcctgaggacaggagttcgagaccagactggccaacatggtgaaaccctgtctctactaaaaatacaaaaattaaccgggcatggtggtgcacgcctgtaatcccagctactcgggaggcagagacagaatcccttgaacccgggagacggaggttgcagtgagccgagactgcgccattgcactccagcctgggcaacaagaacaaaactctgtctcaaaaaaaaaaagagttatctgaatgtcaagtcagataaaatttgaaaggaacttaatattgttaattatattttctcaaaagagtaaacaccattttttgtgggggccttttgatttttattgaattaggaaattgaattaaatttggctagtctttccacgaggaggataaccagactgctg

SEQ ID NO: 98375 - DNA, 1156 bp, Homo sapiens
catgactgtatcccagttcaaaatgagaagcctgattcccttaatgcctgggactcctgggttaggcactttctctttcatggtaccaggctggccaggaagatcggtgcatttccctgccccagcgccccagggaagtgagctcagtgtatggtggcctaggaggggttgggctagggacacttcgtcagggggtgactcagcatagaatgataagaatgtgctaaccatggataaatatatgcccttgaaagaagaactaaaggctttacggctctgagacggttattgttactgaaagagtcttgctttaattttgtgtagatgttatgtgtataatgtatattgtagacaaaagtccagattatttcagaagtagtaaaaatggatgaaagctgtgaaaatgtaagctttatggattatgctagtgttttataatgatccagaaataccttacaggttatgagaaagttaattaccttcagaatcctagtgagcggagggtattcagaggaaaccgttatgaagaaagtcagcaaggacctgcccgcagtagttgtactttcacattaaaattgaactgaaagaatatttttttcatagagaaaattcagaccgttctcaacatacagtgactgtgatggttttacaatttatgtgtgaggcaccttcacagtccgcttgccacaggagtgttcatctctgtcctcatcgcagtgtggcctcccttgtagaggagctcactttccccctgctgggacatcagtggaagagctaaggtcctggaatgccccattggtgttcagagtccattttcatccagaaagatacagttctgcaggatggctcagcctctctgtctggcctgggaacccagtgatcctgtagagcaatatttctgcaaaaaggtgcaacctaagcttcaaaaaccagcttttaaaaagagcacaagcttttggacaccagcggttgtctgtgtgccaggctgaaatggaatttcctatctccatttaaaagtggactgcattgctgttacgaccttggacatggctacttatcggtcattcccgaatttgaataaaggaatttagatgtgggcaacatgcacagtgctagcttggtttgccctttcctctacatttggatttactgagga

SEQ ID NO: 98376 - DNA, 3350 bp, Homo sapiens
gagttctagcaatacatagctcacaagattggggcctcttgtccttcagggtcatttcacaaggtcaggcagtctctgtttttcctccctgactcacagagtatggctccttaaacctctaccttccagggatatgaacataggtggcagatggagaccctgtgctctgcagcaaactaacttggtggaggatgcattatgggatacttgccttttggtttcacattggtttcttgggcagcatcagcagtgcccgctttcaagaatgttgacttaaaagagggctgggtgggaatgatgaagaaaagtaaacagcattgttgcagatagtgttggctgcaatggttacctgctaggccaatgagtcacacacttaggtcactcatgaagacgttttaatgtaaactttaaaaagaaaagacaagttttctttaaagacttttatgttgatatttcaaaagagaagcatcaaagtgaccatcttgggaaaaataagaactttgcaggatgcctttatacctattttgagctttggtattgtttttattttgaattacttgtgggggaggaggaatatatcgcaatggctttgatacttagggcctgtaagggtatccagctggccctcagtcggtgggcaggggagtgagggctttggggactcctcagtctccagttttgcatgatgcctcggtggcagtagcgttgcacccgcccagtatgcagactaaatgcatgagccccttgcttgatgccccacataaagccagaccatggggaggttgcaaccaacttttactgttgccttgtagtgtcttgctggttctttcttttctctttaaacataggagccactttttaggagactggacactgtgagcaaagcattttaacttgccgattttcaactaagctaaattctgcatttgcttaactaacctgaacctgtgtccactctcctttgagtgtactgtcttactgtgcactctgtttttcaactttctagatataaaaaatgcttgttctatagtggagtaagagctcacacacccaaggcagcaagataactgaaaaaagcgaggcttttttgccaccttggtaaaggccagttcactgctatagaactgctataagcctgaagggaagtagctatgagactttccatttttcttagttctcccaataggctccttcatggaagaggccttcctgtaataattttcacctaatgaattagcagtgtgattatttctgaaataagagacaaattgggccgcagagtcttcctgtgatttaaaataaacaacccaaagttttgtttggtcttcaccaaaggacatactctagggggtatgttgtgaagacattcaaaaacattagctgttctgtctttcaatttcaagttattttggagactgcctccatgtgagttaattactttgctctggaactagcattattgtcattatcatcaccattctgtcatcatcatctgattaatattgtggattttccccctctgcttgcatcttcttttgactcactctggaagaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtgacaaggatggggtaaaagaaaactgtctcttttggaaataatgtcaaagaacacctttcaccacctgtcagtaaacgggggagggggcaaaagaccatgctataaaaagaactgttccagaatcttttttttccctaatggacgaaggaacaacacacacacaaaaattaaatgcaataaaggaatcattaaaaaaaatagtaaatgattttttttccctcagcctgctggcacttaatatcttctaaatgatttggcatgatttttttttctttactaccgatgacaaactccagtggcatgaagatctaattttcaaaagggtaaaaactgcatggcatatatacaacaagctagcaagccaattctcagcaaaacctgcaacagaattcctaaagtgaagatgacagatgaacacaaagaagctgcctgggcctcttcacttaaacatgtccccacaccccatcctctcggagccccacttcttaccccccacctcccaccctctataatccccactccccattggagaccaggccagggcagaactccacggaccttgctcttgttgattcactttccccattgtgttttctcctggactgagcatcctttggaaatgggagctggaatttgaacaatgatgctattgtatagttcttttataaatgtaaatatggaaataagagattttgacacatcattttcacttgtctgtattgagatattttccttgtaaaggttctctgtaaacttgagttgattttttgctccccatcttttttgtttcttgtctctctttctctgtctctgtccttctctcttgtaacgtgttatacaatgactcttgggcttgcttaaaaagacagatatagccacagatgcagggagtttgggcacaaaacacgtgcagtttaaagttggtgtgcgttaaaccaaaaataaaaggggggacataaacaacaaaataacccatatcaaagacacaaaattatgtaaatggaaatatatgtactaagtttcgaaaattttttgatgtcattataaacctatgtaaataatgtaagaaagtagacaccctttcagattaatcacaaaagtgccaagctcatgattttggttttcggttttgacaattttctttccctgtctttaatgtgaaaggaggataaacttaaagccttaaataaaaaaatttttttaaatgttaaaagcttggaaaaaattaagctttccattttatttgtatttgttagtgtcaatatttcatccatgctcattttcctgcctcaaaatatatatggtagaaccctattggaaaagtggtaatgggaatagaaggagcagttacctttgtatccgcattgttaaaataggcttttatgctgtgctgtgctttcaagaaaccttgtttgacctctggcattttactgatcagtggaccgttgcactggattataatgggattctactatatacaaatccacattgttcttctccctccagccagatttgcagatgtaatctgggctttccaagtccctctgagtttccttcacttttactgatttttttcttctaaatatggtcaagatagcttctgtcacatgtta

SEQ ID NO: 98377 - DNA, 1031 bp, Homo sapiens
gctatgtgtgtatgaatatgaaagttaatgcaaccatatcaattgtaaaaatggattataattatttttgatggtattaggttatgtagtttcaaactctttgctgtattttgttttgcacctgccattcatttgctaatttttgtggcgtggagattcttttttattaatttgagctcacagcacaagtgtatcactgtttaatgttacccaacaagagttagtgttaagtgatgatcaagttcccatttcacctgctctacttttgctgcattaattaatgacacccggatgaggagacgtgcgctaacttcattgctcatctgggatagtgcatgagcccattgaattagagctgctcctactagataactgagcagtacacataagtgcatgttatgaaacatgaatcacatagagcagtggagttttaccaagtggtgtgtgtggtttttgttttttactatgcaaagatgggaaatgcacaaacttttcaaagactagtgtctgaagaactttacaaacaatacttgaaccctttctttaaagttatcccatcatgttttatagtcattgttgcttccattgttagtttccattttcaagtgctttgtaattttttaagtgcactacctgaaattttgtttgaaattaataaattcattcgtatcttgttggctgcctatgaatggagattcagtagtcattgtatgcatctttaagtcaaatgtgtattaaaactttcgttaacgtagaatgttgtagctttatgctttaatcatttcttttaaacccccttttctgtttcctcttgtagtgctgattaaatggccatgtgcctgatatcatcagagttttagcatggatccaaaggcttactgaaaatttaagcagtcagtggcacaaaataaaatctctgattaatgataaatatatgcctgattacgattcagttttattggattcattggaattttttgcttcttataaatcagaaaaaaccctaccttaggatcgcttagagatttttt

SEQ ID NO: 98378 - DNA, 1021 bp, Homo sapiens
cattttctcttctgttaaatgcatttcatttctttaagtaaaagttttgttttaatttttattcttttcattacttcttcccctacaggaaaacgacagcacgtgttctttttcactagtagaagtgacgttggtttcatgttgacaactttgaagccatttggaagtgtttcagtggagagcaaaatgaataacaaagcgggctcctttttctggaaccttagacaattcagtacattagtttcaacaagcagaactatgaggctatgttgtttgggactttgcaaaccaaaaatagttcattcaaactggaacattttaaataactttcataacagaatgcaatcaactgatatcattagatatctctttcaggatgcattcatttttaaatcagatgttggctttcaaacaaagggcataagcactctaacagcccttagaattgaaagactactttatgctaaaagactgttttttgactcaaagcagtctcttgtccctgttgataaatctgatgatgaattgaagaaagtaaaccttaatcatgaagtctccaatgaagatgttcttaccaaggaaacaaaaccaaaccgtatcagcagtagaaaactgtctgaggaatgtaattccctgagtgatgtgttagatgcattttcaaaagcgcccacatttcctagtagcaactatttcacagcaatgtggacaattgccaaaagactgtctgatgaccagaagcgctttgaaaaacgactgatgtttagccaccctgcatttaatcagctctgtgaacatatgatgagagaagccaagatcatgcagtataagtacctactgttcagtcttcacgccatagtgaagcttggaatccctcagaacactattttggtgcagactttgctgagggtgacccaggtaaaataaaaaggagatttaaacatgcatttacttgatttagaatattttgaaagaatgaagggatatagatatgtagccttcttaaaagagactatcaaatgga

SEQ ID NO: 98379 - DNA, 1044 bp, Homo sapiens
cctgggcaacaaagggagactccatctctacaaaaaatacaaaaattagctgggtgtgatgtacttgcctgtggtcccagctacttgggaggctgaggtgggaatatcacttgagcctgggaggtcgaagctgccgtgagccatgatcgtgccactgcactccagcctgggtgacagagccagaccctgtctgaaaataataataataattttttaaaagacaggaattccttggggataatctggcatatatcctgtcttgctatagaattcaataattgggttcatagctatgggaaagtttttaactttttacattactgtgatttccatatgtccttaaggaataactaatttttatttagtgtatgtgtgtgtatttgtttaaaccacagaatatccctgtttatttgtaggctgtgtattagttcctatgtagttatttaaaagtgactaataaatcaccttacctggtcagtgatgctcttactagattttggacagatatttgcatcgggatgacatctgtgttggtgaggtatgagtagtagatttttgtagtcaaaacatctgtatggatgatggtgtctcactgacctgttggaataatgtaaagacattttagaggtgaaaggacagtgtgccatcaatgaatttgcccttcaaacacatagacaagtggtcttttctttcatagtagatatggatggaatgctgtaaaattgttaaggaaaccctttcataggaaagaaaccttttttttcttctaaccataaccatttcttattattacctggttctgacttaagactttgtgattcattggttatgtaattttagcaaaagagcttctctctcttcaggctaagtttcctcagatgtgattttttgtgaggtttatagactagtgattaaactgtagagtactgctagttaagctgtgttgttactattcactttccagattatgcccactatttctggaatcaaacttagtaccctaagtaaagggacctgaaagaagaatctgtggggtgtaggctt

SEQ ID NO: 98380 - DNA, 2107 bp, Homo sapiens
ttgaggctccaacctgggtgacagcacaagaccctgtctcaataaaaataaaagtttaatttattttgtcacagatagtaaattaaattaaaatttgttttttctttagatgaaagccttgagggaattagacagattttctgttttgaatagccaacacatgtttgaagtactagctgccatgaatcaccgatctcttatactcctggatgaatgcagtaaggtggtcctaggtaagaggaatttttctttcatcatttgcaatacctgagcttctgttttagactatttttgttttgttttaaaaactttgcttttatatgaaaaaagaataaagcatgttgtattcaaaacaatcaggtaatttttgtttgtttatttaactcattcttcaagataatatccatgggtgtcctttaagaataatgatcaacatattgcagtcctgcaaagacctccagtaccataatttggatctcttcaagggacttgcagattatgtggctgcaactttcgacatctggaagttcagaaaagtgagtacattaacaatttagaataagcctcacaaacttttaaaacactaattcatgtagcattttaagtatttctctttcacctttatagtagttaagataccaaaatattccaatgctgaattgacttttgaaaaattagctccttattattcctgtctgggggctacttgctaatatgaatagtccccaacttaggatggcttgacttaatattttttgactgtttgatgttgcaaaagcaatacgcattcagtagaaaccatactttgaattttgaattttgttgttttgctgggttagtgatatgttgtatgatgctctcttttcatgctgagcagtggcagcaagtcgcagctcccaatcagctgtgcaatcatgagggtaaacaatgcatattgtattcaataaattacttgagatattcaacacttttattataatataggctttttgttaactcattttgcccaactataggtgaatgtaagtgttctaagcgtgtttaaagtaggctaggctaagctatgatgttcagtaagttggatgtattaaatgcattttgacttaaaatattttcaatttatggtgagtttgttgggatataccccaccgtaagtcaaggacaatctgtatactattctatcctttggtcatctttctatttgaaacaaaaatttgctcttctttttcgttttaaaagggttgtatgggctgggcgcggtggctcacgcctgtaatcccagcactttgggaggccaaggtgggtggatcacctgaggtcaggagttcaagaccagcctggccaacatggtgaaaccccatctctactaaaaatacaaaaagtagccgggcatggtgacgtgtccctgtaatcccagctactaggggggctgaggcaggaggaccacttgaacctgggaggtggaggttgcagtaagctgagattgtgccactgtactccagcctgggcaataaagatcaaaactctgtctcaaaaaaaaaaaaaaaaaaaaagggttgtatggtacttttgttagatatttagcatgatttccgtgtttatactttgttcttgttagatttcaaataataaagatgggtgatgtgacaggcttggggtttttgaagaataaaatgtcactacttaatggtcatgtccattgttttatccagagtaaaagcctttaaaatcaggagctgtgttaagaatataaacatttaatgaagcacctggtaaaaacttctttttgcaatgaaataggtgataactgttagatctctaggttcagtttattttggagagtaaggtaaatattgagtttactgtggaaattggttatagaaagagaagtaataatcctaagtaagaaagattgagaaggaaattggaggtgaacttgaaagtttattttaatcataatgtttcagttccattttcacttataggtatgaatattaaatatagaaattttggggttatgtcttacatgttagaatctaggaagtatttaagtttgggaatgcgagaagttcaagattgagttggtcattttgaaaaccttcagaaa

SEQ ID NO: 98381 - DNA, 1078 bp, Homo sapiens
ataatgaataatctttctaatgtattgttgaatttggtttgctagtattttttttgaggatttttgcatcaatcttcatcagagatactgtgctgtagtttttttgtttgttttttgttttttttgatgtgtctttgtctgattttggtatcagggtaatactggacttgtagaatgagtttggaagtattccctccttctctgctttttggaatagtttgagtaggattagtattagttcttccttaaatgtttggtagaattcagcagtgaagcagtttggtcctgggcttttctttactaggtagtagttctacttttacatttttcaaggaagcttcatactgttttccatgcaccattttgtagtcctatcaacattgtgcaagggttccaatttctccacatcttctccaacacttgttagattttgttttgttttgtttttttgataatggccgtcctaacagatgtaaagtgatatctcattgtggttttgatttgcatttccctgatgattagtgatgttgaccatgttttcacatacctgttggccatttgtatgtcttctttggagaaatatttaagtcctttgcctatttttaaatcatattattatttttgctattcagttacagtatgttataatgtgtaaacatactacaaatatatatataatatatatattatgggatgcagaaaaagcaatcctgacaagaaaacttaaagcattaagttttatataaacttatagcaataagcataaatatatgagttacaggaattccttatatattttggataataactgcttatcatatgtatggtttgcaaatattttctcccattctgtaggttgctttttcactttgttgactgtttcctttgctgtgcagctttttagtttgatatagttctccttgtctgtatttgcttttgttgcctgcacttttggtatcatataaaaaaaatcattgcctaactaagccaatgccatcaggcttctcctacacattttcttttaggaattttgtagttttaggtcttatgtttaaatctttaatccattttgagttga

SEQ ID NO: 98382 - DNA, 1091 bp, Homo sapiens
agcaaacctacagacccttctttaatgacaagtcctacatgtagaaaaaaataaggaatgcatcattattccttttatttatactctatccttctatacaaaggctaactgttcaggctgttctttatgctttgatcagagctgttttaattcctaatccttacttatcacatttgaagccaacctaagtcaatttttgcagctgtaaacacttggtcactcctggcctgtgatgagggaacacctgttagatcaagaaaccaaatagccaccaaattaattagttcatttactcttggaaccaaattaactgttgacttttagtctttagtattaaataaggcaaagcaatattcaggtagatgtacaaaatttgacgatgtgtctgagaatagagtagttcagaattaaaacataaataaataaatgttataaaatcccaaagttgagttgtagagagtcagtcaataataccacgtgctggtttttcaggcagtgtaataatggagaaacagccttgaaccttggaaacctggattctagttccaactttgccttaattacgaggctttttaactttcctgggcatttccttatccataaattgaggagtttagactaaatgacctctaaagatatttgaagccttaaaacattatcaagtgcagggctttgatttagaccctgtggaaaccagggagacaaagagagagtccttgtgataagaaagagataattagaaatacaagtgcatttatgtatatatttattattttataactattactaaatatatactaatatagttttttaatgttgcatttatttcttcttaatgatatactctctttttcatcttttagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattggtatgggac

SEQ ID NO: 98383 - DNA, 1056 bp, Homo sapiens
caagactaaatagtaatatcaataactgttcttgttttgtttatttttgttttcagagtagctgtgctatgtgtttccagatctgcttattgtttgggttcaagccaccccagaggattccttgctatgaaaatgcggcatttgaatgcaatgggttttcatgtgatcttggtgagaaaaaaatgcaaatgaaatattctttaattactgatgtacattctaacagctgccaggaatcttgtggttgagactggttactaggactagaggaattgtcagcattattggaatgagtgctttagttactgttttctttgaaaaagaacattgctagtacacgatttgggttctgctcagctgattactgtcattactagagcttttacaaatgttgttctggtcagctttaatccttttttgctaagaagaagaatgcaaataatatattttcatatttaagatacacaaaaccatatttaatttccaggttatcttgaacaagggaaggaaagatgttaaagctttgttttcatggcctgtgtgaagctgttacaggatgtttgttgccagaaaaggctggatggttttaagaagatgggtctttctcttccctcttatgcttcaattttattttgtaccccacagcttctcttgaacagcctcttctgatgtttctaggtagtaggaaccttacaaatacatttatatatatgttgctgttggaatctatctaaatgccactcatttggtcctgcgcataatgtaagatgtaaacattccaagtcttctattattatactttagtattggaaatggattacgtgtggactattgagattaagatgactcctttctcttagtgggctactatttaagactttgttttttatattgctgattatatatattctaaggaagattttctcaagaaagcagtttttgcaccatttagaggacctttaaaatttgtataattttcacagttaaagctttcttaaaccctagcatgtagtcttattatgcctttaaaatatgagtagttataaggtcacattt

SEQ ID NO: 98384 - DNA, 1024 bp, Homo sapiens
gtgcttgtcatcccagcacttgggaggccgaggtgggctgatcatgaggtcaggaggtcaagacaatcctggccaacacggtgaaaccccatctctactaaaatacaaaaaattagccgggcatggtggtgcatgcctataatcccagctactggggaggctgaggcaggggaatcgcttgaacccgggaggtggagattgcagtgagccaagatggtcctgctgcactccagcctgaccacagagcgagactctgtctcaaaaaaaaaaaaaaaaaaaaaaaaaaaaaaatacaaaaactatagcaatatgacaacagctgccaggttgtatcaatttatccagcttgcatttagaaaaggttagagctgaaaggaaatttagtgattatttaattgttacttccctcattttatggacgaggaagataaggctcaaagaattttcctttcctgaagtctcagctatgccattggttccacatcatttcatcctcacctgctcttcagcttgtgtcccaggagatcaggcttctggttccagattggacaacctctagttttgtatacttggccaagtgatttaaccttataagcttcagaacaagatgcagatattctgttattaaaggaactaaggttttgtctttaaatgttgagtgtgcatcagttttgagtgtctaattatgactcctcttcaaaggatttgacaaatttgtgaatatttatgaccaccttttagggtagtaattttcagtttgtactagttaacctggcagataaaaaggcatccctcttttactagcattctagtgttagcattcttcattgctttgtgtcaatgaaagaaaaatgggcaaagagctgatgaacatgaaaaaagttcagtctacttgtaaagacatgcacattgaaacagaagagatggttttgcctttcaaattagcagttttttttcttttaagaattacagtgctgatgaaggtataatgaggcaagcacttgcataagctgttggtagactg

SEQ ID NO: 98385 - DNA, 1029 bp, Homo sapiens
tcttaaattttttttttcattgctctatttttctccattccctctagaggaaggggatttttttttggtctgaaaatcagccattaaactgaagaaggctcaaggaaatgaactgaaatgtctcataggaagaaaaatagcactatgaagatgaaaaaaagcccaggataatggagattgatcgctcgatctatctatggcctcaaataaaactgattgaatttaacatgttaggttacagttaaaaagcttagttgcttcagttggggtaatatagtttcagattttcatagggagccatttatttatttttgcatttgtgagtcatttagtcattcccttgtgagtgagaatacatttattttcctactccctgctgttaggcgttctattaataccacactagttgaaataaatggagcagtagaaactgtttggtggtgaatttgtttttcagattttttttgttactgctattttcgtaagtcggctttccaacccctccagtggtttaaatagagtattaacttctcaccgtttctcttctcttgcttcgtatttaattgctgcttttgtttcactattgacaatttcaacaccacctgaaggtgtataatccaagaaatctaacagtggatgtctggtaaaatattcccaatcaagcaccaggattgtcaaaaaattatgggcaaagtgacagttgtcttaaacatcaggtttctctccacctgtttgtgctctacccaaaaggaaaatccaacctaatgaagagaggaattgttcctacatgttatcaagcagtagtagcatgggtcatgttttccagaattctaaaaggggattttcagatgtattttattgtgctggaacacaataagatttgctcatgcgcctttgcactaaagctgagcaaaatacaacgtccttgttattctggacagctgattactgtcagtaattgttgtttgtaatgaacgccacgcgggataaagcagggtgggggtgggggctggggggagggtccgctta

SEQ ID NO: 98386 - DNA, 1038 bp, Homo sapiens
tcctctctgtgtgctttcccttgcaaagcccttcaaatatcctcttctctcgacgccatctcctctccacctgcacctcttgtgccctttgtacatctttgattgcctgatgataacagggtaaaaggacagccaacctcatgcctgattagcagaactgaatcctagttttaaaaaatcttctctggcttcagagaagattttataaggacttttgtttgggataagctttccagattatccatgtctatttgcatcaaaggggaaagaaatggggcttttggatggctcttccagtgcattcggaacattgcctcttgcctttattcctgcattttatggcaaagccaaaagaaactcaagttgcaagaacaaaacccagtgactcgttttgatggttcaaaatggtttcctttatggaagtcacttcataaaatgttaagtaaaaagtgggaagtgcttctgtcttctcttttgcatgagttgcttttaggagcaggaagaaggtaggcaaagtaagataaagatgcaacacatttaactacaaaaatcaggttcattttttagtttattagaatttttttgaaatcttaagagggccagcatttctggctacaattttgcacccagaacattgccaaaatgaacattcagtaaatagaacctgattgaaatttactcctggaagctttcctttgcattttcgggaagtggccacctgccaagcgcaagagttggggggcaggaggggaggactcaaattcagggtgtctggattaaatttcggtgaacatggtgatatctcagtttgaaaactagagggcctatcctgagtatacatcaatgtctctttgatggcctactttcctcagtgaggatctttgggaatacttgagatggaacaacagaaatgtgtgaaaggaagcagaaacttcttgtaaataacgtgacctcccacgacgaactgcctgaggcttcagggttttttcttgcttttaacactcttaaatctcctctgttggttcctaatagatccca

SEQ ID NO: 98387 - DNA, 2032 bp, Homo sapiens
taggcccaccatgacttgtgacctagaacccccaggattaacagaggcctcacatttactctgcaagctgactccaaaggagtctacagtccttacttgtcatgccacactcacacatccagtagtggtctctatctacccgcattcctagctagctggcactggcctcaactccaaagactgcctttaggaccatcaaatggcctatgcaagcaagcggggtggttattaggacagattgtatattttgtatattctgggaccatcccttcaagacacgtctataaaacaaaaatggcgcttggtccacacacggttgctgctccctcctaccagctggctcccctcctgtcctcctttgactgtttgactcattgactgttaaaatgccaccccatacatatttgggatgcaaaactgaagtcaaaaggaaataatataagaaacacaaacacatatatgacagcaaccttcaagatctgggttttcagctttctgcaacctttgttttcactgaaatgttgaaactactcgtctgagggcaaaggaacctcctcacaaatgctatagctgccaattggacacttggggcatttcgaggtctggccctaagaatttactttctccttttccttttttctatttagaccaaaaaaaacaaaaacaaaaacaaaaaaaaaaacaaaataatacaaaacgaaaaaaaaagaaagaacacccgttaacacacacgcgcacacacacacaaaatctgtccatttgccggaggcaattgtatgtatgttagttggagggtattaaaaatcagttttattccaaagatttaaaactagacatgacttaaaaacaatttctggagcactgcttgctgacaatctcgtagttctctgctgcatttgagtgcattttgtggccagtccatcagggcgtaccatgggattatatttgaatgtgtggtgcatccttcctggatgaaggatgtgtgagggaccttgaacctcagctgtattaaactgtagcgcctccagtcagtgcactagatgaaacttttagacaccctgaattctgttggttcctttcttttcctttatgtagcagcctccagcatgaatgcacgcacacgccagtgatggcattaagccatggccaccacgatttgcaaatgttctctcccaagctggagctgctcttgcctctcgaatgctattattaagggtttataatacttaatttaattttcgaactgaccaatgcaaggctctattaaaaagaaagtttaaaaaatgcaaaagagtaatcattgcttgtttgctccctattttcatctgtggtctcatttgaatgtggcagaacaaaggccctttggtcctcatcagtgtctgaaatgttcagtaatttctctctcttttgtatcagtgaggtcctttgtaatctgctcctgacctttcttggagcagggtgcattgaaactcaatggtggtgcttgcttgcttcagagtcatttgttgactgtgagaattggcctaagaatttggtgggtgctaagtggatggctttgaaactgttcttctttagccgagttgacacctgtgaatgatgaccagtcctgatcattttggaaatggatttgtaataaaacgtccatcacctctgcagtggcagagatggttactaagagccgctagagcgagcaggttttccaagaagtaacctgaagacattttgctcccaagaggactggttatttaaaacagtgcattaatggacatttgaaacacattaaacccctttctcatttcagttgttacctcctaaccctccaggggatcccaaatttgaaaggaaaaacccggcctggtgtttctggtggtgtcctaacaagcacgcttttatccagggttcagatttgttcatgtagaaaaagagtttctaagccactgacaattttttttttttgtaatttcaaattatacttctttctcctgccacatgactgtaagtcatagacatggaaacctgaaattataatgct

SEQ ID NO: 98388 - DNA, 1126 bp, Homo sapiens
gattgtcaagtgatttttgttttactctgaaattgtagacctttctcctcattgtccatccatcacatttactggaaggaacggtggctctgggagacctaagctgtttgctttgtcagtcagctacctggctgcagcttgtggtaggagggaaggggagggagaagactaaaaagcctgaaatggcaaatgagtgtaggttctggagaaaaatagaattagaagcatttgtggttcagatgaaaatagcacatttcctttctgcctggactgtgggggtgaaagtgctccggggaatcgaaaataaataaaaattgatccttcaccagtcagaggaaatgctctgactctgggaactaaaatgacagctccagatttgaggatctggtgaaaccacttttgaaggttaacaaaaaagaaaacaaaaaacaaaacaccaggagatttggaaaaaaaacccaaaagacagtggtatactatgttaggaaatctagtctttcaggaatgagttaaacagccctttcccaagcctgaccagcaggcagcacaggctggttgggtgtaatcccttttgttcctgctgctgaccacggtccttccatctcttcttgcaggtgagaagccttataagtgctcatgggagggatgtgagtggcgttttgcacgaagcgatgagctcacgaggcactacaggaaacacacaggtgcaaagcccttcaaatgcaaccactgcgacaggtaaagagaagtagaagttgatgggctagggaggagagatggggaagtgggttggagggtgagcagcacccgtgtgcttggacttatcacaggtctgactcacagacacttggacctgggaatgccttttctccatggagaggaccagtgagaagagggggtgccctcttgcatgaaatcaagaggtggtgtgaattcttggttcagttacacaagcatttacagaacactagctttgagccagaaatggtgttaatcactcggtatcaacaagatgtgacagataactttagtataatatgaaaagtagtgagacagagaatggtcatctgtagggacttctgatctttgtatcaatgtcagtaccactttccctcatctatagtaa

SEQ ID NO: 98389 - DNA, 2284 bp, Homo sapiens
ctcaggatgataaaccactgtctcttatctctgggcctttgtgcatgctgttccttctccaggaaatacttcttgcccttgtccttagtgtccttcaagtttcaggggggctgatcatctctgggacacctgctctaatagtcttaccaagtcttagggattttctgtttcacatgtccacattacacacatctatcaaacatattgagtctcatgttctttgtatgtatgcatggtgctttcctaactgggagctgagctctaacgtgaagagcctttccatttagctttaatctctagcagtgtcattggttggcatatatttgaaccaacaattaatgctggttgaatctaacttgtcacactgaagagactatttctttcattgccggtgagttagaccagaagtctaagcatttgacttttcctgtttacccatggacagagatgaagtgtttcggagataatgcatgttagggtttatgaatctggaaggtaaggtggtaacaaaacttttcgtgctgttggattttgatggtctgatgtctcagttagcaaacattgtattcagtgcatgttacagtgtgtctgagcctgtgctagactttgtgcgtgattacaaagaggccaatgagaaagcatctagcccagtgcctggacatacactagatatttaatcagcatttattccactgggggtataaggtgtccttgttttaaaagcacttttcatttaatgtgtgtggggagaagcagggcaagggatcaaggcataaaaagataaatatctacaggaaatagtaaataactggccaaagagtgaaaacttagataagggtatagttttctgaggaggagaaatccttgcggatggggtgacatgtggagaataggcacattctgagcaggggacatcccagcgagtgagaaaggcttgggcgggagttggggagcgggggctgtctagggatgttggagactagagggttatgtaagaagtgatgggtgataaggtagaaaaataagtgacatggctttgtgtacatcttttcctgagtacataggcagtggtatgtgaagagcgtctatcctagattattatgtgtcaaaacaacaaacaaatgaaaattttcttttggggttactcttagactttatatttgagtaaggtacatatttgggttgctttagctaatggggaaatttagtctctaaaaaaatgtttaatcatcttggaagagaattatgtagacatattgatgttttaaatcttcactgatttgaaatttgcctctaaaaagctctaaaaaacggattaatatctattcaacatgaatggtagctggcccagggagggcccttctctccatgatctggatataaattatctaatttgggctcttcttttttttgagacatggtctcgctctgtcacccaggctagagtgcagtggtgcaaccacagcttactgcttactgcagcctcagcctcccctgctcaagtgatcctctcacctcagtctcccaagtagctgggactacaggcgtgcaccaccatgcccagctaattttttaattttttgtagagacagggacctaccacattgcctgggctggtctcaaactcctgggctcaggtgatctgcctgctatggcctcccaaagtgctgggattacaggtgtgagccaccacatctgatctcatttgggcttcttgaagattgataacattgcctttatttttttaagtttagagaaaattaccatatgaactagtgatatgcttaagctacttctctaccatctgtatttatatcatcaaggaatatcaatttttgttatcattagcttaattaaaacaaatttaggatgctgaagccacttactttatagcttccagaagcagatcttaggtggtttttggattatcctttcttatggttttttttttaataccattgatctatctcttttcatatatatatatatatatatatcgcatatgtagcagaaagttaacttttatccaaataataaatggtttaggtgtatattttctaaatttttggttagcaaaaaagcaaaatttagtgtatccaggaaagtaaattagacattgtcaactaatgtgatacgtaccaatgggtgaccaccatgggtccctgatctgataaggcctagtttagtctcccctccccacctgtcctggccctccatgtctctgcattttctgtggttcacagacacacagtcctctcacctgccctcaggctttccaaaagcc

SEQ ID NO: 98390 - DNA, 1024 bp, Homo sapiens
gggatactcttacctagggataaggggagaatgaatatagaggacaactggcggttgctgctatgcttttagtcttaataattctttttaaaaagcctttaatgcagacattttaacagaaaacttgagttctgaaattctaaatgtatgaaatggtaagggtaacatcctagtacattgtagtttgtggcatattgcaagatcaaaataattgcatgaaaactaggtttctgtggaatggcttaagttctgaatggaaacataatttacattttgcatttcatgagaacattacattactggagtaatatgaagtgactgggaaattaataacttaagcacaaaagcatatggagtcaaattaactgcatcttaatatttcttgcacctctttttcccccttccaaagtataaagtcacattacattgacattttcctcccagaatgccttcattcttcagtagaagaatgaagagaaattattttgtagctgtgagttcagtacagacaaaaattaaggctgtttgaggttagaggtatataggatgacagattgtgtgggggtgtttctacatatgtgggtgtcaatatgtttgtgctgagttgtttgcagattgggggggagggcagggtgtgtgtgtgtgtgtgtgtgtgtgtgtgtgtgaatgtgaatgtagctttcacgggtggtttcagtcattgtgttttcttcccaatgattcctattagggagcagcagaaagaagatgtaggaagatctaggtaactgcttaaaggaaggtatggagatggaccaatagtatatgggtatgttcattcagccaggttaattgagggtctttgacatgtgtccagcattctaagtcttgggaatactaaggtgaataagcctggcctctgcccttaaagggaccatttggttttgtggagctacatagaatgtaaacaatttactcaaacaatatgatagtctcttctagaggaagttaggcgagcagaagaaaggagtgcccaactctatca

SEQ ID NO: 98391 - DNA, 1009 bp, Homo sapiens
tgtacaaataagggaactgaggctgaaagaatcatttttcaaagatttcactgctgaaccatcacagagcctgccctactctgtttttcctttagagatcagttatttcttttgggggcctaagttgaaacaatataaatgaattcagttttgtttatggttcagaaaaataaatggctatttgttgttattttacttgttcagtataactactaattcagaatagctaagaaaactgagtgattatcttgtatattcctacattctgtctattttggttgaacttaagaatccttgatcttagttggttttcccctattttaagaaagaaagctggttttgaagatgcaaacaaacgcaaggtattgattcttgaagtggtatctcagtactactgcatttgcatattttagataattcttgatgagaaatagcaaatagaaacttttctctgaaccccttgaaagaatgcatcttagcaatcctctttattactaagctggaaaacccaaatggagatgccttaaagaattcaaaggaatctatggatgggtggatcttggtgtatgagttgtatgctcctctcagttacaccagagctttgctaggtgaggttgaagaaatgatttatgtgcctttatttttgtttgtatgataagtgtggaattcaggataattttattttatctttgtttttgcccagttgaggatatttataatgggttagaagtcgtaagaataaaaacccttggtaaatacaggaattgtaaatctattcattggcaaagatcccaaactcaggttatgattttgcttgttatgtgcagcagtctctcctctgaattcagaaaagcacacagtgaagaagaatagctgctttctagcattctgccaaaaggatctacaggaacctcagagtgatgggcatttatattatatccagagatctgaggaaagaaaaggtattaacaccaaaagacaaattcctggaaggctgaaggaataacac

SEQ ID NO: 98392 - DNA, 1054 bp, Homo sapiens
tttatggaatcatttctacttaaagtacccttagcataggcagaaggcctccagccaggctaggtgatcgcgagaagatcgcagtgttaacacctgtctaaaggaaaccagctagccgttagtagtgctcaaattgcaaaagaaaatcttgttatcaaagaaaaacttacagagagggtataatattatttctgctatctctgttaaaaggaccagttgttaatcactcaaaagcatttgcccattaaatgaattagccatttacttatgaagaaccatcagaagtcagaatatccctttgtcacttgacaagttttatattctgactttgagagggaggtggttttgtttgagtatttcatctttgttgacagcagactgtcagaataacaactttgcaagtatattatgcatagtccctatttgacttaagcaggatacagattgaaaagttcaaagaagtctggggagtttgtcttacccagccctcttcaccggttgattggatgtggttatacggcctcactgtggtctggcaagaccctggaaacccagggcaggggtctttgaagactgaaggtggtcatggttattaacccagtgataaatgaacatcagtgcatacttccgaggcttcctctcatcgtactcttcttggagagcagatcttttttcttttgatgtctccatgtttaaaacaatagtgagagtgcaggcatacaagcaagcatgctttggggaatgaagaaaggaggtattccatggagttgcttcaacccctggttctcctcagtcctgaaaacctgctttgctaattctcatggccacacaaaactgctagctttgacatcaagcaaaccggttgacagaattggaaaggacgaatctgatggctgctagtcccccagcagggctgctgctaagccacaatatgcttttgtgtgaattagaaaaagtaccctttgcgtggggcagcttccctgtgcttgaggagcagagccagattcagcccctctcagcctgtagctggacaccctgtgctcaaaaccttatg

SEQ ID NO: 98393 - DNA, 1125 bp, Homo sapiens
aaggaagtaaagttagagatgggggtactgagctggaggtgcaggataacgaggcgaggaatgggacaaagggaatattatgaagtagcaggatttagtgaaaggaagcatataaaaatggacataagggccaggtgcggtggctcacgcccctaatcctagcactttgggaggcctaggcaggtggatcacctgaggtcaggagttcgagaccagcctgaccaacacccgtctctactaaaagtacaaaaattagctgggcgtgtggcgcgtgcctgtagtcccagctactcaggaggctgaggcaggagaatcgcttgaccccaggaggcggaggttgcagtgcgccgagattgcgtcactgcactccagcctgggtgacagagtgagacaccgtctcaaaaacaataaaaattaaaaaaaatggacatatggtttattcattgggaagagcacctagtgttggcatgagtgtaaaaatgttcttagcagccaagtcattgcagacctttctctcctactctgtgttctggtcttcatatatttttctttctcacaaattctaccattatgatcatagttgtattcatcttcttgagtcagctaaataatccttatattttgatgaaaagtaaccttcacttccaatattaaaaaaaaaactatgctcattctcagcaaaaatcaatttttaaaaatcttaatagtttctatgtaaaaaaagaaggattttctacatttcttcttaattacttctgagaagagataaaaaacctttcattgaaatggtgctttgtgctaagtaaacagacttttcaaatttgaaaatccatataaaggtacgtccacatttatgttattatgagtgagtcatattggtgaagtcaggacaatggcctgtcattagatctttgattcttgtttgcagtgaagggagatgtgaagaagccatgttctctgaacgtgctgcttggaggactctctctatagactgaagttgctgtcacctaaaccatgggtggtgataagcattctctagattttgtcccgaacaatataacaggatacgtttcaggtggaaaagtaatacaagtgtgcaatttgcttagcattttacattttctt

SEQ ID NO: 98394 - DNA, 1040 bp, Homo sapiens
aagaactcattaccgatagtagtggggttgattgtagctattactgttgttgttgatattagtgatgactgagtgataaaacagctttgtaaaccagaaacaagccagttagccaaagttaactaccacaaaacagcaagaagctttttccctctcgctcccagtggttgatcaatgggatgtggggtgatgacacctgtggatacaagttgtggaggataaaccagacatgcaagcattagcccatagaagttggcaataaggcagaaagatcatggctttcctcccacaacatagaaagcagttaccttgcatccacagaagcattttgcctgtaaaaccttcctcagagacatgcacggaaagtaggtgctacaagaaagagaaacagataaaaggggaggtagagacagggatggagggtggggagaatatgaattaatttggattaaatggatgagaatcagaagtatttatttggaattggtgtgaattggagcacatggggaactgaaaacaaaggtgataatttatgtggtgtagatgaactaagaataatgaaaacagcatgaaggatggaatcaaattaagtgcaaacatataaaggaaatggactggtaaaagctcgagggcaaaggtgtatggagatgggaattcaggttggaaagaggctgctgatacaaggactggagttgggagagctgctgaccaaatgtggaaatgaagattttttaaaaatgggcgctggttggattcaggcaagctattttaacccaggactcactttaattcagtcaaaatatttcttatcttccagttggggaggtgttttgggacaggaaaaaaagggagataagaataccatcccagagaaagaagagaagtatttgcattttgttctctagagttgcagatatatgctgtatctcttctatatggtaatacattgcaaaggagatacagtgaagaaatgaagtaaaataaaatgtgtgtgtcttcctctcatatgcataaaggaagacaatacatgttggtaacat

SEQ ID NO: 98395 - DNA, 1021 bp, Homo sapiens
aagttcgaatatataatatatgacagaggaaatcactgttatgaaccttagagttattcccatgggaggatgaagactgacattgcttccttgcacaccaggacttgggcctgtactgctctaattctgaacttaatttcctgtgtggctcttgcttggttcatgggacggtctcctaacataatgtttatatcccgtggctcaggcatagagacccactcatggtttcccatcagaatttgggttccagttcaccactccacatacacacaccaaggctaatgattcatgctattgtcagtttttgcttctttgatattgttctgaaggtagtttttattgatacttctttctttctaaagtcaatgagtaaagttatggcaagacattggaaagacattgcagtgctcccaggctggagtgcatgactcatctcctggcccctccaggaaaccggagaaggcagaaaagggcaagaatgttgtgttgtctttgggctgtggagttcatgattatggacactttctgaattattggcactaagggcacatcctgcttagcatggaggctggacagctctgggaaagcagagattctttttagggagtccagagcatttttttcttctttcttatcccctctttccaatagagatgtcagaagggtgactgttagggttgatacattatgtggtgctctgtttttttgagcattgtctactcagagtgattaccaaggtggagctcattatgttacctggcacctgcaactacttgcctcatgttggactaaagtggaaagactcctattgggaattcactcagggaggcaccaggcattgttagaaaagcagtatcgcagagcacttaagagctgagccttgtgatcgggtggacttgggtttatgtcctcgcactgtcgcttcctagatttatgacctcagtttcctcatttctaaagtagagacaattgtgtctacctcctagattgttttgaatattaaatgagcagatacttgtaa

SEQ ID NO: 98396 - DNA, 1057 bp, Homo sapiens
cttttgcctctgctttcatttgaaacagaaggctcagactggcagctgtgggccctttgcttgtctcacgcactctaactttttaatactcattgccaacattgaaacaattggagagattccacataaaccccaaaagatttgggcttcctttaaaaacacttgccaactctggacctctgttttctacatgatatcgatgagctggtgctatgtaccaacttccccttttagatggcatgtgctatccagtttaccacagtccccacccctcattattgtcatattccttgactgtttcactaatgtatgttatgctcctagtccctgaatgtgtttgagtttgattcctaacctagatttatgggaagatgtgttaccttttagaggaaagcatcctcagaaatagcatctacctactgcagcaccctaaggacaagtatgtggtcttgtatcatgggaccttgtctaggagactgagcagaaactgcagtccagagtctgaaattgagatacctggagcatggcactgctataagcagagggatcagagtagggaattccattttcctcataccctggttccctaagcaaacaagatttggtcatgagaaatttattatattcacggaggattttcataccattgggaaggatatatatatagtccattttatatatctctatatatatactaatacttttggtttcttgataaagaaaccagagactgaagatgagatgacttgaggaaacgcatagagctaattatgtagaaggagcaggcagaagtcatcctgacttttgtctgtgttctctccatgactccacattgtcttttattttacatacttacaaaaagtctcaaagttgaaggatttggtgtccaagacggatcaggtaccctttacaatgagatacttaattgcctgcttttaacagagatggtcttctaccagcatacatttctgaatcacaatagtcttcctcacccactggcccacccttctttttagtctgttactaacaggtgattatagacacaactactttaatg

SEQ ID NO: 98397 - DNA, 1051 bp, Homo sapiens
acatctgacataatgaaggaatatttctactcatcttcccaaaaatattcttctcaaaaacttttcctgaaagtttacagttaccactcaaaaggaatctaaaatggaacagacattgagaacacttacaactgacacctgtatttcatttatgattagtctctttttgggtttgataacttcccatccatgtatctacctgtaattttcatcttgctaagcaaaaaagttgtcatactttatatagtaggtatattgccagtgttgaatagatgtattattgtttaaaggttcattaaaagaaactctcaacttctttcttagtgtatttgtagtatttcttccattggaaaaaaatgagtgaagaataggaaaagttattgggtctttccatgttacatattaaatcatgtcaaataagagattttgactgagcctgccagtaaggtcttaatgatacgttactgcacagtatttcctaacaaagtctgtatacatgtaagcagcaggtagttatggtcatcagtggtggcaattcgtttttacaatatagatacgagagttccattccttaagttctgccccagaacggactggtgagttgtcactgtccctgttgacaaatgtgaataataactaaaaatacttcaggctgcatttgtctgattctggcttggtatgtggctaaaggggaaaaaaacctttctgggaagtgtgatgcttctttaacagcaaatggattgaattgatgcaagtctgatgtgcaacagggggtacttaaccttctatctagaatcaaacgccagaattggagaagctgaagccaaccacgacttcataaagataagacatttacttgatctgcatgactggaggaaggatttggggactaagatgtgtttgaaaacttagttggtttacttttaatgtcagcagatttgctgccctgaaatgacagatatggaagctgcttggggatagtggcaggatgaccgaaagaccagcacagatcttcaaagaaaggggaagactgagccaccctgtgttcatt

SEQ ID NO: 98398 - DNA, 1016 bp, Homo sapiens
gtcagccgggatggatcatcagagatttcttggactactaacagtgctgccagtagagcagatatgggcaagcctgggatatgggcccaggaggcccctttctctatgttagtctggcacccctgctgaacctcagcagtgataagtgctagaaaaatgtatggctagtctagaagacaaaggcagagcctcctggagagagagtgacagcgctgagtgggggtgttgcttttaacagatttttaattttttctcctcagaaaattattgaagatcatctccaaaaagaaaacacaccagtttcttattattgactatgaaatcaacatgactgggtgggactggggaaaagacagatttatcagtccctaagagctgatggaaactgcatcctttaggtggaacacagagttggctgtaaggagacattcctttgtttttgttgtcttgaacaaaaggaaggacagtagatgacacaggtaatgactgggtatatcatatattaagggcaccaagaatttagagaatggggaatcaggtgagggtggaggggtgataggagatccctgcccccaaagcagatgttggcaaaggaaaagtcagagagcaggagtcataaagatggccccggggagtcagcctggtaatgtcagtgagtgaggaaggcacagtataaggcactagagagtggtgggaactgtggtgacatagaaagtatagaccctatctgaaggggcagttgccattcatctccagccaaatactgctcaagagagttgcagaacctgtcgccagatcttttggtttttcaagagaagctagaaatctgaatttttatttgaagtcccctgattttaaaaaaatatgggcaaaatgaaagtagtatatatgtcaaaaaaccattgtgggctggatctgatcactaggctaccaggatttttgctcattactatctttttgggttgagtagctttgtctttatacatccattcaaagcaaaagcttgcatgtagaat

SEQ ID NO: 98399 - DNA, 2499 bp, Homo sapiens
ggggtgtttttaaaaagtgttttcttttatattggctttcttacattactaaggatatcatttaggttgaccagatggtgatttttagggtcattcttttcctgattaaaaaaagccatttaaaaaaattacttgctgctgggtgttcctccatttttccaatctccgattacttttttttctttttaaaaaattttgagtgccaaataaaggcccaagattattactattttgtgtgtgtgtgtgtgtgtgtgtgtgtgtaaaatttttcaaaaccaatgactatttgactgtgtgaattagctactattaaaatatttctgaaaaatatttctaaaaaggaagagagagaaaaagaaagggaaaggcagacattatgtggtcatagaatgtccttgcacagttttccctgcaaaagagaaccagaatgcaaaccagttgtcctcctacccaagatgcgcctgcctttttcctccagcttttgcacccaggagctcttttttatgccccatatttatagagactaggacttcacaaataccagaacttgaggagtattagacatctctttccgatccctcccccctgccctcctcaatttgcggataactggcctgagcttcagagatcattatttaagcccaagccagtattggaccctcaagaattgtgagcctccttgcaatattttaaacatattcacatgttaacacaaggcatggtgcaacatggctgagggaactgcttctcgaagggtgggctgagttccacagggcttcataagcgcagtgttgataacacagaattacctcgggaggcagttttattcccattgctgttttctttcagtccttttaactcaaggagacagtcagctttgaggtgccatgtctttaacgcctctctaaggcttggtaaactctcctcacccctccttttcaccctccctccctcccttcctttcttcctttttttttttttttttttaataaagagaacaggtcttacactcagagcttttgacaggcaaacctccagttgaaagtttgtaatattgttttgattttgttgtttttaattttatgattatcttctattaatgaacatttgcaggaaaagaatttaaaacacatgcagccttaatatataatgccttagtgaggcaagtaaaaatgaaaacaataggggaatgattgtacagatggaatgctgatttggtaaaaatccgtgaaggtgaaatgaaattgaagtttgaaaaataccggtgtcgtggaaaattcaagggatttggcatcagaaaacctggaatttagtcctgactttatcagtataaaacaaagcaaattattaaattatatttcccatatgaagtgcagggcttatgatagtaggattgctctaatcaaatgctatatggatgtgagagtgctttgtaaactgttacatgctgtacggtgtaattgttttctattctgcagtgggggaggcttttgtttcaagccttaaactatcgcttcttgttggctttcttcctctttatgatttctattcagttttccgagcaggaacttagtgactttttatttgttccagtggggctgttacttgaaccttaattgtggtactttgaaaaatttcctactggttgtctaaatggggacgtaaaactttgtaatttatttcgtgtgtattcatgtgtgtttgctttaagctaaattttgcaaagtaaacttagtctgtggaatacagtattgtataactattggatagatataatatgcttctctttagtttttaaaatacattcttaacaattgtattttaccacattcatgaaacaatcatgtgcatttgtatatgtctgtatgtgtgtgtggttgtgggggagggtggtagtggtattcagggatgaaggaagtctgggttttgggtaaaactgagaattctggggactatttgcttctgaaagtagacatctgtgtggctacagtgactcattaacaatacactgtcacatgttgttagataataagaagacggggacttacctggataggaagtcctggacttacctatatgtctacgtccatggaagcctcctagtttatggcacactggggtcagaatgacagagcagtatgttgctcttggagatgcagactcttgtcctagcccaggataaagttggtagaaggttactgcagcttggaaggaaggttgaactcagacccgaggaccacattgactgtgttggccaagcccctgtgaactcttcaaatgaatatgttgagatttacatcctgcttaagacaggtgccatactgacaaggattggggagcccaggtgtcaggtacaaagctgcactctcatactgccttacctagagtactggttgaaatgaaggcatatctgcagctctgtctgtgagaggctctcccgatgtcttcctgttgccaaaactgtggcaggagtgccttatcaacagtggacagcaccac

SEQ ID NO: 98400 - DNA, 1530 bp, Homo sapiens
gccagaaagaaggaaagaaagaaagaaacattcagttctgtgttggaacactgacctgtgcctatctgtattacccacatagttccaaccttgtttataaaacatacttgagatttactaagttctgttgtgaaaaagctttcagccaatgtcatgttgtgggctggatacttttagggcagatgagtatacaatgtgaatacacatatccataatggccaggaaacagtgcccatgtctgtgccattcggaaatgattagaggtaattaaaataacgtagagccatatgcgatatctatttttgaatgtgggtgtattgacatttcctgagggtcattttgaaagtcaggttctcagccttgtaccaaagcgaggaacatagaatctcagaatttcaaatcttgaaagggtcttggtttcctcaactctaaaatactgggttgaactaagtgattgttaaagccagatgaggcattgcactctccaaggtcacacagcttattaacactgatggtttcagggcccaggactctcagatgcccagaccagtttacttgctttctgtcacctgaatataccttgactcacttctgattcttttctctttcttttttgccttcaaaggaggcaagaaaattccctttttacttttaagactactggttcatggaattttgggattggctaggttctagaacaagttatcgaatattttggagaaggcttacttgtgtaatttgattctttttccacttttaatgtgtgctaaattggaaaatatacactgtaccgaaaaaatagccccagattataactcgagtcttataaaaattattgtcatttaaataataacaaatggagtgggagtatgaagggtgtgcagtggggcatatgtggtagggggttggatggaatatagaactagatggaagtagaaagcaacaaacgtgaaattgctttgtttctggcacctcaccaacaaagagagtgcccgaaactttaccagcaacccatgtaccagttgatgaaaatctttttaaatgtttttaaattcttgagagggttgtaataagcagtagtgaagaaactcaacctctgagaggtttttcaaaaagtcttttgaggtctgatggatgaagtaggcctaatttttaccattgtccctaatgaggaaaggaaaatggaaggctcacttgacttttttgccccagtttttccccagttactttttgcccttccctacctccttgaattggtagttatgatggtgaaagttctctcccagaatgtgtctcacagatctctttcacctctaacatcttagaggttaaaatctccttcccagttcagggcttcttcatctcctcacagctatactctacatctccacctccagatatttccctgggtttcaggccctcatttttttctaaccagaaataagcaacaagcaagatgggctttggggttgttctaccatcacttcagctgaatatgtcctaaacccctaactcatcaacttcttccac

SEQ ID NO: 98401 - DNA, 1036 bp, Homo sapiens
cacaaaggagccttgctagccacactgaaaggataaaataactgtttttttttggtatgtgatttgtgtgttcttcagttactgtaaatctgtttctttatttgaaacagcaacttggtagatgaaataaaaatataactgcccgttacccagaatttatctttatgaagatgcaatcactaaatagatgtaactctacaaatgaaagcacatgtgactgcaatcaatcacacacttagcctttaatagattcatttccatgttcctttaacagacacatctttgtgtagatttaggggcttcaaacattatcattcagtctacctgtttgcagtttggtattttaaagtgggcaaacattataatgcagttattttttactacatctgtccttagtagggggaaaaggaggtcactattctttgttctccatgaacttcccacccccactccttaccctgaggagaatgggatgttggggtcccatccatttaaaaggcagagcagaagatgcaagatgacagccttgccctgaaatgatttatgtatgggtgtgtcagagaccttaagcatccaaatgtgggctgcttctttctgccagcccattctaaacataaatgccagtgggggctaatttgcctctctacttaaatggagatagttcagagagggtcctaatggggcctttaatagccattcttttatgaatcttcacattgtactctcttcagagaattcttgcgttttaacttttggagtacaagaagacattgcaatcttctttaattgctctctgtgcctgttgaggaaagaagaatacaatttcctctggccagtcccatctggctcaagttgataggatagctggtctgattccagacggggtcggtggataccccttatcttttcattttatagtattgtgcaatgggcttttaattatctttgctggaccccacgactggcaaatgcagaaaatcgctctgtgattccagttcactcgatatatcagttagcctatgtgttagaactgcga

SEQ ID NO: 98402 - DNA, 1475 bp, Homo sapiens
ttaaccctctccaactgccagccactctcaccttaaaacccttagccaacttattcagcgtcatgcttatagccaatgctgatgcatagcttgtggggaagcactaataaacaatatatcactccagtgagctttatgttctggactccgtaatcacaactgctctatataaaggcgactaggaccataggtttacactgatgacaaaacctttaacctctagcccttccttcttccccctcccaaaaccgtcttgctgcttctgagtataaggggtggtgatggtgatatgcaactgttagttccaaatcaactatcggataatgaaattttgagactcttttgctcaaaacagctcaacagggtttctgcaaagaaccccagacaggaagaagtttctttatgctctggggtaatcagattttagaggtcaaatgaggagtaattattagatgttcttcttaaagtgaacaatgtacctgggctcatggagatgagcaaaatgtggagactctgataatctgacttggtttctagagaaagagtggcttcgatgataaactcaagaacatttttacgtttgaaaattgaagataaacaatttggggattttattttaaacttaggatatgggataattgtcctgcttaatagtcagtgagcctgtgacaaagtcactgactgtggcagggctccctctcgtcacggagatcctcgttttgacattggattttctggcaatgatgccttagccacatagctccaagtctgaaaataatcgttgctggtataattctgaaatccaaatggacatcacacattaacagctctccattcctgggctctgactgcatacttaagcactcggcccaagtaacatcatctttctgcctgtcatataactgtaaattacactgtgcttatgtggtctattattttatagaattcagctgacgcgcaattcttaagactaccagccttaagcgctttgaaaacttgtaggaaaatttccaagagctgtctgagcaaaagtaggaaaaggtcaagggtaggacagaaaccagagtttcttatggggtaccacttgattatgagtaaagggaaactcattcatgactttttttgccaatagaaatcataatctttttttttagacacactgctgacttggaaaataaaaagaatttgatacaatgcttttattttcttcttgaatatacaaagacttttagaacttttatatgttttatctctagtctgctatttcatgagtgcaggtcaagcagtgatgatctaagtcttatttggacttagctttgcgtcgtgtcattgaggagcatcgcatgtttgcttgaaaagtcttatggaattatgtttgttgttaatgctgattcataattggcagatggggtcagtttcaggcctctctttgctcagagaaaattttccactgctactggaaacaaataaataaa

SEQ ID NO: 98403 - DNA, 1114 bp, Homo sapiens
gagaaaaaaatgcaacctcccaaaataaagagcaaagattgcattaggagcgaacagcgctgcagaaatagatggcagcttcgtgtcagtgagtttgcatcccccttcctgatccacgagctggagtgattagagccctggaagggaattgttactcccgtggagaagtccccttttcctggcagtcgtctgcactgtacacgctggatgcctctctccatccaccccactcactcgctcctctctcacctcctctctccctctcctgcattgatttttttttttcctttttagttgactgaaacaaaacaaaacaaaagggccactggatgtctgccttcttggggggtgagccagacagactgacaaacaaacagccccaactgtgttcgggggagggtttcgcctcccgttttgcccggcagcagcagcatggacgtgttggctagttatagtatattccaggagctacaacttgtccacgacaccggctacttctcagctttaccatccctggaggagacctggcagcaggtgaatgatttaaattacttgtgtaaatcgtgtggtggcggcggagacgcaggggctgcgttggtgtgggctctgggttgaaatttttgtttgtttgtttgacttttttttcttcctttttggctgtctgttgttgaaaatgttttctgaaacagtcatctgcgcttacctctccacccacccctaacctcgtagagtgccgagctgagcagccggtgcgagctgcctgcgtttcagtcgccaacacacatccctgcgcacacgttgtcgggtttgctgtcccctatcagagacctgccgaacttctggggttcggaggagccgggtgggaaggtggtttggggtgttaggagcgattgctgacagggaccacgttctcgcatgcatgagctctacccacttgatacctgaaatcaggttcatctgtttcaactggtgcttatgaccatcggatggggggcgggggagggtgggcaggagcaaagcggagtgtttttcagtaattagcgagtgtcaataaagaataggagcttgattttgagattagaaggtaggcaaaagagagaagagcccactgaca

SEQ ID NO: 98404 - DNA, 1047 bp, Homo sapiens
taaagagcctgaagaaacttagacacctgatccataaaaatggcacctttttctactttctgaaactcatattcttgattaggtctcattattagaaattttgggttcttcatagagaagtagctttatttctctctcattctaagacatttggttttgtttgtttggatacagtatggttatggggttatagtaaaaccaagtatgtcttcctcacgtgtttttaaattctactttttataacagaaaattatttttaacctaatgcttacaatatattaccgaaatttataatttcatttattccataaatagcttatcagatatgagttacataaacttgtttacagccagcttgtgacatagttttgcaaatatcttgatatatggtgtaactttgatggcttctttattgaatagagctcaaatctaaatttaagaatgtaatgagatgtcaagatggaaaaatgcaggatttttttttttcttacccatgtgtaaactcatctgtactgcagtatcacttgagacagcagtttatggtaattcaaatatttatttggcactcactgtgacagagaatgtagttgaaagagcatgaggtttggaatcataggcctaggtctgaatccaagcattgccactgctatcctgtacccaccctaaaggaattttgtgtcctgaaggaagtttcttaatctttctcagcctcagtttccttatatgtaaaattagaatactactacttatttcataagattgcgagataaacataaagtaccttagggctacaactaatgatagctagtcccttaagctttattttaacttcctacctgtgggcccttaggcaagttatcttaacttcttaatacctcactttcctttctgatcagtgtagaacaactacctcagaattgtgggggttaactataaagtaatacatactaagtcccaggcattgtgcaagtgtcaagtgctcaagtgttgacaaggcttttttcttttgttttaatttttttttgagacggagtcttgctctgttgc

SEQ ID NO: 98405 - DNA, 1036 bp, Homo sapiens
ttatttgtcctttaagaggtgttttatgcaaacacgagcaaatatgtatgtacagtctccccctttttgtacaaatggtagcatactaggtatacgctctcctatatcatgctttacccccaccacttaatatggcttagcaattttgtatcagcacataaagagcttcttcattttttaacatacaattggaagcattttattatgtaagtagactgtattaaccagttagtgagctgcttttattcttaggtcttatattaccttttaaactaagggaaactgccatcttgcctttatttctttaaatgaaaaactttctatttgaatgaaaaataaatagtttgtgacaggaaattgttatttaaagtccctcatttcctgtttaactccagtttttaaaagttttagtaaaatgatcaaaatgtacatgaggaggcaagcaagccaggttaagagttaactcacaaggtgaatttaactcttttgttgaggttcttacagttctgaacagactacttctttcaattattattttggcccaaaaggtttttatagctttctttcttaatgagaaagaacatttcatatagtccggtgtttttttgggttttttttaacagacagctcatgggatattattacccagtaaggctgattactatactagatttctccctgcattcatttattttttacatacttgttaacttaccttgacgattttctagtatttcttaatgtaattatgtgagttttatattttgtacctaaatttaaaaatagtgagattcacctatatgattgctgagatgataaactttactgcatagatgatttttttacccccgtggggaaacctttggtcaaccagttggaccaagtaatacgtatttcagccaaagcacaaaatgcgtttcactaccttttttttttcctctagcttttcgaaacagcattgagctacaatacttttttatttatttatttatttatttatttttatttatttatttttttgaggcaaggtttggct

SEQ ID NO: 98406 - DNA, 2182 bp, Homo sapiens
gcctgtagtcccagctgcttgggaggctgaggcaggagaattgcttgagccctggaagtggaggttgcagtgagccagtatcaccccactgaactccactctgggtgacagagcaagatgccatctcataaataaaatattactgtgtgctatttgtacctgctaaatgattaaaatgtttacaaagtgctttgttgttgttgttgttgttgagacggagtctttctctgttgccaggctggagtgcagtggtgcgatctcagctcactgcaacctccgcctcctgggttaaagcgattcccctgcctcagcctcccaagtagctgggattacaggcgcctgccaccatgcccagctaaagagacagggtttcaccatgttggccaggatggtctcgatctccttgacctcgtgatccacccacctctgcctcccaaagtggtgggattacaggcgtgagccactgcgcctggcctacaaagtgcttgtctttacatatttggggatgggggtggggtagatcattgaaatctgtaaaggcagaacgttttttatctggaacatatctgtagactaacagagttaaatgatttcccacagtgtcatggaatcatcagtggattgcctcttggggtggaggcaaagatcattaaagcagcaaactgataatgtgaacgtggttgttttttctctgccaattaaatatatgctagtttagtcattatagaagagccagatgctggtcagcttgttgaagttgtaagtagaaggtgtggttttatcacatctgtaaatgtaggtttttgagacaaaacttaaataagaatagacgttagtttttattcacattcagaatgtctgactccccttaatatatacacactcttgtcttatctactgggtttttttgttgttgttttttgttttgccttttctctctctctttttaagctctgccagacaaggccctatgaagataggttttacaggttgagaatcttttatctgaaattcttgggaccagaagtatttccagttttgggttttttcagattttagaatatttgcatatacatacataatgagctatcttggggatgggacccaagtctaaacatgaaatttgtttcatatacacattatacacatagcctgaaggtaattttatacaaaatttttaataattttgtgcatgaaacagttttgactgtgaactgttacatgaggtcaggtgtgggaatttttcatggcatcatgtcagtgctcaaaaagtttgagattttggatgttttattagggatgcttaccctgtattatattttgcccagatgtttcctcatttgtcttctaggctaccagaaagatgttagcttagaaaaacgtattctggcgtttattccaacagatgagaaggcagtttctccagtgatgaataattacctataatttaatacgtgcattatacatctccagtgatgaaaaatcactgtgtattaaaaaattcttgaagctaggtacataatctcaactcctaaaaaagaaaataaacagtagtactccttgatgaacttacagatgctaagttgccttttcttagagttgaaataaggtgataaaggagtttaccgtgagactagctgtgtgaacaaagatgaaaaacaccctttcagttttcttcctcttggatgattctaggatctctaaaaaataatcttaaaaggggcgaggttttgagaggatgaggtctaaggaattgatggtgagttttttctgaaagaagagaagtgacatttgattagataagaaagggttaaaagggaagttattaataaaatagtttaggagtagagtggatctgaaagttgacttataccaatgatgatagaatgtgtcttttcccaaaggttagtgcatcttctctgaaatgaagacgtttctttcatcaattttaagtgaatttctaaggatctggttatctacttgtgagtttttggttgtaactgtatgacagtacagatgtaactaaaaatgtttgtaatttacccaaggttaaataaccattatttttgagggctgttatccctgttggtataagtaagtagttggcagtaggggacacagaaataccttgtttttcaccactgaagtgaaaattacagattattctgaattatttgtactc

SEQ ID NO: 98407 - DNA, 2105 bp, Homo sapiens
cctgcttcagcctcctgagtagctgggactacaggggcccgccaccacgcctggctaattttttgtatttttagtagagacagagtttcactgtggtctcgatcttctgacctcatgatctgcccgccttggcctcccaaagtgctgggattacaggcgtgagccactgcccggccaaaatttttctttttaagcaatattagtttaggcttgtaagtagctcacttagggtaaatattctagccaagatcatgaaaaaatacattgatttcattatgttcttaatcagatctgcatcagattaccataaataggcagctattctttctttttttccacagttcattgtattcctaccatttccaaatagaagtttatggttttaaattactgatgttaagtacttgtttggaaggaatttatagttaaactagttataataatttatacctgtcaagctctttcatatatagtacatattttatctctcattagtttctgtaagctcttgagagaaaggttcttttttatttccaccttttaagttcaggggtacatgtgcaggatgtgcaggtttgttacataggtaatcgtgtgccatggtggtttgctgcacacatcatcccatcacccaggtattaagcccagcattcaccagctgttcttcctgatgctcttcctcctcccacccccaaccctctgacaggccccagtgtgtgttgtccccccaaccaccgatgtgtccatgtgttctcatcatgtacctcccacttacaaatgagaacatgcggtatttggttttctgttcctgtattagtttgctgaggataaaggcctccagctccatctatgttcatgcaaaggacatgatcttgttctttatggctgcatagtatttcatggtgtgtatgtaccacattttctttagtctgtcattgatgggcatttaggttgattgcatgtcttcgctattgtgaatagtgctgcagttaacatatgcgtgcatgtattgttataatagaatgatttatattcctttgggtatatatccagtaaggggattgctgggtcaaatggtatttctgcctctaggtttttgaggtattgccacactgtcttccacaatggttgaactaacaccaccaacaatgtagaagcattccagagaaaggttcttttatttttgttttgttttgttcgagacagtctcactctgttgcccagactggagtgcagtggcatgatctcggctcactgcaacctctgtctcctgggttcaagtgattctcctgcctcagcctcctgagtagctgggactccagtcatgtgccaccatgcccggctaatttttgtatttttagtagagatgaggtttcactatgttggccagctggtcacgaacttctcacctcaagtgatccacccgccttggcctcccaaagtgctgggattacagacgtgagccactccgcctggcctaattccagagaaaggttcttatatgttttatgctatagtcccatagtatgggactactactatgtagtaattttcagttctgctgaaaatgctgtagtcgttactacgtagtaggcgcagaatatttgtttaatgagtgattctctattaaagggtcataaatttgaaaggtaaaggttaagaacaatttctctttagagttgtacagattaaaggaagtgaactttttttttttttttttgtgagatggagtttcgctctttctgcccaggctagagtgcaatggcgcaatctcggctcactgcaacctctgcctcctaggttcaagcgattctcctgcctcagcctcccgagtagctgggattacaggcgtgcgccaccacgcctggctaattttgtatttttttagtagagacaaggtttctccatgttggccaggctggtcttgaactcccgacctcaggtgatctgcccgccttggcctcccaaagtcttgggattacaggcatgagccaccgcacctggccaaacatatttttctttaactgaggaaattagattcattgtccaaagcttaaaaggaagattttctactttgagtttttattaactctgatactttacta

SEQ ID NO: 98408 - DNA, 1026 bp, Homo sapiens
gcaagaggattgcttgaacctgggaggcggaggttgcagtgagccgagatcgagccattgcactccagcctgggcaacaagagcgaaactccgtctcaaaaaaaaaaaaaaaaaaaaaaaaattaagaaggctatcctctaccctaaaaaggattggtaggctgcttgaatgaaatgataataaaacaccagttgtttaaatggggctcctatacacactttgttttaaaaagaaatatcgagttgtggagggaagaggatgaaaaacattttgagtatgtctttgtaactaaaatttacttggattcactaatggctttgttcctttattgtaatggagtaatattttctaaaacaaaaagttgtaatggtgttctataccttaaatgtcaaaaaagattaagtagtctcaatgtgttgtaaataaaaatgaaagaaatggtcaatctgtgcattagattgtgtttaatcaaatggtagggtaaaactacgcataccagatgacagcatagctttaaaaatgtggcttggaataaagtctttcaaaaatggttgtgtataccctgtctacaaaggaggtatgatacatttgtatttatctttattctagataaaatgatggtttacagggggagaaaatgaagaaaaaattgtgaatgtcttttttttttttttttggtaagacagtcttgctctgtcacccaggctgcagtgcagtggcgcgatctcggcttactacaacctccgcctcccgggttcaagcaattctcctgcctcagcctcccaaatatcccaagtagctgggattacaggcacctgccaccacgcccagctaattttttgtatttttagtagagaccgggtttcaccgtgttggccaagctgatctcgaactcctgatctcaggtgatccacccgcctcggcctccccaagtgctgggattacaggcatgagccaccgcgcccggctgtgaatgtctgctcttaatactttgactcattactgtcattgagtgtattcatttg

SEQ ID NO: 98409 - DNA, 1022 bp, Homo sapiens
gtttaatcttgcacaccttttgcatgcataaacctttacaacaatttgttttacttttttaaaaaaataaatggggctctattttacaatgtgtcaatatattaattttttttcatggttacaattttgtaatggttctcttaatgatggataattgttttcaggggtttttttgctatgatttaaaaaattttacagtgaatactgttgagctacatctctggatattactatcgattatatggtcagtgcacttgtggctttatgaatattttaaataatgtagtcaagtctgttgatctttttccttgtcatctgtgttttgtggattttggtatttccaaactatattcatttctacagagttattttcatttccattttttgaactgtcacttgtaaaacactttctttttatagaaccttatgagtgatagcaagatgtattagtatgtaatacattgtgatggagtgtaatgatcacaaggatcagtgacagttttgatgaccaatttcagagttataaaataaatgaaatatattctggaaaagtcatgggctttttgtgttgtttgtggaatcactaaaggtagtccctcactattaacaaatttgttttgacacataatatgtgaggcactgaattataataggcactagaaacattgcctattttcctgaatcctttagacaggattgcttccccagttaccagagatttctctaaccttgatttacagtagctactgctggtaggaattgctctccactccacttttgctgccatccagtgttacattaccctacaaatatactaagtgcttagcaaagcagagtccaaatgtaagatcaatttttgtcttacccagaattttacaattaaaatatataaataaaagatttctctgtgtgtggatgtatgtgtacagtatagtgttgcatgctatacatggggtgaggtatcagaatgctttttcagtgtttggcacctctaatttggctctgtggccatttattccacc

SEQ ID NO: 98410 - DNA, 1016 bp, Homo sapiens
gctgaggcaggagaatgtcatgaacccgagaccgcaccactgcactccagcctgggtgacagagcgagactccatctcaaaaagtaaataaatacaaataaaaattgaatgtacatgtgccttaacatctagaagatgtacaacaaaaatattaaaagtgattagctatgggtgataggaatataaagggtttttattttattttttatatctgtattttataaatttataatgagaggagccattatataaaattattagtgtagaaaagggattattcattgagttagctaggtatattttccctagagaagactcaggaaagagaacatagtaattgcttcaaatattacaagagcatttatatggaattgagatgagatactctgaataaggttatggttctcaaacttcagtgtacgggaaagtatgattgggttcctgttagagttgactttacagagtatcctgtgtgactctaatgaagctattccatggaccacattttgagaatcaaataaaactaagcaagatttatagtggccagagagaaagtgattaataagtaaggactttattactatccagagatggaagcttctggttttaccctatatgccaaagacactgtctttatagggatcttccccccaggcttcacagtcacatatttcgctgcctgctaaaataaacatctctacaaattcagatgtcagagtagtttcatcatcttccattacaaccccagtcacccaaaagcctatccttacttcttgcattctctttttcaattaaggacagtctgccaattctctttcagacatgaaacattgggtcatctgcagttcctctctcacctcttttaactattcataaagccctttctggactgcttccaaattttcataaaatcacttccctcgttcccatctctactactactaactgccctctttttggccttcatcatctttccttaactacttcatgggctttcttcgttggtctccccacca

SEQ ID NO: 98411 - DNA, 1736 bp, Homo sapiens
gggaaccgagagcagtatagatcattgcaattgagcttattgaaaaaaaagacttgaacgttcattcaagtaggccataaccccagcctcccatttcatattttttgcttcacagtcttcctgtaaggacttaaaaagacttttctccggaacacaggtgagtcctaggtcctagatttggagagaactattattagaaaggaaggtgagaaattattctttatgtctttgtccttttcctctataaacatggaatttcaacacttgaacaaaaacctcagagatcttctgggtctaggccatacttgttacctccccagcccttagtctgttgcttaattctgtttaacatttctcccctcttcctaatggtagtccagcatttacttgaacactttcagagaaaggaagctcaatctcctgaggtaacctgtttacaattaggagtgattgctaaaatattcttctctgtgatgatccaaaatatatcttcctaaaacttttacctagtgatcccgggtaaacacaggttctattctcggaaactagattagcaagtctaattcctgttctattggactgcttcctcttccccatcccccgcacccttcctatttttaagaaaatttccagactaaacaaactatttttctttagccatttattagatggtataactctgtttcctcttcaccatcctggttgttttcttctgggtgagcgctgttatgttttctttacatatagtaaccagaactgattaatatttgtagaggggagaagtgctgtctttgtcctggaagcattctattaatgtcctcagtagaatttgtcagccattttatactattgagtcatcgaacttctattaaccacctctacttcattctgtctttgtgcttttggttcactttgacacttaagtgggagcgtgggggaggagaagtaatgtttttgtgtgaaatcatcagttggatcaatttccataagacactgggaatggcatttgttaacaagtaaaagatagtgttgtgcatgtaaagatctaagaacttgatatttctatgaaatcacaatgactgagcaatagtcctttgccttagtttttattccattgagtgctaccttaccattgtccatactgtgccattactaattccctaaccatatgctcctcttagtaatagtgagaaaacttgatttgctagtgaggagacctagattccagacccagtttggacattaataagtcaaatggccttgggcacatctacctttctctttttcacttatagaagatctttctataaagaacacaaaaattacttaagttacagccacaaaatttgctaagattactgttttttattgtaatatgtgttattgttgattgtattcttgattttaatctttattctggggcaacataatttggacatgaagattttatggccattaagtatagaaatattctcttttttttatttgcttgtattcatctttaaggaacacatttgtccattaaggtccattaaggtgagctgtacttctaatttaagagtgtgtatttataaaagaaaagttggacttattgaaccctggattctacaaatagagatacaaatataatatttttttctttaaaaggcctaaactatagaatatctattttaatagttatcttagccagttaatggtgattagtgttaacaactaggaaatagtttttatcaaaa

SEQ ID NO: 98412 - DNA, 1051 bp, Homo sapiens
ctgttataagacacttttgaattttattttgtttgatcaaaagcatttgtgtgaatggtacttttttctctttttcccttttttttttttgcctctcaaagtgctttattcattcagtgatttttttcatttgtatttgtttattaaacctggtgctgcccatttatacccttttccccacccaccttagtttcaaattaaatgtacacattgaaacttctttactgagatagtttcctaatccctgagggaatctgtatcagaaatatgcataaaagtttgaggccaggcacagtggctcatgcctgtattcccagcactttgggaagccaaagtggaaggatcacttgagccatccaggagtttaagaccccatccctatttataaaaataatttaaaaattaagaaatatgcatgaaagtttgacccccatgttattttttagttccagttcaactttgttttgcgtaactctaatttgcattcccatctgtattaaagacaagttctcaagtagcaaactttttaactctgccaaggctgaaacttttgagactaagtagaaggaaggcatttttgactaaggtttttatccactgtgctcaattagcttagtcatcttttttcttcttaagatctttgtggcagatataaagtacaactctttacctacaattctgtacgtgtatgtgtattatcagttgaagcctcataccagatgcttttagttattcaagatatgtgttcgaagacattgatacatgatgtttatttttcttctacttcagcatacctgagggatacaacatactcctgtcagtaacagattcactgttacagagattctcacttgaactaggaagcatgctctttaggaaagaggcctatcagaatctaaaaaggggaaatgaaggttagaaaagtaccagcacccccatagatgtttaatttggtacactcgtctcctccagcagctgaaaattgctagttttaagagattgagccaggcgccgtggctctcgcctgtaatcccagcacgctgggaggcca

SEQ ID NO: 98413 - DNA, 1005 bp, Homo sapiens
ttactagatttatctgttacttattagttcagtgtcccagatagtaaaatcttattagtgattctgctcttagatagaaaatgtgtatctgtcattttgaacttgaatttttttgtttcagtaaataaaactatgactcatgatgtttccctctttattctggcaactcagattcttagctaactttctgtttaattgtattcttttcttagtctagattttcttctacaattgttttatataactaaggatacatccgttacttgacttctgtctttttatttttgttttaatgaattgtgttttattgaaagctatctcaaatctttttggaataataaagtgtatacataaacattatagagaaaaactgtgttcagtaggattagacttcagtttccaaagtattttcatatacatgacctcatttgatatttacaacaattgtacttagtggctagaacccagatgcttttgtttttagagaagagagaacagaatcaaataacagtttagtgatggctgggcacagtggctcacgtctgtgatcccaacacttggggaggccaaagtgggaggactgcttgaggccaggagttcaagatcagcctgggcaacatagcaaaaccctgtctctacaaaaaaatgtctttagaaaattagtagggcctgatgtcctgtgctagctacttgggaggctgaggcaggaggatcacttgagcccaccagttggaggctacagtgagctgtgatcttgccactgcactccagcctggaagacagaacaagaccctgtctcaaaagaaaaaaattaaaacaaaaaactgttcagtgatggaactcaaactacaacccagtcttgtcatatatggtttactatttctttcttcttcccaccttgaattcactgctctgtagccaagaagaaagtggtatgttaaatacagtaggattcactcattaactctaaatgagaaattgtgatttgtttctgttaaccttctg

SEQ ID NO: 98414 - DNA, 1053 bp, Homo sapiens
ctatgaggccttgagtaaaagtcagctgctctgagcctcaggaaagtgttttgttttttgttgttgttgtttttgttttttcatctgtaaaataagagttgcactgaatctctggaaacaatcttcagaagttcaggattctgtttctctgcttccccccccccccccaaaagaaatttaaatcttctgagatcatcagtttttattattattattattatttttttctagagacatggtctcactgtgttgcccaggctagtcttgaactccgggcctcaagcaatcctcctttctcaggctcccaaagtgttgggatgcctctgcacttgactcagtttttgtttcaaatgaaaacattatattccacaggatcttataccaatatgcaaatctgctgctctttagagaaaaagtagttgttaaattctcgacaaattatagaagttgctttttttggcttttttttttttttttttagttttttttttctgtttatttcaggaatctttatggatagcagttaaccatttttctttggatttgtttgaatatttcaagaatatagttaatgccaggttagaaatttgctgattgaggaaataataataaatttgtttctgaaaatatttttataaataataatgcattttgcctgtgttaggtaatgacagttgtatcctttcaccatggataattgaataatcctgaaacaccaactggagagagtcataacttatttaaagagccctaatgtttacagaatatattctgttattaaacgagtatttgaaaaagatactattttgcttattgatgagagtaaaacaccttttcactttacatgcaggtactcaaaaattgtaaagcaggatgtcagtgaatttgaattctgaacgtcagtttgaagatggtaacatgtttagtatataaatcttttccactcaaaccatacattttaattgatattaataattaatatgaataattttataaagaccttcaaatttttttaagtaacattaggttccttattaggagagcatattatta

SEQ ID NO: 98415 - DNA, 1677 bp, Homo sapiens
atttttcccgtcctcttttgcttgtagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaaagactaaggtggattttaaaaattggaaactgacataatgttaggttataatttctcatttg

SEQ ID NO: 98416 - DNA, 1642 bp, Homo sapiens
cgtttgtaacaaaccattgtcttttttcaaggatgaacagagtttatgaaggagcatcattctaagaattaagtgatgtagtctttatgtttggacagttcaccagattctcaagaaggctttcaaacaactataaagtttgatgtttgtcctgctgagctaatggggaaagttatagcataaaaattgtgtaaccgcatagatatgtcatttttaaaaactggtttaacagaaatcaagcaaagtcacaaatatgttcacaagttggaattatttattgagtcaaaatgtcgaatcgaacattttgaatgaagtaagtgttataaatgaaaaattgcctgatgtttagcagtttgtattctctaaagctttttttcaaaagttcaggctttctacttactgggaagttggtggtcctcttagtccctgataaatcaaggcaatcacattcatgtgagctggatgaatttataagttataaagaccttatccttcataccttgaggatgattgcactggttttgaagtcagttgcttaatgatgaggtgagaaatgtatcctgttgctaaatctgtcttagacccttggtgaaacttgaagatttcagtttataaagataaaatcaagcatcttttgtgcagttttctttttttaatgcaagaatggtggggaggtttgtttgtaagcatgaaactttgagaatctttattaagaaaatgacataatttttaaaaaccttgtagccaagaacatatgtggccacattaccagtaataaatgtttttctctttatattggccaaaagggaataaaaatgtcatcataggaatttgtacatatgctactgatttgcctagaaaatagcaagtttgatattgctcactttgcaaatatagggccatgtggcacttttatctataggacagattaataaaaatgaagtggggaggggtttatttttgatatattactcttatgagttttcaagctttgataatgtttaactgaaaagtggcttagaaagggctagatccaatgtgttcattattaaataattgctatcagatacaattttaagttcattctttttcaaactcaagtaccatattggcaaccataatattgtcataggtgctctcttcatttagatattcttggggggggtggcatttgtataatatatgtgtacatatatatatatatatatatatatacatacagtatataatctaaagctctgagagctcttaagtcaggaatgctgagtattatagtatattgaggtcagatgaaattttacatttttgtgtgttctgttgcattccttctggtagtttctatgactgcattactccagcactcatgattgattttatcttctaattttcttccaagtattttattttttattagttttctttggcttgatacttttaaatatgttactagtcacttgaaagcctctcccccaaaagtatttggtttgtatgctttgtctgtggcagctataacagtggtaagaacattttgaagatagctttttaaaggaaccactgattttttcaaaaatcatcctgggggaggaattttggcatttcatttgagcagggattttgtcagaaaatgtgttttgatggtagg

SEQ ID NO: 98417 - DNA, 1006 bp, Homo sapiens
tgacccagtttgggtattagcaacttaagaaattccctcatcaagtaattctcaactttttagtctttctcctctcttcaaatcatgtgactttttaaatggaagtttttcattgattaaaatattttagcacctaaaagctagccttaaaaacagctgtaaaagaaaaacatcaggaaattagatatgactagcccagttaattaaaagacgggctcaaaccttgttttattctttttcatcttggatgaagattgaagggaaaataactcaagtgcataatatttattttcaatttttaatgagactttatcctcatcacaacattaatactgtacatagtatgccaaaatatccattaatttgtctagaatagtacaagactttttaaagcaattgtcctcacagagaccacatgtaatatactgaaatatgttcatttttaatggctttgttaacatcaaagaaatgctgcctaaatttgatttcagatgaggaaggagaaagtaaagtgtgcatagtaaggctgtaggtgaagagttgtgagataaatagttcactcagttgtacaaagcacaactagaactttttgttgggaggcttacatacatcttgaatattcttaatgtaataatgttgactattaagttggctacacagtcactgtatgtactaggaactggtttccttgacattctagaatcaatggctaggagaggcattaatctttgaggggctgaacatatcatgaagctgagtcagtatggaaaattttcaaataaacagggtgctgaagttccatctgtctcatctgcttatgataagttcttattgattagtgaatgtagcttaagcctttgtatgtgtcctcagggggcagaccgactttaagagggaccagataacgtttgaatggagggattatatttcaggtgttttagcttgaaatttattttttaaaaaaagaaaaatttaaaaaatatataaataaaatagaacaaagccg

SEQ ID NO: 98418 - DNA, 1059 bp, Homo sapiens
gttgatattataaacaggcagttttagcacagaaagaaaatactgacctgtctgcattctggtacggtgggtgcaggtcccagctgggtatgacatgatacatttttaattattctcaccagcaagtaaaaggaaaatgaacaatcttttggaattgtctttgaaaaggatcaaagagtaggaaattcacatttgacctaacattacttgcctatagaagtatggcatttccaagcttttgtctgaggagcatctcagagaagtgagagtaaatctgagttagcttaaaaattggtagggaggaagaaaatctctgcaaataatgattttatgtttgttggccaagtgaaatgatctatcattgtgtttgggaggttttattttcttatgtttttaaaattggtaaatgctttatagatgtatttttatccaagtgccactccaatttgtgtatgtaataaaattatttatattaaaagtgggaaataattgtcaacattttttttgagtatagatttattaggggtggcaaagaagagtgctagttagcagttttccatgtaaagttgtccttgactgatttgtccacatgtcagttgtaactcccccactccctgcaaaaggaattatttctaacccagatgtatcacttgaaactttttagaagcaaaataatcagggaagttcctagaaaggtgtttggctttttggtttttgagggttggggtaaagaagacttcccccacaactgtcagcacaaaacagggtattgatttttaactctgatgtttctattggagttgaatactaaataaataactataatgagggaaatacatttctaataaaattccctacattctagaaacatccctgttttaatttttttatctaaatctttttgtgctttatgtgtaaagaaaaaaatgtactgagttacaatgcattttattaacactatgtacataatagctgctttgtgttcagaatagtagcagttgctttgtatattaaagtgatccttgtgaatttgtgaaatattgtcataaagtgcttttt

SEQ ID NO: 98419 - DNA, 1068 bp, Homo sapiens
acttgatgggtctaacctctcaccccaattccatccatgtctctgctccaccactgaggaaattctcacacatgccactgccttactgccataaatcttcctcccgttgttccagaaatgggtctacatgggctttcacatgagctaagtgcacatttatcactttggcttgtgttgaacattggccgtaaccttctaagtcacagcagatgaaccagtgtgattcatgcaagaatggtaggaatgactgtgacaaatgtttgtcttcagaaagacaaacattatttgtagctcacttgtggtgggaaagtaatctaatatgcaaaagacatctgaatttattaggttggtatagctataacataactactaatatatgagatttttctcacagactgataacagctttattgcatgtgagtccttgtcatttattgcttcctagtactataaaaactgaaaatagcatattattccttgaccagctgacatgagtttgtgattcatttgaccagaaatgtgccctctaaccacagcacttcaacttatggtcatagttggtttgacaataaatttaaaaacataattagagagcacttaggaaattggtctacttaccttgattagagtttctaaggtggttatttaatgtgggccaaaactctacttaagttttgcaactttacaaaagttatgcagataagtcaaaagatctaaataagtagttaaaaggccacaaactctcttcatattgcttcagctcttaacagaaggacctgcccagggtcacactcatatgtgtgagaatcaggaggcagcaggtacacgagagggaaaatgctgtgagcagtgagactttggcacaaagatgagaataaccatgttggcaacagataatggacagcgaggagggatgactgttcctcagctctgcccctttgcctgtgcacggaaacagtggtccagcagccattcaaagcgaacacgagagaaacagatcttcctattttgaagccaagagtttgagaccagggcaacatagaaagaccccatctctaaaaagaaaga

SEQ ID NO: 98420 - DNA, 1085 bp, Homo sapiens
gtagcgcccgctgtggtggagcctgccgagttggatttcggagagggcgagggccaccacctgcagcacatcagcgaccgcgagatgcccgaaggtaaggaggcggcggatgccatccgccctcgggctcacctctgcccgcctcctcccccagagtcccccgggaggcatccgccgcctcgggctccttcctgccggtagccggccccgggacgaaggctggttctgcctcgcgtccccaccccttattcttgccctgctgcgtctggccagtttcttttcctcctccttaccgtaacgcccagttcttgctcccgcttcccattctcccaagccggcgtgggaccctctagtccgccgcccttcttgtttgtagctctgttcattgtctggtgggactttgctaagacttttggggtatattgttttccttttctcaatggaaactcaaatacctcaacttcggagtactcatcccattccctcccttaacccatccagatggtacctaagtgaaggaaccaggtaagggtctgattgttccttcctcccatccgtgaagatagctgatgcccgcgacagtttagacccagatgtttgaggatttcttatctagactcaaaatagaggttgccataggagacactatatggtattcctaataggttaagtcggcgtgaaagaagctgctttattccttccaactataatttgaacacagaaagaaagaaaatggggggaggggcgtaaaatgactgtgaagggtgtgagaggttattaccaggggtgcagacaagttgtttttttgagacggaatctcgttttgtcgcccgcccaggctggagtgcagtggcgcgatctcggctcgctgcaacctccgcctctcggtttcaagcgattcctctgcctcagcctcccgagtagctgggattacaggcgtgcgccaccacgcccagctaatttttgaatttttagtagagacggggtttcaccatgttggtcaggctggtctctaactccagagttcttgatccgcccgcctcggcctcccaaagtgctgggattacaggcgtgagccaccgcgc

SEQ ID NO: 98421 - DNA, 1054 bp, Homo sapiens
cttttgaagtagaaaaacattgtatcataaagatgtttaaatccagtgggctcatttgtttcgtataaatgccagagatttcattactatagaagaaatgtgttagaactcttatatttaaactttgcttggactcttaatttctttaaaataataattaagcttcatgatggacatgcctttgtaactaggaactactttacttacctttcggaatattcagacattgtgaaagaatgaacaaatatattatgtgagttaattgattgtacctttatacacaaagcatgtaagtgcttgtgaaaacttaatgctctcttagtggtgtcaggtaagcctctgagtgattttacacaccagttagtagatgggtgggtggtgttgggtgagagccccaaataaggctcccacccagtgtacatgaaaatacatactttcatgtacatgtaatttagcccttccaaaataaggcctgtttatattccccgtgttgctaatgaagaaataaagagttaggtatgtagaatgactatgtaagacagccactgagcagaactaaggttctcagttctcagactgacatggaggtgagatataccaagttcagttcttaaaaaacttttaaaaatccagaatgcatcatgtattttacccataaaatagtcctgtttttgagaacttacttcggtcttgattagttcctttcaaagtttattttacacgattcagaggcaacacttacatctcttttttttttttttttttttttttttaagagaaagagtctcactgtgttgaccaggctggcctcgaactcctggcctgggctcaagcagtcctcccacctcagcctcctgaatagctgggaccacgggcgtgtgccatcttgcctggctccatcttatgtctatacattcatttcagtggataagaataaaagtagaggtaacaaaatggcctaaatatacccatcaaataaacaggttgataaattttaaagagtttgttctggtaactgtgaattgaagctgagaatgcactggacagaggaata

SEQ ID NO: 98422 - DNA, 1161 bp, Homo sapiens
ttagagttaaaataataacattggataatgaaaaatgaaatggaggtacttgtaacccagactttttttttttttttcttttctctgtatgagacagggtcacaactctgcctgtcgcccaggctggagcacagtagtgccattagagctcactgtaacctcaaatccctgggctcaagttatcctgccacttcagcctcccaaatagctggaactacaggcatgtgcctccacacccaactaatcttttaaaaaatttttgtagagatgggggtctcactatgttatgttgcccaggctggtcttgaactgttctcaagtgatccttctgcctcagcctcccagagtgctgggattacaggtgtgagtcactgcactccacccagaaatactcttaaaagtctaaaaaaggagttaagtgctattaagaaatacacaaagggagaaaggtatactatagcatatgaaatgtcacagctcagtcacgatcactaaaacatagattgaggcgtgaaggtaagttaaagcaagactgaacactgacatagaaggaggtagagcagtgtttcggaaaccagatttaggattgtcagaagctaggaaagcaaaagcaaggcatgagtgagcatgagactggagcttggctggtactgtgtgacctcagatgaggcagggcagctcaagacccatcaggtaagacttacctgatgggtggaacgtgtgaacttagataaaatctcagcgtttacatcatagttgagaggtttgaaatgtttgtgttatggaccgtaagactaatacagtgtgcagtatggtagagcaggtcagtaaatgcagtaagcctttaaataaacagatgcccagcagttggcccagaaactgccaatgtctcctgtttaattgggatatattgaaatcaatatgttgaactcaatctctttctctgaaatatgctgcttctgtcagttactttcttggttgctgccctctccctttaatattttgacaagaaaaataatttctttacagtttacaattgcataattttaacacttttagcctttagtaataatgcatttcatttattctaagttccatatttttacatttttaattaacatctgtgaaattgagatggctgatagattcaaggagaagcag

SEQ ID NO: 98423 - DNA, 1349 bp, Homo sapiens
ggatgtattatagaaggtatttagaagaactgatgtattagtttaaaattttcttttcatatgttcactgattttaatatgtgatatactttcctttagttgtgattgtttagtaataacatgtagacctatttacaggttttgccacctttttataacacaattaattggccacatgatttagtaacatggatttttttttttttttttgagaggctggagtgcctttattgcccatgctggagtgcaatgatgtggcctcagctcactgcagcctccatctcccacgttcaagcaattctcctgcctcagcctcccaagtagctaggactacaggcatgagccaccatgtccggctaatttttgtatttttagtagagatggggtttcaccatgttggccaggctggtctcaaactcctgacctcgtgatctgccctcctcagcctcccaaagtgctgggattacaggcgtgagccatctggccagtatcatggatttatgcatatttctccatacttctttgacctctttcccttgctccaaaagagtacattttaaagatgaatgataggatttaagctgcagcttggtttcatttgaacaacaacaaaaaatcagttcgtatacagggattgaatctgtgattttggcttccttttatacaatgctctaaccacatgagcctatcacattcaaatttatgctactcagaacttttaagctattaacttttccatcctaatgtagtgtaaatataaacatgccccatggtgtttcccagaaggttagcctcagcaagtgaaacttacgtacattttccttgtcctgcttgttttaggatgagaatcagaactgttgtatttttctgtactcctgtttatcttccttataattatgttaaatcctaatttatttgctaaaaagctatatacaaccaggtttttcatttgatttcaacagcaagaatacaagaagtgggggttctataatacttgaagtaatggagcacaacacaaagcaggggagttgtaagcagcattttcgaagctcgtgtggactttgtcttgagctggtcatttctggttaggatagttgtatttctcagtttctttcagagccataggcttctcacacagacagagtgtggaagcagtaaaagaagagctatcccatgctcctctttcttcagtggtaaggagtgtgtgcttgtgatacttgtctagcatcaaaggaagaggcagtataggaaacaaagcgtggtccaagtccctcttggagcttttattcttctggcctttgttaaaatgattttatgtgctgaatataccatgttcaattaggttaaca

SEQ ID NO: 98424 - DNA, 1073 bp, Homo sapiens
ttattttttaaatggaattttatctcattttgtatattgttaatcagatgattagcaactacttttatactgtggcatttgtatcagaattgatcagctaattttttttattcttagtgcgagaaaagaggaagagcaaccatttgaaccatgtaagtaaacagttggaaagctaagaaattaacagttgaattaaaagtatgtctgtcatgattccataaaaatataatggggacccaatactgttagtatgagcctctttttgtggattttctaaatcatttctattttgctgagaatcagatttatgcaggaaagtctttgacttagtgtacccaattgttaagggtttctgacatttaagttaaatttcaatagtttggttgtggtataaatatctgccttaaatatttttgcctaaagtttttaatctttttaaaaatcaagtaacaaaattataatagctaagttcatttttagcactatatgttgacttcctgtcataacaagtgaaaacttagcttcctcactccaccgtgaccttattttcttccctctatttctcccatatatatcacatttttaattaaatcagtaattgatgtttacattgttatgattatacagatattattcactgctgagtcatatattattctcactgtcttctccttgtacatcctttgtttctcttaaatatttctgaaatctgggcgtgtctgcacgtctcttcctagcctccactagctcacacagccaaatgcagtagtaacccttggctggtctccttgctttcatgtctttttttttgtgtgtgtggaattaatttcctgactatattcatttggctgttttctaacagctatttttccccccaaatgttgtagcatttgccacatgcctatcaaaaatgttttccatctactaaaacacatctgttccatttttctcttggagacagctttcctcagccttttgtcatcctcttcaaatatagacgggtttttcctaagactgttctgtgcctgttttcctgggatatctctctgaagtcatctgggatctcacataac

SEQ ID NO: 98425 - DNA, 1048 bp, Homo sapiens
tcggtctcttgagtggctgagattacaggtgtgtgccaccacgcctggctaatttttttttttttagtagagacagggttttgccgtattagccaagctggtctcgagctcctggcctcaagttcacccacctcagcctcccaaagtgctgggattacaggtgtgagtcactgtgccctgctggatgcgtcttttctgagactgttcagtttcttcagagaagaatctcccaattttctacctggggagtacaagcatggctgctcattttccagaagcagagttggaaaagggaggtggagttccacttctcagtgtgtagttttttttcccatttcccagatttcagtcctactatttctgagcccagaaccttctatattccttataagatgggaggacaggtggacctgggactccaactacatattttcagccgaccttgctggcttttgttttgtgtttcactctaccttccaaggtgccatgtgcctctgagtttgaagtctgccttgggttctgtaagacaaactaacttgatcctgttccagtcactctctgtaggcactaaagttgtgcttccatatcagttaccactcctttgtctttttcatctttcaagatttattaaaagtcatctgctgtggccgggtgcggtggctcacgcctgtaatctcagcactttgggaggctgaggcgggaggatcacttgaggtcaggagttccagaccagccttgccaacatgttgaaactccgtttctactaaaaatataaaaattagccgggtgtggtggtgcacacctgtaatcccagctgctcgggaggctgaggcaggagaattgcttgaacctgggaggtggaagctgcagtgagccaagattgcaccactgcactccagcctgggcaacagagcaagactctgtttaaaaaataaataaataaatttataaactctgtctcaaaaataaaataaaacaaatggaaatattatctgctgtcaatcctgttgcctgctcctgtgtataacctttattttatgtctttaat

SEQ ID NO: 98426 - DNA, 1021 bp, Homo sapiens
tgctcttatgcaaatatgatttaaggcattacattttactgtagtgaaggaataatagaaaatctcagctgctttttattgcttaagaaaaaacactgaaatcttattgtaaacttttcccattaatttatacagggaatgcataacagatgcttgccaggtttgattataggtaccacaagagcagcatttcataacccattcctcaaacactgtctgtgggagagcctccactgggtttcccatagagctgcacatgatactacactcaggcagttcatggagtgtaagaaatatcttaatgctttatcatttgacattttaaccaaggaaaaaccacacttttataggtttaacttactgtgacattttcttctatttcccttccccttcaggtatctccagggcagcttactaaaaagtatagctcatgctcaacaatatttctagatgacagcacagtcagccagcctaatcttagaaccacagtaaaatggtgagtacaactaggctgccaagggctgagtgacagacccccttatgctaaaagcatcctagccatcctcggtaatttcagccatttgattgtccttttcagcaatgagtttaagaaatcggtgtcaactatatattgatttcaaggatctaaatatgaattttaatttcctgttttaatcttaggctgcatggtggaagggaaagccagttagtgaagaagcaatcccagaaaagtgtagctatttatttaatgcatttatgttaagacagtgtcgaacataatgtgagaaggagaggtgctttttattggatgtttctggaaaaacgttagtttgttatgagttacaggtctcaaacaatgtgtactgctttgcaaactactcttggaagaaggaacagcttgtcctctactggcaccatagtgtatctgcatttacattttccctgtcgtgcatgagcacctcttgggcacaatctgagatgcactttcagaacaccctaagatgaacttttcaagtttatt

SEQ ID NO: 98427 - DNA, 1064 bp, Homo sapiens
gaccagcctgggcaacacggtgaaaccccatttctagtaaaatacaaaaaaattagccaagcgtggtggcgtgcacctgtaatcccagctacttgggaggctgagacagaatagcttgaatccgggaagcggaggttgcagtgagccgagattgtgccattttactccagcctgggcgacagagcaagactctgtctcaaaaaaaaaacaaaacaaaacacacaaaaagacaacaaaaaacactcctcatgccccaagtcatacccgatgccaattaaatcagaatgtctcaagttggaagttaggcagtttttaaagctcctcaggtgattgcagtgtgcagaaagtttgagaaccactgcttaattgaatgtaggaggatgaactgcttctatttggtgggaccttgggcaagtcagttttaagccttggttcccatatctgtaaactgggtgttggattaaatgtcatgtaaggttccgtggtccttttcagcatataacttcaaattctgtaatgttaaaatcaatttggacatgaaaatgtttgaagcactatagaagtatccatcttagatgctaatgttacagactttttaaaaaagtgctaacattgtatggacttaaaattcagatttgccttccctcaattattttgagcctcagtttagagactgagggcaaatggaagcatataacttacctaagacaactccttgtttcctgatacacaacatctgtgggtaatttaggaatacagtaacatatatctgaaaagtcgtgtctgttcactaatattttacttaaaccaatgtggaaatacttgccattaatattacactttgtagttttatgctgcattgttagcactgcttatttcaggatagctacacctatcattggttttgtgtgcacttatttactaataaattttctactaatgatgcaaaattgatcataaatgattttatttggtataaaacacttttatttactttaaggggaaataatgaaagatgggtgggtaggtgatagttaattaaatcaactgaaatgcagagccta

SEQ ID NO: 98428 - DNA, 1022 bp, Homo sapiens
aactatttggttttttggttatttttattttttgctttttaagctgttaggctctgcatttcagttgatttaattaactatcacctacccacccatctttcattatttccccttaaagtaaataaaagtgttttataccaaataaaatcatttatgatcaattttgcatcattagtagaaaatttattagtaaataagtgcacacaaaaccaatgataggtgtagctatcctgaaataagcagtgctaacaatgcagcataaaactacaaagtgtaatattaatggcaagtatttccacattggtttaagtaaaatattagtgaacagacacgacttttcagatatatgttactgtattcctaaattacccacagatgttgtgtatcaggaaacaaggagttgtcttaggtaagttatatgcttccatttgccctcagtctctaaactgaggctcaaaataattgagggaaggcaaatctgaattttaagtccatacaatgttagcacttttttaaaaagtctgtaacattagcatctaagatggatacttctatagtgcttcaaacattttcatgtccaaattgattttaacattacagaatttgaagttatatgctgaaaaggaccacggaaccttacatgacatttaatccaacacccagtttacagatatgggaaccaaggcttaaaactgacttgcccaaggtcccaccaaatagaagcagttcatcctcctacattcaattaagcagtggttctcaaactttctgcacactgcaatcacctgaggagctttaaaaactgcctaacttccaacttgagacattctgatttaattggcatcgggtatgacttggggcatgaggagtgttttttgttgtctttttgtgtgttttgttttgttttttttttgagacagagtcttgctctgtcgcccaggctggagtaaaatggcacaatctcggctcactgcaacctccgcttcccggattcaagctattctgtctcagcctcccaagta

SEQ ID NO: 98429 - DNA, 1085 bp, Homo sapiens
gcctaccaagctccaaggcccttcccttcacggccgacacgaggccagcctggaaggaaccctgatgaagctgctgtttcagggtcatattggtgccatctgtgaggaactccatgactcagcaaggatccttgcactctcataggtaactcaaggcccccaaagtggtgctgtggttgtccgagtgcccagggagcctctcgagtgtggtgagcgttggatgatgccccagcagtgcttctcagaccgcctgaggggaacgctggagcttcctaactcaggagaccaatttctaaatacaaaaaacactcctaatggggaggggtcaggggcacagggatcttcatatctcaaggcttctgtaaaaacagaccttcagataaaatgtggaaagactagcaaaagcaaatatacaatgtgtgactcaggttgaagctacgtaacttctcaatagtccagaggccctaagacctaatagtggccaaacaattatttcaaaggccagacatatgccctttaagggctgtttataccctactggtcacatgaaaagatataaatgaatgaatgaatgaatgaatgaaaaagagaaaggagcttgaactggcagataactttttaaaagccataaagaggccaggcgtagtggttcatgcctgtaatcccagctctttgggagacggaggcgggcgaatcacaaggtcaggagttcaagaccagcctgaccaacacagtgaaacctcgtctctactaaaaatacaaaaattagccaggcatggtggcgcatgcctgtaatcccactgtaatcccagctactcaggaagctgaggcaggagaatcgcttgaacctgggaggtggagcttgcagtgagccgagactgcatcactgcactccagcctaggcaaccgagcaagactccgtctcaaaacaaaaaataaaataaaataaagatatttactgtgctatgttgttctggtagtatacttgtaagatttttgccaaaaaccacccaaaaaatatttttcaatttatcaagcagattattacacatcaaaacctaccaagtaatgatggaaaatatgaa

SEQ ID NO: 98430 - DNA, 1104 bp, Homo sapiens
atcaagtgatcctgggaaacaaatctgtctggattgcggagggtggttctgaaagaactgccaagacgttaaagaagggtgaagagtaggcagaatataagtagctaacctgagtcaagactctcaaaagctagcagcctgatgacaataggatttatttcagccaggatagtgtctgtctgtgagtgcatcattttaagacagtatgacttcatgttgttacaaactatgtatagtatgtatgttttgtgggttgtatatatacataatatatattatatatatatatgagagatttggtgacttttgatacgggtttggtgcaggtgaatttattactgagccaaatgaggcacataccgagtcagtagttgaagtccagggcattcgatactgtttatgatttccatatatgtatagtgcctatcccatgctgtagtcactgttatgttaaatccagaagttacactagagccagcgatactttatttgtagacaatcaatttgaatccatatgttattactggcagatgatacatgattacagttctgaatctgtaacacttacaaaaggaaacccagagcagcttgatgagtttttgtttctgcttcgttcctgggagtcagtagaaacagcagttgtatgtggttatgttagtctcaagatacttaatttgttgaccttacttcagaaaaattttgtatgtattatatttgtgggaaggtaaaataatcatttgagatttttatcaaatatgaagattagttatttatgaaaaacaaagaaatgtctatttttctttgttcccaattaatgtagataaattttaaaatgcattaaagtaatggtaaagacaataaaaagatgctgtagaagtctttttctcctcatgtttttatagagagacattgctttctaagagtattcgaggagataatacggattctaacttcataatcaggtttttcagatgtacttaaaatataagcagcaaaaattttattagtaagtaaaatcaagcaaattccaatcaccagaaacagaactagttaagaaacatgttttacttgaatatctttcctaggtctcactcctgccgatcc

SEQ ID NO: 98431 - DNA, 5503 bp, Homo sapiens
cggcgggcattagaagcaggtgacccgggcggggcgggagagggcagccagcctgcggccgtgagtccgctgtggtcgccgccgcgcgcggttccgtgctcgccagaggtgggcgaaagggtgcgagagcgcgggggaggagccgagcagggcacgtcccgagagcgtcgccaccgcccccaggagtccactggagcgcggagccccctgcaggggaggaggcgagcggcgggcgggacgcggcggccggcgctcaccatgcagtcccggcctggccagcgccggctgctcgcggtgctgtgaggcggcggggtcccacggcccccgcctcccgccttcctcccgcccaggtgctgccaggcgcgctcgccctccgtccggctcccggccccggggagaacgcacggcctgcccctgcccggctccgtctggatcatgcggggggctcccgaggaggagagggcgagtgaccggcctgcgccgcccctgttctgggggcgccccccactctgagtcgcccccacctgctgccatgtgccgctgccacgggtacccagcctgtcgctaaactttccgggcgccagcccggctctgagtcgcgcttctcagcggagtgacccagggacggaggacccaggctggctggggactgtctgctcttctcggcgggatccgtggaggtgagaaccttccctttctccctgttcttctcccgtttcctgtgcccttttccgggaagctgagggttctggtctccgggcactgcctgaagggcccagcttggaaagagagggtgggggagtcggtagtttggttacaggaggcggagcggggaggaaaggaaaggggttaacttaagagatttggagacagctcgcggggaccgaactgttgacgcctctccaacagggagtggttgcaatctttcttctcccccttcttttttaaagagtcctttccctggaatccgagccctaaccgtctctccccagccctatccggcgaggagcggagcgctgccagcggaggcagcgccttcccgaagcagtttatctttggacggttttctttaaaggaaaaagcaaccaacaggttgccagccccggcgccacacacgagacgccggagggagaagccccggcccggattcctctgcctgtgtgcgtccctcgcgggctgctggaggcgaggggagggagggggcgatggctcggcctgacccatccgcgccgccctcgctgttgctgctgctcctagcgcagctggtgggccgggcggccgccgcgtccaaggccccggtgtgccaggaaatcacggtgcccatgtgccgcggcatcggctacaacctgacgcacatgcccaaccagttcaaccacgacacgcaggacgaggcgggcctggaggtgcaccagttctggccgctggtggagatccaatgctcgccggacctgcgcttcttcctatgctctatgtacacgcccatctgtctgcccgactaccacaagccgctgccgccctgccgctcggtgtgcgagcgcgccaaggccggctgctcgccgctgatgcgccagtacggcttcgcctggcccgagcgcatgagctgcgaccgcctcccggtgctgggccgcgacgccgaggtcctctgcatggattacaaccgcagcgaggccaccacggcgccccccaggcctttcccagccaagcccacccttccaggcccgccaggggcgccggcctcggggggcgaatgccccgctgggggcccgttcgtgtgcaagtgtcgcgagcccttcgtgcccattctgaaggagtcacacccgctctacaacaaggtgcggacgggccaggtgcccaactgcgcggtaccctgctaccagccgtccttcagtgccgacgagcgcacgttcgccaccttctggataggcctgtggtcggtgctgtgcttcatctccacgtccaccacagtggccaccttcctcatcgacatggaacgcttccgctatcctgagcgccccatcatcttcctgtcagcctgctacctgtgcgtgtcgctgggcttcctggtgcgtctggtcgtgggccatgccagcgtggcctgcagccgcgagcacaaccacatccactacgagaccacgggccctgcactgtgcaccatcgtcttcctcctggtctacttcttcggcatggccagctccatctggtgggtcatcctgtcgctcacctggttcctggccgccggcatgaagtggggcaacgaggccatcgcgggctacgcgcagtacttccacctggctgcgtggctcatccccagcgtcaagtccatcacggcactggcgctgagctccgtggacggggacccagtggccggcatctgctacgtgggcaaccagaacctgaactcgctgcgcggcttcgtgctgggcccgctggtgctctacctgctggtgggcacgctcttcctgctggcgggcttcgtgtcgctcttccgcatccgcagcgtcatcaagcagggcggcaccaagacggacaagctggagaagctcatgatccgcatcggcatcttcacgctgctctacacggtccccgccagcattgtggtggcctgctacctgtacgagcagcactaccgcgagagctgggaggcggcgctcacctgcgcctgcccgggccacgacaccggccagccgcgcgccaagcccgagtactgggtgctcatgctcaagtacttcatgtgcctggtggtgggcatcacgtcgggcgtctggatctggtcgggcaagacggtggagtcgtggcggcgtttcaccagccgctgctgctgccgcccgcggcgcggccacaagagcgggggcgccatggccgcaggggactaccccgaggcgagcgccgcgctcacaggcaggaccgggccgccgggccccgccgccacctaccacaagcaggtgtccctgtcgcacgtgtaggaggctgccgccgagggactcggccggagagctgaggggaggggggcgttttgtttggtagttttgccaaggtcacttccgtttaccttcatggtgctgttgccccctcccgcggcgacttggagagagggaagaggggcgttttcgaggaagaacctgtcccaggtcttctccaaggggcccagctcacgtgtattctattttgcgtttcttactgccttctttatgggaaccctctttttaatttatatgtatttttcttaatttgtaactttgttgcattttggcaacaatttacctttgctttgggggctttacaatcctaaggttggcgttgtaatgaagttccacttggttcaggtttctttgaactgtgtggtctcaattgggaaaatatatttcctatacgtgtgtctttaaaaaaaaatgtgaacagtgaacgtttcggttgctgtgactgggaagttgttgggtgtgctttttcagccagcttctccttccactgcttaaagtgtccatgattctttaaggtgagctgcagtttatagccccaggtcatacctaggaggggagcataatgagctcagggcctccccaaagtgacaaggttagggagtgcttagcggttttgtgttcagccttagctttgtttatagagggaggttcagtttcttttctgtagtgcttgtaataattctcactcctaacagcaccatcgttgtgtcttgaataagttagaggtagcattatagaggatctggcataaatatttgcagtagtgagagcctaagcgatggtgattggtggagcttgaattttaggctggtgagatggcagctttgtgcctgagaggtagtgggtggttcttaagcttcagtgatcccctttttttttttttttttttttttttaaggaacttgtgttataattttggtaaaagtataaacccactccctctggacaatacttagcgacagttgctaaagggggctcctttttaaatgtaaggactgaaatggatatacttctaataagtaaatttccaacacttatttgctccaccccctcccccctcccccctccccctttatcatgttaaacagcctttttgcttttcttattcctcctctcctggagagctgtgattagaaaccacacccacccttgaatgaagtgcttgaactgggggagggaggctggctacctgtgaacaaacattggcccaaataagggaaaataagtgttcctggactttggactagtttatagccagatattccaagagcagcaagacgttgctctctgccgtctctgaaaacaaaagagatgcataacatgcttgcacaaccttttaaaatatagatcagtatagtgctacctctatagttttcttcctcttctgagaaagcctgtatattgatgatcacacacacacacactttgcaattagagaatttggtttgctttactaatctgtttaactattccttcattcattatgaacgcttatattgatgaacatacacacagaggtttctttgctattagaaaattctgtttgctttcctaatctgtttaagcattcattcatgaagagtgtggggccattactggggaaggggggtgacagtgcctcagccagcaaaataccaatgaccaggattggggactaaatttaggaagctaaaatggccagagcaattaacatttgagaaaatcctgtctaggaaaacaacttgagtgtaggcatttgtaattcacttataccaaagttggaaaagtaaaatttaagcctaggacaatttttacttcatggatgttaaatagacaaatgcatagttcccagggggaatttaaacactttactggtgggaagaaacctagtattaaagttgtaaggactctcaaaaacttcacatttattaaaatgcactgctcttacccaatttatcctctgaattaaaatttcagtggattctacaaaacctcgtacaaatagctacagaactttgtgcctattttattcctctatttattcttctaggaagaagcctcttcctagaatcttgaaatagatcccttgactgaatgccaattcctctcctgtttttcaaatgagagaaccttttctgatcaccttgaccttttccctcatttcatatgtcttcccagaaagtagacagactgctctgctgccttcagtcattgtgcctcatttgggttgtccctccttctttgtggagaaatctggaaatgatgcacagtgtatccaaaagttgtgggatgaagtggatgaaagtgatttaattcatttttagaatttttttttgttttgttttagcaacatgctgaacaactaatttactttaaaaataagccagttaaaacaaaggacgctaagcccaagtggggggcaatattagtcaggatctttggggtctaattccagaccaactttcagaagcacttctttgtctctgttctcacctctgctgtccctctcttccctcatcccctaagagagacaaagataaaagccc

SEQ ID NO: 98432 - DNA, 1047 bp, Homo sapiens
ctggagtgcaatggtgagatctcggctcaccgcaaactccgcctcccggtttcaagcaattctcctgcctcagcctcccgagtagctgagattacaggcatgtgccaccacgcctggctaattttgtacccaggatgacccatggttgttcctaggcactgactccagctgggaggggcagctggggatggggcagccatccggaaatgagaagaccagagttctaatccacatcccgtcaacaagtgacaatgggcaggtagctccagtcctgggagagcctgagtgcgttcatgtgtaaaaggctcgttatgcacaccttcaggcattgtaatgaggattaggagagagattttatcaaaagggaggagtcctggcactgaatacacaccggtttccctttttgtctggtagtggaggagggcacgttcacttccttttcacccctctctgctgtgttgtggaattgccctgtgctcttggcagacacctcattgcacaccggctccctcaccaccaccactccccgcaaaaggggcacgtcctgattccaccaggaaatgaaaagtgaaaccttctgataatgacccctggaatgtcacaaatatccaagtcaggaaatgcaaatccaggggaggggttattgaagcgacaatgatttagcttcctctaaatgctgtatttccagggctggagaggagagggggcattctttggctctccttagatttactctgttttccaaagagttttggaaagtccaaagggtcttggaaaacagaataaggggattcctgaaagagttcctggcaaggggtttgtggcaagtgtggcatcagcccttcccactgtccctgcaccattggcctttgtcctgtgtgggtaatgggaacccaaagactccagagcttgcaaaggaggcacaagaaatctcaacaggaggcagctggctgcacgtacactctccaagctggggcctggcatcaagttcaccacctacatagctctcagagccccagcgcctctctgtcccatggagagtgggac

SEQ ID NO: 98433 - DNA, 1038 bp, Homo sapiens
tttttacttctcctagtaaatagagatgtgtataatttttgcccattttatttcttgagttgtctgcaccacttcttttcttactctgaaataatgtgaaaacgtgaagttggagcaagaccttgaaagagcctccctcctttgcgtgacctgaatcggtagcggcactctctgtttcccctgcctccgtgtcacttgttagtgatgggcattaggagcttcatatgttgcacaccttgtatcactcttccgaccctgagtcaggtagagctgtctgctcgaggtcgaatccagtgatgggtgactaagctctgctcggttaatgtaaacagacaagtgttgatttctgtcatgtggaacggtgtttcgacagttaagtctagcacccagtagtctccttattggtagacgattctaatttcattggattcaaaaatctctgactcaagggtctttccttagtgcgttttaatgggtgcatggctgagggaaaatccaagtcattgttaaactctaggtaaaagacaagagtatgggataccctcctaaccataccggtagttgtcagttttatttaaagtgggttccacttggccaggattggtggctcacgcctgtaatcccagccctttgggaggccaaggcaggcagatcacttgaggtcaggagtttgagaccagccgggccaaaaatggtgaaatcaggtctatactaaaaataaaaaaattaggctgaacgtagtggctcatgcctgtaatcccaacactttgaaggccgaggtgggtgaatcacttgaggtcaggagtttgaggccagcctggccaacatggtgaaacccccctctttactaaaaatacaaaaattagctgagtgttttggtggatgcctataatcccagctacttgggagactgaggcaggagaattgcttgaacctgggaggcagaggttgcagtgagccgagattgcgccactgcactccagcctgggcgacagagcaagactccgtctcaaaaaaaaaaaaaaaagtaagttccaa

SEQ ID NO: 98434 - DNA, 2892 bp, Homo sapiens
ttcccatttgtgtcttgctggcttcagtcttgctcatcatatccatggttgacttttgcaggtgtgaaagctgtggagccgttttccattctgaatgcaaagaaaagtctgtcccctgcccgaggtgtgttcgccgagagctgcagaagaagcagaagtctttctggcagagactgaacatggacgagagtctagaggaggcttgcaccatgttcgagctgtcctaccagaacacctgactccagccgacccgaaggccagggattcaccaatcaacaatccatcagccccagagcggcctcctaactagccagttagacccctttggaagaagagtatgtatcctcttcaactagatatagatatatatatttatttatatatacgcaaatacctatacgtcctgtacgtatgctctgtgtacatcattgtccagacgatccacagaacctctgtggctcgagaaactaccaatagctggattacacttagccaagaatttcagctgcttgctcccagacaaaacgtggtatacacaatgctttatagttcagactttttttttctctctgtctctcggtacattttattacccaagacacaaaaggaagcatttcctgcacaaaacagtgctttaggttatttttgtgttatttatttttagccttcacagaggctgaggtaactgaggcaggcacccatcatcatctgtttcataagaaaaccttcaaaacacaagagactgctgggtccttccaggacctggtgtccgtggcgctcccgcctcagttcctcctgtggaggcggggaatcacgtaagcagagccgatggctggaaacaggagccaagccccctctgacagaaagcatacacccctcatttatgaggagggctggttctggttttgaagttaatctcagaagtttttttcctgagaagagaagaaacctctgcgaccaataactgcgtgttgtcggtctgtttttcggtactaatcccatcacccacctaatgatgtgacgctccaccgtgttttccaggctgtacacatggctttcttaacagttttcaacgggtgcccatggttgatatttatgatttttttcatgatgctggccggaggaaatgtcctggggtggttgttaaagacatcgtcgtgtagactggtagataaggctatctagtaagtatattcccaaagagggtcgttttagtttcttttctcagaatcctgtggaggcagttcctacctattcattttaagtgctttatttctcgttgttcttcctgcactttcatttcgacctttgtcaatgtgaccattcttgctttctcatttttttgtttaaaaaatcagagtaatgtggaacttcaaaataccaactttggactattaagaaaatacaaacttacaagtataattaatgaattagatctaatattatttaaataaatatatatatatacacacacatatataattgccaccttgaagtaaaacaaagagtgctaaaataaataataggagtaagaaagagatctgctttgctatttggcaggtagtgttctccagctgcagtgcccttggaagagcacgtggcagtcactgtgaccaaaacggcaggtaggacagccctgggaccctgacagctcccattccttccccttaactctccctagagcaagaaaaatatgtttataatggaacagttctcagtagactttatgagaagattctgtagctttcgcgctgagcagatgccttctatgtcttcatggtttagtagttttgctgctattaggatcagtggctcacaacatacttggtacattcaaccccattgctcctttcccccacacgccgcttccccaagaccccaactcatgatacttccatccatctagagatgtgacatttcagactgacttttgtgcagttagatgtaagcattttacctctcaacccacaccagttcctttggccccaggccacacatttcaccttaatagctcaacaccatacatgcatttattttctgactatacagtagccgcaaccaaggcttgaaaacttgttaaaaggccagggccctattcatgagacgcctgacggtgccttttacccttagaaaagcaggttgacttttcccccactctagttaaagagaatgttgcacacaaaagaaaaagggtggaaaatctcaaacacttggcaacaggcaaacaaatttgatcatctcctttcctcctcctcttggtaaaatacagtatttatattttccagcctcagagaagatagcagaacatgatctttcacaagagaattatagacctgcttattataaaacagatgtgctcccatggcaaagtgccttctccctccgcccccagctccctgtcactgtagcttacttttgccttcgctgtaattaatgtatccgtgattccaactgtcagcgaggccattcctagcacactgcatttggagacctgaagtgcagtgccatctcctccccttgtaacatgtttgccctgcatacagaatttcctctcctagctcacaggcacccagggtcatacctgccgagagtcaagggcgaaattctggatccccgttcaaaacatctttgttttcaccagtccccatttagagggccctgctaaatacgagcagtccctgtgaactcctaaggaggactttccacccacatcattttctgcttattttcaaaagggaaacaaaaaatcgatgtgttatcaccatcagctacccagagctgggtccatgtccagcactcctgtttcctctccttttcgtaccaccctgacagcttggtcggtgccagccacaggcctatgacattctctgccaccaccaccaaaatctgata

SEQ ID NO: 98435 - DNA, 1043 bp, Homo sapiens
ccccagatggaatttgacccttcttcagctctgactgcccactcttaaatgtgtttattgtgtcaatgacagttttctttaatgaaaactcttcagcacaatgctagtttttctggattttaaactttagtcaaagagtaacttggtaaataacatttcaccttggcctggtggcttctgtattcacatgtcaaaatgtttcagaatgtctgctaacataactgagacttctgtgaaaacctcagggctgacctgaccctttatgccattaagccacttgataaatatggtgcatttataaacacagtcctagctgctgaagccaccattgtgttttgaggccatttggtcacttgaatagatggctgtcacctagacacatttcttaccaagcttctagttaggtatctggttaatattgtattgatcatcttagctttaagcatttcagacagcttaattttttgctgtttaaagaggaattgttcatcgtttaactcattttaactttctaactataaaactaattgatatttattatagaaaatttgaaaagtacagaaaattaaagaaaatattctccattatttctccatttttctacacatatgtatttttaaatagttagaatcatattgaatatataattttatatccagcattttttatcacattgtatcagaaccagaaaaatagtcacatttaatctataaacttatattaatgggtacttttaaagaaaaaaaaaatttttttttttttgagacaggatctggctctgtcatccaggctggagtgcagtggcaccatcttggctttctgcaacctctgcctcccaggctcaaacgatcctctcacctcagcctgccgagtagctgggactacaggtgctctccaccacgcccagataatttttgtatttttttttgtagagatggggtttcaccatgttgcccaggctggaggaaaaaaattttaattggctctaaaatcattaagatccatcgaataaacacaggcaggccagtccataaaaagatcac

SEQ ID NO: 98436 - DNA, 1048 bp, Homo sapiens
cagaatccacaggctgttttttcctaacttcccatgaactcacctggccaaggccactagacttcactctacccacctattaaatgaactgagaaatgaccctagaaacaaaatgcaacctttcatggttgtctggccaggcaaatgcaactgaactatatgggaaattatttcacaatgtgtgacaatgttgattcttccatttcgtcaagccagcctgttcctagtgagtggcaggtgaccgttcactgtgaattgggtcttttggttagactttcagagacggagttgtttgtcaagtgcagcagccctcttcaccaaagcattcccgacagtcgctccaaatctagatgttacacaatggctaaggaagcttgttttgaaatggaaggtaaattgacaaatcagagggaaggaattagccaatgcataaggaaatttgatgagaaagagctttttcctctcttttttcttgcccaggttactagttctctgtcttctccgccccccataaattttgaattttgtggtggtgctgagggagtgaaggtaaccaacataaaagaatcatttgtgcccttttcccaatcccacagatctctattggctgcagaccttgaacatgacactgcaatttcctggtgccacacatgagtaataagcagctgtttctgaaactgtggtttggggaaggcagcactaggttattttttaacttaattgtaatttttgattggtctgcaagaaagtaaatcaaataaagtctgttgtcttagtctgcaagaaagccataggcctcaaattccaatgctgaccatcttgaccagaatagaagagggaggcaaaatgtgtgtatccctgagctggaagttcaaccaggcagatttcatgggcttctttcacacaagaagggtaagcatatttgacatatttgtcagggactggatggtggaaagtgatatttggcagttccttgagttctagaagtacctaaaatgatggtgaaaagaatttatagacagactgcaaaggtggaaaaatagcaaaa

SEQ ID NO: 98437 - DNA, 1034 bp, Homo sapiens
ttgtatgtttattactacatcaatttgcgtttttttttttttcttttagacagagtctcactctgtcgcccaggctagagtgcagtggcacgatctcagctcactgcaaccttcgccccctgggttcaagtgattcctgtgcctcagcctccccagtagctgggattataggcacatgccaccacgcccagctaatttttgtgtttttagtagagatggggttttgccatgttggccaggctggtctcgaactcctggcctcaagtgatcctcccaccttggcctccctaagtgctgagattgcaggtgtgagccaccatgcccggcctgaattgtttgattatatcttttgtccatttgggagcaggctaattttttagttaaacaattaacttatgttataatcttaaatacaagtaagattgagtgatgacaaccaaatgctgccagaacttgtcaggaagcaattacagagccacttcctgacaagttgagagacttgtgtagattgtacattaatattcacttttgatgtacagaaggagctgaacatgtaccaaatgttcaaatgttagggtatttttttttaccctgcataatcaacaagaatgtcagctattccaataataaaatgcttttcacaatcaatttaaaaattgcccattttggcctttctggcagcccacagaatccaccctccgttgtcctcttgtttagagagctggctagctcattcctcaggaatgacccatgtcccaggagctcaggaatcacacatcccctagaggttattctgaagtccatgtggtgctctagtggcagcaacttctccatttgccctctgtgttcctgccattaggccataacccggtctggtcaaagacttgccattttgtttggacaaagttgcaatttaaatgtttggatccagagcttgcagtaggaatgttccagaaatacttagtttagctttttgaatgcaaaggttgaatgcacttggaaaggcctagaatagaaattaagcaagagcactt

SEQ ID NO: 98438 - DNA, 1043 bp, Homo sapiens
gtgtgtgtatgaagaaaagcaggataaggcagacaacattcatcaagaaagaatagtttgtgtttgatgcacaattcaatagcaaagctgaggtcctgcctgaaagagcagagcaagcaaggatggtaacttcacccactcagaggagaagcagcctagcaatgaaaaggtctgtggagaaaaatggaggattgtgacatcaaaaaggaacagcaggaaaaggaacaccttgagatgctggaggaaggaagagccagaactgggtggagaggaaagggaggtggtaaagatgtcaccgagaagcctgttgcagagatggaagaaactgtcctacattgaatggacagggactgagaaagacagatatttttataatgcagatctttctgaatgagaccaccatcaacataggcccagtatagggtctagagattgccataaatttccaatataaccttatcttgtagttcaattagccaaatacgtacttgtccactatctcctgccctaaccttgaccaacttctactaaattaatgccctctctttctacttgactgccctggcagtgctgttgttctctgtgtactaaatatagttccagggacaaaagggatgagacacatgaaaggcaacaagcttagatatgttaatatatgtcttttttgttcaggaccaactaatccatcttaggagtcccctagaactactgctttctgatgttagcatatttatttgattgtttactgatgagtaagtcctcccttactgtatttcataacatgaattaaattataacatgtgttgccactctgacaattaaatcctatgttaattctgttgtttactccaaatagatgagacactgatttcataatttaacagctaatacatttgggcagccttgtttacctaaatagtgacttacagttaagatcctaaaatcctttctctgtggtgtgatatttttgtgtcaaatgcattgtgtactatgccctaaaggcaataatatatcattcagacttgctgttggtcaagtaaatg

SEQ ID NO: 98439 - DNA, 1118 bp, Homo sapiens
ggaatacagttaggaggaaatcaccagcccctcatacccaggctctagaagggctcaccttgaagggtgtcctcagtttcgaggccagggagcccaagagggtaccattttatgtttcttgccaggactgtgttatgccttccccaaataaaatgtcacctgagttacttagttctcaggcgtgcttgcaagagcctttaaaaataatccataagtgaaagattcagccttgaaagcaagtcttgatcttatccatcctggaccccaatcctaggagcagtgcctgggcaagaaaaagtgcctcataaatatggggtgaatgaatgaatcagttataggaagaggtggtgagggtaagaatgaactaaaagggggctatctgttcattcaaactatgttattgcataagtgagcatttgtgaactgaaaacctctttggtttttttctttaggactgctcggtcccgagttcaagtaaacaattgactttcaagtaaatctttaaataaccctggtctattggttaacttcagcatggcctctgaaaagcagtttagcataatagttgtgggcagagagtctggagccagacagcttgagtttgtatcttgccggcaccccttacctgctgtgtgaccttaagaaatttatttaaacttatgcctcagtttccttttctgcaaaatgaggacaattaaactccctgcctcacaaggttgtgaggttaagtgagttacaaatatgtacaatgcttagaagagtttggcatatagtgaatgccccatgagggctgcaattcaaaatcccttaacaagagtcacttgatttacaactgtaatgaggctttatcccacccccatgaccacagattctttgtctccgttttttattctgaccagcagttaaaactatccctggatagcaagaacaccttgagtgatgttagaaactatctgaaatgttacaaagggtgtttcctacatgaacaatttgacatttatttcacatccaccaccactactaatcttttttagtttaagtagcctcaatttttccatctctgacatggataacaatttatttcacattactgataagaaaactaataaaatatttat

SEQ ID NO: 98440 - DNA, 1003 bp, Homo sapiens
aatttcctttttgcttttttgattatttatttttaagaccaggactctctctgtcacccaggctggaatgtagtgcatgatcccagctcactgcagcctcgacttcccaggctcaagcagtgctcccacctcagtctctcatgtagctgaaactacaggtgtgcgccaccacacccagctaattttttttatttttagtagagacaaggtctcgctgtgtttcgcaggctggtctcgaactcctgagctcaagtgatcctcccacctcggcctcccaaagtgctgggattacaggtgtgagccactgcacctggccttgctttttgtttttgttttgtttttcaaaattttcaggttagcacactctgtatctgtagctatgactgacctgtgtcagtgtgtggttttgtatttatagctggcctgattccaaaaaggacttttgagagagagcttctctctttctctctctctctgtcatgcatatatatgtgtgtgtatttataactgtgactaattttaattcctatccccttccattggtttgaattattgacatatacacttgtcaaagatgagtctttgctacccaggatcccgcatgtctggagttctgctagcatccatcccctagtttatggttaaaaaacccaacttctaaaattgccatcagcctaaaggttcccttcagccacgcaaaagatagcaaaaatctctgatgcagctgacattttaggtgtgtgtataatttaacaaattgttgaccactcagcttttagtcagtggtcacaaaaggaattagcagccctcccctgctcccccaaaacccaaagaaggaagggtgttccttggctttggcccagaggcctgctggcacgcagtgtcaaacagcagcacaatggtacattttggccacaaaaggctttggggtggcagaaagggccaaaatagttgtggcataagttggctgggatattaagtaaatctgagtttaatttaacat

SEQ ID NO: 98441 - DNA, 1048 bp, Homo sapiens
tgctcttcccgttttccaagagaagccggaaatctgtatttttatgtgaaatttctcaatatttaaacactctgcaggccaaacaaaacacagccaccagttttgacctctgctttataatagagaatgcctgcttttgttccgtcaaactaatgaatgctgaattacgagaaggaatttggaggttagtgttagattgtgctcctcaaaaggcggcagaccccatcccaaacccttgagatactaattggcagacttgcacaggctgacagctggactctgaaagtggacacacacaaggaaacagccaagctattccaggtcactttgcaaggtcagggcagcaatgcaaacattaggaaggctgaagacaaaggtcaggtggcagcaaggaagccctacattcccttaagctgttggttgataaatcatattctaaaggtatcaccagactccctcaccctgacattgctttgtgaggtagaaaattaaatagaaatcaaaattaagatggctgtcaggagcttttaggaggccagcacgccagtgtgaggtgaacatgggatggagtttctgcctggagcaaaggtctcctaagggatgatgatatccaacattgggcattgcagaggtgctggccgctgcagcggtcacacactgcagctttggaggctgcctgtctatgttcaaatgccgactcaccccagaaatattaggtgaccttgggcaagtcacttctctttgtgccttaagcacttcatctctgaagtgagaataatagtacctgcccccgaaggttgttgtgaggccttagagttagtatgcataaagcacttagaactttgcctgacacttaagggcttaggagataggcactttactaggggtagagtattgctattagtgttgctgtgaggtgtggaccttgtataaacggctcctgggagttttcttcagcgtcatcaagacactgcatctgtggacactaaaccacaaccattgccacaaaagcaatgcttgctatgtctcagttttccccctcatgttc

SEQ ID NO: 98442 - DNA, 1769 bp, Homo sapiens
agaaagatatttggagacatcacattaaaccaccctcattctgctgtgaagaagctgaagccaggtgggcatgtggggacttgccagagatcacacagcttattacggacacagctggtacaagaaaactgatgttctggtcctcagacctgggccaccacgcagtgcttatagcacttaagattacattagaagtcaaagatcaaacttttacctccattctggtgtctgtgttgggaagaaaaatatctgagaaaaagatattacaggttcctcagagggcttaggagaagtataggtggaaagtggacagggcagaggaaaggaattcttgaatgagactgaaacttatcagaaaaatgtgtgttatggcagcaccacagttcacttgtctatctgcccttgttttcagaattttccccagagaatacctccttcaacagatccacctgtattcacttgccgacctgcagcaggtaagtgctcagaggggctgtttcatttttgttgctttcctggagaagtctctttgttgactttggtctttgcaccgtattctgccatcattggggtagttttcatcagaaaccctgataattctttttcagaatggggggaaaacttagtataaaaagatatatgggacaataacaaatgttggcaaggatgcagagaaactggggctcttatacattgctgatgggatgcaaagtacgttagccactttggaacagttaaaaagttaaacatagagttaccatatgacccaacaattttactcctaggtatatacccaagagagttgaaaacatatgtccatagaaaaacctgtacacaaatgttcagagcagcattattcataatagcaaaaaagtggaaacaacccaaatgttcatcagctaatgaatggatgaacaaaatgtgttgtagccatataataaaatattattctgccatagaaagaagtgaagtactgatgcatgctacaatatggataaatcttgaaaacactatgctaagtaaaagaagccaaacagaaaagaatacatactgtatgcttctatttacatgaaatgtttagaataggcaaatccatcgtgacagaaagtacgttagtgattgccagggcctggggagagcgaagaaatgaggagtgcctgctcatggataaagagtttctttggaggcttaatgaaagtgttctggaattaaacagcagtgatggttatacagtcttgtgaatattctgaaaaccactaaattgtttactttaaaagagtaaattttatggtgtgtgaattttcccaattaaaaatttgtatgaaaagatgtaaaaggcattgaatgtgttaagcccttgacttgtgctcaagccagaaagttgaatggcttttaaagtttagtaaaacataacagagcatgtaagagttgaaatcatccttttatacttttattagaacatgtacttttttttttcctttcgtttgtgagacagagtcttgctctgtcgcccaggctggagtgcagtggcatggtcttggctcgctgcaccctctgcctcccgggttcaagcgattctcctgcctcagcctcccgagtagctgggattacaggcatgtgccaccatgcccagctaatttttgtatttttagtagagatggggtttcaccatgttggccaggctggtctcgaactcctgacctcaagtgatccgcccaccttggcctcctaaagtgctggtattacagacgtgagctaccacgcctggc

SEQ ID NO: 98443 - DNA, 1063 bp, Homo sapiens
tatcatacactgctccctttaagtcccactgaaagactgccctagttttcctttcctgcagataagtttgggcccttggatcttggaacagcaaaaggacattagtgaaaccactggtgaaacctgaataaagtctataatttgcataatgtcgatttcttatttttgatcaatatgccatggttatgtaagatgtaagcattaggggaagctggataaagggtatgaaggtaaggacattttacaaatacagagaaatgttaggaactgtggaagtacatgtgaacattctggttattttcaaaaacatagttttcaaaatataatgagaaaattgcagactaccaaagtacacttttagatagttctagattgtaggtaaacaaagtaaaaacaaacaaccctcatctgggttcagcccccttcccattcaggtttttcctcactccattccctccattcccatggcttcagctgtctgctctgtgctcccatcagaagtgccctgggtcttctacatctcaggcccaggtccatgcttgctgttccccacacaggcactggatattcagcacataggaagctcaattttttattccctcccctggaagcctgccctcagttggccaatggcatcaccattctcatccccaggctctatacttcagggtcatcttagagtcccttctcctttttcacttattcccaatgttctcaattcttccaaaaagtctctggtatctacccactcattcctttcactgtccgcttgtctgccctagaacagactctcacatgccttgtcacctgtctgtagtctctccaccctccctgctgccttcagaggcacatcagtgtggcgttcctgcttcaaaaagcatcagtggctctatactgctaccggcctaaactacagtaataaacatccatccagaagagacatgcatgatattactaaattagatgatcagctcaaacctacctccctcctttccctacccccagccccaagaaattagaaggagcataggcctttggagtcagaaagtcctggccttgaaac

SEQ ID NO: 98444 - DNA, 1117 bp, Homo sapiens
tgtgctcgttggcaagcttgatcagccgtggagaaccaggcatgacaattgggttagtgctagcaaatgcatttactccaggtcagcatttgccagaccctcctatgtcccagacctgtaaacttaaaacaaaaatacgaagttaactatagggttgccttgtaaatatctttagccaaaacagaaataaaaacattaccctctatttctcaccatcatttcacgtaagaacatagtaatactaaaaaaaaaaaaaaaataggcaaactgctttagaaatcaaacagctttttaaaatcaagtagatttagaaatcattctacatttttttttctctcattttactttggactgctaaaaacatcagcagactgacaccagctgtttggactagcttttcagaaatcccagttcaagtcatattttctcttctgagtgctgaagtgaaatccactcctgggaaatttctgtggatgcttcagtatttcccattctcaatcatcaaaaatgtgatttgggggcttggggtgcctggcaaatccatagcccattacggtataaatgtaaaactcgtctctctccagcactagtcaagggcagtaggcaatattaggcctctttccctggttgcttagaacagaattgtgttctcagggagcatttgctcctacatgtttgtcaggtttagtccttgacttagaccattccgaagcaatttaatggcttggcttgagaggctcaagagaatacccaaagtgattcttctaccttctaagccatctcttcctatctttggtgtcacattttatttcaaattatgattatatccagcaggagttcccactgaaatatcagttttaccgaatggtgagaaatttctattataaagattgccacttttattaaaactgtcctggtgaataccagaaaaaaatgtgtgtgtgcgtgtgtgtgtgtgtctgtcctgacagactctcattgcttccccttccttcaagcaaaatttagcagcttactctgctcttagaccagtccccatcaatgtcacttgatttaacaagactgccttccccctccttcccttgttatgccagaaaataactatctttctagtgag

SEQ ID NO: 98445 - DNA, 1027 bp, Homo sapiens
tttgcagtcttaagtttctaggccaggaaataattttaaataaaaataaatgtataagaagaatatgaatacatactaaagcagtaatgcgagtctatggaagaagaatgttatataatttgtgttttaaactatttcatatcctaaaattcaaagagatttgatcactttatataagtaggccctttgattttataggatataaatttgcttttttgatttattcctggtattctcatcatagaagtcacatgttggtctttgatatgtttcagaagaataaaatcattttgaatttcagaagatatagatcttttgatggaccttcctgaacttcataggccatagctgtgctgtcgtttttttttttttaagccgttcatttctcctagtctttgttgctatactttggtctggaaagttcttgtccctttttgtagcttcctttttggttaacattgttctcatcatgtgttcatttccggcgtaacttctaaagagagtgttaatgtaccattggattccacattgacttcaaagtttttatttactgacctttcactgggagagaaactggtgtaggtacagttttaagataaacttgggcaggttaagattctccttaatttctagctaagttccttgaaaaactaagcttttcatggacctaagaataaaagctacttgagagtttctaaaatctattatactccctgaagacagaaacatacttaagtgaaaaacttgccattttaaaatatatccactaggtaaggaaatctagtaatatagcagtaccaacttatttcttgcattaatattttcatctaatcatttgtacattcagcaaacttggaccacacacagtcccagaaattgaggtgtgggggtaaagtacaggttaattttgcagtaggataaatgcctgtatgtatggctatccatctttataccttgaaatatgttaacataaaaaagttttaattaaattacagtaataaaaacccaaagagcgtgaaactccctc

SEQ ID NO: 98446 - DNA, 1562 bp, Homo sapiens
tggagtacagtggcatgattatggctcactgcagctccaacctccaggctgaagtgatcctcctacctcagcctcctgagtagctagggctacaggcatgtgccaccatgcccagctaattttttaattttttatagagacgggctctcactatgttgcctaggttggtcttgaactcctgggctcaagcaatccctcccaccttggcctcccaaaatgctgggattagaagtgtgtgccaccgcacccagcctcctagttacagtttttagactcgagatttccccggctatttcttgccagttaggtaccatcgtgggattctactacttttattttgtttaatttgaaccagaagactgtcagtccctgatctgtgtggtttcttgtgccctgatctgtgtggtttcttgtgcctgccttcttataactaattctaatcaatactttgcctctcttttcctttctagaacacaagcagacattcccaaacattctaaagaagggttacctggagattagaaaggaccatgacagttactggcaaagctgttatgcagaactttcaccttacaacttatacttctacagcctcgacagcagtgggaatcaaaacctttatgccacgtaccagctttcacacttccagagcatatctgttttaggcaacctggaggccaggatggtggatactgttttgtatgacaacactcagctacagctaaaggcagagtcaccatgggaggctttggactggggacagaagctttgggaagtagtgcatgctgctgtgcccggttacatggggcggcagaatgagctgacaatctcaccagggcttggccatcatgatgactatacacagaatcatagtttccagaagaaaaccagtgggctgctgccaccgtcccctgtcctggacagctccaaacagtaccaaaacatcctcaaatcagggactctctacaggctgactgtccaaaacaactggaaggcatttacatttgtgctgagcagggcttaccttatggcttttcagcctggcaagctagacgaggatccactgttgagctacaacgtggacgtgtgtctggctgtccagatggacaacctggatggctgcgactcttgctttcaagtcattttcccccaggatgtccttcgcctccgagctgagacccgacagagggctcaggaatggatggaggctctgaagatagctgccaatgtggcgaggagttcagagcaaaacctgcaagtcacactgaggaacaaacccaaggatcaaatgggtgggcatgaactcaggaagaacaaacgccaatctgtgactaccagcttcctgagcattttgacgactttgtctttggaacgaggactcactgctcagagtttcaaatgtgcaggtatgaagcagattttcagcctatagctcattaaagaacaatcctgaaccccacaattggaattcactttaaaaatccccttaataggctagtcacagctatctcctgtttataaaaagtatctctcctcgagaagcttactgtattaaaacatcc

SEQ ID NO: 98447 - DNA, 1372 bp, Homo sapiens
tgaggattgagcacaaagtcaaggtggaaagaacacagcgtatgtatgagatggtcaggaggctaacctagaacaggggtacattttggagtagtgagctgagactttggaggaccttcaaagccatatgaatagacttactgtgatatatttggcaagaagcaaccacacatgtcttgagactcaagattaaaagggtatttaataagaaatatggaagttggtggggtgaaagtggtgatagggtagcagggaccctccttttcagtggctttatgtgtccatgtaaagggacgtcagctggaatagcactcttggcctccgtccatccctttgcacaccccacccatgagaaggaggagtgacttattggcaagtttaggagaggaaccaggtaattcagctgctgtcctaagagcactaattctggtccgctcccccagatctgctcctccatgccatcagcccttcatgggcagtttcccaggaggggaggcctctggctatccagtgatgcttgtgactcagaggtaagtctctgaaatcctggggttcaatttgctgctacgcaactaagttgcatcctccaactgtctgatgttttgatccccatgtatctgaccaccctctgtctatctcaattggttcaaaagttgggtgaggaaaaggaaggctcttcagtgggtctcctcaggccccaacagtgcatggaatgattggtaggtggaaagaactaagggatggaaaccaatcagaaggtctgccaggcgtcatgatgtgtgatgaggactcagattagtgttgaggactcagattagtgtgatagtggcaataaagagaaagtgggacttgtgaaaaggaaaagaaaggctgtaattggggatagatggaggataatggatgaaggaaagggaaaatctaagtgaaggcccaccatctggaatgctctttaccccttcctgccgtctctgaatatcaattctatcctgtcttcaaagtctacctcagataccacctccttctcaagacttttaagaacttcccaggcaaaagccctctctttcttctcttgcgtgttagaaggctctgagtactttatgctgcatattgcagatactttggggcccatcttttctccactatgggctataaactctgttgacacgatctgtgtctgattggtttggtatctccacagattgtagcaaagtcctttgctgatacagtcaacaatatttatggagctagcctctggtattcaggaaggagagagatatcaaggttcctgttctcaggaggagagagttctttgaaggaaataaagcaagaggtgtgatggagaacgattgaggggctctttaacctgagtgtt

SEQ ID NO: 98448 - DNA, 1045 bp, Homo sapiens
ccagttgtttccatagctctattgctgaagcacccctcttggttgggtgaatgttcatgaagccatttctggaaccagcttaggaggctaaggcctcctggagcctgtgacatggaagctttggaagtggatgatatcagcccagccttagaagttacggaggaattctttagtactttggatagtaatctagaaaaggctgtgcagcaggcagaggtttatgggatccaggaagtccctgaactggtggggcatgaggtactcagtaacataacagacaatggtgctatgagaaatgtcacctccctgggcaaggggggcatgatttgggaccactgtaagagcaggctcttagaaaccaaagctcaaaatgtcttccctgccaaagaacagtttatggtccagagagggacaaccccagataatctttcctggatggaacaaaaggaagcatcaacctttaatttcttcaatatctgtcagcgtcggagggaccggcctcgttctgtaaatgacttactggatgagacctcaactttcaagccagggcatgctcgatcacgatcagatattacccaagtggactggagggtagtcctcaaaaccacgcctttgcagcagcagcaacagcagcagccattgcttcaaggcccgcatgtcaccaggccatcttttctgttgccctcaccaaataagatagaagatgctcaaggaaatactggtatgtttttaaattttatttatttccttttttttttttttctttttggggctgtgactcagataagcttgtatgtttttatatctgacttctactgaatcattgttggtttttcctttgtctctcttaatctggctcatgagaatcttatgctccagcatccacatctgccttgcatatttaagctctctcttccattttcttgtgtactttacagtcttattatcttcctaagaggtatttagtgaaaagacaattacggtaaattctccctttctaatcttgtatgttagaatcggaatactctcatacttaatgtattaa

SEQ ID NO: 98449 - DNA, 1035 bp, Homo sapiens
gactgttgacattccagaaaatgtcgacatcactctgaagggacgcacagttatcgtgaagggccccagaggaggcctgtggagggacttcagtcacatcaatgtagaactcagccttcttaggaagaaagaggctccgggttgacaaatagtgaggtaacaaaaaggaactggctaccgttcagactatttatagtcacacacagaacatgatcaaggatgttacactgggcttctgttacaagatgaggtctgtgtctgctcacttccccgtcaacgttgttatccaggagaatgggtctcttattgaaatctgaaatttcttcggtgaaaaatacatccccagggtttggaggaggtcaggtgttgcttgtttggtatctcaagcccagaaagatgaattaatccttgaaggaaacaacattcagcttgtttcaaattcagctgcttcgattcagcaagccacaacagttaaaaacaaggatatcagaaaaattttggatggtacctatgtctctgaaaaaggaacagttcagcaggctgaagatctaagagttgtccagctacagaaacaagatgctggaagactcctaagacctatttgtgatatttaaatgatgcaataaaagacctttgattttgggaaaaaataggtgtctgaactataaaatgggaagaaaggggtatgtgggagataagtctggaaaggtgaagtgtcagtcaagacacttgcagttgtaaatgtcagaaaccaacacaaactcccttgagataacatgggattaattgataatagaactatagggtctaggaggtgaggttaagctccaagcctgaggagatcctgggactcaagcaaggtcatttgctcttactctcccaccacaccttccaactcccctcacacaaaatcttcatccctcccttggtgttactctcctctctcctgtcaccctccttcccttgttctgcagacaggcattctcacatggtgggaaagatggccatcaggggcctccaattcacatccttcca

SEQ ID NO: 98450 - DNA, 1045 bp, Homo sapiens
gcgtggtggcgcctgtagtcccagctacttggaggctgaggcaggagaatggcatgaacccaggaggcggagcttgcagtgagccgagatcccgccactgcatgcactccagcctgggtgacagagtgagacaccgtctcaaaaaaaaaaagtgtcaggacagtggcaagcaataatataatcgctctcttcatcaccactcatgagaaattcatgctatcatgaaaggaaatgagacatagagagaggacaatttaaatttaaatccaaagcaatacatcagaaattcaaaataatatcctacaagcataatacataactgctaaaaggccaaaaactgatttgctttgggtaggattggttaagagaagtataactttttaatgtaaaaataatttcaaacttagagaaaatttgcaagaataatatacaaagaacccacgtattccttttatacagtcacgaatggttaatgttttgttctgttagctttattatattctgtctttgtctctctgtatatagataaagatatataatttttttctgagccattagaagttatgtatatatactctaccactttactctatgtacctctgtgtgtatttcttaagaacaaagtaattctcttaaataaccatagaatagttatcaacttcagaatatctattattggtacttttatttaatgtactctctatacaccaattttgtcaattgacccaataatgttctttttaagcatttttttccttctgtataagatccagtatgggatcacatattgcatttagttgggaaatataactcaatttccaaatatatcagaataattccatgaaaattcctttgtaattacattaatctaatctatctttgtcagtaagttagtatctgatatttgaccttaacttcctatagacttaaagtaatgtctgtgtccatgttaaattgatgtgcttgataccaaaatcatcttttattctgcaggtcacttagaaaattggaattgtaccatggaacttcataatagattctctgg

SEQ ID NO: 98451 - DNA, 1028 bp, Homo sapiens
aggttttcagacacacagccaaagcacaaagtaggtgtgagattgtaaattggaccaaactgataccagctattttgggagtactttcctgataccgtggttaaaagtctagcctttggagtcaggtgctctgggtttgaatctagagccgactgcttaccagctatgggacatcaggcaagatacttaaactctctgtgccttagtttcctcatctgcaaaatggaagaataatgatatctacctcttaagcttgttggggtgattaactgagattattcatgttaaaaggttagaacagtgcttagcatggagtaaaccccaaataaatactagctattattatcttttcagcatttgaaaaatactatccacaagttaattggctgttactctgttgatgcaaataagcatgttgaggagaaagtttgtattaatttctgtatcccaaatgtttctatccttgatccctctctcagcaataataattttcttttttcctgcttaaagtctcccctgctcctcccctgtccatctgattcctgatttatttgtggtggaattcagagaatggtcggagatggacagggttggaaagaaaggagaaagggaggagggctctttgttcttccagctctgggctctcagctgtaatgtgcaaagtgaagagaaaatttaagaagtcagagagacttctctgatcaacagaataaaagctgagcggggagagaatcagaaaagtggtacagggtgggtgtctgggattctgggatattttagagttttgttgaatgagagatgttagatatgctggaaggctgtaaggtagaaaacggggaagggaactttgagaactgatatactgacttatgattgggtttgcatcaggaaacaagtgacaatttaaattttatttttatttagtttggctgttgtaccatgcatttttaaattgaatctctgaatagactggactacatgaggcttaggatttattcagatttcagaggcaaactgtcttctctgtc

SEQ ID NO: 98452 - DNA, 1009 bp, Homo sapiens
aggatacatttctcggaaggggtcatatttgagctacatgataaaagagaggtaggtgcctctaggcagaaaaggaggaaatggctataaagggaactatgtgaagagtgtctgtgcatgacagggcattctaggaaatgggaaccaagtacaggaacaaaaggccatgtgtgcaagttcacgttcatatacttcacgtgccccatcaatggactgtggacagtgtgtccgttggacagtactcaacaattggactcaaggattctgagttgattaaataggccaaatgctgtgactagcaggtgttcatgccgcagatgatggacagattttaaaagtaggactgttttcctttcaggttccccgagtttcatctctctgcctctccttgcacccctttgccatgttaacagcacccaaagcagcagcatacgcccgcaaacagagtaagcctggttactttcacctgcttagaggaatgtaagtcaaactaggaaattaggaagtaggctcaccaggtaaggtcaaaattgtaatgggaattagatttctatgtctggttgaatttaaaagaaccaggggctcttagggcttgatttccctccattactgaaatcaaggaagtcttgtttctcagatgctttggtgatgggagcaaagcactccaaaagcaaaggatctaaaactgtgagtgggctggctcacactggtaatcccagcactttgggaggctgggctggaaggatctcttgtgtgcccagaagtttgagaccagcctgggaaacttagtgaaacttcatccctacaaaaataagccgggcacagtggctcatgcctgtaatcccagcactttgggaggccgaggcgggcagatcacctgagttcaggagtttgagaccagcctggccaacacggtgaaaccctatctctactaaaaatacaaaaattagctgggtgtggtggtaggcgcctgtaatcccagctactcaggaggctgaggcgagataat

SEQ ID NO: 98453 - DNA, 1844 bp, Homo sapiens
ataggcgtgagccaccaggcccggcctgtcttttgtttttcttaagacactgatagaaataacaacattataactttttttaaggacatgtaacggtttgtgggaaggtgggtaaaggtttggctatgccctgaataagttttgttatgtttaagaatgaggaagaagtgtgatgattttggtctcagcagcattagtctgaaccgaaactcaatgataatttcacccccaaagctacatagcaagaaacctaactgagtatgtatggctgtctctactgccggttgcctagagagcctgagtactgagcctgggtcagccccaggaaccctgaacatagtcattgtctatagattttgtagcttactaacatgaatgcgttttcttccagaaacaaatagaatactattttaagtagcatttctaggactttaccactacctgctaccatatcagagaccaactaaattttcttttttttttccttcccgttagtgtgcaacgttctgactacttgaatacatttgagttcatggataaacttggagaaaacttgaagatcaaactagctcaggccaaactttaagttcatacctgagctaagaaggataattgtcttttggtaactaggtctacaggtttacatttttctgtgttacactcaaggataaaggcaaaatcaattttgtaatttgtttagaagccagagtttatcttttctataagtttacagcctttttcttatatatacagttattgccacctttgtgaacatggcaagggacttttttacaatttttattttattttctagtaccagcctaggaattcggttagtactcatttgtattcactgtcactttttctcatgttctaattataaatgaccaaaatcaagattgctcaaaagggtaaatgatagccacagtattgctccctaaaatatgcataaagtagaaattcactgccttcccctcctgtccatgaccttgggcacagggaagttctggtgtcatagatatcccgttttgtgaggtagagctgtgcattaaacttgcacatgactggaacgaagtaggagtgcaactcaaatgtgttgaagatactgcagtcatttttgtaaagaccttgctgaatgtttccaatagactaaatactgtttaggccgcaggagagtttggaatccggaataaatactacctggaggtttgtcctctccatttttctctttctcctcctggcctggcctgaatattatactactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattaccattcttctgcgtttctgtttattggatgccaagcaccacgctacatcctagccataggagtgtaatctgaaaaaattctctgctcttaaaaagtttaccatggtggaaatagataagtaaatagtaagatgtagatcctgcagtgaaaggaaagaggaccaaagagggaactacaggaagaattaaggaatattagagaatagattatgtctatgcacatgctaaggagtttagtcattatcttataaatgattagggagccaatgaagacttttaagaaataagggacttgatcatatttttatttttaaaaatagcactctgggaaactttgataaaaaatggatagtggctttgagaggccaaggcaggcagatcacaaggtcaggagttcgagaccagcctggcc

SEQ ID NO: 98454 - DNA, 1031 bp, Homo sapiens
acataggttacagagaggaatgttatcaacaagcattttcctttacctctggtgcagtgaaatgtcacataaggctacaaatctaaaagtcacatggatagatccttttaacaagtttcaaagatagcacttcaaaaagagattacagcctggaaaaaggagaccaatatagacaagagatagaagagattgtgacctttttcaaattagaaaatgccttaagtttcaaacactagtaccatgccatgaaaatgtgtttttttaaagtttctgtttggtaaaatatttctaactctcctaaaacttctagcccatgtggttagtatctaaagaagtctgtcacctaaacaaaaaactattctgttttggggaactatgagacatttggaaacctctataactaggatgattggagtgttgtgttttttttcccctcttttagcttccatttttgcctggaccagagggttagcccacagagcaaagcttgataacaataaagagcttgccttctttgcaaatgctttggaagaagtctctattgagacaattgaggctggcttcatgaccaaggacttggctgcttgcattaaaggtttacccaagtaagtataagatgccctagtttctatggtcaaattaacacttatcctcactgggctcagagcatcggtgctttctggaattatataaattgttattcatcatctagttcaggagtcagcagatatctgtaaattgtcagatagtgaacattttaggctttgtggaacatatagtctttttgcaactacacaactattcaactttgcctctgccattgtagcaggaaagcagtcatagacaatacagaatcaaatggtgtggctggtaccaatcaaacttttatgttcaaaaccagcctcgatttggttcatgtgctgggctgtaatttgctgacatcccatctagttgataatcattgaacgaaaaggttctatttaattttaagaagcagattatagacaaatagaaacaaagatacttcagag

SEQ ID NO: 98455 - DNA, 1015 bp, Homo sapiens
acccccttttatttttaaagagcaatatttactaagggaaaaaggtggtccttagacttacacttattatactaattatatggagagaaaccaggccattattgcctctatctggtgaaaaacaggaggcaaagggcagagtttgatggtttccattcattttcctgatagacagcttcccattacaagaggaggggcagcccagcagtctagcctctcttagttctctttgtagttggcacccatcttctgtgtttagggtgtgccagtgctaaaacttggcagattttggtgtactcagagccttcgctttctgcataatgagctctatatgccatcactgcagttgtaggttataactatccatttgtctgaaaaactttgcttctaatttttctctttcaagctatgatttaggcatagagaatcgtgatgccaccaacgaccaagtcaccaaggatgctgcagaagctataaagaagcataatgttggcgtcaaatgtgccactatcactcctgatgagaagagggttgaggagttcaagttgaaacaaatgtggaaatcaccaaatggcaccatacgaaatattctgggtggcacggtcttcagagaagccattatctgcaaaaatatcccccggcttgtgagtggatgggtaaaacctatcatcataggtcgtcatgcttatggggatcaagtaagtcatgttggcaataatgtgattttgcatgttttttttttcatggcccagaaatttccaacttgtatgtgttttattcttatcttttggtatctacacccattaagcaaggtatgaaattgagaaatgcatatatgtataactgtatatttacacacatttagctaaaggcaaatacaaataaacttacaaataggcgtccatctcaacacattttttttcaaacatgctgttttttttcctttatccttttattcagttataccatatgatattgccatttttatgttggtaatttcatatggttcaaccag

SEQ ID NO: 98456 - DNA, 1007 bp, Homo sapiens
taagaaattaggcataaaaacatcttccaactaggttaaaaaaaaaaagcatcttaggaactcctgtttcaggactttacatgacagtaggtgaactggcagggttcttttccttataatggctgcaactaaagatgctttgagcctctttagtgtggaatcatgaggagttttaaaggggagtcactatgactaggaggaaaaaatttggtggctgcagactagataatttttggaggctcaaacaagttttaaatttttccaaaattcctattattatcactgactggttctttttcaggagaatggagcaggtagtttgttttatgtaggctggacagtggtctgggcaatttgttccttcctttcttatcttcttagaaatgttaagaagacaagcaaaaaatctaataatttgctgatagattctccttatgagaaatggttcctaggaacttgaaaactactgatcatacttcctgttggagttgggattggatcaacatttcctatgcaagaagataacaaaggacatgactttgttagatttatatgaattatctaaagtcgaagcagttggaagttatttttatttggaaatatgtcaagattactatctctttgtttgcatcatgagttgggtaggagatctaagaaaggaagataagggaaccaaaaagaaatctagaggcaggttttaagagctgaaaaaccttttaaatccttggagaacagaataaacaaaacattattttgttttcttgctttttaacaaactattgcatgcttcaaataaagctttgcagtcattttctatgctccctggacaactaacattctttcagctctgaatgacctgcaatctttgtgttggtgtatattaagctattactctctggtatgtagaaaaccattgatggattcctttacttacccaataaattgtaggcttgtttccagagcaaacacttgctcaagaattacagaaggaattagctgggcatggt

SEQ ID NO: 98457 - DNA, 1108 bp, Homo sapiens
tttccgccaggcgtggtggctcacgccagtaatcccaacacttggggatgccaaggcgggcagatcacttgaggtcaggagttcaagaccagcctggccaatatggtgaaaccccatctctgctaaaaatacaaaaattagccaggcgtggtggcccgcgcctgtaatcccagctgctcaggagactgaggcaggagaatcacttgaaccgtagaggtggaggttgcagtaagccaagatcgtgccactgcactccagcctgggtgacagagccagactccgtatcaaaaataaaaaagtgtttttcttcactttacaatcaaccttcttgaaaaggttttcttgtctccctttccataccccccattcatgcttcagtcccctgtagtatggcttctatcttctgatcctcgtagaaccattccacttctatcttcttcatcctcatagagcctttttactaaaagtgcattcaagaggttttccttttgccaaaattattttcagaccctgtctttttcttttaatctctctgtagtactccctcttttttgaaaactttcttgtctgttggcttctatgacatcaggctctgctgattctttgttaacccccagactctccttctcattctctttgtgggggctccttttcctctacctgacctttaagacgtaagtgtccctcagagttctcactgagattgacttttctccttactttgaagtcctagataatatatactctgtcttcaactgttatcaagacatgctaaagattcccaaatttctttctccagcccaccctttctgaactgcagatgaggccaactgcctcctggacatcatcttgctgtcccatggcatcgcaaagttaagaaaccttaaacttaacccatgatcttggccatcagatctgtgactctatgtatattccttctttgttgaactgcaccttgtctcccaaactccaaattcagaattcccttttgccgttctctctctcataatcttcatggacaatcaatgaccaagctctattcattctacctcagttttttttcgataatcaaaatgaaaatacaaccacattagaatatttatgagaa

SEQ ID NO: 98458 - DNA, 1056 bp, Homo sapiens
acctgtaatcccagcactttgggaggctgaggcgggtggatcacgaggtcaggagatcaagaccatcctggctaacacggtgaaatcccgtctctactaaaaatacaaaaaaattagccgggcatggtggcaggcgcctgtagtcccagctactcaggaggctgaggcaggagaatggcgtgaacccaggaggcggggcttgcagtgagccgagattgcgcgactgtactccagcctgggtgacagagcgtgactccatctcaaaaaataaaaataaaataaaaaactaaatgttaaaaggagatttcttttaatagagaaagtagtcgtctttttttgttattctttttttcttaatatgctttaagttagtccatagaatggactttgttcttttgggggttaatagctaaaatatttaaagcaatgaaactgaaaggaacagtacatgggaggaaaggtttatatttttcaaaaattggaagctgtcagtaggcttcttgttgacttaaaactgttagactaaggtgtacatgtaatgacatcaaatggaaagatatttttaaaatgagctctttttaagtaatatgtcttttacttgggacaagaattaaaaaacatggcctatatcttttgtcttttgtttgtctgtattacttgaagtatgttagaaagtaattcttgttgttgtatagaatttggagaggttaatagtgttaattaactcagtagaacctttaataatattaactgaattttatttatgatcatgtttaaagtgctatgaaaaccctttagtacatttttaagacaatgatacttaaaaaaaaaaactattttttagaagagttttagatttacagaaaaattgggaagatagaatttccgtatactcccatacccagttttcctcatattaacattttacattagtctggtacatttgttacaattaatgaactgttattgatagattattaactaaattacgtattttatttagatttcttgagtttttaccagttgttctttttatattctaggatcccatttgtc

SEQ ID NO: 98459 - DNA, 1025 bp, Homo sapiens
tgtaattttggtctaaattaaggaaataataagtgacaactttggtgggcataccctattttggccatgaggctggaatttgggcttattagtgatagatttggcttcagtattgctatgtcaggtataaatgatcctttcctatttggagctgtggggttggggaagtgacagggaaggataggattggagttttagcaattttctggcagttttaatttgcttggacataggtcaggttttaccatggcaaaatttgccatcctggatgttgtgaagtctgtcagaatctttgaaggctgggctattaaacttctttctgatcatcttctgtatgagactttggatatatggtctacagatatagacagaactgaactgtttgatcctattgcttacctgtttgactttagagaccaagctaagttaaccctccttgattgctttttcttctgctaaatttctagcatgcatttattataggttggaccaaagggcttaaggagtcattaatgaattttggaccatttaagtgatgttcccattccaggcctgaaaaccatcaatggtctcagacaatgcttgtcttaggcagccttgactcgcttgtaaaacagcattttacatgagaagaaatactttcagtagcctcttacccttataaagacttgttttaactctcaattcatataaccgggtgggagaacataattatatgccaacaataagaggcagtttccatcacatatataccttgttgtatatagatactagggactgttaacaaggttgctttttttttaatccaactcagacacaagaaggaaagcagaacctacctttggaggtcatgaccctcgtacagctgttcagcttcgaagcctcagcacagtattaaaacgcctcaaggaaatcatggaggggaaaagccaggtactgtctagaggctttggaagattacttattaagcgcttatggggatcatgccatacctaatgaaaatggcttaatgccactgaaagaaa

SEQ ID NO: 98460 - DNA, 1157 bp, Homo sapiens
gacctcaggtgatctgccgcctcggcctcccaaagtgttgggattataggcgtgagccaccacgtctggcctggtatgttacattttaaactcattataaatgtttatggtagtttggacacctggatgaatttatcataatgatggctctttttttttcttttaacttctaacttttgatttttagtgccagaattcaaaatggcccttaaatatatataatagagctaacaaaattatttcactttttaaaatgtctttttttgagagtctgtacttgaagacatttccgttattagatgaactgttgacccaaggagttaaaaaagttacgttaagcaatatgttactgctatcttttccttcaatttccttgtttttgtttttgtttttttctcctaggagacctccgagcttgcacatattgtagaaaaatagccttaagttatgctcattccacagacagtaattctattggggaagacttgaatgctctttcagattctgcttgctctgtgtctgtgcttgatccaagtgaaccccgaacacctgttgggagtaggaaagccagccgtaacatatttttagaggatgatttggcctggcaaaggtattgtcccttaaatataattttatttagagttgaaaaatatcgatagttgtctgacctttgagtgctttcagttaacacttaccctcttagaattatttcctgtcagttcactgtgttctcctttttctttggcttgcctccagaatgtttgcagatgtttatggatagtgatgatattggctaattagaatgtaagctccatgagaggagactttacatctttcttgtcactgttctaccccaggcaccaagaacagcgcatggcatgtatataatcttgataatatttgttgaacaggcaacaaattgagatttttaatttaattaatgaacagaagtcattgagattattaatttctaatgtagccttctgtgagaagaagaatgcctgtacaatatgtattcatatttccaagtgaaattagattttttttccttctgaaggtatatgtcatgtttttctgtaagtatactgcactgctacttcatgtttttttgtaagtatactgcactgcttggtagtagagggtgctaactcttggaa

SEQ ID NO: 98461 - DNA, 1174 bp, Homo sapiens
ggttatggggactgagaataaaatatttgaactcaagatttccctccaaaatcaatttcatcttgtattaataatgttagacgtttcaaaggcacccatccaactaactttatttacattccatatacttaaaaactttttaaaattgtcatttcggcattttatattcttaaaagccatgcactgcaaaaactatcattcataccatttacaccctaattaaaggaagaacaaaaatgacacataatctcattattgcaaggaaaaagattaaatctgcttttaatgttaaagcgcctcattgaaattcccttttactgtcctgaattatttcagtattttcctattttctttatagtttgattcatccagattcctcaaatactcctctttcaacaagacttgtatctgtgcaagaggatgctgggaaatctcctgctcgaaataggtaaactgacaaatgaaaacactgtgctctctgatgtttatttcttttcatgctaataagaagaacaaacggataaaaagggtgggattgattgtcatatacttccgtagctctaaaagctgaattaaactatcattttctttttgctattcagcccttgtttccattctctcagtgactttccagtattctccagtggcttccgggtttggaacctacaccatcctttctcttctggttaaataagacgtgaaggatgtgagggaaggagccatgtggacattttgtggaggagtgtcccaagaaaacaggaataacaaattcctgagaggaaatacacttggcaaggaataacaaggaatcctatgataatggagtagagcagtcttagagttaattataaggactctgtcatttactctgagtgagatgggaagctgttggagagttttacattttttgtcgttaatttttaattgctttgaaaaaatgtcaaacatgcagaaaagttgcgagaatagaaaaatatatcttcatgtatttttcattaagatttactaatttatattttgtccctttgctttctcattttttctttttttaatttttatttatcttattattatttttgagacggagtctcactctctcgccaggctggagtgcggtggtgtgatctcagctcactgcaagctctgcctcctgggttcatgccattctcctgcc

SEQ ID NO: 98462 - DNA, 1012 bp, Homo sapiens
tgttggccaggctggtctcaaactcctgacctcaggtgatccacctgcctcggcctcccaaagtgctgggattataggtgtgagccaccacgcctggacgaaacagacaaattctaaatatattttgattgtagagctaataggatttgctaatcaactggatgtaggcttcaacagaaagacatcaaaggtgactcaggtctttgacctgagcagttggaggggtggaattaccaactgggaggaacagtttggttttagatgtgttgaatttgagatatcttctagacatccaagtgagatgtcaaatagttggatatatgagtccagaatttaggggagggctacaggctagagatgtaaacttggatgttgtcatcatgtgtatggtatttatgaacttggatggagatcatcaagagaatgagtgtgaaaagggaggaaataaggactaaggactgagattggagaaatcaagagaaaccagaaaaggagacggggagaggccagtgaggggacagggaaaccaggagggtatttatcttattagtcaagtggagaaagtttttcaaggaaagggagttatgctgctgatatgttaagtaagatgaggagtgaaaactgactattggatttaacaacaacattggtaatcttgataggcagtctcagtgggttgtttggggtttaagagataatggaagaattactggagatgagagttttgctgtaaagtagagggaaatgcagccgagggatgtggagtcaggagatggctttttaaaaagatggggaaaattacagtattcctgttggcatgtgtagaagtgtagggatacctgtgctaatttacagtctatctccatgtgttttgaattaatgctaagactgatgtaagtctttaggaaagacgtaatttagtcaatgaatgctgtctctaaatataattttaatcagtattcttgctactaggctatttattacagcttttgacattaaaattgactaattt

SEQ ID NO: 98463 - DNA, 1049 bp, Homo sapiens
tttcattctttatatttgttattaaaaaaaaaatccactaacttacagcattttaacaagaagactttgtatctattccctttgaaatattactgatatatgaactatgtaattgttttcctgtaatctttccataactactttcttttaaacttatttccaagtaattttagacacacatagaattgcaaaatatagacttacatagggttgcaaatatcgtacagagagtttctgggtatcctttaccaaatttctcccaatgataatatcatgcataaccatcataagtacttttaaaagtacccttaacattggtaaataagcatttatttaaaaatgaattttctctgtaattctgtttattgaagaagaatttacacctgtgatttcacttcttgtttttatttccagatcagccagcattactaacctgtcactggatagatctggttctcctatggtaccttcatatgagacatctgtcagtccccaggctaaccgaacatatgttaggacagagaccactgaggatgaacgcaaaattcttctggtactggtccagtatctttgacccattgctagttttgagcatagagaatgttcatgtgactgagtctttttttttctttttgagacacggtcttggtgtgctgcccaggctggggtgcagtggtgtgatcttggctccctgcaacctctgcctctcagattcaagcgattctggtgccttagtctcctgagtagctgggattacaggcgcatgccactacacctaattttttgtatttttagtagagacatggtttcgccctgttggctaggctggtctcaaactcctgacctcaagtgatctgcccgccttggctcccagagtgctgggattacaggtgtgagccactgcacccagcctgtcactgagtctttttaataagaaatatataagtgaaatagcatatcagttaaacagaagtgcttagcttcagttttactaggatcacctgagagatgggtcaagtattctatactcattgcattaatattttctt

SEQ ID NO: 98464 - DNA, 2507 bp, Homo sapiens
tggctccaactaaatggaaacatctgatagcagtctttgtcttagatacagtattttcttaaaccaacttgttaggttgacatttctagattttaccatagtctatagtttgtagcagcttaaaaataactgaactaataatatggcagcagacaactttctcatctcttcactataatatcagactttctctctgcagaacctccaatatatttcttcattttaaaaattgattttatatttaacttgttcaaattttattaagtctacacagaagtacatgaaaatactgtatccattttggtattgcacattgggcttgtatattaaaaaaacatttttctcctttcctccaataccctgataaaacccatttttactcccctcctctccctatatttctttccccttcccaacactaaaagattctgccagtcctagcaagcgcacatcagtcagcagtttccagtccacagtggacagtgactcagccgcttctatcagcctgaacgtggagctggacaacgtgaacttccatatcaagaagccctccaagtacccacatgtgccccctcaccctgctgaccaaaaaggtaggaggtagtcaccatctggaatccaaacacaggctggacagctgggccataggatctcatgccagcctgtccttctggcttcctctgtcccacgtggctgagggtatttggtgtgggttttgttctaccctttctcatttctcccacacctcctccccataccttttttggttgattccttttatttcttgttttctccctcagcaccaccatgcccagtgtaaagcttgtagtctttaaaaggaactacatctgactgctcttcccataatgtgcaacttccaaggtggcatttctttgcatttataacatggatgttctgctctattcttttctctttcttcatttaacattttaaagcctatttgcctttgccgttacccagtaacataatatttcactaaacccattaagatgcttgaactagattgggggaaaatcattcacacattccaaaatatctccataataattcataatgcttattatgtatattctatatttattaaaacaatttcttctctaatgtaaaatgaattcattatttttagctatcttatttgatgctttagtctactggctgaaaaataatagtgaccatattcaaaagatatttggtgtaaaaggagaaagaggtaaacattactaaaatctaacatagcagcacataagaaatgcctgtttttaaaatggatgatgaggtttactttattgggtataattaaaagccaatttaaattatagtcctatcatgggattgtgtaaaagtgaataaataaaaaatacatgagtaaataaataaatgtgggattttgttatgttgtaataactgaaaaatcattattataaagatgaagcactttattccatgattttacctggagtttgtattttaaacatataactgtctaaagtggaattgtctccttacttagatctgaaatgcttgcctaagttttgcgcactctatttcgagcctaagaatatgatcagaaaacagaagcttttgaaccaaacatttatactaaaatgatttgatacaagtttatatttctccaacaaatttctcatagttgtcagtattagctattatcaagatgtggtaaaatggtactgaagagttatagtaataaaaaggaatatgttatttaaaaataagtagagaaggtgtgttaatgagacttgactagcattgaacatgagtaagatagacatctttatggaaatcctcaaaacagaaattggaaaaatgatggagaatatttgggtgagtatgaaaggagggaaaagcagatatgacacttgtgtgagaattaactatagatggtggtcacttggaggatattatgaaggttttgaatataaacttacagatgtgggtcaggggcacacagatgatgaacatctgttctctggacacatctgttggcaatcacattttgctgtaagcagaatgtgaagtatacttttgacttggtgatgatttcatctcttggaatgttaaagaagttttgaaaatcttgaagaaagtgacctgtcatcatagaatttgtaatagggaaggatagactgctgagcacagtcagatacttacttttgaaaacctaacttgagaacattcggagtggaatggaacaggaggctccaaaaatgacattgttatggtgcaaccccagattgtatctccaaggaaattgacaggagaagcacctgcagttgacaaaaatatgaccccttttgaacctccctgatttcaatcctttttttttttttttctaagagacagggtctgactctgttgcccaggctggagtgcagtggcgcgatcttggctcactgcaacctccgcctcgtgggttcaagtgattctcccacctcagcctcctgagtagctgggattaccagtgcgca

SEQ ID NO: 98465 - DNA, 1605 bp, Homo sapiens
aaccaaactaatgaacatattcatcatttcaaatcctttttgttggggcagggtgcagtggctcatgcctgtaatcccagcaagttgggtggctgaggcaggcggattgcttgagtctaggagttcaagaccagtttaggcaatgtggcaaaaccccgtctctacaaaaaatacaaaaaaattagccgggtgtggtggtgtgcgcctgtggtcccagctatttgggaggctgaggtgggaggattgcttgagcttggcaggttgaggctgcagtgagcgatgattttgccactgcagtccagcctcggtgacagagtgagactttatctaaaaaaaaaaagaaaaaaaattccatattattcttagtggtgagaacctttgaaatttactcttagcaattttgaaatatacaatacactattattaactgtagtcatcatgctgtacagtatatctcaaaaacttattcctcctgtctgaatgaaactttttaccctttgactagcatctccccattcccttcactccctcaacctctggtaaccaccattctacttagtatgagcttttaatatgaaaaacacaaagagtgtagtgtatctggtgaatgtaagagcttatgataacactagtagttggtttttttttttttttgagacgaaattttgctcttattgtccaggctggagtgcaatggcctggtcttggctcactgcaacctccgccttccgggttaaagtgattctcctgtcttagcctcccaagtagctgggattacaggctcctgccaccatgcccggctaatttttgtatttttagtagagacagggtttcaccctgttggtcaggctggtctctaactcctgatctcaggcagtccgccaacctaggcctcccaaagtgctgggattacaggcgtgagccaccgcacccggcccactactagtattaacacgtggatttgtagcttgttgtacaaaatattgaaaggataattaataatttgatgtcaacaggaagtggatgctcctaggttatgttatagggacttgactctatatttagagttgttcacttttttttttggtcagcacttttaatgtttttttaggtccacaaataattaaaatctggaaagaatggctagcgtgttggatagcagaattgacatttaaagatctttattttctcaagcaatagattgagactaacaagatgaaagttaacacagttaaacataaaagaataaggcttaacatgtttactattagtactttggagaaagtcactcttaataatttgtgtgataaagatctaagttttagttatttgcaaacttaatagtgtgatgtgccaaccccgcactccctggcactccctagggcaataatagatttcattagtggccatataatgtctagaatgaggatccaatttactgttttgtgttcagttctcatttatgaatagaacgaggttgccaggatcctaagacatctgaaaaccatgctaaggaaagctggactatttaaaatggaaaaaagacgtggtgtttcctttaggtatctgaagagtacctgaaagaaattatatttattttgcata

SEQ ID NO: 98466 - DNA, 3487 bp, Homo sapiens
aagtctcttaataaatattactggctttcacagttctctcttagtttttaacatactaacgagttattctttttacattttttcttgtgaagttgaagcgtaatagtttgctgagtgttatagtcaagatgaacactgattatcagaaaataaagatttccagggagactggtagttacgtgaaaaaataatagaattcttttgcctctggttttcattccctttgtataaatacaaatgggaatggtttttatctttacattgaaattaaaggtagtacttattaaatattttcttatggattgtcctatattgtttcaggctgaggaaaattggatttataaaattggttgaaatatctgtactttaaaaaatactacttatgctttctgtctgaagtgagaaaaccctattttcagaagctcgtaaaactggcttaatttttcattattggtcttggagaattgtacagttaaaatatattttattatgtattacaagcaggattctgaactattcttggaaagttagcaagtaaaacctagagaagaaggtgaaaatcacggcttccgtaaatctctagatgtagttttccgtgtataggaaaacatgggatagaggagcaagttaaacacaccatgagaaaacaatggattgtactccgaatgtgggacattgcacagaacatttgacctgggttcttttaaattcatgttatgaaaagaaaaaaagacaggagatctgttctagattaaaagagaatgaagagatacaggaaccaaatgccatgtgtgaacttgattgcatcgaggcttaagaagaaaaactgtggattaaaaacattttggagacagttggataaacttgagtatgggctaattctgtgctattaagacattgttaattttctcaaatatgtaaataattttgtggctatagagaagaatacctttatttttatgagagttgtgctgatgtcctagtggtaaagtgtcatgatgtgtgtaactttgaatgatcggggggaagaaacatacacatatatggcaaatccttaacaattgttgaactcaggtggatggtatacagcattttctgtaggtttgaatttttttcataactaaatggggaaaatccaccatttctggagtctcatatagatacaattaagctttagtgtgagaaggctggtaaagaacaatacattaattgaactaataggatttggtgttactcattcctgtgagggaagagtagaaataaagtgtaacatctatcttgcccacatactcgattttattgtatttggcatagtgcacttgaactttctaaataaaatattttctttgtttcctggttggaaggatgagcatattggcttataaacatagtaacttttaaagcccagttgtttataaatgtacttggagaaaattttgtggagatcctttaccgtaaaggagtttacatgcatcatgttttaatttgcatagtggaaagaacctcatttgagctatgcttggtcacagacctagagaaagttcacggggaagtaaagagtaagtttcacttgtaagaaaagtatttaatatattaaaagcattcagagtgtgttcagttaatgtctagcaaaaatttggcagtgtttgatataatttttgaaaaacaaaaacacttatttggaactaatacaaatactgatgagttttatctttattcctgccaatgtcacttctgtattaatttgttttatagcttatattctgaaatttgaaaaaagtttatattgttttatcaggtgggttctgtatgaactgctttgtgcataggcaaagtgattatttgttaaatcatcaagttacatgtgaaaagaactgtaatcttttaggatggtcgtacaagtatctgaagatttaattttcataaaccggttggttttggtaagagaaaaacatttctctatctgacatttgaattaaggagaattgttttcacggctctattgtgttattaatgcaagtctgcttaagtttagtatgaagtgcatagaacaagtataaagaggcatttttacccaaagctttcttgaatttgccgggcagtgatgggtttagtatgagtaatattttgtgtgtgggcgtattctctatataattatgctgacatgttatagtcatatgtctctacttttgttcctcctctctgttgtctccctggtatgcagagtatttgatttctgacactggaggacaacagctctcaataagtgacgctttcatcaaaggtaattttataaaaagctgtatgtggaatggtgtctctttttttcatgaggatatacttagggcttagcacattgattagcacagagaaggtgctgaaaatatatttgattatggtggtatcatgggaacacagtttttaatatatataatgatttagagaatgttgagaaccaagaatgtaaacttggacttggtttgcgagaaggaggtctctgatgtgaaaagtaattgtttaaaaacttttaagtagaatttgaacttaattcttttaaagacatagtttacacttaactgtattgtgaatataatattaagtattgatataaatatcatcaaggattgtcaaatttgtcaaaaagcccacaggcagatctccagttaaggatgctgcttgccctgtggagtgaggaagagaagcaggcagtagaggttaaagaactaactctgatgataaatttcttttggacacaaaaggagattagccttctcctattccttccctacttagcttagcttagcttcctagagtaaagacattcttagtccatagtactccactggttaggcctcagataatgggagaaaatttctcttccttcttggctcccacggtttcagatcaaagagagaaggcaagcgggtacaaggagccactgcagcttatctgatagcttggcagtgcttctaaattcatctccaagcatctggttcggctagaagtttacagagtggccctttatgtaattgaaatgtgcaattcttgtacttcacatgtcatggacatatactttactgtgtaatctgctgggctgtttggtggaagtttttttgtttgtttgttttgcttttaagaggggacaggttagagaatttttgtaagcatttcccacttcttttctttccacttatttggtcagattattcaacagttatttagtgaacatatttttttgttaagcatttattatttattttttgtcttatctattttcattcatcctttaaaaaatttaaagattttacacaaattctacataaatgctatttattatgttttaatatttatgtttttgagtctgtcttgctaaaattttgttaaaaaacccctgtgccaatattgaaagagaaacactattgaggattgtctgaatagactttctacactgtcatctgttgttttgtgatatctgagctgagcttct

SEQ ID NO: 98467 - DNA, 1113 bp, Homo sapiens
gtgagctaccacgcgcggcccagtttgtgattttaaaggggaaattaacaccctcgtttttaaaaattaaaaggagaagcaaaagtttcattttatttgcttttcagaagctgtgcttataattattggcttgagagtcttagttacgtacatttgattttcacagttctgtttctgattttggctgttgccaattactgctcttcttaattcttgcatttctgtatttttagtgtattttatgtatttgtaagtattttcttatgcattttatttatatgtttattacatgttcttgcctttttacaccaataatttatgttggctaacttaaaacatttataaagacaaagggcaatttctaaatatatgagtagatggtataaaacaggacaatgaagtaataacttcttattttatattgtacttagaatccttatttaatcgccgagtagaggaaaaatccaaagagctgcctttcacacctttgggctggcatcataacaacctggagctcctgagggaggagaatggggagaaacaagccatggagaggttgctgtaaggcaatgaaatttttaattttaatttttcacttttattatcttcagtgacttgataagcatatgcatcattcctcttaaaaagggaggtctttttctttttccttagaaagtaaaaaaatactaaggttacttaggaaatacagtctattttgacttgtgattaaatttcttataaaaccaagagccccggctgggtgcagtggctcacgcctgtaatcccagcactttgggaggctgaggcgggaggatcacaagctcagaaggttgagaccagcctggccaacatggtaaaaccccgtctctactaataatacaaaaattagccaggcgtggtggcgctggcctgtaatcccaactactcagaggctgagacaggaggattgcttgaactcaagaggcggaggttgcagtgagctgagatcgcgccactgcactccaacctaggcaacagagcaagacttcgtctcagagaaaaaaaacaaaaacaaaagccccaaactgtgcttgtctgtccccattttacgtgttaaaatttcatttcagtcaa

SEQ ID NO: 98468 - DNA, 1020 bp, Homo sapiens
catggcactagtttattcagtcagtgagtactttagagtcctagggtagtacattagagaacaggggatgggaaaacagagtcatgcagagatgccattgatcgttggttgaaaggaagtattatttcctgaaattttttgttcttatttgattacataatagtttaaaaaaaatggaaagaaataatagcgtacatctaactagattctaagcatgttatcattgaattttattgttttcttaattgttccattagatcccaggtggaaagaagtttgattctgtggttgtcaatggctttgtttgtaccaagaacattgcacataaaaaggtaatgtgattcagttcagcagtgaagttcagcaaaccatggctgtgtgcttaggtaacaagttggggcaccttagttatggaagaaatggacaatggacaatgaaaggcagctgtgtctgccataggggtgaaatttggttggttcagggaagatttcccagagctgaggatgaatggattggaatttgaataatgggaattcaccagacagaaggaggaaggggagaggatcaggcttctagattaacagaatgataagatactggcattatttatctcctgatcctgttacgtcttagggagacagggtttctctagtaggctggagtccttccagaggcttagcattctaaaactgatagctcttctagtgctcggctacagaactgtcagtcttcttctgttatccttctcaccttatatctttgtagcactagcacaaaggagtggagtgagataacctggggtattaaggagactctgagttcctaaggtgtaatatgggcaatgtagatgaagctggaggaagcaggcaagggctttgtatgtcattaaaggtcttgaactttattctgaaatcttttgattctcagtgtagtgtacatacattgagatcacatgtggaccttttaaaaatgtctgttcttaacctaacccctagaaattctcattcagtaggttaaggg

SEQ ID NO: 98469 - DNA, 1043 bp, Homo sapiens
tcccaccaacagtgtaaaagtgttcctatttctccacatcctctccagcacatgttgtttcctgactttttaatgattgccattctatctggtgtgagatggtatctcattgtggttttgatttgcatttctctgatggccagtgatgatgagcattttttcatgtgtctgttgggtgcataaatgtcttcttttgagaagtgtctgttcatgtgcttcgcccactttttgatggggttgtttgtttttttcttgtaaatttgtttgagttttttgtagattctggatattagccctttgtcagatgagtagattgcaaaaattttctcccattctgtaggttgcctgttcactctgatgatattttaatatgtccagatactgcattttaccaggtgtaatatttctgatttatcttacttaggaaagggaattcttgaagaattatgtccagcgaatagttgatgttcgacccaccttggttcttgttgagaaaacagtgtctcggattgcccaggacatgttattggaacatggcattactttggtcattaatgtaaagtcagtgagtgtttttaattttctattgtattttaaaaaaatcacagcttttaaatttatatgcacgtatggtaggtatacaagaatctttttttctttgctgttctatttgtattgaaagtgggacagaagatatggcacctatttcattaagattcagaatttcagactggaactggaagaaagtataattgattatgtaatacttattggtgtctacaagaccaaaagtgaaatggacattagttaatcactaggtatttgttgatccttcatttttgttggagaattgctcaagcagaagacgttctctcccttgaaaagtttaccctgtgcagaacaggggccaattctaggaagttgtttttctccccacattatcttgtggtaatccatgatgcttaagtgcatttttataatgttattaatatgagtaaggtttcagtgggcatatattgattactaagcaactaagtgtagaa

SEQ ID NO: 98470 - DNA, 2663 bp, Homo sapiens
acaatgtttacttactaggaaatacctattaatagtgggtaagtgaggataggcaactgtgatcttattcatgtaagagtttttcttttacagatattaagagagtgaattaattctatttgtacttctggattgccacctccaccatcttaactttctgtttgtttttgtttgtagaacaaaccaagacactgatgttttttgaaggttgtccacagcacctaggctgtacaatcaagctaagaggaggctctgattatgagctggctcgagttaaggagatcctaatatttatgatctgtgttgcttatcattctcaactagaaatatcctttctcatggatgaatttgctatgcctcccacattaatgcaaaacccttcattccattccctgattgagggacgagggcatgagggggctgtccaagagcagtacggtggaggttccatcccctgggatcctgacatccctcctgagtctctgccctgtgatgatagcagtttgctggaattgaggattgtgtttgagaagggtgagcaggaaaataaaaatcttccgcaggctgttgcctctgtgaagcatcaagaacatagcacaacagcttgcccggcgggtctcccttgtgctttctttgcacctgtaccggaatcattgttgccactccctgtggatgaccaacaagatgctttaggcagcgagcagccagagactttgcagcaaacagttgtgctgcaggatcccaaaagccagataagagcctttagagaccctctacaggatgacactggattatatgttactgaggaagtcacctcctctgaagataaacgaaagacttattctttggcctttaagcaggaattaaaagatgtgatcctctgtatctccccagtaatcacattccgagaaccctttcttttaactgaaaaggggatgagatgctctacccgagattattttgcagagcaggtttactggtctcctctcctcaataaagaattcaaagaaatggagaacaggaggaagaaacagctgctcagggatctctctggacttcagggcatgaatggaagtattcaggccaagtctattcaagtcttaccctcacatgagctagtgagcactagaattgctgagcatctgggcgatagccagagcttgggtagaatgctggccgattatcgagccagaggaggaagaattcagcccaaaaattcagacccttttgctcattcaaaggatgcatcaagtacttcaagtggccaatcaggaagcaaaaatgagggtgatgaagagagagggcttattctgagtgatgctgtgtggtcaacaaaggtgagccagaccactttctgatgctcctgtgcatttaggatgtgttgaatgactcctcaaaggcaggctaaaaaaatcagtttggcagactgcatgcagatttgtgaaatatttcttctcctatgctatttttgtttttgtcttgagtctgctggcttatgtgttactttaatatgtatgaagcagaattgtaatgaaactgggtttcagggttttaaggtgagcttataataagctaggaagatccctgaagtaaggggaaatgtggagctgcttaaaatttctgacaacatgacttggatgtggtatgataatcctggatccttgtgtcagggagtgagagatggaagcttattgtaggaaatagatgtgtttttttaaaaaagttagcagcaaatatatttgttttctcaaaaaaagttagctctttttttaacataaaacattttaccttgttatttaactatgacagtgatctttttctttttaggcataaattgagagcaaattaaggaaggtttatagatccattattgataatggtagcaataaaactaattaacaaatccattgctagatgaggaaatgcaattgtttaataaaacgagaagatgtccaatttcgccagtagtcaaggaagtgctaaataatgtatgttcaatttcactagtagtcaaggaagtgctaaataatagtggtgctaaataattttttatttgtcagattgacaaaaaggaaagtcgtaaaagacccatggttaatgatggcatggaaaaacacctttcataaattttatgtaagtttatacaaatgtaggtatatgtacatttgtataaatttatagaaagtgataggaaagtctccattaatttacacatacatgtatatacctttgacccaggactccaactttttataatctatcctgcagaaataattaagtatgcttatataagggtgcttgcattttttaagaatatatgtacaaagatgtttattgaaacagtttaaggatgagcaggatctcaagtcatttaatgacttggataaagcccatgatatatttgaagtgttaaaaagcaaattatgttttaatatgtgttgcattattccatatttataaaaacaaaaccccctgtttgtacttaggaagtgatgtgtgtatgtgggacaggtatgtaaactagcaaaaagaatagatattttaaaaccacagagtcaaactccgcagcttaggaggtggagtagaatcaggaggagcagttttgtgtattttatgaacttcttcatatgcttctatactgtttcaattttaacagagagctg

SEQ ID NO: 98471 - DNA, 1049 bp, Homo sapiens
acattacatgttcacctttagttttaaaagtactatggaacataacttcttgtttgggggcactgtctccatgccagaacatattctgtgttttaattttggataactgaaacacttatttccagcagtgagctcatgggttcttctagtagtatagcttcagcaggaagacttgggagtggcagaacccatgggaattatctctgggagtttatatataggtcaaggcttgaataagatgtggatttcaacagttatatagccaaactgtcttgtgagcatttataggttagataaaaagttagaaactggcactttagcaagaactgctgttttccatgctcagtaaaggcatggacaagagagtaggagaccagagtcccaccttgtgctgacagggcttaagcctttgtaaaggaaacctttacctcttcttaactcagatcagttttactaaattaatattatagtttatgcatcctcattagtttcataagacactagtggattgggagtgaaaaagatgctttagtgtggcaagtctaaacttgttttattaaaacctgtttcataacaacaaagaacattacctcctttcatacttcattgtaagtaccatacatttaataggtaatcataatttgtggtctcatgaaatgtctctggggcatggtaattcttatgtttctaagaggtggtctcttctttaggattgtaacaatggaattttatggaaagaatgatcttacattaggaatatttttagagagatactgtttcaggtaagaacatatttcttccttctgttccattacacatttttgatgctcaaaatttcaagctaaaacgtaaacatgagtcggatgttaagtgactgttacatgatcctcactttcatagtgcatatcagagtatatcattcaaagaagtaataatctatttcatatttaaactgagatctcttatccagaacatccctcatatctctgcccatctaattaccctaccatcaacatttttcggatacctgtttttttacagtgattcaa

SEQ ID NO: 98472 - DNA, 1252 bp, Homo sapiens
aagcatgttctgtgatacccccatggtacatcatattcggcgctttgttcatggccaaggctgtgtgcagataatcctgaaggagttggattctccagtacctggatatcagcatacaattcttacatattcctggtgtagaatctgcaaacaggtaaatagaccctattactatattttgtttgccatttatttctttatttgtatgttttttttttttcctgaggaggtttcctatatggtactggattcgttatttgttatagagctctatttgtcattgttattttaccttccagtgctgtatgttcaatctagtattcgttttttgaagatcccatcttaggaatgtatcagtcattaaataaaatacaagtgccctatacagtaaagtatcttgaggttgtatcatgacatatctcaattttgtttattcattcaacaaacatttagcaccatttatgtgccagatactgtgctaggccctaggaatgaaaaaaagaataaggaatgacttctgttctctaggggaggagacagacttgtaaagcaataactgcagtatattaggatatttgtataataaattcgagcctatgtgagcatttctattcacatacagatgagaccatgttgaaattgatctctattggtttttatgcatgttcttgagaaaaggacatgtgttttgtttcttctttgtgcctttctttacttttctaactctggggcaaaaatttggtgccaatattgtgttttttttaaatatatgatttttatccagactgcttgcaatctggataaaatattccaaatttaacttactaccttaattaggttctttctttcttttttgagacagagtcttgctctatcgcccggtctggagtgcagtcgtgtgatctctgctcactgcaacctctgtctcctgagttcaagctgttctctgcctcagcctctggagtagctgggactacaggcatgcgccactatgcccagctaatttttgtatttttaatagagacaaggtttcactacgttagccaggctggtctcaaactcctgacctcgggtgatcgcccaccttggcctcccaaagtgttgggattacaggcctgagccacagcgcctggccttaattgggttatttcaaagtgtgcttttggaaggcacatatgggaattatatataaaataatagcacgacctacattaatcagtggtagagaagggcaaaatcaaagttgcacctg

SEQ ID NO: 98473 - DNA, 1024 bp, Homo sapiens
ttggcatttttctattataattgctttttctctcccagaataagcatgccgtctttctcagagtgtcctaatttcattctctattaaactaaaaactaatatttaggtaggcattgtggtataatggatagcgtgttggataggagtcagtcttggttgacagttgcggtactgctaccaggatttgattgtagtcaagtcatatataatctttctggatttttgtgtccatttctatgacatgagctatatgacctagatgatttttaaaaagtaaaaattctaccttttaggaagtaggcatatgaatgagcatttaaaaaatattaggtagacatggacttaatgtatgtaaatgactcatttaagattgtgtttttctttagaggatcgcttcttaacaactttgtccagccagagctccaccagttctactcatctccaattgcctacgccacctgaagtcatgtctgaacagtcagtgggagggccccctgagctagatacagccagcagttccgaaggtagaggttaagtcacttttaccatatttcattgtatctaagactgaaagatatatcattgatttacatgaattacagccatttctctaaggacagatatttgcttcataataacagattcatgccttgctttctgtttaggtggtaactacttaaattatagtataaactttgaaattaactttaaaattgctatttaactcgggtgtaatagccacagtgcttcagagatgtttaaaaaaaacaagtgtcccttggagtccatgctgtgtatgcttcactgttgtttcctgttttatcccatagtggtcttttcccttgatcagaaattttaaactgttattggtatagtatacatatgtccatattccgaaaggaaaagaaccaaagtcagcagtttatacttcttattctctgtgaatattaatatataagtagactatttttcattttagatgtgtttgatgggcatttgctgggatccacagacagccaagtga

SEQ ID NO: 98474 - DNA, 2707 bp, Homo sapiens
cttttttcaaagatatgtggctatatccactgatttaataattataaaaacatattgctggttatatatgaggttggtagttgatttgctgggacatggcattgtcctagcactgatgatgaactacagtgacttgtacaagttttcatgtgatcttttttttatggggtgcactcaaatttggaaagaatataggctggctgtgaaagtttatttttcttccactggttgacccatgtggctatcaaatgctgcccttgttatggaacaagtatatccaaaaagtggacatttttgttaataaggccttttattttattaactgacttacatatttattcaatcagtatttaaacttttatttagtgcctgtttaagtgtcctgtgatgtagaataagatttgtaaggaactgtcatcactcttaggagctcataatctttgggaagatacagttagggctcacagtacagtatgtgatatgttacatgacagtaaaatataaaaggtcccttttttctctactttagacctgattatatcagtttcttgattgggcttggatccctcttatgttatggtctttgttcatgctctcacatttatttttatttttttaatttttattatttttgagacagagtctccctctgtcacccaggctggaatgtagtggtgtgatcttggctcattgcaacctctgcctcctagattcaagtgattctcctgcctcagcttcccaagtaactgggactgcaggtgtgcgccaccacacctggctaattttcgtatttttagtagagacgaggtttcaccatattggccaggctgctctcgaactcctgacctcaggtgatctgcccacctctgtctcccaaagtactgagctactggacccggccctttaaacttttttttttaatatagtttttttctttttgtttgtttctcttctctctaaaccactttttgtgaaacacagtcttttttaatcattcagtcctgttctttctaagaagaatttactagaccttcccccttacctcctgctccagtcagagtaggtttctattatatgctcttatgattcctgtcttggtccgttcatgctgctctgatgaattaccatagactgagttgcttgtagacagcagaaatttaattcttacagtcctggaggctagaagtctgagatgagggtgccagcatggttgggttctggcaagggtcctcttttgggttgtagattgctgttgtctctttgtattctcatgtggtggaaggaggctgagagagctgtgtccagtcttttttatgaggacactaatcccattcaagagtattccactctcatgacctaaattaccccctaaaggccctacctccttataccataacattgggggttaggattttaacatatgaattttgtgggagctgggagggtaaacattcattctgtagcaattccctcatagcacttaccacagagattatatttatttatttattggattatctgtttctttacccccactacactataaaccctatggtgccaattttttttttcgccattgtattgttaacatcttacacatgtaagatccttaaaaatagtttttcttcatattgtatccttggcatgtttggtgttcagtaagtagcacctaaattaaaaatgactgtgcctaacagtgcctaggtgagttagggtcggagtcaggggagcaaaatttaagttgaaatggagctacactgggtttttttgtgtgataatagtaaagtggttgtgttgcattgtttattattgaactagtagtatgtcttctccacaatttctagaagactttttctctctagcttgtaatggaacaaaatattttagacttctgctgttcattttaaattctttttgagattagtgtggccagagtcttggcagtatggaaaggtttgtttggagtgactattgcagaactctctgatttgaaacctaattaattctgataattttctaattgccttcaaaaactttctcttgaaatctttttctttcctaatgattcaggttatcatatctgcatacattttggctttcttaattatattcttaactctagagtacttagttaacttatgtattttaaaaatttgcatagtgatccagataaacactacttaatgtatgaacatgaacgagtgcccattgcagtctgcgagaaggaacccagctccatcattgcttttgctctcaggtattattcatgggactttgacttatgatgatatctatgtattttatgtatgtctattaatcccttatttttggaatctttcacataaagcaaaatgattaaatataagcaaaaatatatgttctttagtcgtgatagcttgttcttttttttttttttttttgagacagaatgtcactctgttgcccaggctggagtgcagtggtgcaatctcggctcactgcaacctctgcctcctgggttcaagcagttctcctgcctcagcctcccgagtagctgggactacagacacacaccaccatgcccagctaatttttgtatttttagtagagatggggtttcaccataatggttgggctggtcttgaactcctgacctcaggtgatccacccacctcggcctcccaaagtgctggaattacaggcgtgagccaccatgcctggcagcttg

SEQ ID NO: 98475 - DNA, 1050 bp, Homo sapiens
tataataaataaaggtcctaatacttcaaaaaccaaacccaaaccagttattttggcaagttcagtattttagacttttagacagaaattgtcacatgctcattattgtgattcttactgaaatagagtttccatctctactaacattatagttttatctgaattgtcattgtgataactagtgtgagagaaaggaattgatattttctgtagttgtttgatttatgggtgctgatatagtgttaatggacttgggaaacataatgtattcctccatacatttttatagttacagcatttcactttaagtccagtagatatttcagacttttttttctgtgttctagcctgtgtttatgtaaattatgaatcagacttttgatattgtaggtgggcttaggtaggaagtaaatcagtgtacagcgtaattagtgtagagtacttactattttctgtttgacttgtataaaactaaatttttctttttttttcttttcattttagtacttcagatagcagaccaaagagtagcagccctatcagattacctgaaatgagtggaggacagacaaatcgtacaacagaaacagaaccacaaccaagtaagattacacatggaggaatatttataattagatttacctataattatggtttgaaaaagaaaatacataaaaacaaataagtactatctggcaatgatttactacttatgatctctgaaatacaaatttagatatttttgtatgccctctttatacgtgttttgcttttcttcgttgattcttgtctcaagtgtaagttcaaggtattgaattagaaacttttagaagctctttggtctatgcaaaaaggagaatctgcttcctagaagagctttcagtttaaaatatacaacctaagatgcaagatacgtttttttcctttctagttttacagtattactggcactatgaaaataaattttcatacattccctcctttaatccccctagtaaccacataagaattatttgacatatccttatttttcaagaaggaacttaaaat

SEQ ID NO: 98476 - DNA, 1029 bp, Homo sapiens
tgtaaagtggcaaaaacaatgtcttccaaggttgatgtgacattccacatgtaaaaacatttgtcttaatatgtaactcatattatatactcaaatgttttcattccactactccctcaaatgttttctttcttttcaagtccctgtaaagttgcagctatttatgtcccctttcattttgacatttaaaaattatgtctaatgctgggtgagatggcccatgtctataatcccatcactttgggaggctgagacggcaggatcacttgaagccagcagtttgagaccagcctgggcaataaaatgagacctctgtctctaccaaaaaaaaaaaagtgtgtgtgtgtgtgtgtgtgtgtgtgtgtgtgtgtgtatctacctcattgtgtttgggtatgggtttagatcaggaataggcagactctgatgacctgtttttgtaaattaacgtttattgggaaacagacccattcatttacttatcatctggttgctttcactttatattggcaagttgagtagttggaactttttcagagtgaaatatttgctctgtctctatatagaaatagtttggtgacctctgggttagtccgtgaattagtagttttaaaaaatagcaactgctgggcccagtatggtaatcccagcactttgggaggctgaggcgggcggatcacttgagactaggagttggagatgagcctggccgacatagagaaaccccatctctactgaaaataaaaaaattagccgggcctggtggcgcatgcctgtaatctcaactacttgggaggctgaggcacgagaactgcatgaacccaggaggtataggttgcagtgagccgagattgcgccattgcactcctgcctgggtgacagcaagactctatctcaaacaaacaaaaaaaccaactgctgtaataaattttgactagtaattaagatatctgtttagtattctataggctgcttgctattgggctgtagctgtttataatgggatccttggaaggcatagatgcttca

SEQ ID NO: 98477 - DNA, 1795 bp, Homo sapiens
ataggctaataaagttatatattatgtaactagtatataattttatgttttaaaattatgttttataaaataatattttatgcatattttatatagcttagtacatgataaagcattgcaaactattggggaaacattattctacacacatggggaaaatagtcataataaagaagccatggaagttcttggtataagaactgagttactatattgccactgtaggaatcattcagttgtaagaaaaagtattcaacctaaattctctatttttctaatttaaaaactgaaattccaaaaaacatacatttttattgtgatcatttagacagtttaattgtatatcttatgcttgcttgatagtgacttgagtaggatatttttacttttaatttgctaagtttttttgttacatcaaggaaaaaggaaaggacaaaatgaactgataattactcaaaaccttggctttactaatgatattaaaccttttagatgaagtagatggaggagatacacaaaagaagcaactcataaatcctcatgtggaacttcgtaagtatgagatattatatcattggtttggggagagggactacagttgagccatctctattatttgagaattctagcttcatactaaataaatgtcccagttcttgaaatgaatattaagtctttatgctgacatgaggtatatttaatcaacagtttataaaatataaatttaatttataaagaaatttaatcaaaagtataatttatttgtaaattatgctcttatttctaatagttaaacatttacttattatgtaatctagagccacagaattttgacagttgcatttagaattgtgtatatgtgtgccagaaacgtattatccagaataatatgtacagtacattttaagatatttattaagaattactataaaagtacaatgatgttaatatggtaggtaacaagtgtaaaattagaactgagtcttttttttatgtgatttttatttttttctctttttttggaaagtatgtaaggatggtcatacgatgttctttaattccccctgaagatcagtttaacaaaattgtgataaatagggatttggatctaacatgcaaaatgccatcatgaagaaacttaagtggttgcatttggccagggtagggagtgagggagcggaggaggaaagatattttctgagtcataaagctttttaaaaaaacttctgttgtttatagaattttcagatgctaatgccaagttttactgtcggctctactatgcgggagagtttcataagatgcgtgaagtgattctggacagcagtgaagaagatttcattcgttccctctcccactcatcaccctggcaggcccggggaggcaaatcaggagctgccttctatgcaactgagggtgagcctttctcatcgtttattgattggttcagtagtcttcatctctttacctcagaaaatgcagcaggaaggatattgcttaataagaactttcataactatgacttactagttttaacagaggtgtttataaagttttatttagtagttttaaaaagtagatcttctagaactgaacttagatgtgttattgacaaaagtagagggtttttgactatataaatccacaggatcccttcagttaattgagaattgtgttctgatcaaaattttcactgtgacattagaaaattccccttaaaatcataaaacaacctaatcatttaggatctttggaatgatgtgttatagattacagtatatattgtgattgagta

SEQ ID NO: 98478 - DNA, 1102 bp, Homo sapiens
gcattgcttttcctaccacccaaatattcctgtgttatgctcttctacattgctgtaagtaattgtccagagtttggtatcaaaactatgtttcttaagactatttgcatctctctctttttttttttaacactgttttgtgatccaatgatgtatttctggagttacttgttaatgtatcttgaagttgattaaattggccagtgtatttcggaaacgtttcagtaattgagtacctaggtgttaattttaaatgatagaattatgttactgtgtattttatgtactgtacaatgatatcaccatgcgtttaaaaacttaaaaattatgattcaattttcagttaaactttggagtgtgtgtaatggtagtgactataaggagtctttctgccttttttatttacttacattaactaatcatttgtggcaacctgtacataaatgacaaagcattttctttttactaggtttttgatttgaagggctctcttaggaatcggaatgtaaaaactgacactggaaaagagagttgtgatgtggtcctgctagatgaaaatctcctaaagatggttcgagacaaccctctatatattcgttctcattccaaagctgtgctgagaacctcgatccatagtgactcccatttcctttctagccacctcattatagattattctttgctggttgggcgagatgatactagcaatgagctagtagttggaattataggtaagtcaatgagtaccctgcttatatttcatgattgaagtcagagtcaaattttaaagattctattgaacctggtctaataatagcttattgaatattttcacaaactttcatttgaaatttcaaaaataagttttttattctagtctcttctactcagtttcctcattttcattatctctaccaaaaatatgtgaattaaaaaagtcacttataaatgaggacttttgtgattgttgtgaggattaaacaaattagtgtggagaaaccctgagaacagcacttggcacattgttagcactcaataaaagttaactgtcatagaagtagtagtaatagtcattgctgttgtcatttgattatatttatta

SEQ ID NO: 98479 - DNA, 2115 bp, Homo sapiens
ttaaaattttaaaagtggatactgattcttttttttagttgtaaaaaataagtggttatcattgatttcattgtcatttctaaagtgaccaaacaataatgagaattatataggtggggaaatattgggtgtaaatatgtgttaaaatgtcagaggttctcaaaaagattttttaaaaagccagatgttctgaataagagattgtctttaattaacacttgagacttccaagttctctaagcactgttagcctcatttgtgctcttagacatcgctcatctctaggcaggagctagtctttttaaacagaaactcgtaccaggtaggactttgtcccatggcatgtggcacaacagataacctttcctgcccactcagactgcttctgcatgtgtatctttatggcagtttatatgaaagaacatggtcagttgacttcagttgcccaatcaattatataacagctttttcccccttttctctttcataatctcaggtaaaatgccaacagtggtgtctccggagttgtacaggactaggttttgtgaggcaatggacaagtatttcctaatggtaccagaccactggacaggcttgggtctgaattgctgaaatcaagcacatattttgaaatggactgtgaaggaaaaggggacaggaacaaaggaccaaaaataagctacatgttttatttcttcatcgtgttcaccactgtatgccaaggcttttcagttctgtggctgtttagactgtccgtaatggaatggtaaaactccatgaatttgcactttggtttttgatacctgtggagctgtctgtaggttgggaagtggcatgaaaattttcttaagctaaaatacagacatgtttcaaagggctaaagttggagatgagtagatagggtgaaaaatgggttaaatttgctagcttaattgttttaagaagaaaacagtgtctcataaattgactatcctggcatcacatttaacatgttatctacttagaaagcatttgtagagctgctgaatttgttttgtgtttttctgtaataatttaatgttacttattatcagaatttctgaaacctttacaaaaattctgatttattccattaatggccggttaaacacgtgggcatttattgttttattgaggaatttgacttaaactgggaatcctgtcatgttgtttatctttccagcttgcctgtttttgagtatgtttgatgtttttaaaattttgtcttctctgtggaagacaggaggctacagcaattaactttaagcctccttttagagatatttttaaaacttgtttaaaatttttgtgcaattcatatattaaattgcacttacttgcatacgctcatattctagggttttttctctatttttagggtatcatagtaaatcattagtaaatgagtctgtagttactaaaccctaatggaataattattaatgaaagatttttgaaatataaaaaataaattaggcccaatccaagaaattgagtgagaaggaaacacttgttttattcacagaggtaaagtgtcttttcaatataaccagcaatttaggtggcatctataaaataaaaaatttctactgtggacatccccttttccaactttctacataatggctagttctgactactaagaaatgttaagaaataggccaagtgcggtggctcacgcctataatcctatcactttgggaggcctaggcaggcagatcacctgaggtcaggagttcaagaccagcctggccaacatgacgaaaccccatctctactaaaaagacaaaaaattagctgggcatggtggcatatacctgtaaccccaactacttgggtggctgaggcaggagaattgtttgaacctgggaggcggaggctgcagtgagctgggattacaccattgcattccagcctgggcaacagagcaagactgtctcaaaaaacaaaacgaaacaaaaaaagaaagttattcttagtaaggaacttcttgtttaatagcatttttgtttattttaaaaagtgatcagaagtagtaaactatctttgaggaaatactgtaaccccagaatatttcctcttgacttctttttgtaa

SEQ ID NO: 98480 - DNA, 2020 bp, Homo sapiens
tattaacttactttgtgtctaggaacaatggattttgtatctgatttaaaatgccaacactgttttgtctctgttcattttttctgtgaggatacttaaggttattattcctgtctgtttcctgtactcccctagtcatgagcacttgaagtacaaggtgtctccccctaggtgcaattaggttgtttctttgtttttagtttcaattctatgtgcatagcaggaatgctccacaggaatggcttctgacaataatctgtcctgttgattttgttttccttgcccatgacttgaacaactgtgttttaaagtactgtagtctagtaggtaactttgtggcaaaaattttcaatataatacattctgaaacaatagttgctgccttgcaaaggtaatctctcattttaaaattggacagtattaatgaaggggaaatatacaatttatttctattgagtggtagaactatatgtctggtcccttgctgctcttgtttaggccactatcatagatatatttcaaatattgtactactcagtgttaagtattgaatgactgtttccctttccttcaaggcctagagtatattctgaaaatttaggaatgaggaagaaatcttaatacttccttccttaacatacaacatgagtcccgagaataattgatagtagcaagagaaaactatgtcagtaacatgttgctttgtataaaaatcttatttataaatgtgaagctttttgatgccatcaaaacttattaaaaaataggatttacttttttctaattctgacctaagaaaaataatgagaacaagctgttgcaagctcttttgtagtctattgaatattttatagatattcaaaatttcctacaaactataattttttccatgatttagcagtgagtgattttctagctttggctcttattaggtattgtaaatagtagggttatatcgatatcagcttttgtgatggcattgtggtcatcagcttcatgacattttacccatttgcagtgatcctgtgtaaaactgccaaggaaagtaattacctgtaggagtttgctgagcttgaagagtgaaaactgttgtgaatgagcctgatcataaaacggaccaggccattcattattcctcaagtgttaatatactgacttatgcagtattcaaaccatctagtgcaatgtttttgtttttgttttttttttggtaacacaggtgcagtgtattatagaaaaaataaaaactacaatcattagcagttttaatactgctgtgtcagttttgtaaaaaatgtacattatgtcttttgacatgttgaattttaaactagggaaatgacattgtaaatcatagtagcctcttttaatttaatatgaaaaatgccactatattgaaagtacttaatgtattgtatatatttctctactttggttctagctattttatatgattgacatgttatttaaaagataactgccttgaacttttggagacttgtactgtaaataaagaaatcttaacaataaactcagaatctacttactccacttagttttgaatctgcttgaagaaattgacaacaaaaggaaatggagtttgtcctgcaagcctagtctttgtgttactggtggagggtgtccaggttcttggcgttttgaacaaagaattggacaaaacacaaaaagcaaggaaagaatgaagcaacaaaagcagagatttattgaaaacgaaagtacattccacagagtaggagcccaggagcactggggcacaacagctcccgttacagaactttctggggtttaaataccctctagggatttaccattggttagttggtgtacaccctgtgtaaattaattagtggcctgcaatcagtgtgattggttgcagaaagcaacccatcaggctgaagtgaagttacaaaggttaaaccctatgcaagtgtcgttgtggaaaacaaccagtcagaggccgaagttacaaaggttacaccctatgcaagcatctcattgg

SEQ ID NO: 98481 - DNA, 1053 bp, Homo sapiens
aaatatgggacaagcatggttactcatgcctataatcctagcattttgggagtctgaggcaagagttcaagaccagcctaagcaacatagaccccaaatctacaaaataattttttttttaattagccaggtgtgatagtgcatgtctgtagtcctagctattcaggagactgaagtgaaaggattgcttgaaccatagagtttaaggctacagtgagctatgattgtgccactgtactccagcctgcatgacagagccagatcctctctctctctctctctctatatatatatatatgttatatatatatgttatatatatgttatatatatgttatatatatgttatatatatatgttatatatatgttatatatatatgttatatatatgtgttttatatatataaagcaaatcaacaaataattcaaatatattttaaattctgaatagtattcttggaattatatccaaaatatgggctttttaatattgagatattactaagcatcaaatataaattaaaatgtatttcaaaggattaatgaaagagctttaaaaagaatcagaaaagtaattaatttcttctatatagacaaccctgcttgtgctatagaatatcaaatatacagcatattgttctcctctagttgacagtcactagagatataagacataaaactagtattaaaaataatataatttacaacaatattaatggtaaaaaaaaaagtatgtcttataagtgccagcaaattcagaggagggagtgtcattgccatgtgcagaagtgaaacacattatgtcagaagtggcatgagtgtgtgtaggtttggaaaagcacctagataggacaatagcaatatcaaaggcactgaggacaatagcaatagcaaaggcactgaggtgacagtgagcaaagcaaaccagattgcatgtaatagagggttccttttggagaacagttgcctgtgtgggtggtgctggatttgtagatgtccttagtaagagatttggtttcattgtaaggccactggcatcagtgaaggattt

SEQ ID NO: 98482 - DNA, 1049 bp, Homo sapiens
accattaacaccagcaaagtagtcagaagtttaagacatctatctcaagttaatgcaggaaattagaacccccatctttaattctttctcggggactaaaatttgaaatgtatgtgtctctctagttcagtatttcttgtctttgctcaaggattaattatattactcagtctcaatgaataaggaaattaataattcatgcctaaatattacataggtgaacatttttgttgtactaattagtatcttgtaattaaaagtcttgtatgacaagtacgtgagactgtcggctgaaataaccatacattccaattagattcagtaagtcagtatcatttatggggaggaagcctatttgtctaaaattagaacctgggctgggctgatattttgaatcaagatctgaagtgaattttggttgcagtttagtaaaattaagatattttgtcagagggaaaatgaaaattaaagtaaaattcaaacctcattacagtaattactaaaggagtatgtaagttaattgtttaacttgaaatttaattataataactatttttatttttcaaactgagtcatcgttgaaacttagtttgctattcaaccgtgtattctttgaggaaatttgaaagacacttggtttcttgattaaaagttcttatcgggagcaatttttaaaaatagtatatttttaaaattttaaagtactttataaaatctcacactttcaaaaagaaatgtttgattgtcacatataaaaaagcttaagtcaagcttttttgtgatgatgtgttaccatcactactcttacagacatggttttttttgtttgtttgaatgctacattgtttttgcctgattctgtaatcaataaatttcctaaggactatttagttgtaattctcttgaaattaaaaaataatgtatatggatcactcagattttgatttagaatcaattgtgataccttaacacataagtatctaattagctccaaagcggcttccacatttaagtaatattaaaaattgctaataaagcctaatcctatt

SEQ ID NO: 98483 - DNA, 1031 bp, Homo sapiens
ttaataatatggtcttttaaaatttgttctgataagtcatgctatttctaatttgttttatttcatacaaaataataaaagtcaacttcttaccatttcttaacttgtctcatgaaagtgttcctttggagaagtgtccctgtcgtgctttctggtctgcttttaggtaaggtctgacttctgccactagaggcctgagaatgtttttcttctttttttggcctctctctggggaggaagcagctttcaacatattctttccttgtgaatttgtaaaagttgaaatcaaggcatgcttattagttagtaattataattcttatatataccaatgagatataatcataatacatttacaaagagaaatcataaaaatgtatgtactgaaaatcagtgcccatatttcacatatgaggaaactggaatctaacctaaactgcccaggataaaagggtaaaacctgagttataacattttaactgttgctaaaagaaatcattgaaataatctatggtagttgtctcgtcccactttcttttttatctttgtagatgcgtctttattgaaagtttgaatgttggtaaaatactattatttgcctgagtcaaaggagagactgtagattcagtgaagtaaagaaaattgttggtgtagggattgccttttaaactagctctcagtcgctagatttagagtggtttatatagtttttgacatacagacatctccctcactctgagacatctaattataaacatgacaaatattacaggtgttcaaatcacagagtttaggaatgactaatggatgactggggaaaattagctgtattactgtattatttttcttcatgaacaggtctgtctacagtaacaagtccaaaatttgagactgtgctctatgccatcccaaattctttgaatgattgaaatggttcactaaaatagatgattatatctcagtataaagaaaaaattagcttgtcccttgttgacatagcttcaatgttagtctttttttctgaggaatta

SEQ ID NO: 98484 - DNA, 1059 bp, Homo sapiens
gttggtacatgctgaatgtttattagacaaagctttccatttctctctttcagagaagacaattttaatataactcaaaatgcttttttaaattttagattgaatgtattttactattctgggaacttctcatcttaaaaaaaaacaaaacaagtttcttatcatccagaatagaggaaggtgcatctagaataaacatttagaaaatactttaaaaatgggtatgaattttaagccaaagccttctcgagaccatgattgtggatcctagttttggaaatgagagttctgtccatctcaaagtgatagcagtcacttggaaagaagatctattgacctctgacataagattgtttcctatactttggaattaaacatctcagtaaaccgacgctgaagaaagagatccatttacagaaagtggtaaattagtcaaacctgtagtagtcctccccacgatttgtttttcttagtttttttttttttttcatcattctgctatacgtataattcaggctgtaatttaggaaatacaatgctacttgccactagccatcctgaaagtgaaatatagtatcctggtcagagccctatttccctaatggtgattaaaactgggcagaaagcccaatgtaataaaacagtctccaagctttttcaccaaccttggtctgggaaaagcaacattagaggttttatgtcttgaaaaatatacgacgtccatatgattaagtgctcttcattttcttctcaaccacagggtgcacattcaggccttaattgtgccagctgttctcttaacccatcacctaaatattgcttttgaatataatccgtcttgacacaaagccttttaagttttctttattacaattgatctttcttatactaaattaaacttcattttctcatttgagaaaagtgagctctttggaaaaaaaataaaaacagatttttttattctgcacatgtaaaggcaattcctttttcctgtcctaattgaattcagttaagcattcaaaaccttcatcacaaagattggctgagctatttttcttt

SEQ ID NO: 98485 - DNA, 1047 bp, Homo sapiens
cctctatacaaaatattaaaaaaaaaaaaaaagccaggtgtggtggtgcatgcctgtagtcccagctactgcggaggctgaggtgtgaggatggcttgagcctgggagattgagactgcagtgagctgtgatagggctactgcactccagcctggggaacagagcgagactctgtctcaaaaaataaaataaagatactaaaaatactggtagattactcttattctattgtattaagaaagtgctacttgggctaaagttttgtagcacctgattaggatcagttaggtgtggggaaaatagaatgaaaaacaaacaaacaaaaaattctggtaaacacgtcattattgctagttacctgtaagagaatgacatcaattttagtggttaggaacccagcctctgaaatcaagcagtccagtttaaaatccctatcatgctatctcctgtgacccttagcaagtgactctctgtgcctgatgtccttatctttaaaatggagataaccataatattatctacctcatacatttattttaaaaactatgtgagttaacgcatccaaagaattcccagcatagagcagcactcagtgattattagcttaattatctaattgaagacaaatgtttactactgccaagttgaaaatgtatctggatatttgaaatacaatttacaaaacctcactatagaagaacgtgaaacaggagcagtaagagataacatagttgtgtcatggacacccagcacatcacagctgctgcgactctcctgttgcagagtccactttctaaatatatgtagggcaggcatacataaataatttaggtttttgatgtttatcatacattattaaaataccaacttctagtgactgctatcttcaactcactataaggttccgcatttttattttgttgatatgtctcccatttccactctagatttaattatctaaatagaaatgttttaattgatgtcttgtgatatttgttttaaatttgaaggaaattgcccgtattttcatcagacattctccctcta

SEQ ID NO: 98486 - DNA, 1099 bp, Homo sapiens
ggaatctgaggaagtacttaatatgtaacatggattaacagcagatctgtgtcatagattaatattttcagacttatgggaaaccctaacttttgctgcagctacatttgttccagacatgggatttccttttgtagtgtatagattccattagaattctgaccgttttttggtcccttttatgtaacatgaaatgcaatgataatattaaaatgtatgaaaatatactttatgataaataggtctgaagtcaattctcatatacctcttttggggatttgcaattttatttattaaattatgtagaactttagttataacagcaacacagaaggagttacctacacctggactcacccgagagaaagcctctgactcagagaagtgggtccagaaatctgtggaatgctccgttttcgcttattagtagtgcattgccaaagctttcaggaaattagagctttggggaacagatttgctttattgtcaaggattgcctatagctgtacattcctttgaaattcaggtttcactcagatgacaaaatgatggtttggtaggcctaggaggatgtgtactttccaaactggagaaaatctaggttgtggtattaatcttaaaagcaccccaatgttagacacagctgcctgcctgacatgtgcctcaggtttatcctacatgtttacaaagctcagttgtaaatctgagtattaatgagaagatgttccatgaaagattttcaacaaataattaataatgcattcagttaaccataaaggcatttcaaggaaaaactcagactttgaagacaaatgatttgaataaatggataaaaataagcttaggggcttttgcagattcatcactcaactctcttacttcattatccacataaatacagcattattcagatgcattttaaccttcaaataactcatacttcttattgctgtttttatcataaaccttgagtaaggtagcctcttaaactatttatatacctaacatagataaaataaaaattaaaaagaaggaaaaacaaaaggaacttggttgggaatatgtaagaactttttgccatacatctttgaggtaatga

SEQ ID NO: 98487 - DNA, 1045 bp, Homo sapiens
tttggccattccactgggcgtggtggctcacacctgtaatcccagcactttgggaggccgaggcaggcagatcactttaggtcaggagttcaagaccagcctggccaacatggtgaaactccatctctgccaaaaatacaaaaaaaaaaaaaaaaaaaaaaaaagccgggtgtggtgaagcatgcctgtaatcccagctactcaggaggctgaggcagaagaatcgcttaaacgcgggaggcagaggttgtagtgagccaagatcatgccactgcactccagcctggatgatagagaaagactctgtctcaaaaaaataaagagaaaaaccaaatttggccactgggagccccaccaagacagtagtggtgtcctttcatcaagtctcattagtcagtccttcaacacttctctgctttctggtgcaacaagatgtccagagactctttgtattttccctgtgccagtcctggagtcagccacatttttttttcaaggacttcttgttccttttagtggtaaatggcatttataaaccaagactggggtgtcattgcttctaggacaaaatgaagtaattgctttgagagtacttggtgaaatataaaatgctatattatcatgactatgattagtgctatgaaacaagtattcagcttacttggaacaatgccaaataggagcaccaatataaatctgtgtgcagggaataagtaggaggtaggatatatgtgagggtgaaggaaataaataagctagcttggttagatacaacatgagtccttgtcttctgactctgagactaaacagaacagatgaaaggctatggattgcattctcacctgttccctgtgctgctttgttatttaatacttcagataggaaagcatattttattttgtgatacattgaaatcttttcaaaaaaatgaaacatttatgtgaagaatgataaaacatacatttgtgatttcttgtgtttttacttttcttacatttatttagtaggtctgaaagaacagtgtaatttagggaatataagattt

SEQ ID NO: 98488 - DNA, 1044 bp, Homo sapiens
aattcttagttctatgtttatctcttcctcttctgataccttctaagtgttaggctgaattacaaactaattagctgagaagtccagggattgaatttctgctctaccacttaccagctgtgttcccctgggcactttactaaacctaattaggcctatttcctcaactgtaaaatggaggcacatgactctcagaattgttgaataaaataatgtactcaaaaagactggcactttataggttcttaatcattttatcagaatcatgtcatatgcttttcaaattcgcaaatattagaataaataactgaatgtaaattactgaaaaatggaccaagcccgtatctaataacaggcattatagtataatgatggtttttgttttttgatttatatgttggcgattctgagaaaggaaagagctttatgacattatgtgcttgtgggaattttggaagccattatgaaaaaggcacaattttaaatgaacctaaaaggaaatgtaagatttgggttggaagagaagaaatcagtgattcctgaaataaacttacgattacgataggcctcaatgggtaatggatttttgtgaaaaggatgatacgggaagcatcttagctgtccattcttttgtcataatagcgtagttctgtaagggctgcttcacacaaatactttcacttgttgccatattcctaaaatacaaattttacttccatttctcatttcatgtgcttttactttacagttgccatttatttactaaaagccaatgtaaaacatactctccctactaaggagaatgtgcccttacaatttgtttatttaatatacacataatcatatagtctttatttacacagccatggttacatggtatgtgtgtaaaatatatgcttatacaagaacccttttgcataatattcactatagatcctaaaacttatgaatgaagaacttctaaaacaatggcaccataatatttattacaatttttattatgaaggtacattacattaatagagtgccctctaccccatgtca

SEQ ID NO: 98489 - DNA, 1050 bp, Homo sapiens
ggaaattgcattatttcagatattgaacaaaagctaatactagtcttgagacacataaaattatattgcacttcttcttcagaaattactcagtggaatcgtgtatgaaatcccccaaacaggattatttcacctagatattgtaaaactcttgagaccattctctctttttagatttcactcaaagtaagtgaaaatatttatgtttggtggaaaaaaaatctatttggtatttgcccatctgattaaatccagagagcatatatttcacatgaagatctatttcctaatcttcagactcattcagcaactcattatattaattttgaactttaggatatgtgtatgaattggaaaagggtgaaattatttaactgctaaaaaatgactccaatgcgttgtcaataggaactaataagttctgttatgatttgtctggatattggagaaggggcatacaatctcaccaacaggcctctggcatctaaattttggaggaccagttaaaaattcatctagcggtatgctgacaaaatgcatataataaaaaatgagtttattaaaatagtaggttgggtgattaaagcagaacagaatttgactactagagtcaaattctgggacctatatcatggtttttctagtcaatattgtggtgagttaattcctttactgatttcactcatttttttcacttacatttttaacacatagtatagtgcctgggtcacagtaggaattcaataaatatttatttaattatttcacaaataaatgaatttgtcagcattttcccctattacttttttgttcttgcctttcttaaaattatacactgtgaaacagacatctggtcattttttttttagttacccaaaatattcattacatgtttctaataaataataattagatcattacactggatataaaagtgacaaaccatgtatagaaatttctttaggctgtacggaataggatttttctggttttagattaaaacggaaagaattcttgaaatgtcccctttcactttcatcagctggggga

SEQ ID NO: 98490 - DNA, 1045 bp, Homo sapiens
ttctttgcatcatcaagctggaattgactatttgcagaatttgaataccatgcccatgcattcaattgttaagagtctcagagtagcacagaatcatctctggtcttccaagattgtctctctttctcaaaatagaagtctgagtaagttttgttttttgtttttgtttttgttttgttctgcaggttccatttcagtctgcctcagatggtttgcattaaccttttttcagattctctcctggtgttaatgactacattatgaccattttaaaaagccagatgtacattgatccacctatggcaattattaaggaaaagatactccatttaatgcattataaccaaaatatctttcttcaccacgtgtaggaacttaagaaatgatgtctctttttgggaagatcttacattttatttccaaggtgaacaatggttgtacttagttttctttaaaactattttcttgctttttatatgattttctcatggtaagatttcatgttaacatatacagaataaggtgaagcatgcaagcgttaaggattcttctgacatagtgcccaagagccaccaattaacataattttgaacataacttcaggaaaatttgtgatatttcagagtcttaaaaaaaaacctaagtagactgcctatactttaaatagtgggagcagaaattcctaaaatgattgactttccaagatgacatttgaggaaatatgagatctaacaatcgaaacattttaaaaatcatacaagaactcatgagcctgagaaattcacataattctggctgtacttttcctctgtaggaaagtggataatccaagagataaaagagaaataataaatgtaatatattacattaagcatgcaatgtttgcatgcttaatggaataagctccctatgttatgttcacaaacacaaccagggtatagactgtgaattacaaagttgttagaataatgcaaccagttaagaagctgcatttagattttaaggacaaaaaaaaataatcacttctgtaccacttttaagtaat

SEQ ID NO: 98491 - DNA, 1054 bp, Homo sapiens
aagaactaatattccagaaatggtctgtaaaactcaagatgaactaattgacccattcttgatattaaacataggttattgtacatgttttctttgaccatagaaagccacacggtttgctacaaatttttcctatcttggtacaaccaatatcagatcagaagatttccccaaagtaatagctactattttttctctttcagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcaggtaactaagggctctactgtcaccaagtgcttgctttgtgctttgaagtcagtttagtctgaaagtgaattaatatacagcactgatcctctttcactagtgctaggactgaaattccagtcagtcagaggaaataaaagaagagaaaaatcatggcaactaacttgacatttccccacattatctgtattctcaatcccattcccctatttaatttttatcacgtgaatttttgcaggctgagtatatgtatgttttgctagaaactgtcagcattttaactcattgaaagaaaactttacaaatagtttttttttaattctcttaaatgaccttggacctaaatccaatggattgattagaagcatattttttagagcagaaaaaagcaaaatacgtaaatacatactgtaatttttttaatccatcattcaacaaattacagtttagcttttctacatgcaaggtgttgtgttagcttctgtgccagtgcatgtgcaagaaatggtcccagaacttcatgaatcagatgatcttggagcagacatgagacttgtgca

SEQ ID NO: 98492 - DNA, 1051 bp, Homo sapiens
taagtgaaactaagttcttctaaactaaatttctaaaatatgtgagtttttaaattaggaacaattgtagtggaaataaatatgatttatactaaatgagaaaatgaaaagctaaaaagctacatggatttgaaaacatgtaaattaacttgattagactttatccaaaaaggtaacattataatgcagttatattaaaattcttttaactgtaatcaaaatctatggcattataaaaattttcttaaaataacaagttagaatttaaatttttaaaatgctacttaaaatgccataattaaattacaaaactaaaaatgagtgctaaatgtgaagagattgataatgtagatttttttttctctctctgtttctctctgaggatattaatatttctaaaaaacaaaataaaagaaaattccttttctttttatctgtagtctttccctcagggccgtttaaacaatgcacaattatttcataagaattttgtaagaatcttccatttacaaaactataaaacagctcatatatttctctctaattccttaagtgaccaaatggaatttacttatttttactgacatttcaagtgtaaatgagaaacaaattagtgcaataactcatgaacttgaaaagtttatctttacatcttaaatgttaacttttttatgtgatatacatggtttggggggtggttattttggccgtttgattgccactcaattatctttccttggtgattttgttttgaattacagaaataagactttattactaatgtgcatattttttctttagtgtcaaagagaattatacatgaactacattactgatatttcagggagtttaacaatatgataatagttgtgtcccagaggtagacttttgtaaacagatttaaatttaaccttgaccttgtttttaacacattttattttacttactttttgaaaatgttcattttctccaacatcatacaatgcaatgaagctaacataacttgacttaggtagtcccttaccttggaaatgctaaataaattatattt

SEQ ID NO: 98493 - DNA, 1043 bp, Homo sapiens
aaccctttcagctctcaaactttaaaataaattgccttttaatgagactttaaaagtcatcactattagcagattatacatcatagttttccaaccagtacctaatgtatgttgcattagaatattaatttgttcatcccaatggtaaaataaaaaaacagctgaggtcttcatgaggtcattctaatggagctgaaagtgttcctttagcaatatttctgtcgtttcatgtattgttctgtggtcatgatgtcaacatctttttcatccctaagaagaagaaacgctagagagtcggatggctgaggaagagaaacctgctgctcttcctgagaaagagtgtggggctgctaagtcctcagaccaacccaagggcctcagtaagggccaaatggagtctagtgcggaggcccaaatagttcccgaagagagtgccccagcaggggccccacatgagaaaagtgtaaaagaggtcaaggaggtgtctccagaagtaaaaaccccttcctctgctggggaaggtgtgtctttctcaggatttgcatgtgttttgttgcaaatgatctctccagtggcttaccaacctgatgcctttccaacgctatttcgctatttcatcgctgggtcttatgataacaagtccactgttgtaggcttaatgtgcagagagtgtggcttgcgcaagtgctgtgtggcagctggttttccagtgctgcagctgattcctggttttcctttgccatgatacaatacgctttgcagccaggctgatgatgctatgtgagcttctttttttattttatttttttacccgccccccctcatctcaaatgtttgccagtcacattgctaatacatgtatatttttgtttttattttggggacagcaattcatatgcttttatttcaaatcgtacagttggattttggcacatagaggcttaaatggtggaatcgtttttgtttgcaaccgaaatgtgctatattttttatgcttcaatgaatactggtttgattttcttgacctcctgctgatgcttctc

SEQ ID NO: 98494 - DNA, 1049 bp, Homo sapiens
gcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtg

SEQ ID NO: 98495 - DNA, 1016 bp, Homo sapiens
agaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaacta

SEQ ID NO: 98496 - DNA, 1051 bp, Homo sapiens
acatagtagtaacacaattttgacacacacatacttaattttttttaaaaaggcaaatggatgcacagataaacctacaagctattttataacttaatggctttcagaaaactctagtatgaaggcctaagttacagggggagaccaataagtgttaactgcatttatagtaaaccaaagactggcagtccagtgtgaatgcaaatgcagcaatgcaaggaaaataatgcatgaagcctgagttgaataaaatacacattttaattagagtctgggaaggatagctttgtagtataggcttttattgtttatataacaaatgtatgatcacagttgattagtttataatgaaaatatatttgctagatttagaagcagttttcctggttgtaacccaggaatattgtttggtttcacattaaaataaaatattgctcctctatagaacccctcaaacaatctattagcagagttgttttaaaccaaacacaatataaattaaaaagacaataaattaggatggcagttgagacaatgctagagaaattcttgattgcaaatgatttttttctcctttttaaactatttgagatagaaattataagcatagactaacagaaatctttcatcaatgtgaaatctagagatcatcccctgtcaattggcatagacagtgagaggttggtaataaagtatattactttaaggtgataaattcctcctgcgttgcttgagatgtgggagtggatcacagtgaatcagccaggcagacataggtccccatctggtgaatattggagctgcccatgccctttgtcacatttcacaggtagttcacaggccatgagaaatcctctggcacgggcacaggatacctatgaaagatccagttttctgtgaaaaactggcataaaatgccacggaggtcgaaggcttccattcacgggcatttcacatgtgtgtgagcaagaaggaggtggctctgaggaagaggggaggtttcccctctccacctgcccaagaaatttctgggagaactctgcagttcttg

SEQ ID NO: 98497 - DNA, 1056 bp, Homo sapiens
ccgggtcccaaacctcagttcctcccctccccccacgtaacgtgtggtcttccatcacttaggacccggaagcgacctaaatctttaggacatttcttcactttcagctagagaaactgaggcccaaggggagaagcatgacttgcccaagctcatatagctagttagtggcaaagctggggaaacagacttctctaacgatttaagttggcacctgcggttaggttcccgagttctgccacttgctgggttaccttggacaagccactaacctcattgagcttcagtttcataatttgaaaaatggaactactaacagaacctaccgcttaggcatcttggaagatgaaatgagcgagtacatgagaagtttacagtgcctggcgtatattaagttctctataattgttaattacatcattattacaattctgattttcctgtctattttctcttcaggcaccctgctcttcagggaggtcagttttttgtaagtaatttttaagcaccgtagttacagcacataatattgtttggagtcaggatattagtttctgaagttggttacagaatgaggaaacaaccccagagaaagcagtaagactccctcaagattacagaagattgtgacagacttgcaacttggctcttcctaggtttgccaagtagttctctgagccccactgttaactgactataaaaatcataaataccattatcttgagtggggatggaaaaataaatttattttaaataggtaaaaaccctgtgttccctcattcagtttgcaaattggtgttattttctaaaggtgatgatttccttttctttttaatgttaatctggctttgaagagttttatcttccattgctctatgtggttaaatgtattgtttctctttggcattttacccagttaccttaggagtccacccaactgataatgacaaaactttgaccatagagtactaaaaataataggccaaatgtgtaaaaagtttagtaaatattacctctcacaaaggttggcttttaattggccattatatgtaatta

SEQ ID NO: 98498 - DNA, 1241 bp, Homo sapiens
tactgtttggcaaatttgggacaccctgacttcgtgcttaggattgtagcccctttttgttatggcttagcgtagcctttgggtttttttttgagactactgatgcattcttgttcttccaatatacttcgtgaacctagtgcattgaattgattttcaaaagcacaaattaagtcacgtaactttggggttagtatttttatacgttttgtttaggttttcccaaaaaagtaaaagtgtattttttttggttcttttatttactcgggaggtggttattatacttttattttcataataaatgaaacctactgttaagacaacgaaactatttcccagactacacagcaaattaaaagaacagtatgtgaaattcagatctttaattccagaattgtaaaacattcaataggccttactgcctgcttctgtgacccttatttcaagttctaagtaaacacatgcatcttatccacagccctgacaatcattgctcaggcaaatgttagaatcacttttttaatgatagaaattaaacctccaaagaccaaggtgttattgagtgaaagtgtctgttcccatccaccttatgtgtccctctcagatgtgtcctgaatccttacctctctctcttgaatctcttctccgctagactttttccccttgtttgtttcgtttgttgtcattatagggacagatgagcatagtagttaagagtctggactttgtagccatagtgcctatgtttaattcctgcctccagcacttactggttgtgtgaccttgggcctctgttcctcatctgtaaaatacagttaataaaagtacctacctcatagggttgttgtgaggttttaatgatttaatatacagaaagtctttagaactgtgtgtggcccacatataagtttggtttttattagcactcattctacctgtcatctaactgtgagaccttaaacatagtttgtattttaactcccctcccacacacctaatcatttaacagatccaatcagttttgcctgtcttgtcattcttagtgttccttgccacttaccaagtggcaattgcagtcacctaccctcttgtaatttatttcccatcctatcttatttattaatatttctcactttaagatcttacttcatatttacagcaggacaaaagtccagacactgagcttggcatttgacacctttaatgtgatactaccaacctcccatcttttttttacacta

SEQ ID NO: 98499 - DNA, 1774 bp, Homo sapiens
tagctgtcaatctctgtcataggaactgtagcgtatttcctttacaaaacagtattctgaagcacctagtatggtacttgcatataggggattttttttgtttgtttttgtttttttttttttttttttttgagatggagtcttgctctgttgcccaggctggagtgcagtggcgtgatctcagctcactacagtctccacctcctgggtacaagcgatcttcctgcctcagcctcctgagtatctgggattatagacgcacgccaccacacccagctaatttttatatttttagtagagacggagtttcaccatgttggccaggctggtcttgaacacctgcccttgtgatctgccaccttgttctcccaaagtgctgggattacaggtgtgagccaccatgcccggccccggttttgttaaagatttaagtgaactagtgatagaacaaaaagattaactggagtagggtaaaggataagtaccgtgggtctggtagacttgatttgtttttgtttttgttttcgtttttgaggtaagtctcgctttgtcgcccaggctggaatacagtggcacgatcttggctcactgcaccctccacctcccagattcaaacgattctcctgcctcagcctgcctagaagctgggattacaggtgcatgccaccactcccagctaatttttgtatttttagtagagacagggtttcactatgttggccaggctggtcttgaactcctgacctcaagtgatctgcccgcctcagcctcccaaagtattggggttacaggcgtgagccactgtgcctggctggtagacttaatttgaatccacttccacaaattattaactgagttacttaaggattttatttatcttgtgctcttcaaaggggataataatagcatctactttgtaaggctgtcgtgaagatgaaatgaagtaaattacgatgcttggcatgtagtaaaccctcggtgaaaggtggtcgttactaataaacacatcatgtttctttattagtcatctttaagaaagtttaaagaaactgtcatttagtgccttgtgatagaagtgattagaagtagccacaggcctcctgagatagactaggattcaggagatcaatattagagtccagaacttactaactagtgtgtgacttgggcaagtcataaagcctgagggtttctgattttatcatctctccatttctacttgtcatgggtcgtgaattacggagtcaaatcattatgaaaatatatgtgacgtgatttgttgaaatgtcaaggagacattgcctagtaaaaccaaaatgacccattatttttagtattatttaatactgatgattaagtattaaattgaaaaacattgcagacaatcccctcaacctgtgtcagaattcatattgagagagatacagaaactgaattgaaaacattttcagagtagattttgtttgtcttgtaggcattttgttcccaacatcacctttggtcaccctgtggtagaaagccttcgaaagcagctaggccaggaccctttctttggtaagtgggtgttacgccatctgaagctggatgtgttgctcaagtaaaggaaaactggatggttgattttaacttccaagttcatctggcaccctttccccaactttcctatcctgggtcttcattggcctgactccagtaacaagccaaacttcttcctgcctctgggccttggctaatctgcatggaaaggtagtagcttggctggctgcctcatctt

SEQ ID NO: 98500 - DNA, 1071 bp, Homo sapiens
gctgaggtcattccactgcactccagcctgagtgacagtgtgacactccatgtcaaaaaaaaaaaattttttttaaattaaataacataaacttaaaaattcggtttcttattcacgttaatcacattgcaagtcttcagtagtcacatattgtacagtgcagctatgggacatttccaatatcacagaaaattctgttgaatatagtctccagcctctgtgtaggatctatctactttgagttcaccaaagaaaatgtacattattacctcatttatgtggcatgaggaaacaatgttccaccaatatattcaccattttgaaatttccatataatgggatatagtcctctgattatctaaactttcttttaagccatgattagcttatatagcagataccgtgacttttcctatgaattacggttgttctcatgaccatgagaggtagatgaaataaatagcattgttttctcccactgtacaaccaatggccagaatcctcgcttctggcttgcttgtgtgaatttttttaatgcttgctttttttccccttttcgctcccttttatttgggctcccattgtcacaccatactattgtctatatcccttcctgtcagtgcctttccttttagcaatcctgtgttgctgccaccacacacaatctgctttttcttcttgtttttaatttgttgataaacttgctaattaatctttctagaatttggtctaaaagataaatgaactccattcactttaatgtttgggttttgtgacccttgttttttggtttttcgctttttgttgttgttgttgttgttgctttaagagacagactccgtctattacccaggcaagagtacagtggtacagtcatagctcactgcatccttgaactcctgggctcaagcaatcctcccgccacagctatagctaagactacaggtgtgtgccaccacaaccggctattttttttttttttttttttttttactttttgtagagatgggatctccctgtattgcccaggctaatcttgaatgcttgggctcaagccatcctcctgccttg

SEQ ID NO: 98501 - DNA, 1539 bp, Homo sapiens
gatgaatatcaggtttcttgcagtcaacatgtccttccccctaaatttgttcttgcagtcttgcctctcaattaatggcagttccgttcttctagttgataaggtcaaaatccttgatgccatctttattttcctctcatctatctatccatggaggatcctcttatcctccacatctcatctatcctcagctctctttgctcttatttaagaacatatccatcccgaattgctgccatcatttttcacctgggttattgctatcgtagcttcctcagtcgatagtatcttgtcacttcactgtggtggtttttcccagtggcctgcagaatgctgaagggtttctcctcaccacatgcttccctgacctctgactggtgtatctccttccccaggcacaccagccatattaactgccaacctagtgtgcattttacttacttattttgtttattgtttgactctcgcattaagaatgtaatccctatgacaggagagtttcatgtttttgctctaaccctaggacctagaataattaatgatgcagcaatagctcgataaattgaaagaataaatgaaaaggatcacttaatttttcctagaggaaactagtttgcatggatagtatgacttattctttaagttttttagagtggcatttcctggacctggacctagatttcctgatttttagatgttaactttttatatacagcactgtatgctttttgtgggaaaatagtgttttttgtaaatgaatttaaataaatccttgtcttcaaaataagaggaaactacctatactgaattagaactatttaaataatgatttgtgtgatggccaaagagttcttatcagaagtggcaaaaactacatacaggttggcttccaataacatgagccaggtatttttcagtaatattttgaagtgtcttttctttctagacatgcacatgatggtgtccaagccagaacagtgggtaaagccaatggctgtagcaggagccaatcagtacacctttcatctcgaggctactgagaacccaggggctttgattaaagacattcgggagaatgggatgaaggtaagaaatcgtgatgagagtgttttgtaacattcactctcagttgggaagatttgcgggaaacaggaaattttctctttttttgatacagtcttgctctgtcacccaggctgaagtgcagtggcacagtcagggcccattgcaggtaaagaataccttacttaagcagctgttcttcagctatgatgccaggatttaacttctttgtcacatagcatttatgtattccactaaagttttctgaaagctactgcttgttgaaaatacttacatttaatagtcttgttaacttttaaaaaataagaacagatatttctactgggcctgctatgccacaataatataatacagaagtaattgtaaatgtgatatagcatatttgtgtctgttacaggttggccttgccatcaaaccaggaacctcagttgagtatttggcaccatgggctaatca

SEQ ID NO: 98502 - DNA, 6493 bp, Homo sapiens
acattttagtagagaggaggtctcactacgtacccaggctggtcttgaactcctgggcttaagctgtcctcccaccttggtctgccaaagtgttgggattacaggtggcagccaaccacgcctggaagtcttgaaatttccttttgaaactattatctctaacttttagatctcttggaagttgtcattgactattgaggatttgtctgtcttgtttacatgacagtctctgcaaagacaatacagattgctgtttgccaaatagaacaaagcttgctattaaaaaccaagtgttccccagtaatatgttgtattggtatagttattgtgtgagacaattggagttttaattgctaatatttgctgttggatttttttgtttgattgtcccccacccccacccccaccaacatacccactttaggagttacttatttcctcatgtatatatctaggttcactggttgaggacccagttcccatctttggatatagaggtcgatggtggagtaggtcctgacactgtccataaatgtgcagaggtgagattgctcttcaactatgactagaccaatttcccgtcaaatatgtctccaggacattgtctcatgggccagcgattccctctgtggttcctaagttgactttctttcttggaaaagtattttttgttcacatgtacaactaggaaaataaacagccataagtggatatgctttttttttttttttttttttttctttttctgagacagtctctctttgtggcccagattggagtgcagtggcgtgatctctgctcactgcaatctctgcctgccgggttcaagcgattctcctgcctcagcctcctgagtagctgggattacaggtacctgccaccatgcttggctaatttttttatttttagtagagacagggtttcactatgttggccaggctggtctcaaactcctgacctcaagtgacctgcctgcctcggcctcccaaagtgttgggattacagatgtgagccatggcgtctggcccgtaagtggatattctaaaatcacataaattgttaaaattgtaaatcctggttttctcaggaaggctgaagaaagttcttttttataaaagaatatgttgaatttcagccctttggaagatcattaagtttcacggccttggaagtgagaaatttttccaaaatacggaattaaaaggtactaccaaggggggaaaatagataaatctaattgacctaattattacattattctttagaacctacatattatttagttgttccttgtaagaacttgctagaaccatttttgatgaaaatctaggcctgatacctctttggctatctgtatagaagtaaaaacttttttttacttttttttttttttcagatagctagtctagcatagtcaggctcctgaggatgccagcccttctggtagcactgcaagtgattaaagcttacatgactgcttttcttccacagtgtgatgtatctacttccaggttcttgtataactgccacacgtttctgcttgatatatacctatcaaaagcttgacagtagtaaatacttatgcaggaggggctggccagatgatgagtgagctcatatccttttgatcgcttgtggaattgctttgtactaaactgtgctttgccagtatactattcctgcttttatgccagaggtagcaaattttttgtgtgaaaaatcagaccttggcgatgaccttaaacagcaggatatgaagaactcccacaagcttagcgttccaataatggaacactaggcataaatgggttaactgaagagaatatttgcagtgttaaccctataaaactcacctttataatttctgtgaggaatattgttagaaatgttgtcatacatgaagtgacactatctgtctggaaaaattttcctcagcctgtggttctcccacttctccctctttgttctagcaatgaatcacaaaacagattgggtttccatccttgaatcagatcctaggaagatcagagttaaatttggacccaattttttagcttttctttttcaatttctttgcttccatatttaaatgtatcttaaaaacttttttaaagccacttcaaaaccattctgaaatgcaatgaagtataaagagacattctattttttgacacaaaaacgagaactcacttaattttgccgtagtttatggataattttacatttttagcaataattgtcctttcacactcacaaattcatataaatataattcaaagaataaaagtgtttttttagtaactgtagaggcattggtgcatattgggaaaaaccttagtggacttgaggagtaaaggcttttaaaccttatctaaaggtcgcaaagataccatgtagattattaagagttggtttaccagaaaggtcaatgatttcttagacacatttaaaaatagtctgacatcctcatctgtgaacattttaaatttttcttattgaactagattgcttaagtctgcttaatctcaaagtggctctcatatgattgaaatgttgacagatgcaagggtagacactctagtccaggaattctgttttaggtttttctacattttcctttgaggcataacctaactgtttacttcttccaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaagtttgtcagtattgaattgaattttttaccccttaaaaggactagtataatttccaatctctaacaaaaacttagtgtcaaatctcacagataaggccaaatggccaatattttcagttatgtgggtagtacaacttgagtaaccttttttacatgacaaaaagtgagttatataaattgtcctcaactttcacataggaaaaaaatggtttaatagcttcaaaaggaattttctttcatgtatactcttcagtatccaatattgaagctttgttctttgaaaaattttaatttccaatctaggatgcaagcaagaatatatgtttatttgaatagagtaagctatggcaaagaatgaccaaattagctagaaatagaaatcagccagaattaactaatttcttgctaatctagaaatacaatcatcttttttttttttttcaaattttatactgatagggctttactgtttgtggctcattttaaaactggtgtcttctcttcatgagacacattaattggtaaaactcaaattgagttttcaaagatgtgatagtattaaagtgcaccaatatttgactcaaatttgcttgctttattttgttaggagtaaacagaaagtagcctgtgtttagtcccaaagatagcagtgattttgaataaaggagttttgtgttgcctggatatatgaatttctgtaaataacttctgttggttaaacatgttaaaacaacaacaacaacaacaaaaaacttctgtctctatattcaggacgttcagatgtcttttattagtggaaacctgtgttttatctattctgcagcttacatttcatagggtagttcatacatgcatttccaaggggagtgggtcattgccagtgttttaaaaactacataggggtgtgtgtgtgtgtgtatgtttattttatacacacatatttgtatattctaatatattactaaggcaattttaatgaattaccatgtatataaaaaaatagctgtcacttggcacacaggtttgtatgtatgtgtatatatatatgtatgtatgtatggtgtgggtacatagtcttaaaaattacccagtaatgtgatttgacatcaagttgcagcaattaatatcttggtgtttgtaagtaagttgcatgataaacacaaatgactaccacttgtctgtagatgaaaatctggttacccttatggttccagaaggaaaaacagacttatcttgcctgtttcataaacagcataaaagattaatacatgcagaacatgctcttattctggaggggatgggggatccagaacagggctttatttcctcccatctttcctacatttacatagttttcttaacctgttccctgtcacctattttttttaacattagtaagtcctagaccaaaggttttgtattcttccattccatctgactgcttttttggatggtggccattctctggtacactggtaccgaagatttcaccatggaaagctgtgcttgacctttcaacctgatcctttttttcatcttgacataataaggctgccatgtcttcacccttcagtggaaaagcccgtcgttcccaccacaaagactgaaaggggaaaaattttcagttaagtttcaactaacttgttttgtttaaattcatctaacaagtaatctgtacatgtctatattgtaataattgttctgttctttagcacataaatgtacaatttttcatttcaacttaaatagcaactcaaaatggaatatattgagaattgttgagtgacttttgggatttatttctttactttgcctctgccaagaagaggaaatgctgccataggcagtggtcttcatttccgacctaagagtactttgggaaagtgttcttaggtttgatatacttctacagtatcttcattttcattattaaa

SEQ ID NO: 98503 - DNA, 1035 bp, Homo sapiens
cagacttcacacaatcttgcctttttgagttttggctattttaaaaatgatcaaatgtataataaatataaaataggaattttctcatatatataataattatgtctgatttatttccccttccctcaaagctcatttgtgtttctaaaagtattttagactttttgcattttagattaaacaggtttcttgagaaattttttatttttttaaagaaaaacatattttggaagtagtgatgttaaaatggattacctaaactccagtccccagtgtgaggtccattattaaagtagattgaaatgacctactttatatatacagagaattttcacattatttgttagttaaatccattcctgaggctgacaacataagagaggaaaatacagaaactaatttcatcattatataattagctcaaatatattttgaatacaagctcattctatgtagtattttacttctggtgcacaatagctgatgttacaacagcatgttttcctttttactggtctcacccaaaattcatgcagaggttttgttcatttcacatggattctatggcttggggttttaaatttgtaacctgcctgctgtttcttctgtgccacttgctttgctcccatagtgaccacctggcttgctctctctcttcatattttttgtgccttagggagaagacttcatcagaaagatcttctatctggaattagaaataaagatttttgttttaatcagaaacattttgaaatataagatcaggctgggcacggtggctcacgcctgtaatcccaacactttggaaggccgaggtgggtggatcacgaggtcaggagttcaagaccagcctggccaagatggtgaaatcccgtctctactaaaaaatacaaaaattagctgggcatggtggcaggcgcctgtaatcacagctactcgggaggctgaggcagagaattgcttgaacgcgggaggcggaggttgcagtgagccaagatcgtgccactgcactccagcctgggtgacagggcgaga

SEQ ID NO: 98504 - DNA, 1201 bp, Homo sapiens
aaaaaaagaaatataagatcaggtttcaaagagtttctcatgtagaaaacagtaggaagcaaactaaaataaatgctatctgtgtaagttgagagaacaaatgttatgagatgaactccaaattcctgtaaaaggggagtcaaaattttttaaaaattatttcattattgttatttttagacacgggtctctgtcgcccaggctgtagtgagtgcagtggtgcagtcatagctcactgcagccttgaacttctgggctcaagcaatcctcccacctcaaaaaacttaaaaatacttgtttcctattggttcatatttgaagacttcggtaggctacagatgagttcgtaatactttccatttgccatagcttagtaccagtagtcttaatgttttattcattcaggagtttttatggatcgtccattgtggagtacatactattctaagaagatgttaatatcagataaaagtaaaactaataatcttagacaagtcagcattaatttaatgaatgacttatctaggttttgaacctggaatactaccttagttagggtgtttaagaatttgggtttcttggctaggatcattcagaagtaaggaagaatacattagaagaggaaagggcattagaaggtaaattttagtagttgaaaaacatgaccactggacatagaaagattgttacttgacagaaaccaagtgtcttcaacagtgtcatcttctagagaccatcaccttggaattagtttggttatacagtatttttccctataatcttatcttgatataattttatccatacctattcacaaccccttacctgcaattccaaaatccaaaaatctgcaaaaacaaatttttcataattcatttggtgacatagcctgatctgaaatgatgtgaggctatttttagtgtttatccaactcaactatgaatatttcactacagaaacattaatgtctgattacttttacgcccgagactctacaggtattacgtgatatgtttaccacattacttttttaaagtccaaaattttctaaaccgaagagcaaattggtcctaagattctgaaaatggcatttaaacttaaataatgagtgagactaatctcatgcagaaaaatataattaatactgacaatgaatgtggatattcacgtaaattcagtatctcaaaaactcataaacaaa

SEQ ID NO: 98505 - DNA, 3460 bp, Homo sapiens
aaaccaattttaaacagcttttatttatttaaatgtggcaattttatactcagcacagctaaatgtattagtgtttccttggcacttccatggttcaaattgttgtattttaatacttaattttttaaaagaaaaacatttgtattatgagaaaaggacaaaagagaaaatgagactttatttttggccttatggtgaatagtctgttctgtatagctgcattttatacataataattatgtactgactgaagtcagtggtacgctgataaactggcctggccaaaaagtaacagagaaggaaaaaaaccctggtttgtatgtttgccaatttctttggtgtgaaaatacctaccatagccccttttgagccatcagtagtttaataactggctcacagaagtcttctatatttaactatctgctcagccagctagctccagcctaccattgcaagttgaaatatatttttgctatagaacgtcatagccacaaatgttattacttatgcaacaagtatccacagattgagttctcatataactcttctagaatattatgctcttaatacctcaaagtaattatgaagtagtaaaagaaatgaaattagaatagagatgtatagcaattgactgaaattgtcacccacctgtctctgtttgcagccttttctgtctctacttcctggtgtcatttatattcttaagaagctgcattcatgatttctaaaaagtttggctaacgttactgccagtagggagcagatctgtgtatggcattcagggacctccacaaatctggacctaactttgtctctagccttccattatcaatctggacctaactttgtttttagccttccattatcaacctgcacaaaacagtatctggctaagccttacacacttgtcctgtgcctttgttgtcgtatccctatgtaaataccttctccaccttcccattccttcatggatgacttcccagaccttcccactcatcttttgaatgtgtttattgctgacttggcaatgcatcaaaatcttttttttttttttttttttttggtcacaggtattactgtcttacagtgtgaataccccatgaaaacgtagaactctttgcaacttatgtcacacctgtatcttcaagggcaaggattatttgttgctatagtttttatgtcactaaagtaccttttagtgtcatatacatagtagataacactggataataataataaaaaagactaagaatgctaaagtagtctaggaattcctaaatcttaataaaaactgagaaataaagttgtgatactatataacacttaaggcacgagtaatttttttttcaccgtttcccctccatggctatgaaggaactgggagaaggatgctcctttcattaattaaaattcttcactttgaaaatttaagtttattagggaaggaaggaagaaaaatatgaagatgtaagtatacataccttggagtaagtatttccttatattggagtttctctaatttagctggggctactaatgacatgggaatcacaatgttatctatgtcataagagctctcacttctcaatctccgtcgtgcagtattctgcaaaacaggattacagtagatttacagtactgtctagttacttgtaatgataccctcctttcatcagttatgtaaatatggcagtacacgttacataatttttgtaaatacattgttataaagtctgactaaaaaatgttaagaaaaccaaaaaataaaacatttttctatcttttgtaaatcagaacaatctcttggtagatgtgtaatgtgtatttatgtgtgcaagcatacaagcttatttttaagaccacaaaaaataggtcttaaatgcaaaactctttatcagaaaagaccaacatacatcaccctaaatgtcaatgaaaatgatcagtaaccactttttattaggaaaggcagtgaaacatttttggtcagcccttcagtatactcttcatttatgcattcctggttcctgagtttcggaattcatttctaaaccctcccaccttttgacctctctattccctggccagataacaaaaaaacaaacaaacaaacaaaaaacaggacaagaacaagaaagtcctgaattctcattagtaagactttatttagcttaatatgttaaggaatagagatgatcatgataatgtttaaatttttaacacataaaaagaagctataaccaaatattaatgaacttttagcttcatagttaaaaataagttgtatgaatcaaatatattgttttctaacaagatagttataaatgtctgttaatatgtgctagtaaggctgttatagattagcaaaatataaattattttcaaaatcaggtgtttttatttttaaagctattttagagttcaacatatggaaaaacctactcgtgatgaattctggattcttgataaaacgttgacattggaaacagcagtaaaattgctatgggatcctgattctgtgtgttgaaaatcagattcttcaagtttagttctttctcctgccatggaaagaaccattgaatgttacacattaaacaagtctaatatcattagaattactttcctaattagatgacaggtgattgattccttgttttgtgtgtgtgtgtttaaattcgtgtattagaaaacaaaaaaggaaatgaaaaaagaggagccttacttgcagtcatgccacaagttatttccattttctggggctttggcagtttttatcgaatatatttcttattgttccctgaataatccctcatctcatccctttattcttgtttcctgtgactcctattcatagttgaaccaccagaactatcttaattttcttatctaatctcatttttcatatctgactttttatcctaatttatgtgaggtatctgtccttggtcttctgaacactcttaattttttgaaaaaattctgctattataagtacatgtttccgaaagtacttgttctctggtactctttttttaaaacagcatcctgttcttgtttcatagatgaaatttctcatatctctcaggatattgattagaagtttacttctgttagtattttctgtatatcttccaagttctttttttttttttttcctgttttggttcccagttactgtgtgtgtgtgtgtgtgtagtaaatatatatatgtatgcgtttacttactgcccttattttagtacaagtgttttaaaatgagaatatttcctgcataatataaaatctaatacccagtccatatttaaatatctccatttgttaaaaaaaagtcctttatagctagtttcttcagataaggatctatatataaaaattggccattgtctcctaggtttcttatagtctagaataaatcatttttcattacattgacttttgacaggctggaccagatgtcctaccc

SEQ ID NO: 98506 - DNA, 1116 bp, Homo sapiens
gatatataaatcttggcgatcagaatctttaagttcttgcttacctttaaatctggaaataagttgggaccaagtaagattcaacatggtcagactagactgtgcgagcaagaaccagaatcatttaatatctctgatgccttagttgcatcatctgtaaaatagggataatagcagcgaccttggataatgattacatgagtttattcctgtagtagtaagtaaaagtgtctgatgtgataagtgtgcagtaaatgttagcgttatcatgattgtatatctgaacccccttatttccagccttggtctaacaaccaaattggcttctttttttgaaaggtttggagatgtggaaaggagtggaaaaagaaatatgtaagctgaagtgccaaactcacactgaaataaagggcatggcctaccagctgacaaggagtgtctggtttcaagatggcaaatgaccctaaacatgatagacaaatacgttttacataggtacatgcacagataggcacatataaatccacatttgcaagcaaaaagtggaacctgtaaagcagaatttctgaggaatctctaaaagactaatactatatggaatttgaagaggaaacccagagcagaagcacatagtgaagtactgccacaaagatgtgtgacgccactaaaggtgctctagacccacaagaaaggaaaactgggagcaggacaactatctggatattgactgcacatgccaatatctcagtcagactaacagaatcagagctttaggcagagaaatgaatggttggagagagaaggcaatgcccaggtgccctgctttgaaatgtcccgcccatccccaaattagtctgaaaatttcaaatgttgtataaattcccttcccatcaaaagtgtcccataaacagcagtggtagaagagttttaactgagtatcacagcttcaatgatgagtatagaaaactccaaaaatctgaataccaacacaatcaaaaaagaggtacaaaccacaagtggaagaaccatctcaagaaataatgaagcattcatggaatacagattagcaactctttaaaacagtattgccaagagaaacaggtaagaggccctctg

SEQ ID NO: 98507 - DNA, 1527 bp, Homo sapiens
ctatgtttctggcttgcttgtgtgggttatggtgctattgttcctcctcttccatctatctgagacctaatttcagaattacagaaaacttgaaatagaacaaaaaatttctgtatacccttttctgaaatcccccaaatgttaacatcgtatcacatttgctttacctccttctttcagaccacaaatgaaatttagttgctgacatgatgcccctttagccctaaatacatcaatgtgtatttctcaaaacaaaggacattctcttatgtagccatgcagttcagtaccattagctaatctatagaccttattcagatttcaccaatatctctataatgttatttacagataatttcaactattcattgcagatggcattgcagttgtcagatctcattaaggtcttatatctgaaacagttccactgtcttccataactttcataactttgaacattttggtaagtataaacccttaaattggttttgtctggtattcctcatgattaaactagtcatccattcacttttcaacccactacagtttggcttttctctgcttgttgcctgaaatcagcaatgccattgtaaactgccaaatctaatggaccatacaggataaatccaagcaaagatctgtctactgccttcacacaacttaccctacaggaatgccaagttatttgtagatatttgttgttgtttgtttgttttgagatgaagtctcactctgttacccaggctggagtgcagtggcgccatttcggctcactacacgtctgcctcctgggttcaagtgattcttgtgcctcagcctcccgagtagctgggaccacaggtgtgcaccaccaccctcagctagcctttgtatttttagtacagacggggtttcaccatgttgccaaggctggtcttaaactcctgacctcaggtgatccacctgcctcagcctcccaaagtggtaggattacaggcgtgagccactgtgcctggccttatttatagatatttgaatatatcatactgtgtcatgtctccatgacaagacatatgtttgtttttgttatttaaagacttgttactcagtatgggccaacagcatctgaatcacctgggaccttgttagaaatgcagaatttcaggtcccattccagacttactaaatcagactctgcattctaacaatatccccgaagtaacttgcttacattttaaagtttgagaagcactaatctggaacgctccacccttctttctctgtaaattccaattaagtagtcgaagctgcacttaggcatcaccaactttctggagttcctctccttgcccatttctcatctccctgaacctctctttttctgccttctaagtagttacatactccttatttatatcttctttatataatttctttttaagatagagtctcactctgtcacccaagctggagtgcagtgatgcgatcattgctcattgcagcctcaagctcctgggctcaagcaatcctcctgcttcagcctcctaa

SEQ ID NO: 98508 - DNA, 3320 bp, Homo sapiens
cccaccaacatttttgctagagtatttaaaagcaaatcccagacatgtcttttcatctacatatatgttagtgtgaatctctaacaaactgaaaaagtacgtctgggtttatgtaaccacaatgcattattacaagtagcaaaattaacaataattcattaatatctaacagctagtccatgttcaaatttctctgtttcaaaaattatatgtgtgtctataaacagcaggcttattcaaatcaatctcaacaaggtccatacattgcatttgattgatataacaataaatatttctacacgactataattttaccagatatagaagtaaaatatttttatccttttatatcacaacattctttgataagtaggtttccatccttatatgaacttttaagatattttttaaggctgtatattccactgtaatgtatttaaccatatccctattatgcttttcaagttgttgctaatttttcattatcacaaaaacatgttaagatgaatacagttgcgaaaaaagctttcatatttaggattagactagattcttggaaatggaatagttgggtcagaatgcagggttaacagtccagtaaacatttattgggaataggtacaaaataaacaagggagtttttaagccacactgaacttataaaaaaatacgtagtttaaacgccttgtaatgcattttgcagagctcctcaaaaggcttgtatcaattcttaatatccaagatatttgagggtgctatttttactatagttgtgccaaaattgatgattataatgtttaaaatcattaatgttgcaggcaaaagtagtaaatatttgcatagtgtctgactataagctcagttaatattattttcattattatcatcaagtacacttactttttcttgttattcttttaagacattcatttttaacatttaactttttaatccaactgaaatgtattttaatgttcatccaccttaaatttgttttaaagtgctttatgagttagtgatatcagtttttaattcttccaaagagtcgttatttaatgcctttgattacaaaggaaacttagttatatagagcatggctccaagccagactgcttgggtttgaattctggctcttttattactcaactgtaatttggggaagattagtcaaggagaatagtaatacctaccttatagaattatacagacttaaataattaagtaatataaagcccttcaatcagtgctgacatataaatgatgcttcataagaatttgttgttgttgtcattattatttattgactaagccattttatcaacatggtaggaaataccaccttctgtctctaggctttttttaagctcccttgatctgccttctatcagaaccaccatgttttagtgattataacttcatagtcctgctattaatcttctaaaaatgtaattggctattcaacattttctgtctgagataaacttccagaataacttcgttccaataatacctctgattctgattaggattatattctacttgtaaattaatttggggaaaattgacaactttagttatgatactgtcttctgacaggaacaggatatttctctccatataggaatgtcctcatgtttctcactgaacttttgaagtagtcctcatgtaggtactcgttaagtttgattaaaaatactttatattttcattgtcaatatgtctaacagaatttattcctttacataggctatctagttactattggtacttataaaagctgctgatttttataaatttattttataataagaccccagttctaacaggtattcatttgactcgagtttttgaggtagattatttcatgtagaaataatttatcttaaatttatatgacttttctgatgtttagattttaactttgtagataatcaaaatatgttgttttctttcttcttctaattgcttccaagcatagaactcacccacatttacagaactcataaacatttcattataatttcctcaagttttattttgtagttttaatgttttatgtacaattcttggaattaactagaacttattctgattcatagcattaaatgagtatgtaaaagaattttactgggaaagactctctccatgagaaccaatggttctccactttcccactaatatacaattcttccctgatatataatcaactatagagtttacttcattgatctattttcttaaatataaacaaaatagattctacattattatagatttttgtcatgtttccatatgtgcttgggctagattttctctaaactttttataataattccttttatattttcccctgtttagtcttcccattgtgctttagaattattttaagttaaacaaattctatgagaacttcgagttacattacattaatcatatgaactattaggaagaatttatatatttattgatcttaccatacagaaatgctgtttctccacatttatttaaatttttattatatttatcagtaatagttcataattacaattcaataggtatcgcacatttcatgttaagattgttcttgtattttatgtgtacatgagttgtaaaaagtgagtattaaaaattaaggattttcatgtattcttttcttagattttatttttcttagaatgcaaaaatagtaagtataaagacataaaaaggcatatagagtacaagaactgtaaatgtgacataccaggtgatggagatatgatatattcatctacaaatttattttcagcaagattgccttttatttcagtcttttttaacagtgtttcaaagtgaaaatgaagaggcacatctggaaaaataaaataaaaaaggtattttcaaataccactctttgtaatactaggattacagattgtaacattaaaattgctttctttctataaatagcacataagcttaagaaaataagcaaaagtttgagatgtaacaactatcggaagtgacaaaatactctttccaagcatgttggtagcagtattttagaaattactggttaggtgcacttaatcaacaaattaaaaagctaacagagaaacaacttcatgaacttcctaaaatagtacataagatgaacagtaattataagtattaataaatactattcacagatgaatggaaacaaatatacccaagaagtctttaagaaaacctacacccaaatctggctgactctaaatccattccatcccatccctacaaactttgcatttgaaataatgaagcttccaaaaaattacatgcttttaacgtcttgggag

SEQ ID NO: 98509 - DNA, 1012 bp, Homo sapiens
ctatgtgcctttcttaatacccgcacgtgacctgtcagcttttgtaaaaatatttcattgctttgaaacattacctttcagttgttttaaactagaatgcgagtaccttgagggatttatttgtatttatactcctagcatttatttagtacttacatatagtaggtattgagatttttattgaatgtaagaaggaatggatatcatgaaatagtagataaacaatctaatctcatttattagagggggcataagagtcttaggataaagagtatttataccagctctcagggttatgtcatcagagaaatatatttgctaataagaaaacaggcagtaaagtaatggtgagtagtttggttctggagaatgactacctcaaattctggctcatcatttattagccgagtaatcttggatgagtagtatcacgaagcttagttttctcatatgtaagatgaacagaacaaagatatctattctcatggagttgtgggaattaaacaagaaaatgtaatgtgcttaatatatacaaggctcagtatatgctaagactaaatgttagctacattattattgttatatggattattattttatcatattattaaggtttcctcaaatatagaataaaatagttcttgttaaaaacttaaatcaaggtaatggtgtagctaagaaaccactctactactgataaaaactaaattgagattcagggcagggagacaggttcaaaacatagtgctttacaaataaatcagtcccttgattttgagaatttaaaagaccatcagaaccataagcggaaaatggaacaaaagctaagttgagatatcccccagtaaagaagaaccggagataaccaatgtgagggatgttttctttctcccctaaatatttactttagttccaatatagacaagagtgtaaaggttccacaaaaatcaagaactgaaaatttaaaaccacctagagtaatcctagcatttttgggaggttgaggtgggag

SEQ ID NO: 98510 - DNA, 1023 bp, Homo sapiens
cttgaggttgactatacttataggtacgcagttttcttccctctgcattgagaaattcaatgcagattataaatggagaaatattttatgacagggaaacctccatgtataacagcacattagaaaaagaacactgaattaccattactcagaaacatttcaacagcacagccatgttaccaataaaatgctcaaaatttaacaagataaaaacctagtaatttcccaaagtaaatcaagttggtttagaaggaattaaagaatcaacttacacagatagaacattaaccgtgcatgtgactagattaattcctctacaacaaatttaattgtcaaggcattgcttagttctaatatctactgaaaaaaaattgataaaataagatttattagattctctgtatttagaggattagatttcagtacagaaaatatcgttacttagaaattgttacaaggaggcttacctgatggcaatgatagaacagaatggaaagaggaatctaactctgatacatgttctcttaataggtaagactccgaattgtgttcatagctactccaagttgaagctgattgcaggcaaggcatttgtgtagtgtttaaaaatgctgtttcttttgaaggcaaagtctgcaaggaaaaaccgtattagaatatcacagccaaagcatccataaatggcatatctctacatttatttaggttatctttaaataaaattttccagttctacaaaaagttttacaaatattttgctagatgttttcccaattaactttaatatttattaattcaatcataaaagggatgtaaaaatataattaacttttatatattgaatattctacaactttgctataaactttctttttctaataatatatagcttcttctagtctttgattatctaaacatactagctgggaatgataactgtaatttttttccttcaatcctactagttttttttttagggagttccaaccatgctggatgggttcaccaattcaataatgaata

SEQ ID NO: 98511 - DNA, 1273 bp, Homo sapiens
tactattgctatggagaactcattctgggcccatttgtttatacttgagctagttcccacatactttataactgttaagtcagtatctggtagtcctgtctaccctccttcccttctcttcatggacctttatttgtccatattcacttttgaatgttaagtttccaaaatagacagctggtattttgactaagattaccttaaattcaggaaactggatgtctcccacttttaagtctttatatcctatataaaagttttaaatttgtttccatagtagtcatatatatatatagtcaattctcagaaaattgacagtatgcttttgggaatgtaccttgttttttaatatatttttaattggttattactaatgtggaaaaatagtattagttctaataatttattgattctgttggattttctatgaaattacttcatgtgaaaataatgacagttttatttcacccttacaatcaaaaaaattttccttcagaactttggagacattattctattttcatctggagtcattaatgagaatttcaatggcaatttcattcttacccattataggtcatagtttgcttttgttagctgttttcccttcgaagctttaacatcttatcttctagatattcagaaatttcatgagaatctgtttaggagtgggctgtttatttaattcacaatgctcaaaagtttgtgggccttatcaaactgaagacatcatgtcttctttttggctgtggaaatagtcatgtataatttctctttgtgttctgggagatttatttgactctattttctagttcttatactaaaaaattttaattatagctattttattttaaatttctttctttcttctttcctttttttttttttttttgagacaaggtattgctctgtcacccacggtggagagtggtggcacaatctatcaagactcactgcagcctctactgcctggctcaagcaatcctcccaccttatcctctagagtagctgggactagaggtggataccaccatacctggatcatttttaaattttctgtagagacagtatctcactatgttgcctaggctggttttaactcctgggcttaagagatcctcctacttcagcctcccaaagtgctggggttacaggcctgagccaccacactaggccttattttaaatttctaaaggcactttttttttgtttgtttgtttcatgattgtttctttagtacaacaggctgccctggaagttattgtctgttctt

SEQ ID NO: 98512 - DNA, 1031 bp, Homo sapiens
cagtggtatgatctcggttcactgcagcctctgcctccctggttcaagcaattcttgtgcctcagcctcccaagtagctggggttacaggcatgcaccaccatgtccagctaatttttatatttttagtagagatagagtttcaccatgttggccaggctgctctcgaactcctgacctcaagtgatctgcctgctttagcctcccaaagattggattacagccatgagccatcgtgccaggcctcagttaagtatctttcaaatgtattttcttatttaatatcaacacacctctagaaggtagcctttttcttcttttcttcattgctgattcagctaatgtcttaatttagagctgtccctgtgtcccaaagcagacgccaaggcaaagattgtttaatatcaatggtcacaaatttcttcaatccctgtgtgtatgcccctttgctgaaatttcccctttgctgtaaattccatccctgtgtgtatgcccctatttctccatccctttgaatttgggctgaccaagtcacttgctttgtcctatagaatgcagtggaaattatgttgtttaagatctggtgggctgggtgtggtatttcacacctgtaatcccagcactttgtgaggccaaggtgggcagatcccttgaggccaggaattcgagaccagcctggccaacatggtgaaatcccatctctactaaaaatacaaaaattaggtgggcatggtgggacttgcctgcaatcccagctactcaagaggctgaagcatgagaatcacttgaaccctggaggcagaggttgcagtgagccaagatcgttgacactgcactccagcctgggagagaaagtgagagtctttctcaaaaaaacaaacaatagggccgggcgctgtggctcacgcctgtaatcccagtactttgggaggctgagacaggcagatcatgaggtcaggagattgagaccatcctgggtaacatggtgaaaccctgtctctactaaaaatacaaaaaattagccgggcgtgg

SEQ ID NO: 98513 - DNA, 3089 bp, Homo sapiens
gcactccagcctgggagacagagcgagactccgtctcaaaaaaaaaaaaaaaaaaaccttgctggttttacggctcagggggcatcacggaacctgccaacatgtggtatctcccccggacacccagctttaaaatttctctcttttgtactctttccctttatttctcagaccggctgacacttagggaaaacagaaaagaacctacatgaaatatcgggggtgaattttgcccaatatctggctgaatttcccccatacccaggaggtggagcttgcagtgacctgagaccacgtcactgcactccagcctgggtgacagagcgagactccgtctcaaaaaaaaaaaaaaaaaaagatctggagcctaggcttcaagaggcatgtaacttcctccttgtcatattggagcactgtcctgaggtgccatggaaggaagccattctagctaatgcagcatgagaggccacaatgagaactgagttgccccaaccaacagccagcaccacctgccagaagagcaagtgagtcccacttccgccagcacagctggccctccagctgaatgtagccatatgatggtagtcctatttttatggatgaggaaaacaaagtagtaagtaatttgcacagtactgcacactattaagtagaacaaggattacaatccagtatgaaaccactaaaatgtgctgcttccctacaaaaaataacttctagactctttaatttggtagcttccaaatttatctgcaattatataaagcatattttctcacaggaatatgttatacatgctataaatttatctctccagtcaacctatagaagtccctggagtacagaattgttacagcaaggtaagaaaatcctcaactaagataattcccattgtctaaagcagatgctccagtaggtgtggcatggaagaaagagttggcttcccagcagcataaaaatactacttaagtaactttttttttttttgagatagtgcaatggcatgatctcagctgactgcaacctccacctcccgggttcaagcgattctcctgcctcagcctcccaaatagctgggattacaggcacgtgtcaccacgcctggctaattttttgtatttttagtagaaatggggtttcaccaagttagccaggttggtctcgaattcctgacctcaggtgatccacccacctcggcctcccaaagtgctaggattacaggcgtgagctatcatgcccagcttccagtaagaatttaaatttctatgagatgatatctttatttttctttaaaatcttctattatttgttcaaaaaagtggcctgcattcacataaagtttacatacctaatcattcacattttaaaaaggaaatgaaaactttcaaatgaaattattatatgtaccttaattcgtaccactggattattttattaaaccactcagcattatgatttgagaatctatgaaataacaatgatgatacagactacaaacactacttttgcaaatctgccataggagacagataaaagatcacagatgaacaaattaaaataggaatagttctgccttatttcataaaggttataatattcattattaatgttacttcaatttatacatgttaggtcactacagctgttttcataaatatgaaatggcttgtggattacatgctaaaattcataaaaaatgaaaaaattatcctgctcaaaatagtttcccacccaacattccataatcttaataatgtgaccattttgaatttaatttactacttctgcaagaccagcgtcttgatatgcaaatagcgttcttcagagtaacagtatcattggtaaacagcttaccagagattagcaggtcaactagtgacaaaacaggccagttatatttgtatggaaataagaagaggaaaagaaaagagctgggtaatttgaagaataccatgagaaaacaggaagcatacataacatcactagataccagaggggtgggaaccaccatgatggggataatacaagataagtgagtgtcctgcaaataaagtttcattcatttaaaacttctgcccagttcatgtttctaatatttatatcacattgatttatttattattgctcaagggctgcaactattaatagagaagaagtaatcaccactgctactccccacccccaatatggaggagggtgattgggagcatgaccaaataaaactctgggcttttccctaccttcaaccaaccatttctacttttattaatttcatataaaataacctctgatctaagtgattgaatacacttcttgacttattcttactcaaacaattaggtttattaactaaaatcttataatacaataagtagactgccctaactcaaaatataattattgtaactattagcttcctatataaacaatttgtatgtccaattacctacaacccgcttctatagaaagtgtattaggaattctaatcttggatgccagaggcctctgttcaccattcccagtgggaaagagaacttcctttgccaggagttaatcagggtggcttctgttgtctaaggctgagacatcaatagtatagggcctaacgttgcacagcaactgggtataaagactatcaagaaggagctgaagaagcatattatgatcagataaacatttttaaattattaattgcaagtgaaattttaaagaatgctattagctacatttatattttaagaattatactagagtattattctgaaaaacattttcacatctagctatgcctaccagtgtattttctggatctaaagatacatctatattctaggtagataaagcaacattatcaagcacaaagaagcatagattctccaagcataaactaaagtgtaccagtaatgaataaagtggcttagacagcaaaagatatgattctcttagaataagaaagccaaacattcttaaacagccttagaaactacgtgaagttttaacaattgtttatatgggctagtcatagaaagaaacagtctgaaaaactcataaaagattcaaatcagatgtagaaatcaagcttatgaaag

SEQ ID NO: 98514 - DNA, 1399 bp, Homo sapiens
taacttattttgcttttcatcacagctggtttagaagtacactaaaggaagtatacccattattttgttcacacatgaaaaatatgttttacaaaatgaatgtttctaatgaagtatacttaatttgtaaaaattgtaagcatgagcatctaaaactgtattgcttatgttctagaagaaggaaaaggagcactcaacaagattaataaatatcaaacctaaaaaggaaagcaacgttacttcttccaaaataactgacagctgtgcagattttcttcttctgagcaaacatttatggacaaatatgtagtacatttgtgttaccctcttatctttgacagtacattttaaaaatcatcttgacatttcattttctctcaaattagtttaggcataatagatctttaaaaaaactggggatgtgagaagtttcagagtacactgcttgcaatgtttaaaaaattactaaagcccactttagtattattaatatctactatatcatttttaaactatatttgtaagttttctacatgtaattattcaaaataagtgttatgctaaataacaatctacatcttctcatgcatgaaatatgctgatggtgaatctttgatcatgttttcttcccaaaggcagccttacctgtggagtccaataaaaagtagggctcaatctgtacagttttcgtttgtggaaactctgaagtggccttgttcgggctgatgtactcatgaaagtcaaggatgaagatttcagtcttgtcctgtcttttctctttttcttactgtgcttctggttaagtaaccagctactggaggaagacagctcatctaaattctctgatgcactgaaatgccatgaaataattagggcgtgggaagggaataaaacaaaacaaaacaaacaaaaaagacaaagaaaactaaatgtaaattgccttgatctattatgacagaaaagtattaattttaaccaattttgtggtaacaattggtaaaatattttgtattaacgggaaattacatattcaagttgtgaaaaccatctttacatctattttctcctgcaaaacaaatataccataagttagaaaatgctcatgagtttactagtgtaatgtaattgctcattgtaaaacaataattcatgtcaattacagtattttaactatttacacaaaattctttttgtgtatgatgaaaatacatagattacaggtttttaaaagaactaaagtcatcactccattattagtttctgttttttttgttttttgttttttgtttttttgagatggagtctcactcagctgcccaggctggagtgcagtggtgcgatctcggttcactgcaaccatcgtctcctggtttcaagtgattctcctgtctcagcttcc

SEQ ID NO: 98515 - DNA, 1114 bp, Homo sapiens
gtgttcttctacttttgttaaaaattgttaatgttttcattccttctcatttgatcacaaaaataattgttacaaggttttataaaaatgtagccagtttatgttaaaatttttgatatattattataaattgaagctatttttgtaatgcctttttgtattttaagatcattttatcatactttttgagcaattcagaacttccttattggattccagttaatataagtgataaacgtgttttcaaatttctaaatcataaaatacataaaaaccttaacatcttaaccatttttgagtgtatagttgtgttattaaatacatttgtaatgttgtgcatctgtcgctatccatctccataactctttttaccttttataactgaagctctaaacccattaaataataactgtccactttcctctctcctcaacccctggcaactatgtctgtctcttatgattttgactattttaagtacctcatatgagcagaatcataagtttttgtctttttgtggctagcttatttcactagcataatgttctcaagtttcataaatattgtagcatattagaatttctttcctttttaagactaataatttattgtatgtatataccacattttgtttattcattcatccgttgatggacacttgggttgcttccagtttttagctattgtgagtatgctatgaacatggatataaaaatatctctttgagaccctgttttcaattctttggggtaaacacccacaagttgaattgctggatcatatgggaactttatttttaatttttttgtggatctaccatactgtttttcacagtggctataccagttaacattcccaccagcagtacacaaggttcagatttctccagattctcgctaacatttattttctgtttattttatagtaacctccctaatgagtgtgagatggtatcttattttagttttgatttgcatttgcctaatgattaatgatgttgaacatcatttcatgtgctactggcttggcttttggatatcttctttggagaagtacttattcaagtcctttgcccatttttgaattgggttgcttgcttgtttttttcttgttg

SEQ ID NO: 98516 - DNA, 1050 bp, Homo sapiens
atgaatgacaatgcaaacaccatgtaaaaactgttacataaaacttttatacgtaagtagatgtcaagtaccagacaatccatttgaatggtgctaaatctaaatccatgtaataaactgtagcatattcgattttactataagtaatttttatttgttaaaataggcatcgttattagctaattatttaaatcattttttaaaagctatcaaaaattataaaaaatataaatgctctgctacatttcaaataagcataccaaatatatagaccttaaaatatttaagataaactgttccttaaaaacctgattcctaggattcacaacctacagatcacaaagaatttacataaagcctttctttcatgcatatttaaaaataagggttgattcctagctcctcctagtacctcttgtcatttggcaagagcactacagctagagaaaaattattggggattacgggtggtatatgtgtgtgatatttaattaggagatgcagattgcaaaaaaaaaaaaaaactgacagaaactgaagatataactgtaggacaacaatgacttaatgacaacatgtaaactttataaaaaacttatctaaaaattcatttattgtcaaaacccgctgactgtagaacgccaagagtgaaccctaatgtaaatgatgatctctgggtgacaatgacgtgttaatgtaggttcatcaattgtaacaaatacaccactctgttgtgggatattaacactgggaaaggttatgcatttgtagcatgtaggaacaggggatatgtgggaactctttgtactttccattcagttttgctgtgaacctaaaactgctctaaaaaatagtttattaattttttaaaatgcactggaccataatggaatatctttcaaataatctttaaacagagaaaatatttattctaagagatcatttgctgtcagataaacagaacacaattattatggctttgctatatagaatttattcattataacaggattttacattatatcaatgtttctgaaaggccactgtttt

SEQ ID NO: 98517 - DNA, 1040 bp, Homo sapiens
attttccttttaagtccttgagcatatttacaatagatattttaagctctttgccaactactttcatgatcattatcatttccacatcagtttccattaataatttttctccgcttctttgcatgcctaatagttgaatacacacatgtgcacatacatacacacatgtctagtaggttttatataaatacatattttaagggtactatgattatgttgttaatgtgtggattttgtggtcttccttaaagagtgatgaattctgttctgacaggttattatattacttgctgttcaacttcataaatttcagcttactttaaagctttgttagagcatgtgtagagtagccactacactaaggcagttatcaaattgagggagaggtggatagtctgaggaaaataactagtaaattaataagtgcataggcttaacaactatgacaaaatgagatctttggctgtggtattttcacatataactgacaggaagaaaaagagaatggaaacctacatttcggagggaactcgactaggaaatactaccataagcctaacaaagactatccctgggagccaaatctgcaccaatagaaagcagggtgagaatgcagtggtgtctccaataagagtacactaacacccatgttagatacagtcacaaagaatcatagaccaagagtaattcccaaagagcaaggtcagggactatgaaggacaaatgacaagggagcttatctcagaaagcaaaattaaggtcctagcaagaccttactccactgccagagcaagaagtctattattgtaaggaacaggaactatcatatatggcccattcttttttttcccattgggaattttccttgtcctttataccatcatacaagaagcaagaggtcaagaaaattaggaaacttgtctcttagtttattggtcaccacatcatgatgaaccacacagaaacccgatatagaggactttacccaatgaatgtgactttgggttatcatccttgagaagatggtatgttttatgaat

SEQ ID NO: 98518 - DNA, 1045 bp, Homo sapiens
tgtatagaattaatattatattattttcccaccccagggaattatgttatgaaattgattgtatttaaattttatggcatctttagcactgaggaaatgcaatatttcaaatttatgcatgtaagcatcaggatcatttaaaataatatgttgcataatatatttaagattgtcagaaatatttttcatttaatgtctagtaatattttaaaaatgtatgtaattcattctgttacagcattttaaaatgtaaatttgtgacgtatttggcatttaggggaatgatgtcaatataatgtagatttttacacactttgtgtgtgtatccacaatgtgggttgtttccagattacttcaaacttgttagcattttgaaatgatcaaggtcaagcttttctcaactaaagaggaattcttagcagtagctgaagatctaaacaaaatgctaaaagtcctatagaaatatcctcctgtagctcagtaagttgctggtttattggctatacatttttctgtgttgactaagctttaaagatattttgcttgtgttaaaaagaaattgactaatgaaaaatgctgtctctagaagatatttttaatttttattaaactggtttctattagaactaatgtcttcaaggatgcacatcaaaaaaagaagagacccaggatatgaagctttaaatgtggactgctttattttaggtacaaatgccagtggaaactttccatttttataataatcattattgttttgttagggctcagatttaaaagttccttaggtattgtgtggtctggcactatcttcacaataagtctaactatttttattttgcagaacatgaggttatacagaagtgcatatattgtgttagagcaggaatgcctgtacttgattctggcttagtggtagtcatttttttgattaataaaggtagttttaatttttatcctatttcttttcagggcccattatagtgtttcgcaggcccattactaactcatttgtgtgcattaggaaaagattttccttccactgagc

SEQ ID NO: 98519 - DNA, 1051 bp, Homo sapiens
agggtttattgcactgtactcaaaagaaaattgtacctggccactcaaatgtgcctgttagttcttcagctgctgaaaaagaggaggaagtacatgctcgtttacttcattgtgtaagcaaacagaaaattttacttagccaggctagaagaactcagaaacatttgcagatgctcctggcaaagcatgttgttaagcactatggtcagcagatgaaattgtctatgaaacatcaactccccaaaatgaagacatttcatgaacctaccacaattttgggtaatagtttacctaaatgcactgaaattaagccagaagttaacacattgactgcagagaataaattgtgggatgatgcaaaaaatggctttgcacggtgtacagctgcggaaatccaaagatttgcattttctgctacagggctgttgtctcatgttgaagagggtttggattccgatgcaactgatagcagctctgatgacgatttggatgaatatacccttagaaaaaatgtggcagtgtaagtgcaaaattattattagactattttctgttccatatatagcagcaattatcttagtttccaggtatgttgacaagaaatagattttctaaaatcttaatgctataatctttttttttttttttaatttttatttttgagacagagtctcgctctgtcgcccaggctggagtgtagtggtgcaatcctggctcactgcaacctccgcctcccgggttcaaacaattttcctgctttagcttcctgagtagctgggattacaggtgtgtgccaccacacccagctaatttttgtatttttcgtagaggcaaggtttcaccatgttggtcaggctggtctcgaactcctgaccttgtgatccacccgcctcggcctcccaaagtgctgggattagaggcgtgagccaccacatccagccaccataatcttttatgttataaaacttttgttgaatttttttaatgttttgtttgttaaattattgtgtgtgagtatatacatactatttaaaaataaatttactcaact

SEQ ID NO: 98520 - DNA, 1052 bp, Homo sapiens
ctgtaattggcctaggttagctatatgaaacatttaggtcacaagtgtggaaataatttattatttgaccctacttcagggttctcccctctctcaaaatactgttggtagtcttttcactttatttaagcatcaagtataaatctgctgtctttctgataatgttttcctagtttgtttctttgctctgcatttaagagagctgggattatccagattccagttaaaagaataaatttaatgttcaggggcagatttggataggatattttccatggcatatatggaatatatgtatgcattctagaatataaatcagaatctggagcagtattttaggggataggaattcagatttggcctttaatctttaatgcacattctcaggaggaagagtggttcttatatagattatcagtttcaactctgagcgttgagattagattagcaaattttttatttttctttagaaagtttgtcaaaaattttttgaaatatgtgacctatgtattaatttgtaaaggtctgattattaactgtctggaccaactcagtaactattgacttggtaattatctcactgtgtacatgcaccttttgaggatgatggcttttactgtatttcatgatgtccaagggatcagattgcatttaattaatgctaaattcataaatatgtatggtttagaaatcttaaaaaatatagattaaactcctaatggaaagtctggagacaacagggcaagaccttttatttgtagtacagtagtccatctttatttttggggtatatgtttcagatccccagtggtacctgaaatcgcagacagtacttaaccctatatatactttatttttttctaaccatacatacatatgatcaagttgaatttatgaattaggcatagtaaaagattagcaacaacagtagtagaacagttataactatacataaaagttatgtgaatgtgctcttcttgctcgctctcaaaatatcttaccttactgtactcacctgtttttggactgcagttgaccacaggttactcgaa

SEQ ID NO: 98521 - DNA, 1027 bp, Homo sapiens
ttttacaaaattaaatcagatgaaacatactcattatttttattttgaatttgtaatctctttaatcaaattaatacaaagctatacagattattaacatcttaatagttttttttactattattccaatttaggatgaatgccatattgaaaaaataagtaatttatgaaggacttttattgtttgtacttcactaattgaatagtttatgagttacctggtaagacaaaatttacagtttctaatatattttatttattcattcaatcatctgatttatccagagcttatgtggatgccagagttcagccaatctatggtggtacaaatgaaataatgaaggagctgattgcaagagagattgtctttgacaagtagacatctgcccacatcctggagtcctattacagctaatctcgttttaaatctgctcaagataaaatgtaacttggaaagcgaggaaacactaaacatgtttttacctgctctctctatagagaaggaaataaaatataaatataagattaacacagtggaaggacaaatctttgaagccaaaattctagttttccaatataaggtttaacttacagttttttatgtagccaaaggtaaacggttttctgaatcttgcctaggtgtttcatttatctctaaaattctaaaaagcataaatcattcaaatcttcaaaccaaggcagaaataattttatgtcgctatagtataaaaacattaataagatagcacattgacttttaaagggaaaagtaaatataacttagcatgtaaactcatttcggctaccatttgctccaaattccctagaacagtggtttttaccactgtactccaaccccgtttttaagcaatggaactctttcttcaaacaaaagcttatgcagaacatctctgtgaaacgctgctgagtgagaactgctttcattgaagctggaagccatcataccttactgccttgaaacccctaggactcagctaagtatttgcctaaccctgaccagggaatg

SEQ ID NO: 98522 - DNA, 2363 bp, Homo sapiens
tctggtttgaagttttacttcagcttctagaagtttccagcatttacaaaggaatgactcttgtatgagagaatcaggcttagatatctttactctttcatattgtaaagacagtgcataaattcccaaatgtggcatcatgtaggcaaaaaaatatcttgagacttgttggatccacccttattttccaaataaagtgtcatacatagtgtcattgaactaaactaggagtaggcttagaaaccatcttcagggattttcatggaatactcatctgttttcgatatatagattatttgcctatttttttctttttttgttccatctttatattgtctaagagtaaacttcaatgtgtgggttgggagtgggaaactttgtgctgattaaagggtagatatttgacctaattaaatatatgatgaatagaaatggagatagaaaaaattaagggaaacaataagcggggaagaaagttttgatgtgacccagcatgttcagaactagaggccagaatacagagatggaaggagtggggtgccaaccttctcattgcttagttttggaatcattcgatgccagttacattctctgtttctagaacagggtgaaataaaaccaggggaaagacagtcagttggagttttcatcagcacagtagttatgttgatatacctgtaaggaatctgcccctcagagctttactccacctgatacaccctggtcttgcttggtcctgggtctttttacactcccattctactcttttccagaaatggtaagtatcaaaactgtcccaaccaacaatgacagtgaaagaatcagttttataacttgagaattgctgtagccagcattaaaagcagaccatgtatcttctgagaatgtgtcccaccaccctcctttgagaacacagctgtggctttggacttggtagtacctaggtgggatgtgtttaatttctagtttgagtttcactgcaccacctttgcctgtaactttccatgtatatgctattagccacagtgaagttcttactcatttcacagcagaatgatcagaactgtttctatctgaattttcacaaagaagataggccagctgaccatatctgggccttggacctaagaaatcaactagaatggagtatacttttggagctacccaaagtgggaacccagtatttcaagttcaagccaatttcctgagggaggctcaagagtcagtgccaaagagaacagatatacactccaagttcagagtgtgagagcctagagtcaggaatgaaataaagcttgattgaagcaaggacagtcagcaacaattgagaatggtctaaatagaatgatttccaaaaatgctaatgggttgtccatggccagtaggaggaggtaggtacatagctatattaacattgataatcccagaccattcagtccaagctagagactgctaaacaagctattgagaggtacgggaggtgtattcatccattttcatactgctatgaagaaatacctgagactgggtaatttattaaaaaaaaaaaaagaggtttaatggactcacagttccacatggctggggaggcctcataatcatggcggaaggtgaaggaggaacaacagcacatcttacatggtagcaggcaaaacagcgtgtgcaggggaaccactctttataaaaccatcagatctcatgagacttactcactatcacaagaacatcatgggacaaacccacccccatgattcaattatctcccaccacgtccctcccacaacatgtggggattatgggagctacaattcaagataagatttgggtagggacagagccaaaccatatcagaagggataatgtgaagggatgaaagaggatgagggtactggattttgatctctttagtactctgattttattctattgctttctacagatctagattaaatactgtgcaatattaaataataccttatattttgatgtttatgaacatatatagaaaccccttgtccctccagatgttagaagcagagtagcaaaatctgtatacttaatttcattaataaagaaaaaaatcttcaaggatttaatctctggaggaaaaagcaacaggtgttttcaacggctgtacctaaataactgtaccacaagatggtgctcacacattaaagtcatgctgtttttcaagaattttgcctcgtctaaattttacaatctgaaacaagacattgtttatgttttaaactatttttgcatcttttagtacaaatttccttagcactgaaatatagtgagttttaaatttaagctgatttggtaacaaatgccatttttatggaggaaaaaaccaacaattc

SEQ ID NO: 98523 - DNA, 1021 bp, Homo sapiens
atagcatttcaactgtggcagctatacagacattaggaactagacagaaaggtaggagcttggtagacttataaggtttttgagcaagggagtcgtgtaatggagcaatactgttgaaaaaatatttttgccaagttgtatagaatttttttgaggaacatctttttcaaaatatatttttaaaacatcctttggcctcctctgtgccaaaaagaattctaagcacttaagatagatatatgaataggaaatggctatgagctcctagtaaggaggcacgttgatgatcttttattattgtgtcacctataaccatactgccaccactatattcatttgctgttgtgtagacaacactaacattatttgcccatttttcattatttgtatgtatcagtgctgtgcattttaggtgatgggagtaaccaacatcattttatacccctactatttcaaagagagagagataaaaacagatcattttggtaaatttgaggtgttgtaggaccgcttaacccagcctggagaatttgagaccttttggccaatctgatgtctaaaccacccaggatgagtacaattcattgcagcagagttgggaaagggcctttcccaagtagcagaaacaagattttcaaagactcataggtcaggaagacctcgcaacgtgatggacagcaagtagtttagtagagctgactgaagaagaggaaattggggaaagtgggacaagcaataagccaggtaaggagaggtaagctagtgccagtttgtgataagttttctatttcctgctaaaggttttgaatttatcctgaagcctattaggagctattcaaaaatttttaagtgtgaaggtgatatgatcagattgcatttagaaaaatctctttgacatcatgatgaatgatacagctgtagagagatcagttgtaggaacttaagaaatgatgagggctggaaataaggtaattacaatagacttgaaaggaagtgaataaattccaaaagtattaagatg

SEQ ID NO: 98524 - DNA, 1014 bp, Homo sapiens
gtgggaagaaaagaagatagaagatggaatatggttcattttgcctgccctcagagatggattgagcactgtctatatttttggtttgatttggcctccacagaaaaaaatgttgcaattgttgaaaaacatccagagtttcactggccctttccccttccatggaggaaagcttcattatatataattatgtatctttgtatgttgtattactttagcattttataaatgctttcatgtttattttattattttttaaagaaatagagatggggtctcgctatatttcccaggctggtctgaaactcatggactcaagcattcctcctgcctcagcctctcaacatgctaagattataggtgtgagccactgcacctgatctcatgttgattttattatatggctattataataagatatatggaatatagagatatgatttctgtataagaaggaaacagaaaataataaatgaagtattttgaccaagttcatagagcaaattgttgacatctttggagccagagtgttctgacaccagctgtgtgatcttgggtaaaaatctctgagcttcaatgtctcttatcaatgaaattgagaaaatgatactgaagaagattattgtgagggtctaacttgttggctttactaagtagtatacgttttcatttttaatatttcatatataacattcaaaaatttaggaaaaatttacaaactgagctatgtcattacctttatttcctttgatatgtccctgtatagaagaattttttttttttaaacagtctcgctcttgtcacccaggctggagtgcaatggcgcgatctcggctcactgcaacctccacctcctaggctcaagctattctcctgcctcagcctcccaagtaactgggattacaggcgcccgccaccatgcccagctaatttttgtatttgtagtagagacagggattcagcaggttggccaggctggtcttggactcctgacctcaggtgatccgcctgtct

SEQ ID NO: 98525 - DNA, 1158 bp, Homo sapiens
aaaaaaggaaagaaacatgtaatagtaaaaagttatttttttaaaaaccctttaagtctactttgattaattacatgaaatagatcttttctggataaggactagaaaagaaaaggcagagtccaactaaggaagaaatacactaaattagaatttaatgcaaaatagaaaaagcatcctttggcaagatttgaatatatgataagttttttagatgtgaacttgaaaatgtacaaaatgatgcatagattttcaaaatttctttcaggggtacttcaagggtaaaaaaggctgaagaccactgaactaaaggagctacaaaactgtctcatttgaagcttggtgtgggagggatgggagtaggtcttaaataattccattttacagaatctttatcagagattgatgggtatttttatctccacccagattggctttgtaatgtggcgattacatcaacatggtttgcatcttatacacctgcaatttgaaattgtgtgattctggttaaaatactaattttggaggctttgcattattttaaacattgtatatgatatgaaaatttatcagtattactctaccgtactatttgaattttacataatgtgatccatatgtcacctgacaatactacatttcacctcaagtcagacctgtggttagttctaggcatcatcttctttaaggatttggagatggagaccgagttgaataatgataaggtacttcttaattccagctacatgaggtagatcccatcaaaagtggtggcgcccaaatttgaacccagctttgtcataattcaaactctttctacttgcctctcaagtttctctgtgaaagaaatccatgttgttcagtggcactaatttggatatgaagagtaacaattcacttacttttcctattgcatatatatatttttaagatgttctcattccggaggggaagaacgtctagaaactccttctgctaaaaaattaacagatataggaattcgaagaatcttttctccagagcatgacattttccggaaaagtgtaaggaagtttttccaagaagaagtgattcctcatcactcagagtaagtggcacattttcctctaatgtaatgtatactaggggtattataggaccatttcctagaatgccata

SEQ ID NO: 98526 - DNA, 1236 bp, Homo sapiens
accaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctga

SEQ ID NO: 98527 - DNA, 1627 bp, Homo sapiens
acctcttaacttttggggttgtctctggaagaaatcactatactaatttaacttggtctcattttcagtttgctgaatggtgcttagagtatggagaacatggatgcagaacaccagacacccctttctctctctttgaaggtattttgtacactttatttatttgccctataatatcagcatctacttctctgcttggtaattaatgtatttaagttttagcaaaaaattttataattattcttaaactacttttttatttcctaatatgctaaatcgatattaaaaatcaattagcacatgtaataccacagtcccaatactggtagtcatcaggtgactcccttttatggagccaggcacatgttgggcattttgcagacgccctcataaatcattcagcaaaaacatacaggcactactaccttcatgtcatagccgaggagactgaggctcaggagcttatgtttggtaaatggcagggctgtgacttgaacttgtctggctccattctttctccagtcttccaccgggatataaggctgaacacctcactagtgatctcttctaatgttgaactgcagtgtatgtaaacgtagatagattcacacttcatttaaatcattgccgttaatattgtaatgttgttaatgttaaaaaatggagccatccttcgtttttgcagagttgtaactgctctcggggggtgtcagtgaggtgaggaaaaagccataggatgccgaaggaggagggccaagaggacacccccaccctccagtgcggccttgatccagaccttagggacgaggccatcactggtgggcaccctttgttgatgtttgtgtgtttgaatagactgaaatgctgtgactttttttgtcaataaagatatgggggaaaaagaaccatcctatgaaatggagtcatttggtataataacttttgcctctttctctttcttcaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttgga

SEQ ID NO: 98528 - DNA, 1031 bp, Homo sapiens
tttatggctaaatattattccatggtacattttctttatccaataatccaaagaatgaatgttcatgcaggcacatataaagtgcttggcattatttcctgcagtgggtgtgcctgaaggtgaggcagagatggactggaaaagattgacgtttctttgaccagcaatgctgaccctttgctctttactagaggcagtggcttcactgtgcaaaacaaatgtgtgcttagtggagggtacctgaggtcaagggctagccatatagatgactatgagggaaatgcagtccgcattctatgatagtcattactttttgtatattccgcaaagttttggtataccatattaataaaacagcatatgcaaaagcacctaccagaacagctgtcagaacgcaggcactcaatgaacataacttcccttctcccagcttccccatgccttccttctaacatgtactatgctctttatctttataaacctctggagccctcttatgggtctctgaccattcagggttctcagtttgaatctgccccaggctttgatttttttctatagttttacttttataaacatttaatgactgtatatatttttctttcttgaacctacatgatatctagctagtgtaaccaaagggcaatttatttagaaacaaggtattaaattaacttaactaatatttattgaatgcgtactgtatgctagttaatattatagtgatgagaatatagtaggaaataagattagtcaaagttcctgtctccatggagcttataccgaaataatgcaaagtaggactataattaagtagtggatatattatttttgtcatcccaaatgtatttatctgtttccttattttatggtttctataccccagtatttctatggggaacttgtcatccttatttgattggagtcttagtgggactgtacctaaaaatactccaatctcccttagctaattcatggatatagtaaaccatgctggaccaatcagattctctgttaggttgagtaacaag

SEQ ID NO: 98529 - DNA, 1025 bp, Homo sapiens
ttatatatccaacccattacccacaatgatatttgtaaagtagaatcaattttccttatttcaggtttccagacataaatatctatttttatttttcagaaaaaaagagaatagagtaatactattgttgactctaattttattataattatgtttagaatttttggaatttgctcaacatagccaaaaaaagaagtgaaatacaatgttatggttaattttttcaacttaacccaattggaaaattccagtcttcactataacatgtttagatattagctgctaatatctatcacaagagtgagttgatgaaattggacagatgggggttgttacctcagatgatgctctagacaagcaagtgtcacagacagaggataatgaaatgctataaatatgatacatgtgggaaatgggcacctttagaaaattttggttaggtgacatgttttaacatctaggggttccttatgggtaggatggccctttaggagaaggctctgtgttgacagtgtggatttagggttcaggaacttagcttgaacaaaagaacaaaacctagggaattcatatatgatgatagagggaaaaataaaagtaagacattacttttctgccgtttccgtggtacattttcatagtcagggtttcaggaaagtttggtaggagaactggatgttggagagacaactagacgtgccatgtttcagagtccagggtagctatttcaatattaaaactagagaaagaagaggaattggtgagtaggaaaaaataactggattaaggtcttagaaataagctgaaacaagaagaatgaaaacagaagagataaacaggaaggtaacaggaatcatgtatccagagtgtgttgctattagatgcaggtgtttaaacgtaatagagcaaaatggatctgagaaacttagaataggctagtctctaacatggagcaattatgtttatattgtactgtttcagaagccagaacttaggttcatttataagaagacatattttagttc

SEQ ID NO: 98530 - DNA, 1072 bp, Homo sapiens
catgccagctttcttctgacctccagttcttgcatttctttttgggaagagaaatccagtttactatgtttaacattcaactaccaaggaaccacattgctggctagaaaaaggccctaaaacttatttattatgtattttatcaccatcacaaggttaagacatataatagaaagcagcgaggcataaaaatcacagattttgtgctattgtcttacactttgtgaactctttaaaacaaggcaaaatgtagtaagtaatgggaatgaactattagaccttttaccctcattagaattcttgggagctttctctcctttgtcattccattggtcttctttgctactgctggcacttaataactcagtgcttctaaaaaggtgcctgacccaccagcttttacattttaaatttattttctgttttatatattaactttaagcaaataactataatgtgtcaattatgtgtaaagaagtatactatgaaatgtagatcatatagtgagtgttaacacctatcctcagtcattgctataacgggtaataatttttaatctgtggcttgaatttagttgtgtgcaaattattttagaaatagtatacattaagattataaggagatgaatttatttaacagttgatgcatggatgtggaatagttacaatatcgtaattcattggaactccttatgctgtagtctagaaaccttaaattttaatcattatacatgtcttttatttctaataaatgaataaaaataaagtaatatataaagatgccttttaagataacattaatactctattattgatagtaaaaggcaatgactttgaaaaagtcagaaagtatagttttttgaagcaaaaagattaaaaaagataacttctctcagataatgaataacaaatgcatgttattatgaaaaggtaacacatttgaaaaacataatttgcttttatatatatttggcagagctatatggctgtttttgaatgtacaagaaataatgccatctaaaaatttctatttttttttaaaaaaactttggagaaatcatgcaaatagttta

SEQ ID NO: 98531 - DNA, 1014 bp, Homo sapiens
tatataagttgaattatatttagagatgccttgttcagttatttaggttggtccatttctggttcagattcttctttgttagagaaatccagcagccatctaatattttgaaattagaaaataaattcttttcatcaacaaatttgtggtacaaagtaagtcaaggctctcaagattggccctaagaacggtctgttaattcttaggcattgtgttttaatgtttcataatacctaagagtatatgtacatgtatgcccacaatgacgacatttctcaagataggaagggagaaaaatatcccatgaaatatggcatttcttctgcttctaggttcagtccatttttttgatgcctgactttgtccattccagtccatccgtgacaaccctctggaggaaaatgttcgtgacttctttaaccctagtgtttaccctttgtgctctggctgctcagatttcctctctgcccagttccaggtataacagcacgaagaactctgagaagaatagaaccattcttgaggcattcagcctgtatgtgtttaatgctggcttcaagatcctcctatttagcaattcttccctttcaaatctaattatttgaaagcatatgctttgtcctattctgaccacttcaaataaaatgctttaggaagaaaatcttttctgatatccattttatctatttcaaatcatgcagcaacctattagtacttctgagttaacagctacttccaactgaactagaaaatcatttacttcttcctattttaataaattctctgtatctttttataaaactctagttagtacagtcagattagtcatgagcttactgattactcctcaactgagaatttaacacccatttcagatatcaagggatctatatagaagcattatattctctctaacggcatattcaagaaggtatttgcttgcaatatgttataatatttcagaaaattctaatactgatattacttctaggtggtgagcctcaagagatcaga

SEQ ID NO: 98532 - DNA, 1032 bp, Homo sapiens
cagtaataaccacagttgggggatttataaaggaagggaaaggaaaggaaagttggagggctaccacagcttaatttcaagacttattggaaagctacagtcatgaagacagcatgatatcggtgtaatatcacctatattacacctatattgcaactgatttttgacagagttgcaagggcaattcaatggagaaaggacagtcttttcaacaaaggatgctggaataattggatatacatatgtcataaaatgaatgctgattcatatctcataccatgtataaaaattaactattaatggttcacagacctaactacaaaacctaaaactaaaatttctaaaaggaaacataattttttactcttgaattaggtagaaatttcttagatataacaccaagaacatgatcaaagaagaaaataagtaagatttcatcaaaattaaaaacatttttctgaaagatattgttaagaagaaagtcaaaaactggaagaaaaatatttgaaaatcatatttctgataaagggacttgcctccagaataaataaagtactttcaaactcagtgtaagaaaacaaataatccaattaaaaaaaaactggcaaaaactttgaagacactttgccagggaagtaatatacatgacaaattaacacatgaaaagatggtcaacatcacgagttattagagaaatacaaattaaaaccacagtgagatatcactacacatatattagaatggctaaacttaaaatactgaccatacaaagcattagtaaggatatgaagaaactgaaactctcatacatttgctggtgggaatgtaaaatgtacaccactttggaaatgtttgtcaattttttaaaagatatactaccatatgatctatgcattccacccaatagaaatgaaagcatttgttcaatagaaaatttgcacacaaatgttcatagaaactttatatgcaataaccctaaactggaaataacataaatttccattaagaggtagacagaattgaaagcctgga

SEQ ID NO: 98533 - DNA, 1067 bp, Homo sapiens
gttgagttgtttgttctagaaatccttagaagagctgtatgaagctgatcatcaaaccaaatggaatgtctgtgaagaagcaagaggaagaaccaaaggtaaaaaggaagtaacctaagggtatttgtgttgggtttcattgggcctttggtaagcctgtggtagaagagggaggagtcactgtgttgtcatttcacctcaccagacggaatcaactgtctccaccgggatcagaatcaactgtctccaccgggagggagtacttagtgaaatcccttgatcaggaagtaggagaatttggctaagagggaatggcaacagagttcattttgtatcaatgccctgggcccacatattggttctggttttgtggacataaaagcttaaaagactttgattaacatctatctgttctccttgaccctgtcacaattctgattactctaaataaaacacagcctttttcaatgtgagaaattcgatgcaaccacaatatgtgagttttaaccatacccctcttttttacaagtactttgcaaatgagcacgattgttcctgactttatctaattcactctcaaaacactcatggaaaatgtagggtgtctgatactttatcttcattttattggcaaggaaacagattcaggttggttgtgattttgttcataagcaccccaatcagtgaaaaagctaaaactagactctaattccacatattcttagttcagtgttttaatttctaaaccagtttattcaccattttattgataaacccaattaataagagaatcagcaggcatactttaaaagtaatgttttgcttttctaatttttaaacagaattatcccaaatgaactcactggcacagtcattaagactgagaaatacagtattaagtagcaaggcaaaaatcatttgaaattaaaatattgttgcagaaatttttttaatgaataaattatcctagcttggttcttctaaagacccctttgtgacctaatttaaataaatgtgggcttttgattacttacaaaatttccttcagagttgatcgaattctttgc

SEQ ID NO: 98534 - DNA, 1031 bp, Homo sapiens
tactggaataaatttagggaatctcaggaacaagcatataatttgtccaagatttatttcttctcagaagtgtaagtgcagtttttaattctgtatattatttaatattttaccaataaaataaacttctgacataaaaagtttgctataaaaactttctggtgaaaattctgtacacaaacatgtcttccaaatacagaagactaaattgttgactataccaggcttaaattatcattgccattgtgtatttgtcacacttccagttccagaggtttggatacatgtgatatctgcaatctacatctcaatcgttagtcatctccatcattactatatagtccaccagagcagaaaacaaagtattacatgatttgttaagaatgacatctctgctctttagacagctttcatacatatcttatttcacttttaaaaaagaggagtgtacatcagagcctatcccctttctatataagaaaatagaccttaggaaagaaaattgtgacttactccaaagagcatagtagtgcacttaaattacacaagaggtctgagtgctctgatctggtcaataacactactagaatacactactgctatagaaaccagtatttcttagaagtcaaagataaaattaagaagtcatagcgattgttcaatcacactggcaaaaactggttgccagttctgcttcatgttgtacaatcactacgtgagtcatacacatctctttgtttcttagattttacaaatgtaatttatcttttgccatgagaagtttgttctgttataaacatcttcataaccagaaatgcaaaagggcatatatgactgcaaattcattttattgagtgttagctagccactatccttcaggccagtttgaactccaccatcacatttgagatagctgttagagtttttcctcactgatatgtatttatagaatttcatggatacttaccacattccccagtaatttcacttccatgtgtcacacagaatgaaaaataccataaattcaaatg

SEQ ID NO: 98535 - DNA, 1248 bp, Homo sapiens
aaataaattattataatcaacattgaattatctgttggcagattgaacttttagagaatcaaatgctaacgaaaaatttaaacaagtatattttgagagaagcaaagatatgtcccctaaacaactggggcctcagtcttaccccctattccccagattgcttagccctccgtaggcacaggccctttacaggtggtgctgaagctggaaccaagtgggggaaagtgggaaaggggtaggggcactgggtaggtagagcagagggtaaaaccaaagaggagaagggattgagggtagcttctgataccatttatagaaacaaatattcttaaatactggatatcattttaaccacataagtttacattcatgccatttcataccatactttttctgggtttgttataacaataatttgagattatccttaatctcctctatctgttgttaacatgcctaatgggaaattggccatacgaggtaggagttgataaatactgtaagagaaaaacatggttctgtaaaatgctgctagagttcatcattaacatacgtctcatataaatagcttggcatatgtctctttttaaacagaaccatgatgaaacttatatctattcccttctcttgctgtatgttatttatttgttttccttttttgtggtagatatgagagttgctgtcattttggttgccattagctccatgaaatgatttaactattacttgtttttaaaaaatatctgacatagttatatttcctagtctttcttttctaaaacatgtttttccctgtgttgttcttctagtatggaattttttaaaggaaaagaggcattttcactttactcagaaaacatttatcaagagcttactatgtgccaagttatatagaacattctggggtataaaaataaatggacccagtcttttaatacacttactttatagtctggtaggaaatacatactttaaaaaaataaaataaaatgaaacaaaagctctaataaggatgcatacacagttctctgggaacatagatgtagaattaacctaactctggaaaagtcaagagaggcttcttacatgcaggagtgttcaatccaaacatgagggatgagtaaaaattgcatatatcaggcaggatacagagaatgtatattcaaggagaaaaagaggcttggagatataaaagataattaacagcttccctgatgttgagtgtaactgcagtttaaggagtggtag

SEQ ID NO: 98536 - DNA, 1046 bp, Homo sapiens
gatagccttgaagtgtctaagaaagaaaaaaataataactttttttatgtgaaatgtaaatgacattttaagaaggggaaggagaagagggaaaggggagacaaataaataattgaaatgttttatgaacaaagatcagctaaagattacagtcaagttgtggccgggcacggtggctcacacctgtaatcctaacactttgggaggccgaggtgggcggatcatgaggtcaggagatcgagaccattctggttaacatggtgaaaccgtgtttctactaaaaatacaaaaaattatctgggcgtgatagcacacgcctgtagtcccagctactcgggaggctgaggcaggaggattgcttgatcccgggaggcggacaccagcctgggtgacagagcgaaactccatcctcccaccccccccaaaaaaagattacagtcaagttattagcccactgagaaagtgaactgcacttttaaaaacatgtcccagagatacattacataaagttataggaaaataaaaggtattagtctatacttgaaactcttgctattcagtaatcttgagatttactatacaaatcatctactttgcttcatgtgaacttttaacatagtatttaagtgacttttttttttttctgagacagggtctcactctgtggcccaggctggagtgcagtggcgtgatctcggctcactgcaacctccgcctcctgggtttaagtggttcccccgcctcagcctcccaagtagctggaattacaggcgtgcaccaccacgcccaactaatttttgtatttttagtagagacggggtttcaccgtgttggccaggctggtcttgaactcctgacctcaggtgattcgcctgcctcagcctcccaaagtgctgggattacaggcgtgagccactgcgcccacccttaagtgactatttaatgatgaatcaatgcttctgctacaaaaatgatttttattagttttgtctcagatttttcagttttataggtgattatagttctttcattcttataaatttgat

SEQ ID NO: 98537 - DNA, 1023 bp, Homo sapiens
catcagtcgaaacagaaaaaaaaaaaaacaaaggaaaggaatctgaaaactaatcttttttttgaccaattagtgacagaaatttccgagttactcctttcttatatttcatcgttagctgatttgattgggaagagaaaagagattttaattttacccctgtcatgctgggcgagaattcactgtttcaaaacagaactgacaagtgaatttcattaagactgataatatggcaacatagtgaaagcttgcaactattatcagcatgaagaaattttaaccaagctattatttttgaccaatgttctattacttgtcatagcgatcttgtatctaatgatggtgaatataatgggttgaagaggtttcattttaggttttcattcaaaaattgtgtgtgtgtatgtgtgtgtttcattttaatatttttaggttttgcttgcattgtagggctaagttcatagtgaaaaaagacaattatataattttgtttatatttgtcgtggaaacaggctaggaagtattagtgagaactacctgttgatactgacatgtatcttcaacagtaaatattctgctttctgataaagggatatatggtagggctacaagtccttagttcaggaatttaagtgaattgctgtgagcctttcttcttcccaattctgtgcctttatacttctccttccacacagacagacacttgtagtgggattgtgatctcttcttgtctccacctaatataaacagaatatgaagttaggactatggcttgattgttactgtatctttagtgcttagcagtgtgtccggtacaaaagtcttaccccataaatatttgttgagtgaaggaatgaacactcacattttatcaccttgaaaccgggcgtaaaagcccagttcttaaactcactcgttacattcaattccttttctctgcagattctttgcatttttctgtttattttgttgcatttcacttgtttgcctattacttagtaaatgagcttgtgtttttaaatg

SEQ ID NO: 98538 - DNA, 1049 bp, Homo sapiens
cactgcactccagcctgggcgagagagcaagactctgtctcaaaaaaaaaaaaaaaaaaaaaaaaagtacatagaatagtatcagaactggaagcccaaaggtcaattaaaaaaatttaaaaaacaaattgcaaagatgttaagattgtttcccatttttatagttcatacttacttactattttcattcattttgttgattgacagcattcactatagataagaggtagttcatggcagtggtttaatataaattattagagaaaatttaaatacagaaagttcaagaaattcatatttctgtgatggaaaaaagactagtattattttacttgagctatggaatactacaatttaatatctataacacttgtgcttttcatggatacattttaagaaccactgatttaaacaagtgacacattaatacacttatttgttcactattatcatattcatttggtgttagaattctgtaaatgtagaattaagtcactagaaaatccttaaaataagccttctctataccagattcagtgaatttcatgtatataagatggataattattaagcagcttgcataaagatattccacagtccttttggtaaacttgtacctgtgtgtaacaatcttttattctgaggaaaccaaaattttccttgaaatgatttatatattagttgtatgtcttcagactcactaagttcatatacttttatttcttttatttatttattttttttggagacggagtctggctttgtcgcccaggctggagtgcagtggcgcgatctccgctcacgcaagctccgcctcctgggttcacgcccttctcctgcctcagcctccggagtagctggactttcatttcttaatagtgaattgtagaatttggatgtagaatttggaagttggacatctctcaagcttcttttaaattaaaatatcataatttatcctaaacaattgaagataaatattccatggtattaagtatagggaaatgacatatctcatttattctcttttctatattaaacatttaatt

SEQ ID NO: 98539 - DNA, 1014 bp, Homo sapiens
catggcagcccaagtagggttcaaccgtgtaggtaggatctgtattattaattttcattatgccaaaactgacaaaacattacgttgaaatcataaagcactagaaaagcaaatacctagaaagtattatctgttctgtaagaaaaacaacaagctaaacattttaatatattattgagtttgttggatttataatattgggacttctctttatacaagtacctggcctttaaaaagaaatactacctagagtagccacaggtactgttaatgttgccaagtattcctaagtatattgtagttagattagtgtgaggaacttccttaaaaaatttaagtgtaaacctgtaaggttactcttattggttgtttttcatagtttatttagtgactattgcacggtaatgctttgtattagatcaacattaagttagaattcagtggctgtattaaatagccttttaagacagtatgttaaatacgtggctttcaccaaggggcccctatggtattttggcaattttactattttttaaaattcatacctagtttgaattgagattcatgtaagtgaaacaccattaataaggatttttagttttaaattttagtttgttttattataaaatagtcaatatctatcattcttaaaatcaagtattctttatagtagtcctacttaatatgcagtctgtaggctggaaagcatttgttaccagtctgccttgaaattaaatatagaagttgagtaaatgcttaaaactgtcaccaaagtttgatagagtaataaaaatagggggcttgtattttgtttttgtcaaatttgacttgattatacaaatgtgatgaattagaaatttaaaaaaccaattggtccttcccacagaaggatatttcatttgagaaatatcactttagatgacattagaagagttatccatgtgcttagtgtcagttagcttaaatgccatacattaaaatataaacatatcaaaaacccacttatattagtaa

SEQ ID NO: 98540 - DNA, 1085 bp, Homo sapiens
ccttttcacttgaaacactgctaaaaatggtggttaaattccattgaaagaaacaacaataaaaaggcttagttaatgtggcaattgtagtagggttaatagtattatacaaactaacactatgaggaaatacattttaaatcacaaatcagaacttgggaaatacactttcccctgttcattgtcaagagtgggaaacggaagtattgtaattagccttctggtgcaagtggcaataaatgcagttgcagtgactgcagtgatggatgtagggactcaggatcagaatttgaagagggtagacctagagtaattgttagagcccctgcccttagcagagcatgtcttgactgttgtgcagttagcagctccttgtgcctagcattttttctggagtaggtgttcaataactactgattaaattctggggcctaggttcaaatcttggctctacttaccagctatgtgatcttggatatgttacttaacctctccatgcctcattcctctcagccctaaagggttgaagaacatctctctcataaggctgttgggagaattaaatgatattaagcttttaaatctcttagcaaagtatggagcatataataagtgttccaataaatgtgagatatgattattcagtaactgtgggttgaatggcagtatctcgtaaggcttgtgttggagaggcagtgttgaatgacagttgctcctttcagtgctggtctgtttattggggtcaggagtttttgtgaaattaatttctttcgctgttcagcacagaatactcagatgcctaatattttaatatttgtttcttctcttccttatgtacctcaaattctgggctttttacctacggaattttaccctaagtgctgttgagtacaaattacgaggtacaacagttagatgaattttttataatatgggttactttttccaaattgtgattattggatgtgaaaattgtgatttttataaattatattttaatgatatatgttttttaataaacatttttgatagaatgaatgcaggttaattaaggagaaggggaacatgcacaagtaaaaggaagt

SEQ ID NO: 98541 - DNA, 1032 bp, Homo sapiens
acactccattgtttttcaacctaatagctgtgtgaccttaggaatgttccttagatttcctaaatttagttccttcagctgtaaaatggtataataataataatacttgccttaagttttgaagaaataaatgtaacaattgcatagagcacttagctcattttttggcacgtttgctgttgtgatttatagactgcaaatatttgcatatagctttttaatatttattagataaggcttctagggtttgaaaattaatgaataccaaccccattctaaagttaccacttgcattctaggaaatacatttgttttgccttgttttaagatttagaataccttttttattaaacagacaaacaaaacaagtttgcatcctcacatttcaccatttcacaaatctattgtggtatttcacaaatctattttattttataatggtaactttatttagctttttctatttgcttttatattatacttaatagtattttaattattatggttgatcatcatggtaatttaatagcctcttaggaagggaaatgctttataaaaacaatcaaatctaatttctttagttcctaggatattttggaaatacatgtattcttaagttagttaattgggtggaaaaattgcagttataattctttagaaaagaatgttgacatatctaaccaaaaattctgatgatagataggacttaaagagaaaatgtaaacaagtgtgttattgatttcaaattacttttatttgggttggattagctgtctttatgctaggactatttgtgtgtaatatagatcaaataaggtgttcagaatgggatgaactatctggaaggaagtggtgttatctatactactacagctggaaaatatgacaattacaaacttaattgatcaataccgtatcacatcattattcaatgattaaggactgctaggtgaaactgacataatggggttttctttttggaaaatagtatcttagttgtattggtattccactggatatttagtaaaagtg

SEQ ID NO: 98542 - DNA, 1064 bp, Homo sapiens
acatctcagacagaacaatataaaaataatccatattgtatttcggcccatcagatgaaacttactttgtgattccttctgtttcttggttagctcatttccaattcttgcatagttgttcagtattggtttcagactgttctatactggcaggtgactattttgaaaattgtttaaagttcaaaatttttaaattaattttatttttcttatctatttttttataatgtttatgtataaatttactttgcaggtagttacttaaatgggtatgaaaatacatcatgatgcaaaatttgtttctattactttaaagctgttaagtggatcaactgtacagtcaatgctatttatcagtctgatggccaggtggcatgtatggaatcggaagaagtagtaagtctagttttacaaggctctgaccaataatcaggtcagggaatctagtttattcttttcagagtacttcacattaatttttttcttagctagtttccatttttagaacctagcgaagcagaagtatattatgatttctatttttcatatgtggaaattgaggcttgaagaaatcaatttacctcttagagaacttagcagaaagatgaagttatcaggattgggacataaaattgtgatattaccttgtgggttagttagataactgctatctctacaatgtcaccttctcagggtgtctgccgtgtccaatactggcccatatttttgtgacaaatatctcagaaatagaagagttattatgagggtggagtgatatcagattatcttttcaggcgggtgttctaatgcactttttgaaatagagcctatattatgggacttaccagctttctgagttttcttctgtagcttagtttggcagtcacccttgcttggatttctgtaggacacaccctaatataacaccagatgggcttgatagaaaatcttctgttttaagtcgccatacttaggtttgtgtatatacccaatgtactttacatttagttcttgtttattagggaattaaataaaaatagttctgatttaatttctttacaggt

SEQ ID NO: 98543 - DNA, 1043 bp, Homo sapiens
ggctggtccgtggggcggggtgagagatgccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacgtatccttcccgtggaggcgcggcccgctgcgctggcgggtaatgggtgttgggacgaaggcgagggcctcccactggcggcgccttttgagccttggggccactccggaggagcctctgttggacttcaaggtgctgtttttgccaccacagtcttcctgagagccactcactgaatttctcgcccttagtagcccagggtgtcctgtacctgttagaagagttgggagaccttccaaggcctcatacttagtaaccactcagtacattttggatggagggttgctttttatgttaagacagcacaacaaattgcttcaaccctcctttcaaataatgggtttcctaaataagccctcaatctttcagaaagccgtcccaataaattcaacggaggaacgttaggagactagggaaagacctctgccattggactttaaggagctgaagctcagaatacccaacccacgatcctgttcgatggtccagttaatgcttaaatgcttagttttgatagcattatcttcctgagtagttccaagtttgactacttaataataaatactaatagtatagttgcttttttttcttgagcaaataaataatgatctggtgagctacacagctcagagatattaggaataaagcagatggtgattagcgatttttatcggaagtaccagaaaaattgaataacaatgtgtggataattaggtccactatttcttgtgtaaggctttagaacttctttcctctagttatatagattaattc

SEQ ID NO: 98544 - DNA, 2057 bp, Homo sapiens
agacttcatcactatgcaatatatccatgtaaaacaactgcacttttaccccttaatctataaaaataaaaaattttaaaaaagaaaatataaactatccataatttcaccacccagggccaaccacttaccattttgttgaatagcagccttgactttcctcaatgcatttatattaatgcatatttatgagtaacttttaaatataaactgcactaataccatattttgtaagttcctttttcattcaagagtacattattaatatattttatgaaaataaattttcttctaacttaaaagaaaattactgaaaggaaacctttgttttgtaatttcctggcataaatttattcatagaagagaagccagatctctccacacctttctttctttctgcaattaatggaagacatgcaattcctggtgaacaattttagataaacagccagtgttattctgacaaggaatgtgtgaatgcattaacttggggtgaatctgcttatctgaggcaatgttatatggaaaaatcaatgctcagatgtgaagcagagttcgtgttttatttattaattcatttttattaaatatagttaaagagggcctttctcacttaaagaatcatattaaaaccaaaattagattaatggaactaccatataggaacataatattgttaagatttttgataagtttaaagaaacatgccttttcattgagaagtagagaaaatatttaagctcttgtaaaagatggcagtaaataatttgtatgatatcatttattcaagtattatctgtacttgtagaaatgtttttgcaaggtatataaattttgtattgtctatggatgtaatgtaccatttagaattttatattttacattagaagtgtatgatgattcagaagaatatattactagaaccagtgttctctctattcttcattccatttctcaaaagtgttttgtactgtttgccctgttgctcactatgattttgtatattcatctaatggattcactgggaatttggtatagcatatttctcacagtgctgcctggcacactgtttcagttcctgatctcctttgaattattgcttgagtttgctaattttcttttaaatagatcaaagcagcctctttatgccataagtttagctccagtgacattgaatagtcattgtcaagtactggttgtttgttgaatattatgtttaatagcaataatacgaaataacatattactcatgcagattattaacttaatgttaaaagaagccaggattaaaatgtatcactcaaataaaacatcttgtcttactaacatatcagattatagttttaattttaacagtttatggctatttctcaaatctatctcattcaatagaacttaaaatctaaaaaattagacaaggaaaatttgtgtttgctttactctacttgacatggaagatttgaaaggaagctgcttgatccttagtagatgcttaatctttattttgttgagtggatattaagcatggtgtgctttcacagcacattttagtaaagtgcttccttatagcctggttctactgatacattcttagaaaatgtagaatgaagttttgtttcgttttgtcagtagttttttattgatacatcataattgtacatacatttatatatgataattgtacatgtgatattttgatacatatgtatcaaatacatttgtacatatgataattgtacatgtgttattttgattacatacatacaatgtgtagtaatcaaatcagagtatttagggtatccatcacctcaaacatttatgattttttgtgtgtgttgggaacatttcaaatctaactattttgaaatagatgataaattattgttaactgtagtcacgctactgtgatattgaacactagaagttaacccttctatctaactgtttgtatccattaaccaatttctcttcatctcccctttccacccaacgttccccacatacttcccagcctctggtaattatcattctccctgctacctccatgagatcaacta

SEQ ID NO: 98545 - DNA, 1031 bp, Homo sapiens
agtattattatctttataataaatttggagtgggaggggacaaagtttctttaaaaggtcacgctaagttggtatccatggctaccatctctgcagaatgtggtgcatagcctacatatttaaattataacctgtagttacacctaaaatacaaaaattagaaaaggagccttaactgactgctgtgattctcatgagttggtgaaactttacctgtgtgactaaaaacaccttatgggttaaaaactaaccataaaaagaaaaaagagaaacaatctgctttttggtagagacctcagagattatcttgcttgtgagaagttattttgttaagatgaggaaactggtccagagaactcactagtgactcacccaagatcattctactcacaaatggcaggacctacaacaaatgcctgtgttttttctctatcccatactaccccctggggcacctgtgtctttaaggctattaaagcatttgctgttatgctttaatagagcctttgatctgatatctaccgaatgaacttactggactgttctaggacaaccataagggaagactgtctgtcccacacttggggcaaccccacctctacctcagcagacattactaatcactgtactttgtttctgagactgcaaaggatcttgagatctttctcaatttttgtttcagacaaccacatctaattagtcaagttggtttatcagctggaatacatttaccatttctaaactaagccatgcttaaaaactcaagtaatttttaagtgtatgtgtgtgttgctttcctctgcagcagactagaagtacgtaattttccagttaatgatattccagtcagtaactgtggctcagtacaagtgattttcaactgggaggctacgccctcctagtcgaggatagaaggggtaaaaacaaacgaaaaaacaccatcaaagggtaagagaaagagagtggaaagaaggaatgtggttcaaaaaaattctctaggcgatttttatgcctgcatttgccacagtttc

SEQ ID NO: 98546 - DNA, 1075 bp, Homo sapiens
gctctgaaacactctctacaaccagtaatgcatttgtcccacatttcattctgatagaaaatgaacaccatagcaccaaacaaaaatccgaggcgttagataatgtctggattaaataatttaagactctctaggattttggttgtcattttttatttataacagactttaagtcactttctgttgcctcataggtcacattttagacaggtttgtgtctgttccttgcatctgaattcctgattgtaaagacacctatgaggtctcttagtttttgtcattcattttcttggtttatcacccctcccttctttttgttgtttttccctgactgttaagcagtttcatctttgcttttgttaaatatttgacagcagttagtttgtgttaagctcttgaaacttgtgattgtactttctgtgtagatatacatgtaattattttttatttttcaatcatagattcaagcttccttcttttttaccacaaatcattaaagttatttgtgtttccatatacctgtgtcttgtataaaattggcttattctgtgctgttgaatgaggctcaacatgacttggtgaggaagtctattaactaacaaaagcttatcttttttaacataatgctttttaattaattttgaataaaaatatttctaaagtgtactagatactttattaccttagattattccgaatacagtataactttgatagtttggaatagtcattaagaaacaattacacactgattgctttgtgtctctaaaagtgagaggctggtagcttttccacattctcatggctattttctagttctacttgaatttataactgtttccctttttccttgacagctgccactttgtagctatttttctgtctctgctaatactttaccatatctatctcaattgttttttcttttgacttgctgaaaaatagaaaccagatgggaagtatattagcattatgattgaaataagggtaaatgagcaatgtgtgaaggttttcactgacttcacctaaaagatagtttagctacttgaattttagtaaatagaatttttccttt

SEQ ID NO: 98547 - DNA, 1879 bp, Homo sapiens
tgcacaaaattactgaagatattgtataaaattacttcaggctatgtgcataaggtgtacaagaaacaaacgaattttgtgtttaggcttgagcctcatccttaagatacctcatgtatatgcaaattttccaaaacccaaaaaatttatgaatctgaaatgcttctcctccaaatgtttcaggtaagggatattcaacttgtatttttattttcctcattcatatacagtgtttttgaatacagtattttgatctgcctttaacaaatgttttctcattatttcagttgccaaagctgtttgatggatgctacttctatttgtggggaaccttcaaacaccatccaaaggacaaccttattaagctcgtcactgcaggtgggggccagatcctcagtagaaagcccaagccagacagtgacgtgactcagaccatcaatacagtcgcataccatgcgagacccgattctgatcagcgcttctgcacacagtatatcatctatgaagatttgtgtaattatcacccagagagggttcggcagggcaaagtctggaaggctccttcgagctggtttatagactgtgtgatgtcctttgagttgcttcctcttgacagctgaatattataccagatgaacatttcaaattgaatttgcacggtttgtgagagcccagtcattgtactgtttttaatgttcacatttttacaaataggtagagtcattcatatttgtctttgaatcaaaaaaaaaaaaaaagtctaatgccagattaggaattcatgttatgtttaccatttagaagctgggattgcttttaaaggtttttctttttaaaattggcatgtttttgatttatcatgtctttctattcagattattgggtatcaaagattaatgaggacaccagaatcttggttaaatagacaagtggtatcattactgtttgagtcttttaatattctccatacctgccaccagtgaaaaaacttgccttttttttttttttttttttagtaaacagaatattatcaaacaatttattttggctttattgaaaaaagagtatttggtctaaatgtgccaccataggtgttaaattctcctatctgcaattgtctttatcctatattgtgttcatttcttttcttaataatttactttgttgtgtgtttctacactttcatccctgttttttatcttgtatatcatcaggaaattgtgatttaatcattaacattggtttttttgtgtgtgtggtaaaaatcaacactaggctcatggtacatatttttattctgtacatttgcttgtaactatcaatttgtaactctgtttatctactacatgtgtatatatacttagagcattttctctaacacattttaatgttagtattttttaaaaggtctgaccagtctagcaaattgtcagtccaacgtcattactttaaattaagaagcagtcttcttctggtaaaccttgttggtatttgtaaaataattttgaaggtcttaatttcttcctttgtaaaaggaaaaggttttttttaaagtttttaggttggcatggaggcagaagttggtgattacttgatttacaacagattttttccagatcatacaaaaggccatacagtaagtatagaagtaggtatggggagggcttactaatatcaaataggcaaggccttagtgagtgggcaggataccacctgagagtggccagatgtggggaggttactctgctctgggtgctctcattcatgaatcgacaaggatacattagattattttgaaacatttttttaagaagcagaattctttaataattccttcctagacattgaatatacttataaaattaaagacttggggaag

SEQ ID NO: 98548 - DNA, 2019 bp, Homo sapiens
acagagtagtgaagaactttagttgacaaacaagtgtgtccccagctgaggtcaaacaaggtgatactttacctcctcttttcagctctcacgctgtaaacaagtggccctttcacagtctgttgatgccatgttttttgcatttttgtgtttttgttgctgattttattatttaaaatggcctcataatacagtgctgaagtgctgttttgtgagtctaagctcaagaagatggtgatgtgcctttcagggaaaatattaaatactgtgtaggataagctttgttaaggccttaattgtagtactgctggccctaagtttaatcttaatgagtcaacagtatacaataaataatgtgtataaacagaaacatacataaaacaaagttaagtattgatcagttgatggaaatgctggagccacaggcccacagaaatgtaaccctgtatttcctttaacagcagtgtttcattattcactaatcggtgttcatagcatctttatagaacataactactgtagataatgagcattgactatactactcttgctggatttggggaaggatacaagtacttttggtagctgttatcacagtaattttgatcaggatcttttcttagaacaaacagttgtgtccttggtcatttaaagttagaaaagtaaaaagaaaacagaatagaataaattggtattttaagaattttctttttctcctttgaccagaaaatattggtgtgtgatttttagcattggattggttaggccttatgatttatgagtattttattctagattgtggaaaaattaaagttttcagagcactgcacaatgtacacgttcaatctatagtaaagtattttgctcattggatgaatattaggtaacatagcattcatagtttttataaaatgatactgctctcatggttctctattaatttataagaagagagttctgtctgatagtatttacaggtgtaaaataaacttatatacaatcaaataaattctactcaggttctactcaatttaaacccagagaagtaacaatggaacaacttattccatattttcttaatgatgttctactttttctttccatatttaatattgtgatttcgtatttgtttaacaagagctataaatggctaaaactctggctgtgtattatttcctgctttattagtatttttgaataccacttcactaatacatgtaaatcattaatacttccagcatatttttttaatatttaaaatatattggtcctccattattttcagaaacaactttgcattcaaacattttattcaaaaaacctattatctttgcttttaacattgaaatacatgcaaaatataaaagaatattttattatctttctggcaagcaaatctgctcccacatttgttattctttgaaaggttagccattttaagtaggaaaagagggaaaagctgaatctgaaaaacgaatcttctcatgtttgtctatgtataagctattaaccttttttctttcactgactttgtaacagaagtttacgtaatgtgaagttcttaggatttctggacaagagtagggagttttcttgttattagatataccatgattgagattatctcagtggcatccttaatatctttaaaacatggatgtaattttaaatgtgcttgaaaaattaaatttgatagtggattgcttgttgacagaggaaaataaagcaataaaatttcatttaaaattaagcactctgagatagagcatacaatattaatgaaagttcaggattagattattgaaataaagtgacaggaaacagcaggaattttcttcttagggaagagattatgacttctcttgtacatgataggtgtttaacacagtttgagcattcctaatctgaaaatccaaaatgctgtaaaatactaaactatttgagtgccagcacaacacacacgacctaacatgatggctcacagtctaaacgcagacacaactttatgcacaaaattat

SEQ ID NO: 98549 - DNA, 1392 bp, Homo sapiens
tctaataattaggagaatttttggacgttagactgtgttcggtttttaaccatacctatatagagacagacaattttgatattattcataatacaagagatagactattttgatattttgatattattatgcataatacaaggtcttagaattgatacccaagttttgtctaagaaaaatttatgatataataatatatttttgcaatagaatttaacctgcttctcaatgcattaagtaaaatagcaaattacacatcttgtaatgtgaagaaatatatttctacatataaatatgctgatagccagaatttttactaaaatgtcaaaaataaataattgctaaatgatatttatatggagccagaatttaatgactgtcgacagtatttaatgagatatctcaaatcttaaatggaaacatttagcctttattttatattttcagcctttatttcattgtcctttcacttttcgctatggaagtttcaaatttcaaactcatttctctgttcttttacttaagttttccaaaaattgcagtgatagtatgctactgttttttcatttttgtcattgttgtaggctgcctattgtgatgtccctttttactaaagtttagtgctgttatagtttactcgactaaaaagtctaaaatataatcatttgcaaaacacttgttttgcttttacaatctgggtgttgatttttaatagaatcaaaggaaattctttaatttttattttacttacatactgttatcttgagtgacacacatccctaatttaaacatctttagtttagatctaatgacatactgtagtagaacatttgttttcatatagaatagtgatgtttgattctgtattttaattttttttttttaggatattttgtattgactaaaagtggttaattctgattcccatagctatttcagttacaaatagccattaattccagaataataacaacccttttttcccctccctcactctgtcacacaggctggactgcagtggtgcaatcatagctctttgcagccatgaactcctgggttcaagtgatcctcctgcttcagcctcctgagtagctggaactacaggcactcaccaccatgcctggctaattttttttttctttttagttgaggcagagatctcactttgttgcccaggctgttcttgaactccttgtttcaagcggtcttcctgcttcaccctcccagagtgctagcattacaagtgcgagccaccaggtctggcctaaaaattctttaaaatgtggatctgtttactactctgggatttgaagagtgagaaaattctaagtatggctttccatgcagagttaataatcgtctcctcctttggacatttaacagatctccatt

SEQ ID NO: 98550 - DNA, 1063 bp, Homo sapiens
ttctcacaggccattagcaccaccctcatacaaggttgattttggcattaaagaggtgataagaatgaaagaatagaaggtatataaataagtcatcttacgaatctcatagagtatgaataagatgaaactgtatcctaaagatgcaaactaggccaagataaaatgttttctactgacctattcttttagtacactgctttcaaaatttttttgtatcttagcctttttttctaaaataaatttaattctacatcttcttttcttatctcattatgaaggggagaacagatggctgtcatcttttctttaataatctttccctcttccccactctcatctaagtttaaataaaattgcagctgtagaagttgtaaaattccccagtacctaagggaattactgaaggaatgtgccagacattttacactggatttatgtctgtgagatggggaagggctaaattgagtgttttttcatttttgttttagctgaggagagatggaccctagaagacaatcattacatcatcatttaataaataacctcataatcaggctaacacattaattcttttcaaacaaattctaacaagttggcttctttaaatggatactgagagtactatggaattttaaaattaaatgcaacttttattctatacagactttgctaattatttaaaaaaaaacattcgtataaattaagattgattaggcaactttatgctgacagaaggcttccaccaaagattgtctaagaataaaaaaaaataacatcctttgatctaatagtcccagttctgagaatttaccctacgcaagaaatacagatgaaagaaaaagtatttgcagtgttacttctaacagcaagaagtagagaatataacctacatatgaaagattaggaaaattctgaaatgcctgaagatactctctggaaaaaatgcatatttttaatatgataaatattaagactaaaagattatgaaaaatagaattgtttaaattttaaacacatcaaaattatatcttcactttcaacaatatataaatgtatgcat

SEQ ID NO: 98551 - DNA, 1234 bp, Homo sapiens
agcggtgttagatgttaacattggacactgaaggaaaagtacgtgggacatctctgtacattcctttgaaacttcctgtgactataattatttttaaataagatgttaagaaagaacagtgggtatatttattgaaactctttatgaagcaactgatggattaaaattagtttataaaaatggttttatggctttgtgctttgaaggttttatggtagaatgcctgatttatcaagatcttaattatgttattaatttaatctgtagttagaagttgatttggtttgtaaaacagtttcctttcatcaattggtattcatgtcattttcaaatacagctaccacttctttttttgtgatgcttgtctcaaccaatgcagtctgatccagctaagaggctgtgactagcaatgccactccatctgttctcatcaatccctattaattagtccctcctagttatgatgagtttgagaagtataagtaattggactaatttgtctcacttagttttgaactttctttttccttttaaatctgtgaaagtcttattgagcctcagtgtttaaaaaattcatttaaaatggtttcatgattagggatgcttttgtatcaaacctgtgccagaaacctttccagtggttataaggagaaatagattttcatcatagtaaggtcgcagtaataaagaagccatacgaaattttgaatgttaagacatttaccacttaacttttgagtctagttcttgtgaatatgctgaagtggcatttggttacatatacaggctacatgatttatttccataaaatatgccttctttgggaaatgtgggttttgtcactttaatatcttggccgtgtcgtttttatagaaccactgatggactcggactaacttaatagtgtgctatttggtgattctgacagtagtgaataacatcctctaatatcaatggttcttttaggataaaggatggatggaatcccttactgaagttcatatcgtcatattttctaatatagagtacaaagagaaacagattcaaagtttgagatacttcctttaaatagtcactgggtttacaaaaagaaggcaagaaccttcaaatagttctttcctaatatatatttctcatagtttctatactgttctcagtgtcaagcatctcagtttgattctttgtttgttttttaagagatgaggtgtcactcaagcaatcctccagcttcagc

SEQ ID NO: 98552 - DNA, 1976 bp, Homo sapiens
tttggagaactacctttgataatttacatatgttttaaccattgggagatggctgtatactttgcatcttgtaatacatctaaattttttttcagtaataaactacttatagacaacaacgtagttaggaaatgtaaagtttaaaggtttgcatatattttaggacaagacagtatttcagaagagcaaatttgtgacttttgctagtgacaaataaattgttgtgcagtgtaatgtcataatcccttagctgtaatttgaaaataaaaatttgtgtttgccaatatggctttaagatatatggtttatgatctgatttttcatattgatggccaggttagagaactagatactaaatagaagtagtcttacacttaagtgtaaaaattgttgcctttgaagattcagatataagcttacaaaatatagatgagttataagaagcaggccaaagaaatactttggcttgtatctttctttctcttactgctttttttgtattttagtaactcatgttgttgttcctggtgatgcagttcaaagtaccttgaagtgtatgcttgggattctcaatggatgctggattctaaaatttgaatgtaagtgttggatttgagagaattaagaaatgaattagactagttttgtttttcatggttattaatgcctgtgattaaggaacttgatgttaattttcttacctctggttagtcactgcattttggaaaagcttctggctgggcgtggtggctcaagcctgtaatcccagcactttgggaggcccaggtgggcggatcacaaggccaggagatcgagatcatcctggctaacacggtgaagccctgtctctactaaaaatacaaaaaaattagccgggcgtggtggcgggcgcctgtagtcccagctacttgggaggctaaggcaggagaatggcgtgaacctgggaggtggagcttgcagtgagccaagatggtgccactgcactccagcctgggcaacagaatgagactctgtctcaaaaaaaagaaaaaaagaaaaagcttctcatatttatggtgtcatttagatgtccttagtaaatgtatatacatatgttctggttttaaagtcttttttcctacaataccaactatttcaatgaaaagtaaatggagtacatagtatacttttaagcctaagcgattcatgttactgttaaatgatatattgaatttaataacacatgttttaaatatactgcatgacatgtctgtgaaatgaaagcaatttattgcttttcctttatgattacctgcataacacccttttggtcttagttaatttaatccagtatttttaggaagctgttgggaaattgactgccttttactactttagttggagtcactataccagctatctcaacctccactgaaaatgtatacctgttcccctcttcttgctgatagtcaacccaccatcaccttcagagctgcctgtcaccttccctgctgtcactcatttacatttctacttggattctcttgggacttaaaatgaaaagaaagctcatacacgattattttctactccttaatagttaacatatctacttttgatactatggctaacatagaacagtggattgacctttttttgtttattaattgtttacaaaagattagtagttacaaaagattagtggttacagaggaggaatgtggggagcaatacagttgcgtatcttgatgttagtggtggccatgtaacacaagactacctgagataaaattatgcaaacaagtgcatttataaccagtgaaatcaggccaggcacggtagctcatgcctgtaatcttagcactttgggcgaccgaggcaggcagaccagccaggccaacatggcaaacccccttctgtactaaaaatagaaaaatgagccaggcgtggtggcacatgcctgtaatcccagccacttgggaggctgaggcaggaga

SEQ ID NO: 98553 - DNA, 1251 bp, Homo sapiens
acaagactgtctcaaaaaaaaaaaaaaaaaaaaaaaaaatatatatatatatatatatatatatatatatatacacacacacacacacacacacacacacacacacacacagaatttcacagagaaaggtgtcctaagtctttcagggtaaacattttagcagagtgtctaatagaatgctgttggctgccagtaacagaaaaccttttctcaaatgcttgaagacaatttattactttatatagaattaatcccaatgcaggatagctctgcatttgcttaatttagcacttagtggttgcatcaaggaaccaaattctttgtatctctttaccttgccatcctcagtttgggggatttgtcctcactaagaagtttcctttaatggttgtcgaatgattgccacaattctagatatgacagtggccaactgaaaaagagacactaaagtctttccctgaagcctttccgtggacttcccctgtgtcttattgtcagaaattgattttgacagcccctcctggggctggaggttagggtcagtctttgaaaggggggctacctgaacaaaactgggcttctgttagtgtggaggaagtgagcaatagattttgagtgtaacagccaacattccccactgcagtcaggtgtacaaagtgagaatggcagcccaaatctaaggaacagctgctcagagacaaggaggcataaaggaccttaggaatttgagaaactatagcatttactgtgagaggagtatgacgtgtgtttaagagggattcagggtaaagggttaggttgggaccagattgtgaaaagccttaaattccctgatacgagtttagacttaatagggtaccttcagtgtgtttataactgaaataggactgtctgcaggctagctgggagtaggaagagactgaaggctgattgggaggctgcagtagtggagaccaggtttgaaatgctgaggactggaattatagatggtagttatgtggggatggagagaagaagaagagttttagagagagttggtagactcaccagatcccagtactgctcagatgggggaaagtaacagaaagggaggagctgaggtcaaggatcattcacaagagtagtagtagatgccattgtttaagataaggaggtagcctaaggtagctacagtttgatactctcatagatgctttcatgagctagttgctttcatatcttgaaaaccctatgtcttctgctttagacttc

SEQ ID NO: 98554 - DNA, 2167 bp, Homo sapiens
cagatttctattttttgattgtcatatgtatagcatatgtgggtgaggagattgtgtagttggtatatgagcataataatttagagaatgaattaggaagtatcaagaatagtggatgagtttcttttaaaataccctgagattgtctgctgtaaatgtatactgtgacatgtgtcactttgttttaaattataaagctgaaatgcaatccgctgtattatatcttggctggagaaagactgttgccagaggaaggttgttggacttggacataaagaagagtcagaatacaaacttgtcagtgtttacccaggactgtccaaagaagaaagcaattggacctgatagtcacgaattgcagtcattagagaaacatttgctgtggttcatttcttattctaatacattagctttcttttcccactctgccatcaaaacagttttcaccaaggtcattagtgaccttgtctgtgaactcagtagatgcttatatccctcatctacatgatctctctctgcagcatcaaacggaattggcatttttctacctttcacttcccctaatgtttctctctgtttccttccagatctttttctatacatttgatacaatttacagaattagtattataccatgtttataacttcatgtcccatttactgcattggattttcacatggacttctgtggccattatatgaatatagcataatctttaaaaaaaacatagaagactataaaagaattgctcattttgaaaacttcttgccatggtatagtgtatttaaatcatattctgaaaccatatgtaaggaaacagaatagtagacagaagtcctttagttttaacaagttacttataattgaaagactttaggctgggcaatatttaatttcagtgaaattgaacaaggagaatatgaccttagttaagccattggaacttgttcttctctcttttttttcttatcttgaacaggatcaaactgggatctctaaaatctcttccagcgtaacattctgtgacttgtgaattagtacatgctgagaagtttgtatctctctgagccataatactttgttctgcgatggttgtgattattataggttattgtatgcacacatgtttaaattaatttttaaagtaccctgttaactatattattaaactgtttgttatgtggcataattttccttctagtagaacaaaatccctgtcctgtgaatttatctaattttttattggtttataaagactatatggcctataatagctatagtaaatgatttttattggcatttgaaagtctgtcacttatagtgattggtgattatgaagccatattttaatatgaataagaatgcagaatacagttgtgaaaaattcataatactatattcagtaaaaacaatccctataatctgatgtcaaactgaaattttacatcatttctcctttgagttcagcagcttttgattctagattcttctgcctaatatgagttctgagtaatttattttagttaaaattgtatattattaaggatgttgaaaaattgagtcgagtcacacatttgacttacttaaacacatctgcacttattttaccagtaatatatttggtctgcggcctgtcgattatacagatgatgaaagtatgaaatcgctattgctgctaccagagaagaatgaatcatcctcagctagccactgctcagtagtaagtatggatttagctttgggacatttatatattttattaaaattggttatgaaaggaacataatagaaaaatttccatttgaccaattgcttacattcaccaaacaattattgagcacttcctgagtattagctactgtggattcaaagacataatcacagtacgaccatctagaaatacttattgagcccactctgtattttaggcagcattcataaaacaatgaatatgactggtagaactcttattctcagggaggagcttaccatctggtgagaggtaggaaagagacaaactgtaaatattgaactaatataaataaaataatttcagacacttagacatgagtgtttcgaagatgttgtagagtgtcgttgggtggaggtagtgggcttctgcaaggccattgctttagctagggtcacagagtggagccttaaagc

SEQ ID NO: 98555 - DNA, 1056 bp, Homo sapiens
aatctccactgttttccatagtggttgtactagtttacatttccaccaacagtgtagaagtgttccctgtttaccacatctatgccaacatctgttatttttttattttttaattatgcccattcttgcaggagtaaggtggtatcaatatggttttgatttgcattttcctggtcattagtgctacacccttttaaacaaccagatctggtgaggactcaatcactatcacaagaacagcaaggaggaaatccgcccccatgatccagtcacttcccaccaggccccacctccagcattgggaattataatttgacatgagatttgggcggggacacaaatagaaaccttatcagtataggtaaagtatattatctacatataatcattttcaattcactgaattcgcgactgtccgttgataaggcattaaaagaactgactgtcgaaagtggtacatgtaaaagatattaatatactgtcgtgtactagatgtaaattcagcagttaagatctcgacattttcatatattccaaaatagttttaaatattttggtgttgcattgacccatgtcatttagctagtagacacatgtgcctttccattttcacagcaacatacgctttgtgtctgtaatgttcattgctttatatctgattttttcattggtttttcatactgtgtttggtttctacacatgagcacacagtgcctagaaggtttgatagaaagctttcttccatcagttgcatccatttcagtaatcatgttgcttattccctacacggccccttaacagttaaccaccatattccagtttctagtcctgggatcaaggccatttaaatcttatcttctatttcacctcattacttgtttgggtttatactttatcagtttgatacctgtttgttgaatgaacgtttatcctcagtaggattataggcaaggacagtgtttttctaagtcttatgtgtccctccaaaacacctagtttggtaaaactttaggttaaatcatgctagaaaagagagaatttactatatttaagtgt

SEQ ID NO: 98556 - DNA, 2032 bp, Homo sapiens
ggtatgaatttaaagtcaatgatactctttatttgccatcttcactatttaattttaaattaaatgagcttttatagttcaccagtgaagtctcccaatcctattttttcccatagaggctgtgttctttattaattttcctactgcaatgtttttgggccctaaatctttataattatggaggattcgaatgtacagtggaaagtcatatatctacttcatactttctcttttgttttgatttaactctaatattctggcaacttactgtttttatatgtcttgcatttaaataacagtattaagtcatttaacccttaatttttttttgcataaaaaaagtaccttttgtgagctaaaacaataagaaagtcagttctgttttaaccctagatcatgaaaaaaagatttataatctttgttgtctgggagtatttataactgttcaaaacatcattggtaatctgtcttccccactgccctctgtacatcccagtgtgaagctagaaccacagctcttacggtcacatgagaaccattttgagtgtgtggcgaataacatgtgcttctttttttttatttttaatggatatgtaggattttagaatgtggtacttgatctgccattaacagttttccttggaaggatgttgaattctgaagtagaaaatattacatggaccattggacctattaattgtcccactgccctaggttaattttaaaaaattaattgccagagataatttatgttttatagctttaaaaacccatgttgctagtttgaattactctgctttatcctgctccatagcaagcaaagtgacttgaaaaattaaatctatatgtttgcagttttgtagttattcatgaagggtttcattcatgaactctcttggtatcctgtcatgcgtgatagatttagtattagtaaaaatgcctttttgcatatgtttttgcagtttggatggtctgtacatgcaagtacaagtttaaatttgcccatctctcctttctctcttttattagtggtgtaatgaattcagatcaccattgtaggcaggtgtctgccatattattactgaggggaaaaggatattaaaaggttatactgcatcctgaatgtggcctttgggacaaaactgaaacattgaacaccacagtttagccctttcataagtacttccttttcctcatcttcaggatcagaaggattcctagttaggaaaaggattttcagagttatgtggttcatactctttagatagtgccacatgggaaaatgaaaatctactcttagaatgttgttaagaagacataattctatactttcccttagtaaacttccagattatcatgaaaaacatgcatcaattgtatcataaaattggggaaaatgaagatatgaggttaatgctccagacataacttattttgtgcccttatcttcattctgtatctgtcttccaaaaatgcaaatccaatacagtaatataatggcagttattgagctgttcatatatgctaggtactgttttaaatgcttttgatgtattcatttgattctggcaacaatcctgtaaaatagatagtgttattatttccatcttataaatgaggaaacaggcacgggatttaagtaattcgtgtaaagtcataagacttttgagtggcagggctgaaatgtaagttcaggcagtcttattcggtaaccccaactcttaactaccatgctacgttgatgccatccctcctgcttacaatgatttaggaagctgttcagggtttcttattgcctttgggaggaagtccaactctttaacacctcctctttgttcttatataatctgaccatagcttacagttcgagagtacctcatattcctgtggtacattccctctctttctctcactctccctttacccccttttttccttttttttggtggttctaaaaagttctaagtgctatctcacttaaagtccttcacacacttttctgtctgctaggatattcttattctgtttgtgt

SEQ ID NO: 98557 - DNA, 2187 bp, Homo sapiens
agcagcggcacattttgacatcacgggttgaggaaccaattccccatggatagcaatggggataactgtgctgacatatttgggggagatttactttcttaattcagaaacagttgtcaattttggaagctttcatttaatggaaaaatttacttagtgtttatattctgtagattgatttacactttaataagcagttattgtagaaataattattttgtatgcttcctaatagtttggaattattttaaatatttcattcccattttattttttctgtgtatttactattacaacaggtaaagcatataagaatttaaatattgggccggggcagttgaattatttcttaaattttttacatcattcacatgaggttctgggtgaactttttgcagtgtcaggacacagagatgcattagtgaatgccagcagctggattttaaaattggcattgtcaagagtgtcacaagcaaatgctgtatgtagattttgtatctttaatctgtaacttggttcatgtctccctatgtagtattttattcttttcagttaattaagtagttgaaatgaaaatgcaggtattgcgtctctgcccttgttgcttctataggtttgaaaagggcacaaaaaaattaagttttcaatggtaacagatgcaaataagaattataaaatgcagggcttctaggtcgtaattttttattggtaattatttaacataattgaaaaccaaattaataatgcaagaatgtaccataccttggtgctgttagtttcagtaaatgtgtctaatctcttttatctctcatcacaggttataagataattggggcaaattcaggggatgtgtatattcttccggtttttatttgtgtgtgtgtgtgtgtgtacacacgtgcgtgtttgtgtgtgtctccatatacatggacctatttctttgtaaggacctaaccgatatgaccctcccatatgtgttgcaagctatttggtaacgcaaattattgcttgggtcaggtgaaactgactagttttcattctagggttcttaaatcagccatgactactttaatggatggagcactggtcagggcgttagggaatctagcttttatttgtgactccattactgactgtatagcttcaggcaggttaatttctgtgccttggtgtcctcacctataaaacatgggtgatgcctgctgcatttctatttcttcagagcatagtgaggattaatgagccaaaacacagagcctgtcttgtggtttgtacaccatgattcgtcactgcactgtgagggcttattaatatacaaggagtggcatgagacagtgagtgagtctgccttcacaggtgccttcagtgttggtttaagtaggactacctagtgaagtggcaaatttaggtatatctgttcctcagcactgtccagtagacctttctgtggtggtggaaatgtttatatctatgctggacattcagtagccactagtcacctttactattgaacacttgaaaattagctattgctaccaaggaataaattttaaaatgtattttattttaaccatatgtgccagtgactactgtgttggacagctggttgatacagctgggcagttgggaagtagggtttatttcacccaagaggttgggattgatattggataaaggatagtagggcagatgaagggacagatttaatcctagggtacaagagtatggtggctgtttctaaaaatttcctttccagactattggtcttcatacttttttcctgtgttttttgcctcttaaaaacatgtcgtagtcattgttgttcatctgattggctttacaaatttcctgactgttctcctccttttcaggttacttttctttattcactctccatcctgcagccagagcacctgcagaagaacacgagtctggccaagtcatttatttgcttaaaatccttccgtggcttcctcttaatgtttttaaaataaaggttaaatcccaaaatatggtttataagaccctggatggtctggtgctactttcctctctgttctcatcggtcttcacagcttctcctttccccctttccttcaagcattttttgcaccagcttttctgaatttttgtttccttaaaatatgtagggtcttttacctcctagcctttgtacatgtctttgca

SEQ ID NO: 98558 - DNA, 1684 bp, Homo sapiens
tagatcagtcgctttgctggttggactctactggctggctaaccttttcaaagaaaggttaattttatttttttcttcaaagccactaaggcaagttgtagtaaagattggttagtgatttagagggtttagtgcctagtttggattcctttctcctaaaaatagacctacagatgttgagtgtgatatcacttattatgaattgaaattgatgtacttaaaaagtatagaatgccagagatttattagaatacagcattgtttatagttcattagacataaggaaagatttggatgtaaggcatctttgaacactccattgttgccgtttctgtcattcagcaagctctttttgtattcctactcgtgttatttctcttatcaataacagcagccatacagcaatttgtaggttcagcaaatagcttatcttaaaagcattccttcacggatacttactttgttgcatgatatgtgtatgtactggtacagattttatgtatcatcttgttattaaatatgtagacttttttcttaatgtgttacatttattgtagaacatttaaggagctaccgttggtttaaaactacattttcttctaaaaaacagaaaagtgcttgacccaaggctcaaatgagaatagcctttctttttttatgagttacacagatcttgattgaaagattattaatagtaactttcactctgtcagcaacttatagtgtttttgagtatttaggtaacaataaatttactgcctgacgtttacatttatttttctaaagtgtgatattataatatcatccattgctctttcttatcacttctttcacttctttttcaaaaaatttaattagcatgaagcttgcaatcatgggcacctgaaggtagtggaattattgctccagcataaggcattggtgaacaccaccgggtatcaaaatgactcaccacttcacgatgcagccaagaatgggcatgtggatatagtcaagctgttactttcctatggagcctccagaaatgctgtgtaagtagttcaacgtaaaaattatttttaaaatggacctatattcttgaatcaaggtgtgtgataaagcagactttaaaatagtcaagttgatggctttcttcactttcacaactaaaattagatgtgatcatcacattctgcactcataatcagccttcatgccctttttatgatacagttggtccttcatattcttgggttctacacttgaggattcagccaactgcagatcaaaaataattgggaaatatcaatgacagatcggataaaaaaaatgtgttacatatataccatggaatactatgcaactacaaaaaagaatgagatcatgtttttttgtgggcacatgatggagctggaggccattatccttagtaaactaacgcatgaacagaaaaccaaataccgcatgttctcacttataagtgagagctaaatgatgagaattcatgaacacaaagaagggaacaacagacaccagagtctacttgagtgtggaggatgggaggagggagaggagcagaaaaagtaactattaggtactaggctcaatacctgggtggtgaaataatctgtacaacacacccccgttacacaagtttacctatataacaaaccttcacaacttaaataaaaacctagaataaaag

SEQ ID NO: 98559 - DNA, 1107 bp, Homo sapiens
tgaccttaaaagtctactcatttatagtaggatttagttggatcatgacacacaagacacagaaagttcaaaactggaaggggtcttcaattttaatgctatttaataattgacggtgtcttaatatgaaagtcgaattaatattgtctgccttcagagtattttccttgccttgtgcctcattttaattcacttattccccggatcttgctcatctgatttaaaaagaggttgtgatttctaaagtaaagttattgtatttcttactattcctcatctgccttctccattgcatcagtgtgctactgttgctactgttataacattgttgcatagctctccagagtactggaatagagaaatagagaaattgaaaaccacttgttagaaaagacttgtaaggctacattacagaagctctatttcgtatagttgaattagttgataatgggtggtgattttagtcttgaactgggcggggagcagggggataaaaaatttaatgctaattctgtgggctgatttgaataggtttgtactgatctctttttttgccattttaaacagagcaactgttgcttcctagaaaatgttgaacaaataaggtgaatataaactaaatgtattaggatggagtaactgccaataaaatggcagtttttggctgttttttaactttggtttcactgagtagtcttctgggctaaacagttttggttgttttaaacaatactcagaagccatttacaaatgctcaaaaattgtttttttcacaagtgaaattatggcttttaaaacttcattgtgagcacatgatctttggccagtgtcctttatttggtacctgaaatgaattttgaatatggctttctaatagattttgtagtctatattcaagcatgactgtacttcttgatatctcagaataatttatacgcagacaatttcttttttgttttgtttttttgagacggagtcttgctctgtggcccaggctggagtgcagtgacatgatcttggctcactgcaacctctgcctcctgggctcaagtgattctcctgcctcagcctcccaagtagctgggattacaggctggcaccaccatg

SEQ ID NO: 98560 - DNA, 1097 bp, Homo sapiens
atatgtgctgggaaaccagaagattcgtgtgacttgttttattgcaatatttgctttatcgcagtgacctggaactgaactgacagtatctccgagatatgcctgtattttattcagtaaattctaagaagctacagaaatatttaacatattttagagcttcattccagttggttcatttttgtttgtttgttttaatggcatctaattgccaagaagggaagtctttggttcctggtcggttcatttacatggaaaggcttaaccatgctaggcaagtcatttgtcttatacttaattgtaacgttctgtattgtttttatgaatatgtttattaatggtattttagaagagctaacatttataataaggaaaagttttgtttttatgtgtgtgtttttggaaagttaatttatattgttggaatatgtgtggatctgcagtatgtacaaatgtgtgaaggatctttcctttgattgaaagattaggaataaaagattcagtgggacacacacacactcttattttcagccttcagtgtattacttgaaaataccaaattcatttaaaatttttaataagccttggcaaatactttccttagataaattatgtttgctgtggtttaagaaaagttcaattattctttcaagttgtgaggagcccaaaagtgagtacttgaaagtaatttaaagaagccagaatcaaaacttaatttatttcctggctacttcatatcagttcaagctattccagttactgtagactctatctaattatcataattttatttatgcgcatgacattacatttacatgaagtagaaagatgaaaatatgacaaaactttcaagtactagagaggagaaagcagattggttataaaaagcaagccgtttgctaatcagctatacagttcaggggtggggagaatgttaacagaagacactttgataatatgaagaggtgacatgaaagaaaaatagcaactgtctaacaaccttaaaagagagtctacttgtattctttaaattgtcactccgtttctgtttgactattcccttgagactcttccatttcacaattgtgtttatatta

SEQ ID NO: 98561 - DNA, 1638 bp, Homo sapiens
gcaacataaaacatttgagaagaacatggagtagacattgagtgtggtccaaagattcctgtatttctgtgtggagaaagggaatagcataaactgagcttatcccagctgctgctggtttgttttccttgcttttcttccagattaatgaggaatacagtcagctctgtgtatctgtgcattctatgtttatgggttcaaccaactgcgaatcaaaaatatttgggagaaaagccaataacaatacgcaataaaaaaatgcaaattaaaaaatatcgtataacaactatctacatagcatttatattgtattaggtgttataagtaatttagagatgatttaaagtatactggaggatctctgtaggttatttgcaaatacatcattttatatgaggaatctggattttggtatctgctgggattctggaaccaatcccccacagatactgagggatgactgtactctatttctgataccagtgaggcagggaccttacaacatgaccacatatcctttggacatgttgaatttttgcacttggctctggttgtgttttagtttgatttttgcaaagcctgacttaacaaaattagacattttttgtcatctctgttatatatatgtatattatatgtacatataagctattgtaaacaaagttatagacataagtagctagtgtaatgattatttttgttcattttgctggctaatacatagtaatttatatattttgctttctgggaaatttttggactatcaggcaagcatttacttatattggtggcgactttttcttctaaccataagaataatttatctttattaatgaggatccctagggtctaggccagagttttgtaagttctttcttaaaggtgcagttagagtaaatgttttcagctttgcaggccatgaaatctctatcatagcggttcagctctgccttcttagtgcaaaagtagccacaggcaatatgcaaactaataaaacttacgtacaaaattgggtgactggcccataggctatagtttgcctactcttggtctaggcatgtgaagaaactgtaatagaatattaagtcaggataaaatgatggcatgctcctgtcttggtgaattttctctattaatacgttcaagattacttcatatgagttttgtcagtttgcttagagttttgccggaattattaaatccatttttatttccttgaacttaattattaaatgcaattattgtcaccagttgtcagattatgttatggtacattttttaaaagttaatttttattgtttttaaaatcaccaattaatagtgtccttttaaatttttttatgagttgaatgtatgcctctcgccttagctttattttaataaatatatccttaaaatcagatttgcttatataaatatatttatatatttttttcttttttgggggtggggggaggggcgggggacagagtcttgccctgtcacccaggctggagtgcagtggcacaatctcagctcactgcaacctccgcctcctgggttcaagcaatccttctgcttcagcttcccgagtagctgggattacaggcacctgccatcatgccaggctactttttatatttttagtagagacggagt

SEQ ID NO: 98562 - DNA, 1595 bp, Homo sapiens
attctgttagatttgtattttatgggtttttttgggtactatatttggaatataagtttcatgttttgttctctgctatatcttcagtctctaggatatggcacaaagtcggattcagtaagtattgaatgagtgaatatctgctatcaaagagttcacactctaggagctgagaaagaagtacataattaaaagatgatacactttaggggaactgtaaacaaaattcttcgggagctccatgtgggagcaataaatttcatgtaacagatttctttttctttttttctgtcagatttgaaagaagataaacctaggaaaagtttgtttaatgatgcaggaaacaagaagaattcaattaaaatgtggtttagccctcgaagtaagaaagtcagatatgttgtgagtaaagcttcagtgcaaacccagcctgcaataaaaaaagatgcaagtgctcagcaagactcatatgaatttgtttccccaagtcctcctgcagatgtttctgagagggctaaaaaggcttctgcaagatctggaaaaaagcaaaaaaagaaaactttagctgaaatcaaccaaaaatggaatttagaggcagaaaaagaagatggtgaatttgactccaaagaggaatctaagcaaaagctggtatccttctgtagccaaccatctgttatctccagtcctcagataaatggtgaaatagacttactagcaagtggctccttgacagaatctgaatgttttggaagtttaactgaagtctctttaccattggctgagcaaatagagtctccagacactaagagcaggaatgaagtagtgactcctgagaaggtctgcaaaaattatcttacatctaagaaatctttgccattagaaaataatggaaaacgtggccatcacaatagactttccagtcccatttctaagagatgtagaaccagcattctgagcaccagtggagattttgttaagcaaacggtgccctcagaaaatataccattgcctgaatgttcttcaccaccttcatgcaaacgtaaagttggtggtacatcagggaggaaaaacagtaacatgtccgatgaattcattagtctttcaccaggtacaccaccttctacattaagtagttcaagttacaggcgagtgatgtctagtccctcagcaatgaagctgttgcccaatatggctgtgaaaagaaatcatagaggagagactttgctccatattgcttctattaaggtaggatgcttactctgaaataccatctcagaatgaggccaactataaagcaatttctttgcagtttttgaaaaatggcataggattactaggataattaacctttcacagacatgatacttcctctgaaccagagaagccagattcatagggagagcatctctacttcagttggagcagtggcccctgagtctgggcgcatgatcttgtaggagaaaaccaatatttgaatatttcggcttttattttgccaagtgcttttgcttttgtctattttaccttcagtttttatcattttgtttacctgtcttcatgctttatgaatgtagacaattgctaagttattacag

SEQ ID NO: 98563 - DNA, 1067 bp, Homo sapiens
gaagcaatatggagcaaagtctctcctctatgatttcttttcacagccatattgggcaacagcttcattgctgagggactagacatcactcgcctgtaacttgaactacttaatgtagaaggtggtgtacctggtgaaagactaatgaattcatcggacatgttactgtttttcctccctgatgtaccaccaactttacgtttgcatgaaggtggtgaagaacattcaggcaatggtatattttctgagggcaccgtttgcttaacaaaatctccactggtgctcagaatgctggttctacatctcttagaaatgggactggaaagtctattgtgatggccacgttttccattattttctaatggcaaagatttcttagatgtaagataatttttgcagaccttctcaggagtcactacttcattcctgctcttagtgtctggagactctatttgctcagccaatggtaaagagacttcagttaaacttccaaaacattcagattctgtcaaggagccacttgctagtaagtctatttcaccatttatctgaggactggagataacagatggttggctacagaaggataccagcttttgcttagattcctctttggagtcaaattcaccatcttctttttctgcctctaaattccatttttggttgatttcagctaaagttttctttttttgcttttttccagatcttgcagaagcctttttagccctctcagaaacatctgcaggaggacttggggaaacaaattcatatgagtcttgctgagcacttgcatctttttttattgcaggctgggtttgcactgaagctttactcacaacatatctgactttcttacttcgagggctaaaccacattttaattgaattcttcttgtttcctgcatcattaaacaaacttttcctaggtttatcttctttcaaatctgacagaaaaaaagaaaaagaaatctgttacatgaaatttattgctcccacatggagctcccgaagaattttgtttacagttcccctaaagtgtatcatcttttaattatgtacttctttctc

SEQ ID NO: 98564 - DNA, 1045 bp, Homo sapiens
ctctgttactcaatattttgtgatgtactctgaaattcagagaatggaattcttttaaatattatcattaaggaattttctgtgcagaggaaggaccagtatttttcttcatgaaatgaatatgttgatttatcatgctgagaagcattcacccataaaaattgttggtagctgttaataatgtgatttatgttccagcaatagtgttttgctttttacagttttatcttagaatattatcttagatattcagaatatctaataaaattcagaatatacagtcatctttgttgtgctccttgcttagttatgcaagatacataattaaaatcttttgagtaaagttattattaccagatgaatagtaaaattgtgttcatatcaattacattgagtatattatcttcatttactcatttataaggtaggaaatatgtacacctgagtatgaaatttcttctttttatattgaggttttttagtcagttgagtatgttgctgctatatataagccttaattttcctttaaaagctcaattctacatttttaaagtttttcaaaaattgagaacctcagggtttgaacatggttttaattgaaaatgtcatctgtgtttaaaataattaaaaaaaaatcaaatacaagttattacagactatcagaggattaacctttatgactttgtaatcctgagtctttcttgaaaagtaatcctggtaacatttcattttgacctttcctatagacttgagattatatcagaagtgacttggttttgaaatctacttaccactgcaaagaaaataccttgttgaatctagacataaagtctctatgtgaatggatacgtcattctgatactttccaagatcctgtcttaataacactttgtggaccaggtcatgttcagctatgatatttaaaagtttatgtaggagaatctgcccttattcatatacatactcctgccttcagtaggtttatcattttactgtcttttcagtgtagtgcttccatttcatctgcaggaagtgatggtacact

SEQ ID NO: 98565 - DNA, 1987 bp, Homo sapiens
aagatgtggcttttcaactgttacattacttactcagtcctactggaacccatctggtgaggccaatgaaggaggagatttatagaattcttattctggaattcacagatgggcttgtgggggggatcgtgaatccctctttttacatgagtatgtatagattttcatcagatttgcaaaaggtctataaaccccaaaattagaaaaactcttctaactctgaaactttagtccttagataacccaggtaattgagtctacaggttttaaaattgtctgaaaaagtcaaagatcttttcccaaaagctactttaaagccttgagatactagtcccaaaacaaaacagaaggtctttcccagtgtctgcagtagttttgggtattttcatgcaatgttaagatagaaaaagttaggatgcacgactactatgcattaggcattctatctttctgttacatctctgtaacctttagaagctacagatttatttgtagggaaaattatgcagactaataatcaggctaagtaaagtctcttcatagcaaattacatgagcaaccttagatttgatgtatgtattttactctttaaaacagtattcaacaaggatattacaattgaccattgtatgttagaataacctctgctccatttatttctgttcaaactgtttagtttttggaattaaattctgctgaatgggttgcttttttttttttttttaattattttaaagtaattgtgtaagtgactgcattggaactggatgtccagtgtgttacaccccggcctggatacaagacttgaagataaatagacaactggacagcatgattcaactttgtagtaagcttcgaaatttgctacatgacaatgagctgtcaggtaagaactatccctatctctcttagttaaattcatcagttaaaaactgatgaattcatattcataaagtatataaaacatctatctggagttctggaatacgtatttcagattttaaaatctgtaggttttttttttttttttttaaatagccattgagtctctctatgttgtccaagccggacttgaactcctgcactcaagggattccccccacctcagcctccctggtacatgcatgtgacacacccggtggttttttggaagatcattttgagaaatgacgggaaccatagagataattaaagtctaacccccttattttatagttgagaaatcaaggtccagagaggtgaaataaccttgcctacagccgcatgtgtagttagtactagaagctggagaaataaagcccatttctgactgtaaatccaggaacttttttgctgctttacattgcctgctttttacatttatgataacttctgcagaatatatatggaatagtgattttggccttaatagcacttaactcacttaaatacactttcccaagatagaatacgacatttttccatggatcacttttctagactgaattaattagatgagcacattttgaaagagcagaaatctaatattcattttcttttctatttaagtgggggttaacgttttttaaattgtccttagactctgtgtattaactgtgtatctttccattgtgctttctgctgagaactaattaactgtggaaagaaagtaaaatgttttgtatcttcataattggatattagagttgtctttttattgaccagatcatgctattttagtgtgtgtttgtagaagaacgtgttcttgactggcaggatgccatggatgattgataatgctcatataaaattgttagatttctatttttaaatcttttgttcttagaatcctgccatgatgtcttattgtcagctaaagatgaagttgattatacaaaataaataaatgtggcaaaaactttgagtcttaccacaggtccatatttttaagaattagaacttaaatcactttatacctattaaaattttccttcagctagttatctgc

SEQ ID NO: 98566 - DNA, 2241 bp, Homo sapiens
agaaaaggttgcatggcttaggtgttacagattgtgaagaactttttaatagtaaatttttttttaatggtaaacagtgtgtgaaaagaattaaaataacacagtatatggccattcagtatttgttaaatgaacgacagataagtgtgaatcttcttcagtaacttataattatcagtttcttgtgtatccttcaagaggttctatgttcatataagcattgtactgcctcagataagcagatactaaacaccatgtagttgttgcatgattcatttaaccatttccttattggaaacatttaggttgtttgtggtcttttgctgtaacaagcagtgctggagtgatactgatgtcatgtgcctttacatttaaaatgtttttaaataaagttatacatgaacgtagttgacagagtcaataggacagactattaatgaaaacattctttgcttcatccttcatcacccctgagttctatgcatcagaaacatcttttgtcttttttttagttttacaagcatgtacctctacatttccaaatatgtttatattgctatttatttttttttccattttagatgttattaacttcctaactattctcaaagatgaattttcttactactgttaactttgacagtggaagttagtggatgtagaattcaaagtacaaaataattgtcaagaattattttgaaggcctcgttccacagttctgtagcatctcttattacccttgagaagtcttatgctatcctgattcctttttttaaaaaaagtatgacatttaattttattatttcttaaatctctggaaggttttagaatcttgtctagatatctttgatgtttgaaagtttcatttttgcaagtatctagtgttgctgaaggacaaattcctggcagtggaatagctgagttaaagttggatgcatttatattcttgataggtatctcctagttgtaataattttttaaaaaagtttttctaaagatacatgttcttgttgtgttgtccaggctggagcgcagtggctattcacaggcacgatcatggcacactatagccctgaactcttgggctcaagctttcctcctgcctcagcctcctgagtagctgggattgcaggcatgtgccactgaatttggcactcccttctctctcagcttggctcacacacttccttcttgttccctcccccaatacacacaagtgcacatacttctcattcacatttccattatctttccttatccgttaacagcaacacaaatatatattctaactcactaattagaataattagtacaactgatcaattattcccacatgttaaatcattactaatatgtgatagcaccttattgctagagtgaaggttaagaactatagctaaagagttcagtcatcttaggaaggaaatttaaagttgagaaacagaatcaaggcgttgagtcaagtattgccagagaaagccggaaggctacggactgcatcctgggggtatgcctacatggagaggtaggaaaagcagctaaggaaatgctgaaataggcagatcaatgtgtataaaaatattaaaatgcggtggaaggaaaggtttcaggaaagaagatgaggtcagtgctgtttcccagagtggtcagagagaaggggaccaaaaatgctttggagaacagtttcagcagagtggagggagttaaagctaggaaggtgaggagatgggagtagctggtatggagcactcatttaagaacttttatctgttcaagaaagggaagagatggagcagaaggtagaatgggaggtatgatcaaaactgtgttttttctgtgtcaaaggagagattacctgttcatgtgtagatgcaaatgagagaagaaaggcaagtattatgaatatctagtgctttgggaggcagaaaagatatgggaactataggtagagtagcacattttaggaagagtgactaaaggagatcgaattttcctcttagactctaggaagggtaagatgactggtgaagagataaaaatgtatttaggtgttaaaaaacttacaccattaagttccagtaaagttaatgagatgaggaagcatagagattgttttgaatagccatctattcatttgtttgtttatttatagaatattgaatacattactttggtagagatacaaacatgaagaggctaccaaataaattttatgtctttattttattttattttaatatt

SEQ ID NO: 98567 - DNA, 1013 bp, Homo sapiens
attgagcacccataaagtgccagaccctattctgggtattggggatttgttagtgaacaaagcagacaataaattccatctcttagggagcttttatggaagaaacaaaatgaaattttacatgtatgtaaagtattgagtttggtggttgtgatagaataaatgataaataatgtgtgtcttaatctaaaagaatgtggtgtttgcttgctacatgatttgggagagacaaaatagataatatatatgaatatatgttgtcctgaaaaataacaaagccggtttcactttttatcccctaccaaatatttttccagtttctaactgaagtgagtagacagtaagaggcaacggagtgtaaacagacatcagtaaccaggcccagacttttagcatggctcacccatttgactacagaatgctattgaatgctattgatttttttttttttaatccgaacctctatagatgaactgaatcttaactcttagactgcatgttttcatgtaggggtctgcaaattttttcggtaaagggccaggtaattaatattttaggcctttctgcccgcaaatagtttttgttcttatttatttttacatctcttaaaaatgtaaaaaccattctttccttaagggctgtacagaaacagactgctggcttggtttggcccacaggcaatagttgctaaactgtcgataaagtcttgataaacttaatgtctcaagtttaaaaatcctttttggtatacaattttatatcacatggggtgccttttttttttttttttccctaggcaaagtttcactctgtcacccaagctggagtgcagtggcatgatttcagctcactgcaacctccttcccccgggttcaagcaattctcttgcctcagcctcctgagtagctggaactacaggtgcatgccaccatgcccggctaatttttgtatttttactagagacggggtttcatcatgttggccaggctggtctccaactcctgacctcaagt

SEQ ID NO: 98568 - DNA, 1175 bp, Homo sapiens
ttgcaataacttggtaaatattgtccttgtttttacctttatccactctcttggtttaggttcctccaatagcagatcctgaacaaggatttcagtgtaacttatttaggaggtgatctcagggagcattgtagagagtagtgcagagataggagtaaggagaaaagcccattaaagatttagtgttaatgaggtggttactattgtagacagccaggctcgatcttgctagggaacctctgagagactgagtagaacatgtctctgaattgtgacaccaaggggcacaagaaacttgagacagggaacccaagtgatagaatatctcccatatctaaagagaactgaagcactgtgcctttttctttaatataggaggtgcatggtgtaataacttgtcctttacattgaaggaatgtcctagcttgcctcaaaacatggactataaaaatgtcactaatgttctgcagccaattaagccaactgagttcctttccttgtgggggcccagtgtgcaatggctgcacacagcagcttccttggtagtgtacacagcctgttggttgtatgggttgctctgagggaccttggagacaggcctttccaatggatgttcatgtttctgaccttgcgctaccccaatgtaggctccaaacaggcatgcgaggtgcctttggaatgccccagggcactgtggccagggttcacattggccaagttatcatgtccatccgcaccaagctgcagaacaaggagcatgtgattgaggccctgcgcagggccaagttcaagcttcctggccaccagaagatccacatctcaaagaagtggggcttcaccaagttcaatgctgatgaatttgaagacatggtggctgagaagtggctcatcccagatggctgtggggtcaagtacatccccaatcgtggccctctggacaagtggcgggccctgcactcatgagggcttccaatgtgctgcccccctcttaatactcaccaataaattctacttcctgtcaaaaaaatgtcactaatgtaccctaaattttcttttttatttttattttttatttatttatttatttttttgagatggtgtcttgctcttttgcccagactggagtgaagtagcatgatcttggcttactgcaacctccaccccccaggttcacc

SEQ ID NO: 98569 - DNA, 1131 bp, Homo sapiens
taaaaattagccaggcctggtggtgggcacctgtaatcccagctactcagggggcgaggcaggagaatcacagggtgaacctggggggtggaggttgcagtaagccaagatcatgctacttcactccagtctgggcaaaagagcaagacaccatctcaaaaaaataaataaataaataaaaaataaaaataaaaaagaaaatttagggtacattagtgacatttttttgacaggaagtagaatttattggtgagtattaagaggggggcagcacattggaagccctcatgagtgcagggcccgccacttgtccagagggccacgattggggatgtacttgaccccacagccatctgggatgagccacttctcagccaccatgtcttcaaattcatcagcattgaacttggtgaagccccacttctttgagatgtggatcttctggtggccaggaagcttgaacttggccctgcgcagggcctcaatcacatgctccttgttctgcagcttggtgcggatggacatgataacttggccaatgtgaaccctggccacagtgccctggggcattccaaaggcacctcgcatgcctgtttggagcctacattggggtagcgcaaggtcagaaacatgaacatccattggaaaggcctgtctccaaggtccctcagagcaacccatacaaccaacaggctgtgtacactaccaaggaagctgctgtgtgcagccattgcacactgggcccccacaaggaaaggaactcagttggcttaattggctgcagaacattagtgacatttttatagtccatgttttgaggcaagctaggacattccttcaatgtaaaggacaagttattacaccatgcacctcctatattaaagaaaaaggcacagtgcttcagttctctttagatatgggagatattctatcacttgggttccctgtctcaagtttcttgtgccccttggtgtcacaattcagagacatgttctactcagtctctcagaggttccctagcaagatcgagcctggctgtctacaatagtaaccacctcattaacactaaatctttaatgggcttttctccttactcctatctctgcactactctctacaatgctccctgag

SEQ ID NO: 98570 - DNA, 1063 bp, Homo sapiens
tacttgggaggctgaggcaggagtatcgcttgaagccaggagtttgagaccagcctgggtaaccatttctaaaaataaaaaaaaattaaaaaaaaatagccagacgcaaactacaggcatgtacctgttgtcctagctatttaggaggttgaggtgggaggatcattcgagcccaggagttctaagctgcagtaagccatgattgtaccactgttctccagcctgggtgaccgaggaagactctatctcttcaaacaaaacaaagaaccccaacaaactccttatagaatctgctgaagcttttcttgagagtgcatcacagcccaacttttccctctgctcaatcctgcttgactcccttcccttcagcatgttgcagccttaagaaccttccttctggctataatccctgtctcagtctgcttccttgggaaccccatctgtggcagattacaaattgagccaaggcagtagcaatggagctagtgtagactttaggatattttaaggaataatagcattcactaccaattggatgtaaaaggaaaggaagatggaagacttaattataacttccacgtttacttggacaactgggtagtcaatggtgcattcatcaagataaggaatataaaagtaggagcagagtttgggggagaaaatgaccaatttcttcttgtacattttcatcatgtatataaaggaaaatgcaacaaaataatatgtggaaagttattaggctaaaccataaagtgccacttttataggtcagatttgttaaatattggcaatttcaaatggatgaaactaataattatatattagcttctacatgggaaaatttactatttttattaaaccttacgtaggtcatataagatttcagaaaggcaatatgtgtcagattcaaaagataatcttttggataatatatcatttacatttaagcttctgaaacaagaatataaatcacattgttgctttaaggcacattaggggatcttgatgagattgggaactttgatttacatcagttttcttgaagaagttgagacataatcac

SEQ ID NO: 98571 - DNA, 1012 bp, Homo sapiens
cccaactacatgtttgatattctttaattaagaatattatgctgggcatggtggctcttgcctgtagtcccagcacttggagagctgagacaggagaaccgcttgagcccaggagtttaagatcaccctgggcaagatggcaacaccccccttctctttaaaaaattgaaaagaccagctgggtgtggtgatgcattcctgtagtcccagctacttgggaggctgaggtaggaggatcacttgagccctggaggtcagggctatagtgagttgtgattacgccactacaatccagcctgggcgatagagtgagaccatctcaaaaaaataaattttttttttaatcaatgggatttaatttgattgaagacactatgttgaaagacattccttaatctgacttgttttttgaagctaatgactttgtttaacttttttaaattaggaatcctagctcgtaatattccagaagataatgctgacatggccagacttgatttcaatcttataaggtaaaaacctgaaattaaacttttaacacattacgaaccaacgacaaagactatgccaaacctggtgtccctgtgttttcttactcactataaacctttactgcgtaccttctgtgtgactttgtatgtgtgtaagcattttggtttggccagatttatataccaaaatacatactgaagttttttaggaagttacaatctaaatcttagtatgtataggttgagtatcccttatctgaaatgcttgggacccagaagtgtcttggatttcagatttcttcagattttggaatatttgcaggtaacatgccagttgagcgtccctcagaaatccgaaatgcttcagtgagcatttcctccaagtgtcatgttgacgctcaaaaagtttcagattttggagcatttcagatttcaggttttcatattaggaattatcaacttgcacaactaactgagttatttgcataaagatactggctgtttctcttaaatatacgtaa

SEQ ID NO: 98572 - DNA, 1019 bp, Homo sapiens
tttatgacctctctgaaggcaaaacaaatgtttcacccttagaatgctctgatatttttcatcattgtgccaatccactggaaaaagaatctaaattctaatgttctggataatagtgatcacattccaaaatgagaatgttatctgtaatcttgtactttatacttctattaaaatgttctataaatttttcatggcttggtggttctgggtagctaaggttatgcaagcagcagcgttgcagtgtgacgtggagggagtactgtgtattcagatccggggagcacctgctgactaaattacctctgctcgaccccagcaggacaccctgactttttaacacactcgttagaattctaaaatgtcaggctcacagtttatatattagttctctatggcttttgtttacgttaatagtactgacttgtttttttcctagatagctgtaaaccacatgagtggactttttaatgacagccagattcgtctttgttttatagagttgttgcctgcaatctctatccctttgtaaagacagtggcttctccaggtgtaactgttgaggaggctgtggagcaaattgacattggtaagtcagaaaaaccattttagaagactgagaggagaggattatttaaattttagtgagatttcattttgaattttattactgaggaaatagaaagaaaatagctacttctggattgtgttttgggattactataattcatttatattttctttttttcatttatattttctaagctttttttgtatgcagagatgcatctgggttattttcctgatttatttatttatttattttatttttatttttttgagatgaagtcttgctgtgtcacccaggctggagtacagtggcacagttttggctgactgcaacctctgcctcctgggctcaagtgattctcttgcctcagcctcctgagtagctgggattacaggtgcacaccaccacgcctggctaattttttttgtattttttatagagatggaat

SEQ ID NO: 98573 - DNA, 1068 bp, Homo sapiens
cagcttttgagagcagaagctgcatctgtttttgtttgtcgctgaatccccagggcttagaagactgcttggcacattccctaaatgtttactgaatgaataattagcaacctgacattttgcacaaatttttccttgtaggacttcttgaaactgatttgtctgctgttatatctgacctatttcctgcttatagtttatattctccattaagattctgagacaaaaaaatccccatgtactgtcagttcttatacttttcattttccaaagcattttcattggactatataaaagccttcattgttccttagactgtgtgtgcgtttcttttgaagtttaaagtattatttgtggtaaacatggcagaggcggccctggacacgtaaataagcgtttcttgtgcgagattcccaggatttctccccaacatgggcttatttccacaatagaaaaggcactttgccttttcatgtggtttgagtatttggcagtgatgttattacagagtgtatggttgcgattgtatctaaaacaaaattgaagcaagaacaaagatggggttgtgtgagtgtgtgtatgtgtctgagattttaatgactggtttgcttatgattggaaagaagaaaattcctatttatttcagctatttactagattaagcaactttcagcatttctctggcactttctatttcagttattaatgtctttgaaaatttgatatttgaaggggaaccggatactcttttttttttgaggcagagtcttgctctgtcgcccaggctggagtgcagtggcatgatctcggctcaccacaacctccgcctcccaggttcaagtgatctcctgcctcagcctcctgagtagttgggattacaggcatgtaccaccaggcccagctaatttttgtatttttagtaaagacagagtttcaccatattggccagaccagtctgaaactcccaacctcaggtgatccacccaccttggcctcccaaagtgttggggattacaggcatgagccaccgcacccatccagatacgcttaactatgagatgtttcaga

SEQ ID NO: 98574 - DNA, 1073 bp, Homo sapiens
aagaagaaagaaaaaacacattatttcttctcttcttccacccacagctgttgctttagcttgtaatataatttcttacatcgatagggtttataactttaattttgtactgtctctgtgattacctcaattgtttaatcttagttctgtatttacatgaattcctgactgatcactagtcttgtcatagtttctcccatccctaaatctcttattgtggatttatttctagactggctggttctggtcctccagtcgtgtgtgtgtgtgtgtgtgtgtgtgtgtgtgtgtgtgtgtgtgttcatgtacatgtgcattttttttaaagatgggctcaggctcagttgctttgttctttatcatcaagattttatgtttgtgtgtatctgtttggctcttaattatacttaaaacatttgtttagtcatgttatttttttgagaagtgtgcatacatctgaccttactgatcctgcttagtaatgtgcatgtatatttttacatttagttctaaatggagcccctggatttataaacttgtgcgatgctttgaacgcctggcagctggtgaaggaactcaaggaggctttaggtattccagccgctgcctctttcaaacatgtcagcccagcaggtaaagctctgtgctctggaaagctccagaattgttcgaaaggcatttcttcttaaatttttttgaatattaacaagttctaatgtgaatatagacatgctatgaaatctgaaagtcatctgttgataacagtatcaatgtaataatataaaatctgatacacacacacacacagaattgtgtaatattgtcaggaaaatgaggcaggaatttgtttgtggggtggaaccataaaagtttagaaaataaaagtgaaatgtcctaatgcaatagactaagtcttgtgccacatctttgaaaatgtaatggagtaaacataaagaagttcttctttggactctttatctgaaacttcttatagtcgttgtatgagatactttgcttctgtgtttaaatcatgaactccgcaattgagttgtctgtacaccacatcttgctga

SEQ ID NO: 98575 - DNA, 1600 bp, Homo sapiens
atcttaatctgtgtgttgaataaagctttatttgttcataatgttaattgaaaccataacctataatatttatatttataatatcttttaattagctaagtttatcatttaatgttcatattttaaatagaacattaatcttaaattgttaattttgaaatgtagtgaattattgtttcagatggatatttggctgttatgatgttttttacttatatatttattttaaattctttgttgtcttcatgccaaagttactgtttctgaagagcagaagttgtaattttaggtggtgatgcgatataatccatcttactgcatagtgggtaaaaaacagaaactacattaataaacttaccccatcagttgaataccaaacaggtattccagacaggtgggggtactgttggtagtaggaagacaggaagaaaagagaaaaagattaaatagctcagaaaggggaaaaaaataagcagaggtgaaggctgaaggagcatgtggcttggcactattttgttgctttaggattctttccatggccactgccatccctgggttacaggttacaggagggctgtgacatttgtatctttcgtcatgtcaaatctctgatttaatctggtcttgctgttaaggaaaacgccttgccggaagaggtcatttaaccatgtactaggagagtcaggactagaatgtgctcttgctcattcaaaacactccctgaagaaatatttcctcctgaggtacatgtgttaagagcaaatcagtcatattttcttagtttaaactgaaacgaacaaaaacttggagaggacagaaagttaggatctgctatacagaaagctgtattctaatagatttctcttttcaagtatagcgttagcattgtttgttggaggcagaaaccagaatatgctgccacattatttaagactgataattgctgctagatttttttaagaggtgttctctgatttttaaaaatagaaattaaaatttaatatttttgcaggtatctgatggtataattgccccaggatatgaagaagaagccttgacaatactttccaaaaagaaaaatggaaactattgtgtccttcaggtgagtgcaattcatgtttgaagcggtaatttgctcttttattctgtgtctctttctcccttgtttactctttcctttatactcatacccttctagtttatccttattatagtttattttccccaatcctgcatttaaaaaaatactattaacttggggttttgagatgagagtagctttcttaccctcaattttaactttttgctggttgtgatggctcatgcctataatttcagccacttgagaggctgatgtgggaggatggcttgaggccaagaattggaggctgtattgtggtactatgatgcctgtgaataacgactgcactccagccttggcagtgtagtaagaccatgtctctaaaatactaataatagtaacaatatttaatggaaagtctctccatccttctgttaccttttgaaaagataactattttaaatttcttgcttatctttcctgaaatagtctatgtattcagcaaatatttgcatgtgc

SEQ ID NO: 98576 - DNA, 1140 bp, Homo sapiens
agcctcctgagtagctgggactgcaggtgtgcgccactacccctagctattttttaattcttattttttgtagagatgagatgttgccatcttgcccaggctggtctcctgagctcaagcaatccttctgtcctaacctcacaaagtgctgggattacaggcatgagccagtgcacccagcattggtcatttattttaacttttttttttttttgacctcaaaccatcaattttattgaattgtagattattaatagtcatatgtcacatatcactgaagaggtataaatagtagttataaacaaacctcttactccaccccttttaatgacttaaaaattatttatatttctcttattttggcctgatatgttcttccacaaaactaataaataggttttggagaatgtgcacaaaagatccttttgagaagaaagtgtctttggaagaggtgttcactttaatgtctgtgttcctcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggtgaaagacttggcattgggttctcggctgtgttaatattcagttcaaccctttatgtgtaacagattttaacttcatcaccacacagagaaaaagatactttcattgaaattctatgttgtctaaaattgatcattgaaacttcttacacatttctcatgttcttctgtctcatgtaactttcttcattgtttttgacccctttctgaaaccacagtcctctgtctttttaaattgcagccttggtgtaggtttgtatatttgtacttcccctgttgattataagcttttgatgacaaggactgcttttcacctacgtcgaggtgcctgccaccacgtcatgcatggtgcttgctgtccgatgggtctgtattcaacattaaatacaaattgcctgacggcaggtaaccctggggtcttctcccaccacattttctacatgtgccattaataacttgatacattttgttacatttc

SEQ ID NO: 98577 - DNA, 1096 bp, Homo sapiens
tcattatttacaattaagaaatcctggccgggcgcggtggctcatgcctataatcccagcactttgggaggccgaggtgagtggatcatgaggtcaagagattgagaccctcctggccaacatggtgaaactctgtctccaaaaatacaaaaattagctgggtgtggtggtgtgcacttgtggtcccaggtacttgggaggctgaggcaggagaattgcttgaacctgggaggtggaggttgcggtgagccgagatcgcaccactgcactccagcctggtgatagtgcaaaactccgtctaaaaaaaaaaaaataataataataataaaaacaagtcctaagaaaaatgcccaggtgctttctggcatggtgatttgcaccacatagaactaaagacgatgtcagaccaagcttcttcctttctctctccccgcataggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaagggtaagtatggaattgggtgcatttgcttagagttgagcattatgtagaaactgtttcagaaatcctgcttttgatttttaaaaggtgtggcaaagtgatacagatcagtaatattcagagaaccatttgacttctccattgggtggatggagaacccaaatcctgttgttattttgcctttttgactgagtgtatctttgttagcatatgctttttagagggggattttgagttttgcaggtttttacataaaatcgcgttttgaaaatcaatatacttcccccagagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatct

SEQ ID NO: 98578 - DNA, 1070 bp, Homo sapiens
gagatgggcatgtttcattgtaaagtcttgtccagcagtctcctggcaaaggcagtgcttcattctagaatgaaatggccatttacaaagtaccaagttgcaaagggcccaatgggagactccttggcctttgatgtatcttgcctaagggagcctgctctgctgggtagcttcagggcacttgacgccagccccagtccatcattctgggctggctgcctcgtacagcttcaaccaatgctagtttcaatcctttgggggctccacatgagctgttttagagataaatttggctcctgagattgttaaaacctgtatgtctctaaagagtaagtaaaaaggaattcaaggaaatgtaaaacatgctttaatatctcatacctgactctactgaggaatgttaaaaaaggaatttcccatttgggactttcggctgaagccctgtttctcttgctcttttattacatcttttcttcatttgtaatttatataggtttctgtttgcaattcaagttgaatcttttattttaatgaggatatggagtgagacgatgtgataatgaaaacaacgtgcatttcaagtattttgaaaaaacttccttagtttctgcaaggtcatctttgtgtttcttctgctttatcagccttaatggtaatctttaaatgtttccaaacatgggaagtcccaacagcggtctttttttttttttcttaagagttgaattgtctcccttgaaaatgggattttttaattgtaacctgccacattccctatcacagtaatgggaacttactaaataggaagcaatttgagcacttaaatgtgctgatgtgatgtttcttaatcactttaatgagtttcataccactagaaatggaatagaagtttcaatggaaatataattaaatagaaaagtcatttcctgtacttgtaatttccccctgatcatttctttattcacctccatagaaagggtgccctacaggtgtatagtgatgttattatacagacttatttgcataattcacttagattattagagctgaaaacaatataaaatgtaacattt

SEQ ID NO: 98579 - DNA, 1049 bp, Homo sapiens
tttttgggatggagtcttgctctgtcccccatgctggagttcaatggcacaatctcagctcactgcaacctccgccttctgggttcaagccattctcctacctcagccttctgagtagccgggaccaaagacgcccactgccatgcctggtaacatttgtatttttaatagagacaaggtttcaccatgttggccaggctggtctcaaactcctgacctcaggtgatccacctgcctcagcctcccaaagtgctgggattagaggtgtgagccactgcgcctggcctgaatgtcaaatttaatcccaaagtttgtttcctcaatgttaaattgaaaaagaaatgacctttacagatcaggagtaaacaaactgtttagctgggagtttatcaagccatgccaaaagtgtcagctgacccaaagtaagacatgttagatgggggttatcataccatggggtttccctaagataaaactcctccatattatactattcaaatacttttaatatcttagtcatttttatttcccttgcaggcaatctctttgaacagaggtttattcaatgaaggaaaggtggagggaagaagggaagaattacaatggttagaaaagagcaactaaagattatttctattatacttctgaacggtaaactagcaattttaataaatattggggtccacttaaatctattaaagcagaaagtgtaaagctatctccattagtgaagagatgaagtgacaaaaaccaatcagtttttgtagcaactgatttagaaaatcttgtactgaaatcaacaattagacttgcacatcatagattttcaaatgtttgctgaattgaaaaagaatattcacaggaattatttcccccgaaggtgtcttatatcaaatagatgaacttcaagttgtggaatgtaaatcttttattaaaacagttgtctttccacagtagtaaagctttggcacatacagtataaaaaataatcacccaccataattataccaaattcctcttatcaactgcatactaagtgttttcaatac

SEQ ID NO: 98580 - DNA, 3044 bp, Homo sapiens
gattggaatttagattgaattcagtatctctctctgtctctctctctctctctctcccattaacacttacaacgactgtgattgtatgaccttagaactcagtcattctggtatgaaattgtgtgatggagaatgaatttgctgggaagttgattttggtctcacttcagcatcttctcattatttatgcacatgaaacctttcatgtgcgacacttattctattctcaagtgctaaatgaaacatttaagacaggagtggaaactgttcactttctcatatgaaagcaagattcagtgattctgtaaggaggtagtcactggtattgtgttaggtattaaggggcatatgtgcttaaacagagaaatatgtctaaaatatttaaattctaatataaaaaagaaagtgactgtattatttagggctgcattttagttgtaagaaaaaagtccaactcaagcaaaaatggcccacacaatggaacagtcccaggacccaccggcttcaggggctgctccagcaatggcgcccggactccctcttgctccgcgtgccttcccatgcactggcttcgtgcttcagcggggtctctgctgatggtgccattgatgactgacctccatgagcttgctttaccccctgccagcttaagaacagtagtgaaagagaacatgtgtgtcctcccatttccagtaaaaacttcaggcaggagcctcactggctcagcttggtcccgtttccatctcccatgccatctccggccaggtgacaggctaccatgtcactgcctagggaagtttaggaagagagtggcaaagtggtgcattagaaagaacatggccaggtcaccccacctcctgggcggcaggcccaactccaccagtggtccactgtgtgacttccctgctccctctaagcaagtcactcctctcctctgggtctctgtttccttacctataaaatgagaacgtttcttcatgtgatctcaagtcccttttaaaatcgctaggattctttgaaaaccttttctatcatctagtgcagagaacttgttgaggaagttgggattggaatgagcctcagcagatgggcaaggtttgaataggaagagaagagacatttcaggagaaagaaacaacatagagagacagatgtaggtataagatatggtaataagccaaaatgtattaagagttataaatgcatgaaatcatcatcaaagcttgcttagtgattaactgcttatattttgccagtgcatatgatgtgacatttttctttaactcaaacactaaattacgatgtcctcaggttatcataaaccccatttgacttcatgcctctactctctcagggctggcgctgtgacaactgccgcagacctgggggtgaacccagtcccgaaggcactactggccagtcctacaaccagtattctcagagataccatcagagaacaaacactgtaagtgcattagcagcacaagtgtgttccctcatactagacagtctctttctacaggtatctttcttcagaatgaaccaagtgttttaattaattaaaaaaaaaaacaactcataaatgacttaagtgaaacactgtattccataatatagtttaagttataatttatgtaactcttgaacatctcctattgcccagtatgctgctaggttcttgaaactaggaagaaatattatcctatctataagcagctgtcatgagtccccacctccccgcatttttttttctgtacactttacagtatttgccactaatttttttttccttcttcctttttaacagaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaagtatttgaatagtataatatggaggagttttatcttagggaaaccccatggtatgataaccccc

SEQ ID NO: 98581 - DNA, 9772 bp, Homo sapiens
atctgccactgaggactgcttggttattaggcctaagtagattcatgtatataatctgcaggactctctttcaaatttatattccagtggtggtatatgatgctgatagattttcttaaattcaaaaaggcaaataagaccacgttaaaagaataccctggaaaggccaggcgcggtggctcacgcctgtaatcccagcactttgggaggccgaggcaggcagatcacaaggtcaggagatcgagaccatcctggctaacacggtgaaaccccatctctactaaaaatacaaaaacaaaattagccaggcgtggtgatgggtgcctgtagtcccagctactcgggtggctgaggcaggagaatggctgaacctgggaagcggagcttgcagtgagccgagatagcaccactgcactccagcctgggtgacagagccagactccatctcaaaaaaaaaaaaaaaaaaaaaaaaaagaataccctggaaaagttagccaaaaaatgtctattcaggcgtcagatatgatagtaagataattagtttgcgatgcggactttatatgcaggatatttgggtgtttatggaggaaaagtgaagtcgattttaccttcaagaggccaacagccagctggagaggaagtgcctgctcccagtagcgtctgctggtgagaccgacttccacttgactagctgagcccattgacataatgtgatggttctattctcccttcaggcctggaaccgggaaccgaatatacaatttatgtcattgccctgaagaataatcagaagagcgagcccctgattggaaggaaaaagacaggtaagagtatcttgcaggtaacaaggagaaagataggacaaaactaataacaaatgagcaatcttgcaatatgaaaaggttctccatgttttgatgcatttcttgtgattttttttatctaacagcatagtgtatatattgtattctttaataggagaaataatttaacatgcactgcagagtttggttttattttttttctttactacagccactcaatataaagccttgttattcaccttttaaaaattcaaacaagatgttaaaatgtaaaagaagagctatcattgctcttcttttataccttctgttgaattttaaaatgtttccttttttaaaggagggagagaaacctctcacatttatctttatttggtttctacaacttagagctaaataatgtcttacttttgcatccagtttcagttaatttcaagaaaatgtgtattcctgatataggaaaatttcaaaaatgaacatgtgtgttttatctatttttaccatttcaaaccatgaaaaactgttgagccaaacctctgtaattctcatacttatgacactgatatgattagtctggattctacttcctacaacttgcttctcaaatttaaaaaagaaagagagaaagagaaagactgcacatttcagttccattaggtctaatttgagcagaggcagcttctacggggctcagcggtttaaagctgtgtgtatgataaattcatactaacacttttttctttctaaactataaagaaacctttgagaaaaatcctaaagatttctttctggaaaaagtgttttgtgatctcagaactgctcattttctggtggcttttatcaaattgatgaacagtcattgttgcctgaatcgattattatcattgctgctacttcctggagcttaatgcgctttgcttttttggctctaacctctctcggctagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacaggtaattaattgttctcttcacttctcatggggcagcacagaaaggaataagttaggtaactgaagtgaccagccctcgaataaaaagtggcttcatggccgggtgtgatggctcacgcctgtaatcccagcactttgggaggccgaggcaggtggatcatttgaggttaggagttcaagaccagcctggccaacatggtgaaacctcgtctcttgaaaaaaaaaaaaaaaaaaaagtggctccacttttagaacctcttagaagatggcacatttaagccctgcttttttttttttttaaatcccaatatggctctactttggaggacataccagagagtcactagcttttatttcatagagaaaatgaaactatttctcttattctcacacatttgaggttcctttttgagtaagatagatgattctagaaaagaaagatattctacctgaatttccatttgtgtgcagaagtctaaaacactacctttacgatttgtccttgaagaaccccactatctacaacatatctaaagaaaaaaaaaaacaggcgaagctgtgcatagcagctgataagtgattgattctctaaaacgtatattatttaatttgtgttgacagtatccatttttttttttccccgagatggagtcttgctctatggccctggctggagtgcagtggcgtgatctcggctcactgcaacctctgcctcccaggttcaagcaattctcctgcctcagcctcccaaatagctgggattacaggcatgtgccaccgcacccagctaatttttgtatttttagtagagacggggtttcacgatgttggccaggatggtctcgatctcctgacctcgtgatccgcccgccttggcctcccaaagtgctgggactacaagcatgagccacccactacacccggcccactgacagtatcaatttttattgtgttgttacttttagaaagtggcagaatttaaaaactgacaacactgtaggaaatttatgagcttagaaacatgagtttgaggatttgcccaactgttttaaggactccacactggggtcagatgtcacctggaggagcatgaccgtgtctcccatatagcgcagtgtccaggttttatgtgaagcaaacatggccagggcttccagagggcttatgcagacctgcgactgaagcaagatcaatggcaggccgtctctagtattgtcgagggctcctgttaactacggagcacgtaggtagattgttggcaggaaaatctggcaggaacgatggcccctatccttgttccatttctctcctcagctggttaggaccactataccctccctcttttttttttttttgttttttgttttttgtcttcctttgctttgtttaaacagtgagggttattggtaagaggagagcccgtgtcattcctcactataatgctttctctctgctttggatgtaccgataattgcagttcagggttcctggaacttctaccagtgccactctgacaggcctcaccagaggtgccacctacaacgtcatagtggaggcactgaaagaccagcagaggcataaggttcgggaagaggttgttaccgtgggcaactctggtatgtaaacacgtactatttagacacaggctcccctctgctgtacaccagagatgggcttttctgttgactgtacctttgttgccattgtctttttatctttgggatttaatgcaacacatcaacatgaaataaatgagcaactttatattaaattaatctctcccccacctcctgccatatcctgttgtcttcacaaaatgcatacgtaattgacagactctcaaatggtgatatgattatagatctggaagggatttcaaatattatttagtacaacactctgagtccttacttctgagtatctgagttgatatagggcacaggtttcctgatgtcttttcccagaccctctccatctcaccatgctgctgtcctcttgagtgattaaatactgaaacgattacctataaagaaaataccccttctgcagacatggggacagttggcttttgctcctgatataaaatgctaccaacattgtgcatttctgtctgcagagaatgttattccaatgttatttccatttttttccaatgttatttccatttttttttctgactatacaggttaaaagcttctatagaggttaaaagatcattaactcttctttgtagcacctgggaaatccttttaaatcaatagcgtgccacctggctgctcaatttgcagcagctgaaaattcaccaaggcacatgagataggggataatcaaaaccgtgaatccccaatcttccaacaggagagttctctactccacaccaacagagagtgctaagtcctgtctatgccaagtgacagattttattcctaaggccagttgtttaattttagccccttccctcatctgatagaagactgtgctactttacatgtataaattcctgtgaattaagcagttgagcatttggctggagagaggttgggaggagattattttgtgtttgttgtattacatatccacagtaatgcttatctttgccttttgtggttttactagtagaatgccacgtgaacagaattttcaagagcaaaaaggtctttgtgcttttctaagtcattttttttttttttttttaaagattccatctctttaactttagttaggatggaatttgaactcctggctcttttgagtatagaaacccctagtaacaatttaagttccttccatttttcttttaaactccttattcccagcagcagtattctacattctaaccaggttctcccagctttgagacgtctcagacttaccagttctccaaaacgctattttctttaagggtgacaccttttaaaaattaggcacctcaaatatctactgcttttgagcttttgagttttgcactgtaaaaagaaaaatacacagtgggattttaagtcaaattagtttatctaatttttagggaataatttgaagcatgctttgtttgcatagatttttttaaaataagcttttccaaatcataaagagataagatcttaggtaacatgaagagactcccttacttattcctaaatcatctatattccaagggcattttcttatttggaacagttgacctcactgataaagctgtctcaccactataataacaatgtccaaaatctaggctttctgcactattatgcaaaaattacaataataaaagtgaaaattacattataatggtatattaaaatgctaagacttttgcattataagcaaaagacagcctttaataattattctttatttagtgaacattttctaagtcttggaaaagggtcaatgttttgaattcatggccttatataatcttcacaagattccccaggaggtatagatatttttattattacgctagtattgcagatgagggaagcaaggcagagtggtattaaatagctggcccaaggtcactcaggtaccaatggagaggcatcattagtctttgcatcccactaaagttctccactagcttcaattgcctcaagatctgttccatgttctatgaagtagtttcaacagaaatggcaattatcttagaagcaagggaaaaataaaagatgggcttcctgtcgggtgcctgtgacaggtgtcacatctaaccatggttttttagagcagttaatgccttgatagaacagatgaatgcctcttaatcctcctggaattcttgttttagattaagtcattgtatacagtcattcgattttcttcttatggtccaaatcgattaataagatgtctctttttgctttttcttccttttcttcatagtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagtgagtagttgctttgtccatccacttccgtgtttgtctcctcaagttccatgcatgcactcatgtgccaaggaagcatgtttggaagacacaggttcttccaaacatgaagcaaacaagagaatactgtttgactcgaagtaatattttgcatcatagaaaaatgatgggaaattttacttgttggacattgcttcatttcaagggttgtatgccaatacaactattaattacacataagattatggtgctaatttgatttttgaaattttctgtgaaaacaaatggataaagacttttggaaccaggtctatttaagagtattagagacacagaaaaacctcaaatctcttttaatcttcagtgttgaatgagatcagaggtgaacatttagactcaaaaacagcctccttcaacataaaccaaacatgcacatatcatagtacccatgcacacacttttgcgtcacacacatagcccaggtagcttgaacgttgctagaaatatgaaagaaaaaacagataatctgcttttagatcattaaaaatcaacttgaattgataaatgtttgattttcaaattctaatacgttttaattttcaaattttttaagttaaaatgtgcctaggaaatatctattatgctttgagattaggattagaatttataaacctttcatttattctttgtgtttaggagatgtgatgattattgacaattggttcatttttataggtgttgaccgttatgcctataaataagcctcctatagacatacagaaatcatatcctgtggaattagaatataagacttggtaaaagagattttcaaagtattttacttaacttgtatacttgaaatcatttaatccagactgaagttgtaaaagccagccagtgttttcaatatagacttccatgtttgaccatctgaaaatgaaaaacactaaaaacatcacatgctgtttaggagctggaaattttaatatttgacttcaagtagatggtttttaactcctgaaatcgaactacgtttaagtttgtatgtttattacctgtttgagcacttaggtgcaattgtgggagcggggatgtcaagttcatttatgtgactctttggctcaacttacataatctttgttttgatatcacagttgtctaattattttactttgtagcttaaggcaggctgaattgttgataaaatggaaaaagtagtatattgttatataagcttctgaggtgtgttttgttgtataagccctggaggttaaaaagtcatcccttatgtatagtagttaaaggcataaaactgtgacttttagatattccacagaaccagacttatttgatgtggataataaccaatgatttagcattttgtttgcttttgttttattttatccgggttcattttttactcttcccatgtacatgaaacaggtggtggcgtgtagagatcagctgatccttgttttatggttaattgaactactttgtatccagggtttctgcaaatccaaaagtgatttttcatctaggatctattcctaacagtctactccaatcccactttagttttccacaattttaaatcttaatagtgagaattcaaatgaaagtcatttcatttgactattctgatgacatgattgtggcagaataaattgggtcttaaaatgccctagaaaatggtaaatgataaaaaataatattttaaaattcaaccaaagaaatggcccattggccaggtgtggtggctcacacctgtaatcccagcacttttggaggctgaggcgggtggatcacctgagctcacgagtttgagaccagcctacccaacatggtaaaaccccatctctacaaaaaatacaaaaaaaaaaaaaaaaaaaaaaatagcactgtggggagtgcctgtaatcccagctactcaggaggctgaggcaggataactgcatgaacccaggagatggaggttacagtgagccgagattgcaccacttcactccagtctgggcgacagagaaagactttgtctcaaaaaaaaaaaaaaaaataaaaagtaaataaataaataaaataaatggcccattataggggtttttatctttaacttgctatttttccagatcatggttctgaagaccctgtgacacgtcccagttcacctactgtcttgtgagtcagaatatacaaataactttttggtcctgactttccccacccctacaggatggtgccatgacaatggtgtgaactacaagattggagagaagtgggaccgtcagggagaaaatggccagatgatgagctgcacatgtcttgggaacggaaaaggagaattcaagtgtgaccctcgtatgtcatcacagatcatttttagtgccttattaagcattctcactttcattatcaggctgtaactctcattcacagaaatgattggagactttaggtctccttgaggagtgaacagtgggtttcttaatcttttgatttgggaaagtggagacaagcttcaaaaatgagtcatgatttaatgttattacaggacactttagcacttgtccaacctgagtattttgaccattatctgcagtaaaatgctacaaagaagctttattggtctgtagattcaacttttaaaatatgatttccatcttcccgttggaccctttccagtgtattaggtctaatttttggaagtgccaccctaagatctgtatagcagtactgctcttagggatgattcacataaatatgtggtgtttgcgctgtgatgatacaaatttaggacagaaatagaacccacccctagatcaagtctgcagtattgttctcagcttatgcgtgcatctgtcttgtgtctatatgcagatgaggcaacgtgttatgatgatgggaagacataccacgtaggagaacagtggcagaaggaatatctcggtgccatttgctcctgcacatgctttggaggccagcgggtaagactggatgtgccaggctccctacaagttagataagataaagggtgggctcctgcaaggatgtgtcgtacacacaggaggggcagagacccttcggaagtattaaaataccacatttcctgttggcatacaactgctgacatagagctctagagcagctctatgtctaccttacatgccattcattctttctattactcttagtagaaagaatgaatgaatggcatgtagagtaccaaaaacacaagtcttgagtcattcttaatagcaacacctgtcatttatatgatgttagaatcattttcctaagctccctagcatgtcagagatactatttacactgaaaaatagtgaagcagagatactattcaaattaattagtggtaaatagaatgtgtttcatttcagccggttctccccatcctgggcagcctgagaccctcccctcccctactattctcaggctgcttctatttttcagcaaagtgttaagtgcagtgta

SEQ ID NO: 98582 - DNA, 2883 bp, Homo sapiens
tgacccagtctcttgagaactcactgtcataaagagggcaccaagccacaagggatctgcccccatgatccaaacacctctcaccaggccccacctccagcattggagattacaactcaacagagatttggacagggacaaatatccaaattatatcacagcacagtaaccattggaccaaatcaggcttagattctagtcttctgttatatcaataccttgatgtatgccttttcaaaagtcaggtaaagtgtcaaagttttatcatttataaaagagggatggcattgtacctgttgagagaaaatacaaaatacttgccgtaatattagacacacacacacacacacacacacacacactctctctctctctcacacacacatacacacacacacacacaaaattgttagctggccatgttattgtaactcctaccacacatatttttacattataatacattaataattttaatatttattgaagtatttgtagatactataaagccagccctgggaaccactggtagtatctataaagcttttcagctcttcaaaataaaatgtctgagaggtagatattttcctattttctaattacagttgacctttctctctgaatgccaaaggagataatctacacattactagttatatatttcttgaaatggatgaatttgatatataccaaggaaacgttttaaaataccaaaactttacatggatgagccaagcaggcactaatctctagctatgctcctgtgcagatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtcagggaactcattgcactaaccacatttgttaacaaatacccacaatgtaaacgggcttattaactgttctacgactgacactgataaaatttattttcagtgttatcatcataacccagttttagaacgttattttcatgctatgatcagaaatagttttgtcctttgaatgcctgattttgtgtaatatttgtcatggaaattgcgtaagtgtcaatcaacaagtttgatcttccatcattgtgccctttcttatttaaaaaattgtaacataaggtttaaaactaaaagaaataaaaaacagtgatgtatagatcttagcattaaaaagcatagttaatataaaagtaaacaataccacttaataaaggccaaaattgtaaccgaagaatattcaatatctgaggtcttttttagctttttaaaattgtgattccaaggctcaactattgaccatctgattacggtaaagagaaaacctcaataagtggctgacccccattctgcaagagggcctcttccaacatagcatttttgcattccagaatttactttaccagtgtccttgtctgtatcagtgattcactttcgagatatgtttcttgttaacagttaacatccatagcatgctctactttactgttcaaatgtggaccactttggtagtctatataaatatgggatgatagaagaacccagaaaaattgcaggctagcttgagaattctcctagtaaaaagcaagaactgttaaaaatcatctcttctcaaatcccaggtttacaaccaggcactgactacaagatctacctgtacaccttgaatgacaatgctcggagctcccctgtggtcatcgacgcctccactggtaactataccttctactgaggaaatgccattgacttgtatgcaatcagtttcatgaactcaaaaaacaaatgtgaggcgtatatttttgtattatagattccagagaatcttgtttccggtttacagtattctcagattcttttaagtgtgtttagaacggctcgggagaaaagtgtgggagtaattttcttggttatttgccttcttagagacttaattttgttttctttcagccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggtattgctgcttccatgctgtcattttccttcttactacctaggacacatgaagtccttagcaaactcccacagcgtctttgatactgtgtcatgagaatgcgaaactctgttcctgataacctcaaaaagcattctctgtgtaggagtggtagagcctaatacatcccaaaaggcatgagtgaaggaaaatgcaatttcaagactgtactaatggcatgactagactcatgttttcctttcgctgcaagtttgccagatacctgtcaattcagtcctggagaaagatatttttcaaagcatactagctgattgtgattctgtcattacactcagctctctatagatatggcaatcttgcaggacttgccagtgcaccacctgccattgaccttgttgaccactatcacaggataggtcttgaggcagagcagtcccaaccacccacattggaagaatgcctggaatggggaataagagttgtctaccttggtgggaaagactataagcctctagtattatttttgcccaagagatgaaatatttaaactatctgtattagtctgttttcatactgctataaagaggtttaattgactcacagttccgcatggctggggaggcctcagaaaatgtacaatcatggtggaagga

SEQ ID NO: 98583 - DNA, 5079 bp, Homo sapiens
cccttctggttttgtttatcattcacactaagaagagataaatggcctaactgactttttcagctctttttagctatgttgtctttgtttttaaatagaatacttgtgaaattaggatcttaaggcaatttattagagtcaagttaattttcattttttctgagagcagtatcactaattgttgggggcatcatattaagttttagatcttatccttgagtgtgacttcactcccatatggtaatttgtattagcaatgaacaggtttgtccaagaggaaatcaaagtctgactctccatatttttgttacaattctgcaaataaaaattctaggccaccatatgtttactaccaaactctagacgccacttgaggactttatagtggatgacgtggatgttgcatttgcttttcactccctttgcagatcaaacagaaatgactattgaaggcttgcagcccacagtggagtatgtggttagtgtctatgctcagaatccaagcggagagagtcagcctctggttcagactgcagtaaccagtacgtaaccactgcttggtttccattttcaaagtcaaattttgttcttgggtgtctgaatgcccacgacatgtcttttgcaattacacatagggaaagtgaacttgttggttagtttatgtcttgagctgagccctttacgaacatcttttttccttctcagtgccaagcgaggaatttacagagaaagaagttgtgaaaccaccatagttagttgctgtgctttgaatttcttttgctcaaatggcctcagcgaaatcttatttgcctatagcaaatctacaaaaaattttcctagaccgtcttttctacaactggatggtaaagttgattgaagtgtgcctcatgtagctttatgtttggggcatttgaagggctatggctggaccagagtgtaatataaatgcttaatagagaggggaaaagaagagtgtaagaaccattatagggctgggctcacgcctgtaatcccagcattttgggaggctgaggcaggcggatcacgaggtcaggagttcgagaccagcctgaccaacatggtgaaaccccatctctactaaaaatacaaaaattagccagtcgcggtggcacgtgcctgtaatcccagctactcaggaggctgaggcagaagaatcacttggacccaggaggcagaagttgcagtgagccaagatcatgcctctgcaccccagcctaggtgatagagtgagactccatctcaaaaaaaaacaaaacaaaacaattataacaatttgaatctgacattgcaaatcagctttaccacttccaaggtatagaaaatccaggtctatgagactaacatcacattgtaaaaatcaaatcgtggtagaatatctttaaattaatataaatacatccccattgtggggacattttgcagggtatctgcttatctcacatacacctatgttttaataagtgatgcaacattgcatattttctaaaccaagaaaaattaagcaagtgtttaagtgatttttccttttgatagtgggttaattggacttcatcaaagaaaatggtatctgcaaaactgctttgcatgttataaaaatgcttatttcacaacttgcttttcacataacctcttaccattaatttgcctaacagacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacaggtatatggttaattgcaccaccaggtgcccatgggagcagcggctttatgccctactgaatgaattatgcttcactgggctattgattcccgtgtaagggtgaaaaagaattattaggaaagatcctctttaaagaggaatggtaagaaacaataaaacttaggtgatatttaaggaaacaagtctgattaaaagaaattttggagtatcctggcttatacacaagaccataaagcaagacatttgaagaggatactaaagttgtggattatttcctaagctctgactccctgtgattaccctcactatgtataaagaaaagaagtttggcattacagagcttacttataaaaaggaacccaaactcgggcatttcatagcagcatgattctgagcacacgtgggtaagacctttcttctctggttagatatcatatgctggtgtataattagcttaaatgattgtgatttagacacctaggaaataatcaatagggcaattgctttccataatactttatcttcttgtgctttatttctgaagcagagtagaatgctaaagatgtatcctagtgacagcataaaccctagaggtgacagtctgtattattgcttttcgcttctcttttctgcttctgttgggagccagttttcttcttacgccgcattacagagagaacgtcaaatttagcagccatatctgccatagggtccaaataaagagacaataaaaacattattctctcttttttggatggaatactgcgtgaaatggttatccatacaaagatactttatgtagaatagaaaaaggaggccgggtgcagtggctcacacatgtaatcctagtgctttgggaggctaagccgggagcactgattgaggccaggagttcatgatcagcctgggcaatgaagtgagaccccgtctctacaaaaaaatatgaaaaaattagcgaggtgtggtgacacatgcctgtagtcccagctactcaagaggctgaggtagaggatcacttgagcctacgagttcaaggctgcagtgagctatgataactccactgcactgccgcctggatgacacagagagaccgtttctaaattaattaattaacaattttaagaaagaaaaagggccattgcttatttttccatacaaaagtaaaataaatcataatggccaataagccaatgtaacttttttttttaagggaaagcaaaacttgtaaaacctaaaatctcttagagttttggcatttacccaaatgttttcagtgattctgagaattggtggatataaaacacatttctcagcaaacactttcttcattttgcatcccttactgtacgtactttcttgtactgaatctttgcttgaccagggaacccacctagcccaacaagaacaatccattctacttcttggaactcactttattttccttttcccccatttcctataagataacctctaaccaatgacaatctcgacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtaagacatgaccgttgttcattggaataaagatggagatcatctctaacacagtttctaaggtggtgaaaatataatatcataataaatctaactgttcttttcctctgcatcaaataatcttattgtaattttatatcaacggaattcctttatgttgacctaagttttccagatgactattgggacagaattttataaatagctttggattttgtgcagctcttttagatgtattgtgcttattttaaaaggttgtggggggcaatttacatatccattggttgaatgcataaatcgacttagttatgcattttctgagctctgttaccttggtaaagaatattttacagtttgtaccagtctaccttgagcctaccctcattaaaacattttaaaatccttccagacatacatgcagaaaactgctaggaacctaggggactgatgtacctcttaacataaggccaatttcaggggaaactacagaaagagggttcagagacaaaatggaacattctctttgcctctctatgataaggaaaaaattatgatttacacctgtcagatcataaaaaagaaaaatacgctaatacccacttttctcattttttttaccagcttagtttaagtatataatctatggcttacttaagcttaaccgctaagagcattttaaaattgataaatacatttatcacctgcactgtaggaatgaaattaatctaggaattttcaaggttgtgggttttgctggtttgtttattttttattttctaaccattgcatttacctaatgctgtagtgaaactccttgggtttcagttgaggacgttgctaaagctcaccatgcccttatttctctaggtggccaccaaatatgaagtgagtgtctatgctcttaaggacactttgacaagcagaccagctcagggagttgtcaccactctggagagtaagtaacaaaatgtcttcatatggacaaaccttctgtatagacaaaaattaaagaatggtaaatcagtggggttcagtggctcatgtctaaaatccaagcactttgggaagctgaggcgggagcgtcacttgaggccaggagtttgagacctacccgggcaaatagcaaggccctgtctcttaaaaaaaataaaataaataaaataaataattttttagatttatatgttaacagtggaatgagtcctaatttgaaaatcaatttgattgcctttttgacgcatgactgtcatcttttatactccttcagaaaggggtctactgacccataaaatggaatcacttcataagcttataatgttgatattatggactatgactgacatctagtttatgctctacttgttagaatttgttttcatagagctaagcttggggagaccccactggcttctgctatatcttaacaatgcatattaggccattcttgcattacta

SEQ ID NO: 98584 - DNA, 1435 bp, Homo sapiens
gaagatgtgatttacatgctgctataaatgtggtaattcaattaatcagtaatacccaagtagctctaaacccctcacactctgaactaaccctttttcatacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacaggtacaaacttctactctggggtgacaccagcttttacttattcagatactgttttgcaatgttctcccaaggtatttttctaattgtagaatagattttcctttttaatgagcaacaacctgcagctagcacctgcagcgaacagagttttgagccagataaagaaggaagcaccccaagggcaggaagttcagtcagttttgtcgatatattccgcatgtctgcaatacgacaggcatagagagtgttcagtaagtatttgtgggaaaagaatggatgagttgataaagtaggaagagacacctgcttgtggaatgtagcttctttgtgaatgaagcaaccatctcaaaaataggaaatggtattgagatgcctgccccatccctctaaaagctctctctgtattctttcgagaagaaatacctttctcatgtaagcgatcattcgaatatgtaccagacctagagaggaggacttgtccaatcttgtctccaaggactggggcttcactggtttctccctgcttttatttgtagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccaggtaagaatcatctgcatctcggccaggtgcggtggctcactcctataatcccagaactttgggaggctgatgcgggcagatcacttgaggttaggagttcgagaccagcctggccaatatggcgaaaccccgtctgtactaaaaaatacaaaaaaattagctgggcatggtggcttgtgcctgtaatcccagctactcaggaggctgaggcaggagaatggcttgaagtctggaggcagaggttgcagtgagccaagatagccccactgcactccagcctgggtgacagagtgagagactccatctcagggaaaaaaaaaaaaaaagagtaatctgcatctcatatacaacaggatagatggggtaggaccacctaatattcttttttatataaatggctaccttgttgtgagtactatgtatttttttgtcctatgtcatcattgtccccattcatgagttcagggctcaag

SEQ ID NO: 98585 - DNA, 1186 bp, Homo sapiens
tttttttttttcttcctgaaatggagtcttgctctgtcgcccaggctggagtgcaatggtgggatcttggctcactgcaacctctgcctcccaggctcgagcaattctcttgcctcagcctcccaagtagctgggactacaggtgcccgccaccacgcccggctaatttttgtatttttagtagagatgggattttaccatgttggccaggctggttttgaactcctgacctcaaatgatccacccgcctcggcctcccaaagtgctgggattacaggcgtgagccaccacgcccggccttgtatcacttttttttttttttttttttttaacttttctgtagttttgaaatttttccaaataaaatgttgagggaaaaaaactcttccccaaatttgaaataatcattttatcacaatttgaatgggctctgtaaccccttatcttgaattcgtcataatataaaattctgctaattacacgtagtatttacatgattgtatggaagaatcattaagacaattatctggaaaatgaacaaacagtaaatctgaatattgtttgaaaattacggatgtgaaaagtttcccttttttttctagtttctgatgttccgagggacctggaagttgttgctgcgacccccaccagcctactgatcagctgggatgctcctgctgtcacagtgagatattacaggatcacttacggagagacaggtacagcagtaaaatgctattttacactctgattaaatcagattctgttgtggataacctgaaagcccaacagtgaacaaagaattaaagaaactttggcaagtccattcaacggagcccttgttttttccaagaaaatacgtaagatatagatgatataatttgttctaaaacccaaataaaaagttgtttatatactacaactagagggggaacggcagagctgaggaaataaaaggattgtaaattcacaaacatattatcagtggtggaaataagtgatttttattttttcttctctttacttttctgtattttccaaattttatttaaaaggaatgtattctgttaaaagttttaaaaaggacacaatgcatgcaatcctgggttgagggcttaccttctcccacttctaatgctactctactactcagtgacattttaaagctgaaatgttaaaacagcgc

SEQ ID NO: 98586 - DNA, 1340 bp, Homo sapiens
gttttgtgtttggcatcattaccactctgttgacatataaatttcctcttgagcttaggaggcttctctgagagtcaaacatttactttgagagtgggcagatcttgctttacttggaaggatacacttacaggatagaaacacagaatacttgaacactgaagaatttgaaaatgtcaattctcagaagatcttgaacacttatctccaaatgtgacacagaaacttactgtaataacccctaaaatctgcttgaattacttagcacaagaaaaaaatgaatgcttgagctggctattttgaattgagtcaatttaagattttaaaattcatatgtagcttagaatcagtacatcttactctttggtttatggcaaatcatggtattgatgagacaggaacgaaatgttggatgtacgttaatttcccctacaccttcctcacttcctaaactggtggtgtcttttcttttttttttctcttcctcccccgggtgggaaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacaggtaacttttcttgtctgcaaagaaactcagaagactttcctacccagttggtagattctgtaaagtagcttgctgttgtctgtcatcagctctcaaaaaaaaaaaaaaaaaaaaaaaaaatagatcattgtcatggtacatggagagggaagtgagaaaatgtggagaaacatcttccttagaatatggtaaagaagcccgggcgtggtggcagtaaagaagataatttttttcctctcaagaaatttctcacctgatttgggtatttatgcatttctaataacacaagttttgttgaaaatgtagaaaattggccggacggggtggctcacgtcagtaatctcagcactttgggaggccgaaatgggcagatcacttgaggtcagaagttcaagaccagcctggccaacatagtgaaaccccatctctactaaatatacaaaaattagcaaggtgtggtggcatgcacctgtaatcccagctactggggaggctgaggcaggagaatctttgaacctgggaggcgaaggttgcagtgagctgagatcaggccattgcactcca

SEQ ID NO: 98587 - DNA, 1226 bp, Homo sapiens
aaaatattctgctctcattttaatatggcagaaccgattgctttctaagtgtggcttttttccagtaaaggttaattattaagaccactagtcctggcctgggtcaatcccagtatgatcctgggcaagtaaattaaagaagataacttctctgtgcctcagtttttttttgttttgttttttgttttttcatttacaaaatggagataattgtagtaaatcaaatttttagaggtgataggtttgttcatttcttgaatgcggtgatggtctcccaagtcacacatatgtaaaaacccatcactttaaagatatgcagtacgttgtatgacaagaaattgcttttaaaaggagcaaactaccttccagggttgttgtgaggcataaatggcaatccacagcaccacagcaaggattatcatgtgccctccagagacatactctcaggtggatgcgagaaatatccagctgttgcagcaacttcatcccactcgaaatccagctgagtcacactcacaggtggaatggagggcttcgagaggccatggggcaaggtgacccttccttatcatctaattacagaccttctcaaggtctgttcactgaacacttcgctgtagtgttcacttaggtgtaagtaggctataggactggacatttggatatttcatcagttcaaatagtcctgggcgtgctttagtttctcatgcttttgagcagagttttaaaataagccccatttgcccctacagatctcctgcctggtacagaatatgtagtgagtgtctccagtgtctacgaacaacatgagagcacacctcttagaggaagacagaaaacaggtgagtggtgttggcagtatgactatccagtagcttttgcctatcaattctgtataacaaatgaaatgctacttctaaaaatacatctccattttttgttgtcatggtgtgtgtacctttgtcatcacagtatgattttatcgctggtctcaaaaactaaaagataccttactcaacaatcacctagactttcagtcactaacaaattaagaaatttgttgtctgtccttttaaaaaacattttctaagaagatctttgttatttagatttagcagacattccttttcattaggcagctctgtctaatggctgacccaacactcattgtcatctatttgtcttcctttactaagccagcaagtttacattttctttttacttaa

SEQ ID NO: 98588 - DNA, 4002 bp, Homo sapiens
gcaggtagaaaggaatattcctcagctgtcttcaaatgattcattaaggaaaagcagggtacagtgataggaccatgagatttggaaacaaagaaagctttggggaatcactcccctggttcaagatttcctttaaagtgaggatcttggcggaggttgaagtgagccaagatcacaccgctgcactccagcctgggtgatagagggagactgtctcaaaaaataaaaataaaaaaataaagtgaggatcttagtactgcctgaaaggattgttgcaagcattgaataacagtgacagtggagtcctcagtaaatgccaagtcctgcattccgccctgtgaatccatcattggagtctagttaaatatgctctggctcacagatcctctgtgcaataacttcccttttcttttttctccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccaggtaatagaaaaataagctgctatcctgagagtgacacttccaataagagtggggattagcatcttaatccccagatgcttaagggtgtcaactatatttgggatttaattccgatctcccagctgcactttccaaaaccaagaagtcaaagcagcgatttggacaaatgcttgctgttaacactgctttactgtctgtgcttcactgggatgctgtgtgttgcagcgagtatgtaatggagtggcagccatggctttaactctgtattgtctgctcacatggaagtatgactaaaacactgtcacgtgtctgtactcagtactgataggctcaaagtaatatggtaaatgcatcccatcagtacatttctgcccgattttacaatccatatcaatttccaacagctgcctataaaatagttttgtccctgtatgtgagcactgaaacagcatttggttgacacatctagtttttcatcttgcagtttcaaatccttctttttgaaaattggattttaaaaaaaagaagtaaaagtcacaccttcagggtgttctttcttgtggcttgaaagacaacattgcaaaggcctgtctaaggataggcttgtttgtccattgggttataacataatgaaagcattggacagatcgtgtccccctttggactcttcagtagaatgcttttactaacgctaattacatgttttgattatgaatgaactaaaatagtggcaatggccttaaccttaggcctgtctttcctcagcctgaatgtgcttttgaatggcacatttcacaccatacattcataatgcattagcgttatggccatgatgttgtcatgagttttgtatgggagaaaaaaaatcaatttatcacccatttattattttttaaccttcttcatgcaagcttattttctactaaaacagttttggaattattaaaagcattgctgatacttacttcagatattatgtctaggctctaagaatggttttgacatcctaaacagccatatgatttttaggaatctgaacagttcaaattgtaccctttaaggatgttttcaaaatgtaaaaaatatatatatatatatattccctaaaagaatattcctgtttattcttctagggaagcaaactgttcatgatgcttaggaagtcttttcagagaatttaaaacagattgcatattaccatcattgctttaacattccaccaattttactactagtaacctgatatacactgctttattttttcctctttttttccctctattttccttttgcctccccctccctttgctttgtaactcaatagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacgggtgaattttgaaaacttctgcgtttgagacatagatggtgttgcatgctgccaccagttactccggttaaatatggatgtttcatgggggaagtcagcaattggccaaagattcagatagggtggattggggggataaggaatcaaatgcatctgctaaactgattggagaaaaacacatgcaagtattcttcagtacactctcatttaaaccacaagtagatataaagctagagaaatacagatgtctgctctgttaaatataaaatagcaaatgttcattcaatttgaagacctagaatttttcgtcttaaataccaaacacgaataccaaattgcgtaagtaccaattaattataagaaatatatcaccaaaatgtaccatcatgatcttccttctaccctttgataaactctaccatgctccttctttgtagctaaaaacccatcaaaatttagggtagagtggatgggcattgttttgaggtaggagaaaagtaaacttgggagcattctaggttttgttgctgtcactaggtaaagaaacacctctttaaccacagtctggggacaagcatgcaacattttaaaggttctctgctgtgcatgggaaaagaaacatgctgagaaccaatttgcatgaacatgttcacttgtaagtagaattcactgaatggaactgtagctctagatatctcacatggggggaagtttaggaccctcttgtctttttgtctgtgtgcatgtatttctttgtaaagtactgctatgtttctctttgctgtgtggcaacttaagcctcttcggcctgggataaaataatctgcagtggtattaataatgtacataaagtcaacatatttgaaagtagattaaaattttttttaaatatatcaatgatggcaaaaaggttaaagggggcctaacagtactgtgtgtagtgttttatttttaacagtagtacactataacttaaaatagacttagattagactgtttgcatgattatgattctgtttcctttatgcatgaaatattgattttacctttccagctacttcgttagctttaattttaaaattacattaactgagtcttccttcttgttcgaaaccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaagtaagcagttgaatgtatctgttccataaatattaacctagagcatagcaaatgaattctaaattctcaagtaggaggagctaagagcaagagagctgcaaccaagctacaaactaaactctgaattcaatgcacagctccattaattttgaaagatgtaatgtttgttgctatcttaatatacttttgatatctacagctttaaaaaaatcatagtggaaaaacacctgcaggaaagttccatgacttcaaacaaattctgcttctaaataagcacgtaaaaataagtgaatatcaagagaaattatatgactaaatctaaatctttagagaaaaaaatgagaactgaaaatagtgtcaccatatgtgctttattctcatttttataaaaaaagtgtcagcagttgattgatttaggatttgaatacttagaaaagtgactgattgtttggtctagattagaatgttgttgtgaagagagtcagaagtttaa

SEQ ID NO: 98589 - DNA, 3627 bp, Homo sapiens
agttaagattaaggtttccctgtggatatctggattcatcttctttaaagtaatgatattagggaagcggtgaatacaaatgaatatgtttaaaagaattccattctttggcatttagtgtgaagagagaaatatttgttatcgctggaaatcatgactcaatccccttgatcgtttaaaaaaatacaccaaagataaagtttgtaaatggccatatttatgattatgctactcaaatatagaagaactttctgaagagtgccagtataccttttaattcccttaataatgtcatgctgactttcagaagccttatgatgtgtgaaggatctctctagagttgaacactattggataacagtgttacctaagtttttgaaatagaatcttaaaaggattttaaattatgggcatagttattctaattcttctcttgtaatgtatcatcctgcagttgaagctatgtacatatctcttcaaaaggtgtgtttttgcaatacagttgctacaggggctggtgcctttaaatggcaactaaaaggttaattgaatgtgaataactcgttaaagggagagctcagacattccttctagcacacacacagaaaaatagaaatgaactaccatgtgacccacagtccctgtatacgtctggtttgtaacaagagattctttatcaagcaaaacagtatgtaatgacatttctctggaaccttccattacaagccaccttaatgcagtttggaagatacctcccccacctgggggaatttccagctaaagtatataaaagagtccccaaatcatttcccaataaaagtacactgtgcagtttctgaagagtttacactatttaaagcataatcatagcctcacagcagtaacagtcctctggaaatatttgtccttggtgtttactttgcattccttcctctagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacacgtaagaagaattttttcccttttctattagtttttaaaactgttctacttttcgaaaaaagctagtgtcaatatcactttttacttatgagaatggcacaggggagatatcttatccttacttatattattaatgctattcctgaatttggagtagcaggttcaattcatgctttatattttatggcatcagaaatgttctttccatgtcaagaatatttatgaactggcaagatgaaaataatttcaatagtattgcaaaatcattaatcataaagaagtctttgtcagagaattactgctgtccatcatattttcataatgtaacctatatttttatgggagggagggagggagggaagaagcatggaagagagggaggtagggaaggaggaaagattacacaggtcaagagctttgtgtcagctttgacttttaaaatgttctttctgcatagcattgtctccaccaacaaacttgcatctggaggcaaaccctgacactggagtgctcacagtctcctgggagaggagcaccaccccaggtaagtttgggatggatcagagggcaagtatacaccataccttcccaagacaaagattttagaaactgtgtttctttcagagaaagaagggattcaaattacaaatgcttagctctccataaaaactatagcagtacatgatgtacatcatggagcagcctgcaggatgctttaatgcacgttgacttcaatcacaggaagcagaacaaccttacactagtctagggggacaagacagatcctcacacagctgtagggctgaagaaaagcactgtggaaggtggcttttgctgagtgcattaaaaattgccaaacaaatggttgaagtcatattacgtaatttcccttttgtgagttgttacagagcctaagtttattattccctgaagttttatgaatgttttgtcatgggttgcaccacaaatatttaagggtgatgaaaggcagaaataccttcattttacagaataagaaaactgagacttagaaaaaattggcctactcatagtcacacattttaaatgttacaaaactgggattgtaacttaagtttgtagactccttctcacacccaatgtcacatatttggaatgtaatttttttttaattatattctatgcaaactgaaaattctgattaaggggtttcctgaccatttttagagctttaaatgaagcatttgtctaaattccttgttcacatatatttgaaaattatttataaaatgctaaaatgtataaagatagttgttaacaatattcaaacagcatgacgtactatagcaataacaggaaattttagatacccattacttttgccaaaaccacatggaagtctcaacaaacctatggagaaaaatcttaaacaaaaataaaagttccaattaatgttgattgcattcttacctcatatacttgttaatttaagggatatgtttaggttattatttagctatttctaattttactgtaaaattcttgtgaaatttttgtttaaaaaaaagtattatatagttcttatctttgccggggcacagagctaaggctatcatctctaaatctgattaatgtatgcaaacacacagaatgaaactagctcagaatatctcttttaatctccctctgaagtagagtgattttggtaaagttttcattatctgcggaaacattgtttaagccaaagctatacaatttccagctgagttgctctgaatttgaaactttaagttgacaatcttcgtgcttgttagcagcaggatcattaatatctcgtctcaatggcccagcccacacatatggatgaccactagcaagtgtaatgatctcaatatttatttctcattcagttgggtttccttgtatttgccacattagtgtttaccctgttcctaatggcaaaatattctgtcatctccttgccttttataaagtttaatatactttctcattttaatctgtccccacagatctctagtcatcactgtttttatttgaatgtctctcatccctctcaactcttttactgcccaatttctgtgattcctgaagacttcaacaatcaatactctctttttttgtttgttttgttttttttttttgagacagagtctcactctgtcacccaggcttggagtgcagtggcgccatctcaactcactgcaacctccgtctcctgggctcaagcgattctcgtgcctcagcctccccaagtagctgggactacagacatgcgccaccaagcccagctattttttagatttttagtagagacagggttttaccgtgttggccaggctggtctcgaactcccaacctcaggtgatctgcctgcctcaacctcccaatcaatactctttctagaataagtatcagcacttttgtttctcaccttttctcctttcttggttctcttcctataaatcccatagtttcagaccttttaaattaggagagctctctggggaatgtgcttaaggtgg

SEQ ID NO: 98590 - DNA, 1180 bp, Homo sapiens
tcctgacctcaagtgatccacccacctcggcttcccaaagtgctgggattacagtcatgagccaccgatccccgcccagcataaagctgtttttagatcaccttctataatttaccattgttcttaaattaatggttaagaaacaatatgataatcagtttgtggtggccagttttacattttataagggattttacactgacgatatagggaaatttattgtcatcaaagtcaaatcccaacaatcataaaaagacatgaattagattatataatttcaatgaaaggaccaccttagcaaacatctaaccccttgttactcaggtatcattcacgggccagcagaattggtattatctgtgtttgtcagaaatgcaaactccctagttttttgttggacctccagaaacagaatctgcattttagccagaccccagatgatgtgtgtggcacattaaagattgagaagcctgatcctctcccaattctcacccaatgaaaaaatatgttacatcctctatccactgcttggttaaactgaggttctccataaaaatacttgttatctatatgctatgcaatcatctgtgagtttgagttttgaatatgtgcattgattctctctcacagtgcagcctgggagctctattccaccttacaacaccgaggtgactgagaccaccattgtgatcacatggacgcctgctccaagaattggttttaaggtaaactgcagatgttcctaatctctgtgatacagccctgagctgtccttgtggttcccatgtagtggaaacagggtgctcaggagtcaggagacctgggttttgtcacctgcttctgtccatacatctttgactacattgtcagggcctaacagtccttccctgcctacctcactgaattgttggaagggtagatggaggctgcgaaagtgttttgcaaaggataaaacattagcacgaagctgctgcttattgttatcttattttctctatcctttcctgcagggaattacatttcaaaaaaacatgggaaaactttatttgatgtgttgttctaaatgagtgtgaacaagttcacaaaagccagtttagggagaccagttaaactcagagtcacttaaaaatcgcattttcatccaatcagtttcatctccaactgttcaaagcactgaggg

SEQ ID NO: 98591 - DNA, 3029 bp, Homo sapiens
cttatgtgattctgatagtgcaaactcaccagtatcctaccatgaatctgaggatacgttatcattactgtaattactgtctaatctgaaccatgtgaaaataacttttatttctctagcaaagggctattcacagaatattgcttttgacccatagagagcttcttcttgctgtcattttaggaggcatatccctttttccttaatctgtttggctcagagctaactgtgaacttcagaagtgtttgttttgcctttttaaaaataccattgctttaatgtaactataatttctgagactgatgcgaaagtcttgctggaaaattagacttcccaaaggatcacagtcaagcaaaatggttccacaatttctcatgactggcagagttttggcaaagttttgtgtagcactcaatctcttactggctcagtttttccagggttttgactttcacatagttacaaccttgaggagagaaaacttagacattcaatcaagtttcaggacttgagttatgatcattactgatctaaatatttcttggcatgtttcatcttttttcctagaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacacgtaagctgaaaattaagtgccttttcttaactatatttacattctctattcttcatgctttaaaacaaaacaaaacaaaacaaaaaaaacattaaaaaattagtacataatttaaatcagtgatactaaaaatgtgctccatagactggctgctggcccgttaattgtttgctgctagtctgcaacaagaaaaacggttgtgccagaacgtaaatcacaaagcacactgcttagtacagctgagaatttttctgaagccagattttcttgatgaaggaagcagtgtgttaatttgcacacattgccaagctcgctctttcctctagggccagcactttgagtaacatgggtttaaagcagtctgttattagaaaaattaaattcgattacattaaatgaatttaccaaacactagttaacgcaagaaaaaattagcacctatgtctacattctattactttgggcattgaatagtaactataaatgcagaataaaaatatctatggattgaatgggaaccaactaattgaacatgaagccaaggaaatgatttctttatgagtgttggctgcagaagattaaagtacttttgcagacggaatcgctcttttcttaaattactcttgaaattcctcagaggagaaaaatactaacaataatttttggtcatgtctatccttttgctcaacattttaaaggaagtggtcttaaatctcccacatatctacatcacaataacaacctctattcacaaaccgattcctattaaatacatttccatttacattacagagaattatgagactccttatttctagctgaacatcatttgttattttcaactcgacattttgaattatagaagcacctaacataagtactttttcagcatatattctaaccatggactagtttgcaattttctaagagctttcaacaaatgttactcttcgactaatttaaaagtatggatgttaaaaagcattcaaaaagtccatacaagcctagtttgtaaataactatggaattgatttcccaaagaaaatacaaacttttccccataagaattcatactttaagaaaaacttacttccatttaaatttactgtatgaagtttggctcatgaaggctttttcctaaataatagttaatcgtaagcaagtaaaattcacttttaatttgcaaataagcttacttgaaaatttggctaaaattttacacggttctaagatagtctaagatctactctcatgaaattaatgtctttatatttcttgtaaatattcatttcttataaatgtccttcagtgaattagaatggagatttcagtgaatgcgccctttcagtagatgtcgtcttttactaaaatgtagaattctatagttgtcttgttcattccttaacatgagacatattttatgtagtttcttttgttgaacacagtgcttataaaagaaaaagcatttttaatgatgctaacaataattaagggaaggtggtgggccaagatatttcaagtacttctgaagactgatatattggatatattattttatgctttgcataatacattcatataaaatataatgattttaactgaagtactgatagccaaaactaattttattagataaaggttaacatagtgtctggaacattgtatgctttcaaaaactatttggtgaatagataattgagaaaggaataataataaaaacagctaaatgaagcttatatttaaataaactaatgtaagcagggtattctacaactccatttgaactttaagcactccctaaggctgtaaacatccacaaggcttgcatgtttttgaaattactaaatttctgtagttttttactatcttactaagctgaattctgggagtaacttttctgagttttataacttgtgctaaattcttaagagcaaatgtgagaaaagttaggggaaaaagctgtttctggggaaaattcagcttagtcttatattgatagggcaaattttatttctttaacagctgggctgttcttccctaacaagacctgccagaacccatagctcacacttagaatcacatcctttgtttgacatcgtttgtgggtttgtggtttggtgattttcccataatggccttcccaggcagagagcatcatcttaaacttgggaagactctaggtggctggctcaagc

SEQ ID NO: 98592 - DNA, 3348 bp, Homo sapiens
agacaagaagtggtgttttcccatagtacattaataatcacagattaggtgggtgcggtggctaactcctataatctcagcacttcgggaagctgaggctggtggatcacttgaggccaggagttcgagatcagcctggccaacatggtgaacctccatctctaataaaaatgcaaaaaaaatagccgggtgtggtggtgtgcacctgtaatcccagctactcgggaggccgaggcagaagaattgcttgaaccggaaaggtagaggatgcagtgagctgaaattgtgccactgcactccagcctgggcaacacagcaagactctgtgtaaaaataataataataatcactgattagctattagcacattaccttctagtcgcttttccctatgaatatataattcttaaaatatccttcttataagctgtagagtcatttgagggactagtttgctctgattagttaccttttcttttcatttcaaagatcttccaagcacagccacttctgtgaacatccctgacctgcttcctggccgaaaatacattgtaaatgtctatcagatatctgaggatggggagcagagtttgatcctgtctacttcacaaacaacaggtacatgtgtgctacatagtgttaaaagaatctttttctgtaaaacacaggcctgtagtagcacttcctgactgtttgccccactttctttctttcttagcgcctgatgcccctcctgacacgactgtggaccaagttgatgacacctcaattgttgttcgctggagcagaccccaggctcccatcacaggtcagctaagcgtccccctctttggctgctatgttaatcttaatgacatcagcagggagggcgcagattctgactgcggacctgcatatcactttaaatctccaatataatttatgggagaggggtttgtgtgtgtgtgtgtgtgtgtgtgtggcgggggtgggggagttattttctatggcacatttccccttgaaaccatttcaccaactcccttatacacacacaccacaacatacacacaacctgtaaagccagctcattggcttattaaagcaagtgttcccagggttgaagaggtgtaatttcctgaaaacgttgctctaagatttatccttaaggagaaagctgagctgtcgtcttagctcattaggtgattcaactgcctcatcactgaagttccaaaaagacacacacagtgctagacaactctgcttaggctggttcattaattgcttccctcgtctggagctcaaagaggaaaaatcagcttaacatgaatattttcacctaatggcatctctaattgacatttattaaggatgtcaggtcttcaaggatgacatttattattaaaaaggttcgcatgactgttcttattttatcttcgtgctgaatagtcattattagaagaagtggcaatattcaaagagtcaaaaagtatcactggctcttcactaatcaagcaagatgctaagggatattagaaaagggaggatttatggtgtttctaagcctctgtctcaaagaaaacagtgcatcttacttttgctcatgaatctgcagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcaggtaacttttttaagaagacacttcctatgttatcttatcaggattgttcctgaaggagggttgttttgtctctgtcaacagtcctctcattcaagaaatcttatatattagtttttccctaaacttctgatatttagctgaaatgtcataagtaacttatcaaagctggctactggcctttctgattaaaaactgacaccataacgtccatctacaaattttcccctagaagcttaagggtcatttcatttttgattcttaagtattataaaatgattcagtaaaacaaaaactgttacattattttctgcagttatttcaaaggctttttctaaaaaattttttagtatcttttcttataaccctctccccccaccaccatatgacacttcatatgctggtaactcacttattacctattttagataaaaggttcaaatgtcataatttaagcactatgactggaccatgaaaatgtgatctgattaagagacaaaacttagcaaaactctcgaatgagaggctcaatgaactgcctaacatatccaagaaactggcttcttaaaagtaatcttcagcagagaatgtgaatgaccagttgactcttgtctgtcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccagtatgtcttctcctatctctatctcccctccaaattctccaccctcacttgcagcctgtgagaaagtgcagtaaaccattcactcagaggtgtatggcttagagagagggaaatacccagccggcaagggaatgcatagtgaacacaaagcacattaaacttgaaaacaaaactcagacaagctccatggatgctaagtggtaacccatttctaaaatacatgtaccagctgaagggtactaagaggggagaactgaagagaatctaatttgagtgcatttttcgtgtaactaaatatatctagatcaaagttaaaatgcaggatcataacacttagagtagaattcatttaacaatagcaattgtcaagtgtctagtattactagccaccagcttatctgctcagtttttacaagcattattctcatatttactctttgttttgaccttaggaaggaaggtcttattattattattttatttatttatttttttgagatggagtctcgctctgtcgccagggctggagtacagtggcaccatctcagctcactggaacctctaccacctgggttcaagcaattctcctgcctcagcctcccgagtagctgggactacaggcgtgtgccaccatgccctgctaatttttgtgtttttagtagaaatgggt

SEQ ID NO: 98593 - DNA, 1504 bp, Homo sapiens
aacaagagcaaaactctgtctcaaaaaaaaaaaaaaaaagtgaaggtgcccagtgtctgcaactatgtcaccccgggcatatcacatatcactctgtttttccgtctgtaaaacgggagcaacaatgccattgccttatcatcagaaggatatggagactaaatgggagaatgtaggtaaacagcacagagtatgggtatcagtaagtaaactgcagcagtttgttgatgttaacaatagttagcattatatctaactatatctaacgatataaccattgggaatccagttttccatgattttcctctagaatggagctgcctaagtcctgcttaagtcatttttctttgaagattactgaacatcatcttcaaatgttcatccttgtaaacacgtgtgtgtgtgtgtgtgtgtgttaatttaaattttcagaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagtatgtacacaaccaccctcatgcctcctacccccgaggttcctagagctaggctctcctgaggcaatgctttccttctcaattcatattcttccaggaggggcaccaacgttttttaaaatgatgttggcgacgaggacggtaaattttctagatgactgaaggctgactttcccctttctgtgactctctaggcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctgggtaagctcaatatgtcgctcaagacaggttcagggcagctgctggaaaactctccttgtgggggtgggtggcctctaggcaggtggtatctgtggtttggaactggttgacagctcagactgaacaaaccaccctctggcatgaggaagggaaggactgactctttctaagaagtggccgggtttttcccaagccactgtcacatgttcctggtccctgatgccagctgcatcatgcgcctacctgtgcacaagttcctacagcaaaagctgtgttcttggtggaagtaattaccaggactgcagctgacaatgtgagcacagtacggtcactcatacttttcaaattgttatggtgaggggcctttaaaaaacttcattggcgcactgaagtgtgtgccatcgtaagcactgagttcagtgaatttgaattcttataaagtgaacacaccacaagaccagcacccagatcaaggaaaagaatatctctctaccctcaccccatcatcttccgccaataa

SEQ ID NO: 98594 - DNA, 2823 bp, Homo sapiens
tttaaaaatgtgtttacatttgtaaggatcttcataaacagaaggggtaattcaaagataggcatggaattgacttatgccaattgattaaaacaaacatcctgtgtgttctgtgaaatacatacaactttaaaatgaaaaactcataattttatgcatgaattttggtgttcatgtggcttggaaatatgtgcattaaatggaattaagattcaaagtatttgctaatcttcaaccaactttgaattgttactggtgtggaagtgagcatattgttttagaatttctgaatctacatggatatccaagttatatattttttctgctacagaaagctttgttttccaagagaatttaatggcttagataataaagtttgaaaatcaatgtattttttttcctagaagctttcagaaaacttaaatctgttaataatctggtgaagtgctttattacacatacaaaattttgctctgtttgacagagtgtcagttagaaattcttgaaaaggttactataagacacaatttttatttctagtaatttaaacattgactgacatcataaagatagtgttttaagaaaagatagttttctgttctgcaagcataaattttctagctatttcattattatcttaaatggagttaacactacttagaaattgatgctacttcccttattttccttttattttaaacaaaagaaccaaaaccatactttaaattttgttgataacagtgatatacatcaaggtgtagaaatactgaatttagtatacacttcataaagtcatttctgttgacaactgattttggaaaaaaaataaatttaatcacttaataatttgatggatcaatggtgtgatttgggagtaaacttcttgaataaaaataaaacttgatgttttttccaaactgatagactgcttagactgatgagaaataaaactaggtctttaattattacctttgctatttgtctaagattctacccccatttagaaatgtgtttgttttacatcatctcatatggcctttggaatgttgtttccttcttaggtagtagattcattcttgatgaaaaccttccaaaattagaatttgctttaaaagaggctcaatacaataagtaaatgaagtctgtgttctgtattacattatttttgtaggatcgtttcacaattttctcacaattcttactttgatagtagagaaaataaaagcaagccaagagacttttttttaaaaatatattttatttgctataaacaactatgatttgcatttctcatgtgaagaataataattatcggctaaaaatggatttgctgcattgattttcaacgtaaatatttaaaagattaatgccagataattttattatactcacatttaacgacaagcaaagctgtttataatgatgactgtccatgtacacagttttaagttgaagtgagtgaatattcaagataattaaatgctacattttcattttcaggctcaagtggtcctgtcgaagtatttatcactgagactccgagtcagcccaactcccaccccatccagtggaatgcaccacagccatctcacatttccaagtacattctcaggtggagacctgtgagtatcccacccagaaaccttggatactgagtctcctaatcttatcaattctgatggtttctttttttcccagcttttgagccaacaactctgattaactattcctatagcatttactatatttgtttagtgaacaaacaatatgtggtcaattaaattgacttgtagactgaggggattttggttttggttttgggttttgtttttttgcggtgggggggctggtatttggaagaatttagctctttatgttacagaaatcttttttgcaaggacttagaaatgataatgcttaagattgttcttgcccaatgtgggaagagaatctaaggtttttatatgtcttgcaacctcatcaaaggaaaattactggcatcattttcataatttgaaaaaaaaagccaaattaatatatttcttttttgattcactttttaagtgatcatttttaaaactttacttttgacccactgaatttatttagatagaaggaaaagagatgatgggagggaagtttagataaaggatggaagttggttttatttaaacaatagccctgtgatttcctaatgagaagtgactagaaattgaagaaaccaaataaggaggatattggtcaatttagctttagtttctcttactctctcaagcctgccctgtttaactccaaagttcatggctcataatttgagaaacactgttttaaacacaggagaaaaaaatgtccattttaaatcatagctattgaattctacaattacaaagaaacaaacaaacaaaatttgaccaacccaggcggttaaatttaaactcttcaggaaaaatttaagctgttaaaattattctttttctaaatttctaaagtggagggacagaatttttcagatttaaaagggcctcctaggtgcccagaaaattagtggaaagaaccacgtctagacgcatctttgatgtgtcagagttccaaggataaaaagaaacttttaaagtcttctatactcagccaggttatcaatcaaatatgagggcaaaataatattttcagacagattttaggcagtttatcttccatatatccttttctttaagggtatttgtagatacactccagaaaaacaagagtgaaatatgaaggaagttgtggggtccagcaaacagtgcttccaaatcagacccctgatagaggtggaaaactttg

SEQ ID NO: 98595 - DNA, 1700 bp, Homo sapiens
acatcatgcctagctgtaggtgtaattagttcatttggggggaaaattgcatttaaatattcactgagtgattataataaaacatgttaataaaacatgaaaggctaattaaaaggcatcagttatttgagcaactgctgaggtgcaaagtctccaaagtcttcactaacgtttgactgaaaatatggcctacattcagaaacaaaagagtttcagggtgtcagaatctgcatgcgacagaaattaagattaactctgtgataaaagattcactgtgacagagaacaagctatgggaacaacttggccaaaggtagtgttagccaagcctcattcctccatttcctcatctgtaatatgggaagattgtagctgattacctttaatgttccatcctaaatactaaacacccagatgcaccttttctaggaacttggaagattctgcttttcccaaccctcagacactgtcagtgctggggaaggtgacttcacttttgaaggcttatagcacagattgaccaacctcctaaattgtatttcttggaggatttaggtgtaggaatcacttaattttttgtaacttaatatatatttaaatctgattgtggaagtactataagtatatgaatggtttgtttgtttatatgatgcaaatgatacttaaatggtagaaacttctaaaaaaatgctctgtggtttctatatttatgattgttattggtgttgcaatttgctgaaaatgatttccttctgaatgattgagagagatcttcgtctctctcaacataaggctgtccacatagctgcttgctggaagcatttaggtggacatgttggagataaaatctggaaaggaaggaatccttgagtattggagtattacatgttgaccttactcctactctttaaaaaggagaacagcaagatcccactgagcatagaggtgatttcggagggaagagattggaatttgacctcagatatgctctttggtgcttatctgtatgtctggtttgctccgtggcctagcacgtagggctttaagagtgtggtgagaataagggaacagcagattaccaacagattgtctctgagtcctgccttgtttgttcctcctacagagaacttggtagagttgttcaaactagcaaaagataagaggcatttggtttgtcaataagcaactagaaaagcacagatctcagcaaaataaatagagaaaaaaaggactgagtcaaaaaatcataaatgtttaacttctccaaggacactactattggaaattattcatttagactttatttgaaactaattttaaaagtgtagacattgtactatctcctttttttggtatcatctcaactattttattgttagtttattcatattgaataagagagggagtaaagatttcacaatggcgatagctagtatatgccaattaagttaatttaaaaagttataccaactaccagtagcgaaaaaggactgtcaaaagtttaaatctaaataatgtaaaagatgtcataatttttaacttttctgtctttaaaggatacatagtataagctagagtaattatacgtagtataagctagaatataggaatttaattgatctaagaaataactgacacaaagtctctttacttcctgaacaaaaacatgctaaattccatgctgttcagtccatttccttt

SEQ ID NO: 98596 - DNA, 6914 bp, Homo sapiens
ggagtttgaggtcaggagtttgccaacatggcaaaaccccgtctctactaaaaaatacaaaaaaaatcagctgggcatggtggtgcgtgcctgtaattgcagctacttgggaggttgaggcaggagaatagcttgaacccaggaggcagaggttgcagtgagccgagaccgcgccactgcactccagcctgggcaacagagtgagaccccatctcaaaaacaacccaaaaaaccaaaaaacaaacaaacaaaaagaaatataatcccagtagccccagctgagctggaggatggagaccacttggtagacacttgtggattatttcctaggctaaatgcaaaagctactgctgaataagggacatttttttccagtcccaggccagtagcgacatagatttcagagtgatctctgtgagatcctgaagatcctgactgcagaaagtagtgaattgtcttctctcacccagttttgtgacattcccttttcatgccattaggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacaggtatgcattatctttttgaagaataggactgatgactttattatttagtttttgaaggacaatacattttcaatgtgaaacaataaaacaaacaagaagcctgtaatcttaccaccctgtgataacaattagggttggcatttgaaatagtttcttccaatctttttaatttatgtattttctttctggtcatggatatcatgggtaaaaattttattgtatttatctgtctaaagtgttgttacaagagagctactttctgaataatcatcaatgttttatattctaaatctcaaatttcagcagctttgtgatgtaaacatcttccaataacctaatatatgtattctgcactacaaacatggtagtcactatggcaataacaattgctacacaattctcccccagaatagtctcatatattaattttatggcatagatatagtcataaatattatcccaacatccttaagcagcatccttaattgacctgtataaatatagctttacaaatagagaaactgaggcatggcagcagaagtggtcatgaaggacatcagcagaagaactcaggtgtcgttctatccacagtagacatggattcctgagtaatgcattttgactgaaattaacgagatgatcatctatactcatagcttcttcctttgagggcacaagctcagtatctcattgaagccataaataagcagctgctggtgggagataaagcatctctgtttactgacactcttttgattatgattgtagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactggtgagtgtcccaagggggagccacagaagtgagaaaaactcactttcatgccctagttttatttgccagcattctagccatttattttgaacccgcccaagaagcatcgcttttgttcagtttggactcaagagatcgcagcgctcacgtaacagctgaggattcttccatcttccccagtactgttgggaaatgacaccaagggagtagccttccagttcatttgatttaacacattgggattatgatgtgattaaagatacttgtattttggaatcagtagatgatcccacagggctgaggaatacaaaggatgaatgttttagtgccttagcttattttccagttaaaacaatgttttattcaaagctatcatttaatcttttgtggggggggtgctggggaaatgacagtgaaagtgggatttaaacctgttttgaaggtgtgaaggtaaatatgctaagaagcttagaactatattatcagacattttttattctgagatagactgtctgtgaatgagctgcagaaacctggctctctcagaccagtaattctgtgtacattggaaagctcagcggtaatcttttccttctttgttgtgtattgttcctggcagttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctggtaagatgaagcccttgtgggttgtcttgtttgacaacaatttagggagtagagactaaagactagtgtccagtttactcccatttcattcattaacacaattttgagacaacagaaaacttcatgtgaagtgtgtttgtgtgtgtgtgtgtgtgtgtgtgtgtgtgtgatgttacatcatatacataaggattgggaagaataattagataattatttatataatttttaaacctcattgacatgatttaatgtcaaaaatataattacttatttgtaagtctggaaatatgaatttgcacaggtttgtctttgtaaagagcacacaactgagtagcttacaacatttaatatatgtatgacggctttagtcacagagctacaatattgacacatggttgtggtttgatgggcataagctctatcacttattaataagtgccaaagtgactaaaactcaatgttttctaacaggtagggaatctcactctttttttaaaggtccccagtttgtatagatggcgaacaaatggaaacgaataccttttacttgttttcagatttcaagaaccccatagattccctttaattttccagttgtagaaacaagagcctgggcggtaggcactgtcaagtgtgactatgagacaaagaaattgcttatacttttatttctttcaacaaaagaagatgctgagtttagaagaaaaaacccacttttgcttgtaattctatatccaaacccatagtttttatttgatccagaataaactggaactgggaaaagttatgaagctgtagttaaatccaggcttctagaacagcaagaaccctttgtgtggatgtgtagatattatcttagtttaacatcccctaacccttcctgtaactattttctatgacacgtttggactacgttttctgcctccagggctcaaaaattctaccccttcacctgacagcacttagatgtctttgatgcacacaaagcttcttcccaagtgagaattcttaggatgaccaaactgaactgatccttttgcacacatacatgtttagacctggtgatcatttatcaagtgcatttcttatccatttccaaacagcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgaggtatgctggctgattaacaaaaatatttgagatggcaaaaggtacagaaagggacacttttttttatgaaaacttgcactatgccaaaagcaggggaagaaatatggaatgccacgtcattcattagtctactgtgcatggtaagataagcctgaaaggcttagcaggcagcctgctaagacaagcggcatagcaatgctaatgttctgaaacactcctagcatgtaagtacttaggctgagccaaaaagatggcttcaaaagtaagaatgaaacatttgatccattcagctttaggctatgccactggattcatgtctagaaaagataggataatttctgtaaagaaatgaagaccttgctattctaaaatcagatccttacagatccagatttcaggaaacaaatacataggggactaactttccttgttcagattagtttttctcctttgcacccagctatataatatgaggaagtattgactttttaaaagtgttttagttttccatttctttgatatgaaaagtaatatttcgggagaaccctgagctattaataatctatgtggctagtgcgtagatattggtctgaatttgttctccttttgtggtgtccagtgggtaacaccatccgggagtaataattacatgtggtgttgcagaactgaaagagaccttaataacacatagagacctcactctatatagatcaaggagctgagacccaaaaaggaaaaagtaattttctcaggatctctcaaagagtgagcaacagagttggcctaatttattttagcgttgtgaatactgttgacattttatttcccaaatctaagtatctcctccccttccccctattccagagaccagaccaccacatcatgctgggtgttagataaatatgtttaatcttcttcttatttatcctaacaagcagatatttaaaggaaattatcaactaagcaagaaattttcagaaagtaagacatgtatttgttcaaatactggcttctcacaggaaagtgtattttaccacattctttacttgagcatactgtaacctctgcaaaagttacacattttgggaagaaaaaaatttttttggcaaaaattgtattactgaccaaactttgaaaaaaatgttattctatgcttgtagaaaagttattttagtggaaggtgttgataattaagtggaagtagttgtatgctttgagaagcataccttttttctttcatcaatggaactttaaaaagtttctcactcacccacctgtttcctaaacagatcagtgcattgttgatgacatcacttacaatgtgaacgacacattccacaagcgtcatgaagaggggcacatgctgaactgtacatgcttcggtcagggtcggggcaggtggaagtgtgatcccgtcggtgagtagccctatttccctagatgagtttgcacagggggaatggttagcaagtttcagataagaaaagctatgtgaaatcacatgactgaagttggctccagactttgatcagttgcttgcaaagaactttgcaaagtcttctctctaatactggaccaaaatatctcgatattggtagtcgtctggtttttgctgaatttggtgacaaatttaggcttattttaattgaatggaatttattcttgggtttagaatcataaagataatccatgctattaaaagtattctttccttttttttttgtttgtttttgtttttgtttttgtttttttgagagagagtttcgctcttgttgcccaggctggagtgtatggcacaatctcggctcactgcaacctctgcttcctgggttcaagcaattctgctgcctcagcctcctgagtagctgggattacaggcatgcgccaccaggcccagctaattttgtatctttagtagagatggggtttctccatgtgggtcaggctggtctcaaactcacttccttaccagctgtgtaacagcatgagcaaagggtgtaaatatcacccaccaaaacactctaggtttttttttggccgcccttcaaaatagaactaagcaaatagtgaaggctgagccttaaaagagctgtgttaccagcactacaaagtttaaggtgatccattactatttctttaccaaaagagacaggttgctcactgagaaaacaaactgataacatccgtttgtttgacgtgagattaccagaactgagagagaagcctgagaggttttcttagaagctgctcagcaggtatactcgtaaagtctagttcattcatttaaatgtcaaacagtttctttaaattttgaagaagtaaggaaaatgaaattattgcagatttttttcttgctatttaaatgttaagccagttatattaatatgggtaaaaataataactaatatttaaaattaatgtgtagattatcaatatacactgaaatctaaatctttacatttttatttagaaatattaccttttagaaaactaaatattcctcctaataggtactttggttttttttttactacaaactgtcctgtaaggtaaagaatgtgaacaaaatatttttttaactgcatatatttgtaagaacaattgcaaatttctatttaagctaaatgtatgctctagcaccctgaaattaaattcgtagttataagtcttcaaggctgtttatcttttccttccatgtattttagaccaatgccaggattcagagactgggacgttttatcaaattggagattcatgggagaagtatgtgcatggtgtcagataccagtgctactgctatggccgtggcattggggagtggcattgccaacctttacagacctatccaagtaagtagctctattactgcaagttgagaactgccaattgggttataacaacagggcagtgattattaatgctctcatgcctaagttgggggtctcccctctttcccacccttttctcttgttattatctaataatcaattgaatttttgattaaaataatttttctctcttcctctatcaagtaaaaggtagagaaggctatgaaaatgtgcctgtttataattttacttcttaactctgtaaaatattctgttaggttaagacactctggctaatttcatcttatatccatacatggaaataaaaaccaccaagtgagttatgctgggagtaaaggtttggggctttatattatgattcttaacagag

SEQ ID NO: 98597 - DNA, 1053 bp, Homo sapiens
cgtagtgtctcagccatccttcaattaaaaatattaattgttctaatttttcttcttttgatgagtttttgtcttgctttgagcacttatgaaggtgaacaagattagatttgataatatctttgagttattttattatcattaataaaattgctactggccaaaaaaaattataaacatcggccacgcgcggtggctcacgcctgtaatcccagcactttgggaggccgaggcaggcggatcacgaggtcaggagatcaagaccatcctggctaacacggtgaaaccccatctctactaaaaatacaaaaaattaaccaggcgttgtggcgggcgcctgtagtcccagctactcgggaggctgaggcaggagaatggcatgaacccgggaggtggagtttgcagtgacccgagatcgcaccactgcactccagcctgggtgatacagcgagaccccatctcaaaaaaataaaataaaataaaaaataaaaaaaattataaatgtcagtctaccaaaatagattaaaagtgtaggtgggaattaaatggggataaacactcaataaatgttagctatatatgaatattgccaatactgaaaagattccattgttcaaaaaagtttgagaagcaatgggttaaacaaaatggaacctgctctgcagaatctgtgtgttcctttacatcatactctccatggtagagtgtaggggatgggcgccatgtctccctagtacgtttgaccttgggattctttgtctgtgaacatctttgggttctagtgttcagcagcacttagggaggcactgaattcagtgtacctttggtctagcctcagccctgattctgttctgcggtgggccctggccttcaagagaacagatatctaaaagttgaaagaaaagatcggccgggcgcggtggctcacgcctgtaatcccagcactttgggaggccaaggcgggtggatcacaaggtcaggagatcgagaccatcctggctaacacggtgaaaccccgtctctactaaaaatacaaaaaattagccgggcgtg

SEQ ID NO: 98598 - DNA, 1458 bp, Homo sapiens
cattggtgaagaccctttgatacctgcttgcctccccattgttataagcttttttttgtttgcttgttttttttgttttgttttgttttgttttgtttttgagacagtctcaccctgtcgcccaggctggagtgcaatggtgtgatctcagctcattgcaacctccacctcccgggttcaagcgattctcttgcctcagcttcccgagtagcttggattacaggcgcccgccaccacagccggctaattttttttggtatttttagtagagacgggggtttcaccatgttgcccaggctggtcttgaactcctgactgcaggtgatccaccctcctaaagtactaggattacaggcgtgagccaccgcgcttagcctgtttttagttttctaaagcaaggtccctattgaaaggcaggccataaacagtgatgactaagaaaaatcctggaagagcctgagaaggaaaaagatgaaatataatgccagagaatgaagttagtcaaaggaacagtgtgaaaacaataaataaatagataaatgaaaatgttatttgacagagagatgaaactagactaaaccattcagctgcctttccactgtaacaaatgtaatttcatctttcagaagtgtaataccttgcagcaccagagctgaatatgaacatattaccaaaaatagattaccaggcatagatagcattccttttttaagtttgaattgaccacttgcgactctcgacctgatgtatgtatgtgcttcctttgtgacacagatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggtgaggcacaggacgagcaggggcgggaaatggggaagcaggtcaagaaatatttccgcaaatccatctttcctttgacatgccatttgaggataatttgcagtgtttcagctaataacctaagataatttacacattattggttgttaaaactttttttaatgtcaagttttaaatttttcagaaaaaaagaaaaatgacatacaaataaaccttagggggaaaaaagccagatttatctccaaaagataaaactgagttttaaagaatgctagcatcataaaacttaccatggatagatcacgcacacacgcacacacacacgtattttgaatatccaaagttcatttgaaaggaaatgagagttataattaattatatgactacctggttcttctgctaggaaaggacaaaaaaagtgcatttggattttttgtttgtttgtttttgaatgaaatatacttccctgtcccgacattgaactctttttgtagtggaaaccatcctttatatgtggtttctatg

SEQ ID NO: 98599 - DNA, 1887 bp, Homo sapiens
accaaaaaaaattagccggctgtggtggcgggcgcctgtaatccaagctactcgggaagctgaggcaagagaatcgcttgaacccgggaggtggaggttgcaatgagctgagatcacaccattgcactccagcctgggcgacagggtgagactgtctcaaaaacaaaacaaaacaaaacaaaacaaaaaaaacaagcaaacaaaaaaaagcttataacaatggggaggcaagcaggtatcaaagggtcttcaccaatggctacaaagaagctataagaaggtggtagtatctctttcttcatttgttatgtaaaaaatgtagaggatgcacaatttctttgactaaaatattattttcccttcccctatacccaaacatctacagtatttaaaaatcactagcaaaatagccccaaattattcagtgttagccctccactggaagagtgggatcaacataaaatgataatttgtaactaaatgaccattagtctatgcgtgcatttatctggtaaatagattatttaaattataatccaaatttgctctgtgccacgatgtgagtatagaggatctgatgtctttgtgaattggatattgttgcaactcctgggttagagaaaaaaaattaatagttgatgtaggttcaaacaaatacacacccacatccatctaccacaagaatagaagtttgcatgaaggtataattactgattagagctttttcccaaatccccagcgaaaagtattatcatcccctgaacctccatagcactactttcagtatttctgttgaaatctttaatactgtgttttgcagatgataaatatgtataagactttctcatctccctgaccccctaagtactctttgaaggctgggctaatgttcatttcatatctgcacccctataataccttgaacaaagtaagtccttataaaattttctggaataaatgacttctctttgagaaacttttcccaacttgctatttaaagagttctaaataacagataaggtttgaatcagacatctaatttgtcttaagctaaaatattgccacaaagatcttggaagtctgatgatcacagtaacattttaaatgcaaaatatctaataaaccagcaagtttctgggaaagctttggtcaaaatggttaccacttttcatgagagacctatttttgttagcaaagaatttgaatttggatgatggctatgttaaaggtagttaaatgggttcagctagataaataaaacaggttcaaattatttggatttgattttaaacttatttacaacaccagtagttaatggctgttttacttcaacaaactctctagctgttattagtttacaatatcaaaaaaggagccttcaaacccaaaggcaacaattaagaccccaagacaatcttagaaggagcagtaaagacaccagaggccagcttctttacagcactaatcaaatgcgttaggtcagagacactatccctaactccagagtagataaatcattttaatttatgggataaattctttttaattttatcaatttagcctgtgaatgtgccctatttaaatttcaaacatagaaggaaacctaaaccttttgttcaactctatgtcagtggcagtgagctgagattgaaccttatcaaagtgatatgtttttctatttatgtagtcttctctgaagatgcggaataagttggttatgaaagttttcttgacttccagaagttaccaaagcatgctgatatactggatgtgttctgagtaacatagtattacccttctctctaggaatccagaaaacaatacctggcttaatctttaacataaagatgtaaaacatacttctagaagtgcaagtgatgcgtccgc

SEQ ID NO: 98600 - DNA, 3777 bp, Homo sapiens
cccagctaattttcatatttttagtagagacggggtttcaccgtattggtcagggtggtctcgaattcctgacctcaggtgatccacccgcctcagcctcccaaagtgctgggattacaggcgtgagccactgtgcccggccaatcgtttgctttttatgtgaaccttgctttgactttctgagtcagagattggaatgtgaaacccttcacaaatctagctctgtcataagttagtactttatatggccttttcctaagagcctgagatttttctacaatatgaataatttacagaaaatttgacaatatgtcaaggtcaaaaaccatggccttattagagcttaggataaaaatctgtatctctcacttcattttattctttgaggtgtaccatgttacttgtggaatagagaagtgggttttcctttagaggggattagtgaactagaaaagcttgtacctaagtgaggctcacatggactttccttttcccctcagctgaagagacttgctttgacaagtacactgggaacacttaccgagtgggtgacacttatgagcgtcctaaagactccatgatctgggactgtacctgcatcggggctgggcgagggagaataagctgtaccatcgcaagtaaggaagagattgtgtaaaatgatgccaaaatatcaaatatgaatttctctgttaccatcactgtcattttctgttatccatgactggatattccgaactttgaggtttgcccctggtgaccaggtactcttaagtggtcacccaactggttcctgtgtttcttaaagacgggtatgagcacagatggaatcagtgtttgatgtgtgtgcgtttatgagtgtgtgtgcatttatgagtgtgtgtgtttctgtacatagtagaaccaagagacctcttgggttccatttcagtaagacatgcttaggggagttgcccattttaaatcacctggatatcttcaagctagacaaatcatgagacttttctgcagtgactgggaaggtgttcatgaagagtgaaccagccatgtgttgtctggtcttcatgtttgcaatgcagagacctcttgcacctcacagaaacagtctggtttcttggtgaccagtaggttatacccaggaagcagatgtcactattcctagggataatacaaaattattaacccaatagagtttgctaaggaactttgggaaccgggctgattctcaactctagtttagctaaggcactctttccagtatgattcactgggttaccaatagattctattaagatagtatttaagttttttaatccattctttaaatataagtcgtcttaaagacttctattcaaaagaacaagtcccgtgtgaataggcccaatcaactttccccatatttcatgttagggtttatccaagttcacaggcaaatcgcaagaggcaagggtccatagtgtttacaatctagttcagcatttgaatgtgccattgggcttaacaacttagaaaactaccaggatttccacactttatatgcatatgtctgtttgctttccaccaaaatgacatttctatcctagggtaaaatacaggctctccatgctcccaaaagctggagtgctgtgcctgatgtggccttttcactgaattagtctcagtcttagcctgctgtgtatgagtgaagaccaagcctcccagcctttcttttctgcttaggacccaatttcctgtgatctctctgggaaagcaggattcatgacctcttccttgccatccagatttctctgtggttttccattgtgttctaagcaagacacttaactgaattgactccaagtgaccagacctgttaacgtttcccctgtctctgatgggaaagctgttgtctgtgtctctactttagccaacctaagtacctaccatgggtggaatatgagaccaaaaaaaaaaatctgttctgccctctcctaacattttcgttgtatcttcaacagaccgctgccatgaagggggtcagtcctacaagattggtgacacctggaggagaccacatgagactggtggttacatgttagagtgtgtgtgtcttggtaatggaaaaggagaatggacctgcaagcccataggtgtgtgagtcttagggctgagcaagagctgggatgcttagttctaatgtggggttggaccagaatcacatctacataggtcatagacctgaattccagtgaaaaccaataaagaaatgggaattttgtttgaaataatgaattattatataatccatagtcttcttacaggagttagatcaaaaagtactgactacacatagaagtcttaactttgcttcaaaagcataaggtagaattgaaagatttagaatggagtcatttcttttacctaatagctgatctcagattcctccttcgtcaagatataatttatttaaaagaaaaaaaaatgacactttggacacatttctatatggaatgtcctggaccgaaacatgaaatagtgtgtgcttgtcacactctgctcatttcttttcaaattaaaagttgttgagcttctttggatctcaatcctcagttgaattttgtaagtacaagcctgaaagtttctggctataaattttactctgtttacttgtcttctaatttagaggtttttgtcttgttttgtattgttttgctttccaatatttaaaaatagctttctttgtcattgtatttaggccactcaaaattcataattggtcatttataattaagattggaattttgcatatgtagtctcccacagactagatacatacatagatccttgctactggaaatgctgctgggaagtttggggctcgctgaaaatatgtagtccatgtacttattaggagaatggaatttctgcctgccaactcagcttgagctttcttttgccttggctacttactgtgtgcttagatgctgggtgtgtcattctttctgaacagagtgccacttaaaaaaaatgtggctgaatttttgcttacacactacactttaaattacagggagcttgcacaattcaaaataacctttttttcctgtttttcttccaaatttccctacagctgagaagtgttttgatcatgctgctgggacttcctatgtggtcggagaaacgtgggagaagccctaccaaggctggatgatggtagattgtacttgcctgggagaaggcagcggacgcatcacttgcacttctagaagtatgttttacatctttatgttaaagattaagccaggtattgttttctggattcctagagagaagggtaatactatgttactcagaacacatccagtatatcagcatgctttggtaacttctggaagtcaagaaaactttcataaccaacttattccgcatcttcagagaagactacataaatagaaaaacatatcactttgataaggttcaatctcagctcactgccactgacatagagttgaacaaaaggtttaggtttccttctatgtttgaaatttaaatagggcacattcacaggctaaattgataaaattaaaaagaatttatcccataaattaaaatgatttatctactctggagttagggatagtgtctctgacctaacgcatttgattagtgctgtaaagaagctggcctctggtgtctttactgctccttctaagattgtcttggggtcttaattgttgcctttgggtttgaaggctccttttttgatattgtaaactaataacagctagagagtttgtt

SEQ ID NO: 98601 - DNA, 2341 bp, Homo sapiens
cactcctataagcagagattccccccctccaccccgaagagaggtgacgcaatgtcctcaaacactaccaccacccccaataaaaaagaaaagggaagggggagcgtcttgcaaccccttcgcttcacacaagtccagccactccctttcctcccagccgcttcccatcccttcccccatcccctaaaaagtttgatgaccgcaaaggaaaccgaaaaaaagttgtcttgccccagtcctggcgggccatcagcatctcttttgttcgctgcgaacccacagtcccccgtgacgtcacccggagcccgggccaatcggcgcgcggtcggctgcggcggccggcgggcgggcgggcgggtggggtggggcggggcggggacagcccggcgggtctctcctcccccgcgccccgggcctccagaggggcgggaggggaccgtcccatataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcgtgagtactgaccgcgggctgaaacaggctgcctcagggatgggaccctaaagccgaccaaagttggggctgaagttttgtgcgcgcgcgtgtgtgcgagtgtgtgcgcgctttactgagagaaaccagctgtgcacacaaaaggaccgagttttgagcacgctggttctgagggcctgggatgataagaccgtgcattggaggacgaggactctgcgactttcccgtgttctaataaattctgcacgttcagattgtccttctaggaattaaccaaaacttgcctttaaagagaaaaatgatgcatgtctataaattttccgtctgggattagtgtggtccttactgctacttatttccttctgttaaataattggtcaaatattttcaacatgggggtggaaagggggtattgaaatagctgtcttgtttctaactaacttggaagagatgtaattggttcagacctctttagggccgctcaggatacttcaccaagaacagaggttggaattctttccgtttttcaaagacacaccctccttttgctttgagaaagctgcttaaagttgtcctttttgactattactccaaaagaatatttaagttccttgcatgttttaaaaatgtgacttcaattgtctgccttccaaaatgtttccaacttttttatgtagacccctggccagatggaaatgacatcattgtatataacttttagcaaagttaaaaggaaaaaaatatgtacgtcaatattcacatgaagaaaattccataattttgggaaaaggagaaatgcaaatgtaacgttttccttcaattatttgcagccggttgttatgacaatggaaaacactatcagataaatcaacagtgggagcggacctacctaggcaatgcgttggtttgtacttgttatggaggaagccgaggttttaactgcgagagtaaacctgaaggtaagtgacaacaagccccatagttagtatcttttaatacatgaagtggtaattgttaaactttgcattagtaagtaaaaatacatacaccatttttctaatagaattacctgtcatttcctcttaagtttaaaaactgcttatatttgcttttcacatgcttttacctttaaaacaaagaaacgaatctttcccaaattagttcctagagtcttctttttgctttactctcccaaagtttttgatgagaaaaatgaaagattttgtgtgtcctccgacaaaaaaaattgcttataaaattttaatttattagaaagcagtctcaaatcttaaactgttagtttatgagccagaaaacactttggggacttacatcgtaaaatgatttgtcagcggcagttaacacaaaaccattagccacttcaaagttctcattcctttaggaccaatgatatttttctcataaattatagcaactctgtcagagaagcactga

SEQ ID NO: 98602 - DNA, 1044 bp, Homo sapiens
aatttagaatcctgtctgggttagaggatttttttggaatttctcatcacttgacaaaacagttttctcttttcaaatataaaagagctccttgtaaaatgcttggtaaatttctgggaagccgagtgtttcttccagagggaaggatacctggaaatccggatgtaagcaagataaacctgtagctaaagctttcttaaaattcattgattctgggggaaggaaataagtgattagaaaagtatttggtcaaccaaaaccatgatagtttgatatatttactgcactgaaaatacactagaatcatatgcatagtggagcttgaagtggaaagcccaccttacattttggaagaaacttttatatttcaatcccatagatatctaatttatttaaggaaacaggatatctctgtctcataagaaaaaaaataacatctgactgatttttataggaatgcttgggagtttactcttttacttgaaaggttttttttttttttgcctttttttttaaactttagaaacagaggcgtttcttagttaagataacagggcttactacagtattctttaattatcaaggtcccttgtaactctaagtctgttatctctaattggagagataattaaatcttaaagaccactctgactctaattcaaccaacgtgtgtggtgtccaggatcgttggacttccttaagaattctattttatccaggtgggttcttcctcagtaaattgtattctcctattggtaggaaatactcttggatttctttctttctttctttttctttctttctttctttctttctttctttctttctttctttctttttccttctttccttctttctttctaaaactgtattcagagagagaaatgtgacaaaaaaagggaaatcaatagagacagaaagtagattcatgggtacccaagtttatgggctgggaacaggaattaactgtaaaagggcacagggaatcttattgaggtgatggaaatctgtgttctaaaactacattgcagtgatgactgtaca

SEQ ID NO: 98603 - DNA, 1032 bp, Homo sapiens
caagtttaacgtatgctctatagtttcccttgctggtatttaagggtagaaataatttatagattcttggccaatggagatatttccgttttagaggttttgtcattctgacatttcagtttcacgctttgtagttcttttatgcattgaggtgtatggcaataatgtaagtgtgaatttttctatttctccttatgtattaaatattcaccttttattttattatattgcttaatgaggacattctgtgtactagtttgatgtttatggaagaaaaacaaaagcttccctagctctaaaaacttgccttttaagttcctcatctctataagtagcaaaacataacacataaattattcaggcaatacaaaatgaaaataaatacatttcaattggctatctaagagattatttctctgtgcattgagtcttcttttatgtagtcactgcaaaaccatgaaagattgaaatattttctgaatgagaaatctttcaacatgaagcagcacacacagcactgtgagcagaaactaaaataaaccctgtctggcctcaaggttcatgttgcatatttagagttggaaatactcatttcagggtacatttttctttaacccagtcatcccagagtggaacaacaacatagagaatagataagattgtctgtctggctagctgaacacactgtccttcacactgctgagaaatttgcagagtatggtagaggtttttagatcttgaaactgtacaaggcactcttctgcttttaatttatgctttgaagatttatacaaaatagaaagaccaaataactcactttccatttaaagtgctcacgttttccatctggtacattgttatgaataacatgtctgcatgacataacagaaaatttttcataccagtgcgggtctgccatcaatttataatcagaaatgtcacatgacgtattgaaaagaaatcagaattacacacggttgctgcatttgccttcttatatttcttaccagaagcccttttccttcttttcag

SEQ ID NO: 98604 - DNA, 1080 bp, Homo sapiens
ttacttttaaggtgccaagtgtcagaacttgttgctgtttgttgaattccaagaggcaatggagaaaatgtaggaataaactacattttcttctacatttaagatgtaaagggaacattttcttagtagaaaatccttacttttcagaaaataacttcttaggtaaagcacatcattttaaccctttttgcagaaaaaaaaaatacaatgcttctggttcaaggtggcaatttgagcacatatgtttgaatcctcctctttcccaaataaccatgaaaatgcaggagacactttttagcattgctgaaaccacaacagggtgacatccacatgttcaaactgagtggaattcatggaggatatatgcagatagaagaagttgagtgatgggcaagacgaccaatggttttctgcacaagaagaagccagtcagagaagtaggtggaagcaccttctaccccagagagggagctggaggaaagggtgggctttgggggggtctttgaggtgcaaatttctgtgacactggtcatagctcacatagagagcgattgctgccacggctcttaaattatttgaactcacacattacgtagctggtcattcctaggcaaaaagccagggcttcctttgctgaatcctaacgaggcagttatgccaggtaggaaagggaagtgctgccccagctagctagatgccgcaacagaggaggcaaggaattcctccaaagagagaggcacacttgggtgtgatggcctttggtttgaagctggagttccttcttactccccaagttcatgggccaccagcctgagaaagcagtgaaaatgctttcctttgtctgttttcttgtttttgtttttatcaaagatttgaacaggtacacttgcaatttctgatgaaagcattttaaccaacatagatacacctctatctgtttttgcaagggtaggtaaatagaggtgaatggcaggacagataagtgagaacccccagctgtcaaaaggagaggaccattatgagaaaaggtgttcttgtgagacagtgattataaaagaggactaaaatgtctaaaagctc

SEQ ID NO: 98605 - DNA, 1054 bp, Homo sapiens
ttcttatggttgctgtttgcatgacatatatatatttatatctttttacttttaacatatttgaaaattttaatctaaagtatgtctcctgtagacaacatatagttggatcttttttaaaaatccagtttgacaatctctgcctatttgatttgatcatttaatcagttcatattgaatctaatgttattatggctgtaattggatttatgtctgccattttacttttgactttctctttccctaagctctccattaagctgtctgccttatttggtatcacactaagctgttagacttcaccaatttctagcagattgctctattgttttgacagttcctggggcataattcgttccacagcctgacccgattaaattcaagcaggaataatttttgaggccagtctttgaggtttgttctgttgccaagagtactcttcttagctgtttctttccctgattttctctcttaaattagctagcctatgatttagcttgttactcttacagagctaccagcctccttttaattatttaccatcaaaatgtccattgtttttgagagtgtccttaggcttgaacttccccacactctatttataataaagtattttttttttcactctgtcacccaggctggagggcagtggcgcgatctccgctcaccgcaagctccgcctcccgggttcaagcgattctcctgcctcagcctcctgagtagctgggactacaggtgtgtgctaccacgcccagctaaatttttgtatttttggtagagacggggtttcaccatgttagccaggatggtctcaatctcctgacctcgtgatccacctgcctcggcctcccaaagtgctgggattgcaggtatgagccactgtacctaccctaaagtaatttctttttgggagagcttcagagccctcttttttatgatttgcttcttcctctgaataaaaaccaagctttgggtgcttggcatggggtagtagcctctggtcttcttattttgcttcttctgtgtggagcctcagtcctgtgagtgagctgga

SEQ ID NO: 98606 - DNA, 2390 bp, Homo sapiens
tttcaagtgattcccctgcctcagcctctggagtagctggaactacaggcgcgtgccaccacacctggctaattttttgtatttttagtagagacggggtttcaccatgttagccacgatggtctcgatctcctgacctcgtcatccgcctgccccagcctcccaaagtgctgggattacaggcgtgagtcaccgcgcccggccaagcccttggcattttatctggaatagcatctgtaaactgaagtgtttgacctctgttttcttctctcctctttcatctgtttctgattcgttggctggcagctgcacctgtggggggacctctcatgcagacttgcacatatgcagggagtattgcactgaagatctttgctggaccttcttctcttcagaagataattttcaaaagggagcaatgctgtgaatgcagcttgcttctctctacagattgagaagtccagcttcaaaagttacttgccacttaagcaaggaacttgtcaagagatcatggttcatgttactgaaaagactttaaggatttgtaaggttaatccatagattgctgagaaaaatggaaatatttttatttttacagattttgcacttctgaattcaggttaaaaactaacttgtatttagtctgcttagaggactgtgacttgaaaatttttatataccaatgagctttttggtagcgtccacaatgtttaaaatatttcataggcgagatccgtgttctccatttattaatgcattgtagaccaatttaactgctgtgtttcaggaaaattcttcctagtttaataagcaagctaaaagttttattttttatatttagtgcttaatctttgcctcatgttatgtaaaattagcctgcagatattttctctcaattctgtagactctcgcaagataaacattcaaacagtgaaacaaacaataaaataaataaacctaaggatgtcgtattgttttactctcggtctcagaatttgtattttgcctttctgccttttttatgtcaaaatagatgagattgtgtgcatctataaattgttaccacagtatttttgataatgaataaggataggactatctctgtgattattaaaatacatggaattatccaggaaattttccttacaaggaattaaaagactcctgtatttacttttcagctggatgtgtgttatatttctgacataagaagggatagatattctttccataatccctttaaattaaagggcagagaggctgaaacactcatgggtttaaggacctcccatcatcctaaagccagtcaaggattagatgtgtgttaagtccagtggacatggcagtgcatgagaggggcgcaggggtgcctcaggtggccactgtagatgtcacagtgtgctcggcaggaccagtagccacagaagtgtgggaggccagagagtttcccactttttgtctccctgtcgactactttagtactcctttttcatttttttttatattcttactttagtacttcttaaaggctcatctgtgtatgcaggttgatttggggtggtagatggatggaagtttttatattaatatttattttaaaatgcaccaggagaaaaccctctaaccagtagatcaaacacctggttttacagttcatggatgtgttgcacagaatattatttatgctttcttaaaggcaaagggacacccaagaaggcacagaggacacatgtactaaagggataaggaatgcattggtgagagggcaccagcatccctgagaagctcagtggcagttctgaaggccagatgctgttacagaagtgagctcactgacagcaatggacatggaagaacagaggcccaatggcagtgagtcactatcagaagacaaatggatacaattatcacaatgagtggccaggttgaaggattcctgcagagagctttggagacagttaatggaacatgccatctttaggagcaaaataagtctaaaatgagtattgctcaaacgataccttcaaaagacctcaaggatgggtgatcaggagataggacacagccaccttaataaaaggttataatcttttgccaaattttcagacctttgttattttccaaatgcagaaactgctgattgaaggaaagtctaggtctccaagaaggtctttgtaaaaccactgcaagtgtgtatggcaatgatgtccctatggttatttacttggataactgtacactggggaaggggagtacatgaataatctgagggcgctgagacacaaggtccaagctgacagtgatacttcaggaccagagtatcactacagtccaccttttggagtgaggggcatatgggattcaggtaataaatggagttcttttccagg

SEQ ID NO: 98607 - DNA, 2161 bp, Homo sapiens
aagaaaatccaggtttggagaaggacagcctggagggaaccactttgcaggctgggaggcaggtaggaattctggggacaggggagaagctaaagagtagggaggacaggaaagagggcttcaaaccagaaacaaggtggcaagcaaccagtggatgagtatctgaggctctgagggaaaagttaacaaagagaaaaaaaataccgaaagaattgtaattaaatatcctgccaatcacatggatctgggaggcagcacatggaatagtacctttggcttcagttttctgatgctttatgcttgtacagaatccacatgggtctgttcgtaatctcctgcagggaccgtattgcggaacacttgttaacttgggactactttacatgagtggtccatttttctaccttaggttttcaaaaggaagctgactctttgttgtcagtgactaaactcagcaccatcagtgattctaaaaacacaaggaaagctcgagagatgttgttaaaactggctgaagaaaccaatattttcccaacaagttgggagctctcagagagatatctctttgttgtggtaagtggatgctttttttcatttgccctaattttgctttaattgcttggctttttaaaactattcactatcctccgtattccaacaccaccatcactatcacatatgaggtggcagatgctggcattatatgctgtggtccccagtggcccgcagcatcagaatcacctaaagagttttaaaagttcagatttctgtatcacacgtagacctactgaggcttgggttccagctcaagagtttgtatttttcagtgaattctactgtgtagtctattttctgaaccatttgtaggtcaaagagatgtgagaagtattgtttatttaacctataagactaagaaataatctgaaaggagaaaggacgctaaggagtggggaaatgtttcttggataatgtaactaaaggattaaggcgtgtctctacatttgttaggaaaaaattaataaacgtcttacttgctcattgtcatttccagggtgggttttgttgttgttagattgctttttcccatcgacatgtcttggttcctatcttgccagcagttttttggtttgttgtttgtttttgcaggaccgtctcattgcacttgatgctgcagaagagttctttaagcttgctcgtcgaacttaccccaagaagcctggggttccatgcctggcagatggccagaaagaactgcactaccttccgtttccaagtccctaaaggagaggctcaggggcagaatgggaattcttccatgaggactcagcagtcaaccaaagttggacaattacatgtagaagagagtgagcaaatagagtttgcttagtgaaaaatgatactgaattctacataaatgtaaagtctttaatctgaggaccctgccccatgaattgtgcaggctgcattgaaacgccttggtgatctcatatttaggaagaaagttaaagagttggtcagatggatagttcataatgggtggttccattctgagagcccattgccccagctttggttttagttgtgtcataatctctgatcattaatcctactgactgagtggactatttcagttaataaaacaatatgattaatagagagagctgtcattgagtcccaaaatggattgccagttttaaaataattattataaaatgtatgctaaccccaaaataatactaggcatgaggtgacctctctgatttggtcaccttgtagaaccttggagggtgtcagggcatctctttgagtatcagttatgattattcagaagtatagatgtatcaaatgatagaaatgacaaggaatggctgggcgtggtggctcatgcctgtaatcccagcactttgggaggccaaggtgggtggatcatgaggtcaggagttcaagaccagcctgaccaacatggtgaaaccctgtctctactaaaaatacaaaaattagccaggtgtgatggcacgcgcttgtaatcccagctacccaggaggctgaggtaggagaatcgcttgagcccgggcagtggaggttacagtgagccgagattgcaccattgcactccagcctgggcgacagagcgagactccgtctcaaaaaaaaaaaaaaa

SEQ ID NO: 98608 - DNA, 1050 bp, Homo sapiens
acattggattagccaaggaagctctttgggcctcagttactgtatctataaaatggctttaataatatatagattttattagatgctcactgtgtgcagatattgtactttctgtatgccatcaatctttataacattcttaaatggaatatttatcattgttaactccactttacaggtgagatcactaaattgagagaatatgtaatatgaagagtttcagtaagataatttatgcaaggtgccatatcacctggtgcagagcagattctccagcagtggtagctgatagtattcctatcaactttatctcatccatctccttctcttcttttaggcttgctttgaagattaataaaagagaagagccaggtgtttaggcaacatgaagtttgggaatgagatagaggtttaagccaaggggtataaataaaactaaacttttattttcctgcaggagtggcagaagctcaactatgatatccataccctgcggcaggttcgaagggaagtaagaaacagatggaagtgcatcttagaagatttaggtaagtctaaaagagattgtgaaatggtaaaaataactcgttgtgatcattattcttcaatttctccaccatggtttttataaaaggaatgtcaataattgcctaattaagactactgtgtactaattattctcccaatcttgctcttatatcctcaagcataaatgcctgatgtttctgttgtcaccagtccatgtcttcaggacacactctgccatgtgttactccatctgtccctagtatagggtacgcatgccagtgcagtcatgtgggcactaacatttacttttttggcattgtacattaatttaattagatggggtgttggccaattagtcatagctttgtaagatgaagcaggttgggagaaatattgtttgcaagacagacagcaaaactcagtgtagaatttcggaagaaatatggaagaaaagcttcgaggttgggaaaaacacttgtggcattagggtagatacctgccctcatcactaatggttaatga

SEQ ID NO: 98609 - DNA, 1050 bp, Homo sapiens
gtgactaggctggtctcaaactcctgacctcaagtgatccacccgcctcagcctcccaaagtgctgggattataggcatgagccagcatgcctggccctcttttttttttttttaagacaaagtctcactctcacccaggccgaagtgcagtggtgcgatctctgcgcactgcaacctctgcctcctgagttgaagtgattctcctgcctcagcctcctgagtagctgggattacaggtgtgtgccaccacctccagctaatttttgtattattattattattattagtagtagtagtagtagtagtagtagtagtagtagtagtagtagtagtagtagagacagggttttgccatgctggccaggctggtatcgaactcctgacctcaagtgatctgctcacctctgtgttccaaaatgctgggattagaggtgtgagccagcgtccttgacctaggattgtttcttaattgtgctacactgatttggaggagcatgtggaccaacctccattttaaggacttgtattaactcatttgatcctcacaataagccaatgaggtaggtaggtagttttattatccccatattgcagatgaggcaattgaggaacagtgaggttaagaacttccctgaagtcaggctgttagtaaataacagagctgggattcaaacccagacactcaggctcagcacccacagtattttccaatatgctatactgagtggccaagtaagtataataaggcccttccaatgaagacagcagtacttgagttttttcccttacaacttatatagtctgtgagggattagataggtatgccttaacatgatgctaaagatgtggctagggttgcatatttcttatatgacttagttaactttgccctcttccaaggtcacagattttgtccctgaccccaatcaccatgcacatgtgcacatgcacgttcaacatgcctttggtaaaataaaagaggaccaggagaaattgttcaaacttgccacttcctgacttctagaaaatagctgaaagcccatgccctg

SEQ ID NO: 98610 - DNA, 1554 bp, Homo sapiens
tctgcctttcatcttgttgcctcaaccttcttatctagcagccctaatctgatttggccaacaactgacgaggaaaaaaaccccaagaattcagctataaacatcttcagttattgatttcagttttgacttgttctcaggtatcttatgaaattagctcagtatgttttcttttgctacacctttgctaattgacccattgttaaagttcagggccacggcatcacattgaccacaatatattatttcagaaattaaggaaaaacaaataaaatattactttagaaaataagactttaacttttgatgtctggtagaattgcattgaagtcacttgggaagaatatgtaattgacttttaactgttgttttcaaattatttgtttcaagcttaaaagataaatcattacaatttaaaaattggagagggacatcggaagacttgctctaacgccagggagtagcggagttagtttctttagttatggagagatgtaattggataacattttttacatcactatttttcatttgctgcatttcgatctgtattagcttgttctcacactgctataaagaaccacctgaggctgggtaatttatgaagaaaagaggtttaattgactcacagttccacaggctgtacaggaagcatggctgggaggcctcaggaaacttacactcatggcaaaagggcgaaggggaagaaagcaccttcttcacacggtggcaggagagagagagagagaaagagacagagagagagagagagaagggggaagcgctacatgctttcaaacaaccagatcttgtgaaaactctatcacgagacagcaccaggtggatggtgctaaaccattagaaaccacctctatgatccagtcacctcccaccaggcccctccttcaacacatggggattacaattcgacatgagatttgggtggggacacagagccaaaccatatcaagatccaattctttggagtcacatgtttaagaggaatccagattctcctcttaccaattatgtaatcaagtgtctattcttagttaaaaccctgtcaatgcttctactggttttagagctttaaattttgcataaaatttccagatactttcatgtataattattcatgactattctgtcaaaagaagacagtaataatatggaagtatgacatccatagtttcattgaactaattttaacaaccacctgtcatgtgcaagctgtccccaaaccatggtaggggaaggtgggatccaaagatgcatcaactatggatccatccttagcagatctttaatctcatattgattattagttatgtgttgcttccccattaaatgttttatcagagtaacagacactgaaactgaatgaattcgtataacattcattgtagatatttaggaatagcaaaatgactaatcgatggacagcaggaagggaaggatgttttaaaagtccaaagcctggatgatccaatgatgaatgagtctctgaaaaacagagatttggctgcatttagaacaaggcctaagacatcagcc

SEQ ID NO: 98611 - DNA, 1018 bp, Homo sapiens
ctggtgataaaggagacattatagatacctattgtataagagtatcttggctgggcacggtggcttacgcctgtaatcccagcactttgggaggccaaggcgggcggatcgtgaggtcaggagttcgagatcatcctggctaacatggtgaaaccacatctctactaaaaatacaaaaaattagctgggcatggtggcatgcacctgtagtcccaactactcgggaggctgaggcaggagaacagcatgaacccaggaagcagagcttgcagtgagccgagatcacgccactgcactccagcctgtgcgacagagcgagactccgtctcaaaaaaaaaaaaggagtatctatacagtcagtaactctacaacaattttcgtaaaggaactgaggaagttcaaaggaagcagcagtttactttcaattggtaagaacagcagacttctcagaggtggtggcatttgagctgagccttgaagggtgagtaggatttagatcacagaggaaggaggccatgaatgaacatggtcgaggcatgcaggttcattcaaggtgtgccggaggatagagtggtgttcccaagtgtcagaggcagactctgtgtggagggctgtcattgggaacaagaccagaaaggtcagatcatgggtaaccttcttgggattgaaactgtattcagtaagcggtatggaacaactgaagttttcagggagggaagtgacccaatctcatctttggaagacagcaggttgggagaagattggagaatttagcttgtggaagcagaggaacaagtttctgcaggcattcaggccaattaaggcagaaaagagtaagaatcttgtgcagagggaaaatcaacaagctgaggtggctggcttagatttggaagatgggattaagggagtgagcagcagttgacaaagttgggaacataaggtggaagggtgacttaggatgatggagtctgattgggctcatccacatgtcagcagcccgtccacttggacacatcca

SEQ ID NO: 98612 - DNA, 1023 bp, Homo sapiens
cactgcactccagcctgggcgacagagcaagacactgtctcaaaaaaaacaaaaaaggcggggggcctgcatgtgaatctgatacctagaagctagttctcatctcactgaatgggtaggtctaatgaggcatggagagagatacctacatccgagtttgacctgcccagccaaaaaggctcattttcatcagctctgtttaccaacagacaaacctttcttaaagggagtgctccagagtggtgagacatccaagctaaagcataaagccaaccattgttgggagttattgacggcccctctaagtcttgaaggtgccagaccgctgggcacaggcctctcctggcctccaccccctgccaaccgctactccaaggttagtccagtcttttgcctatcctctcagtcactatgtttctttgctgtgtcatttgatccttttccatttgggctgaggttagggcagacagttaatgagtgcaccagctgtctaggaacagtgaaatacagtcttctctttttcgcttgcataccatgcctggtagatgcagagagtcagcttttgtagtgccggaagagggtgccctccttgacaccgtccaggcccaggtgcttttttaattttattttattattattttttatttttttgtgatggagtctcgccctgtcgcccaggctggagtgcagtggcccgatctcaactcactgcaagctctgccttccaggttcacgccattctcctgcctcagcctcccaagtaggtgggactacaggtgcccgccaccatgcctggctaatttttgtatttttagtagagacggggtttcaccatgttagccagaatggtctcgatctcctgaccttgtgatccgcccgcctcagcctcccaaagtgctgggattacaggcatgagccaccgtgcccagcccaaatatcttaattatataaacctgccttgttcagaattcacatggattatagcccaagtggctttttccagtaaaatttagtgcagctttc

SEQ ID NO: 98613 - DNA, 1035 bp, Homo sapiens
ggctgatgtgctgtgaagaggtgatgtagcttttaacccccaaaacattaaatattggattcttatgtgtttgcatcttaagctgctagacctcattcatgccagacctcattcatgccctttgaggaagatgcatgcactgggcctgaagtggaagttgtgggcatttttgagagtaaaatgggtggatttgattcctcctgctacatttcccttcacacttaggactcactatgacacatgggccaaatccagtttgctgcctatttataaataaagttttattggaacacagtcgtgcccatgaggttacatactgactatggctgcttttttgctactaatgatgtctcacacagaaccccaacataaaatacacataaaaagtttgctggcctctacttaaggccacttggtgctcagtaggcttggcgcaaatgactgtgtggatttaatttttcatacaaaaaggacacatgagcagcctctttaaggaagacttcttataccccctgatttatgatactttggaagaagagattctctttagagattgagagaatcttctagctttttcatttatgggtataaaacatttttcatttactggtgatttctttcttttgaaaaatggctaaacagtgctctattatgtgagattagtctaagtgaaaaaatgcactataattttcaaatatattaaaatgcaccctgtcttggactagtgccactctgctattttcctttcatattctggggttttaaattcacaggaaatgttttaatggctttatctgaagcctatcatgttgacaaagaggcaggcagatgactgacaaggtaaaggtctcagaaactgggaatggctgcagaattcatgatccaaaaggcagcttcgtgactggcttggtgaggagtcattcatatgtctataataacgaggaaagactggggtaattataaacaaatatgttaaccagtttttccagacaatcccaggactgcttcagtttaagtgattattttgcctgaggc

SEQ ID NO: 98614 - DNA, 1075 bp, Homo sapiens
tccactctacagttcgtaaaactgaggtcacagaggctgaatgacttgctagtcaggggtgaagctcagactcagacccagagctcatgctgtttccctgctgcccttgtgcatgtatggctgtgcagatgagtaagagactcttgttagagaggcttgagtcacagtcctttgatgcagaagtctcaaagtagaaaaactcatatttcatggatggctctgtttatttgattcatcttgtgaattcaaaatggaaaatacattcatttggtgggtgtattggtttgctggggctgctgttccaaagtaccataaactgggtggcttaaacaacagaaatttgttctctcacagttctgggggcaagaagtctgagatgaagggttggttcctgctgagggctctgagggaaggatgttctccaggcccccatccttggcttggaggtggctgtcttctccctgtatctttgttgtcttcctgtgcatgtgtctctatctaaatttccccttcttattgggaaagcagttgtactggattagggcccaccagaataacctcattttaactcgattacttctgtaaagagattgtgtctaaataaggtcacattctgaggtactggggcttaggattcaacataccaattttgcggggagtcaatttaacccataatgataggcatgcaattgataaaataaaaaatgtaggccatggtgagaatttttaactctatcctaagagggatggtgaatgctttctaactaaatgagtagaaaacacttctttgtccctttgcaaggttttttctttccctctgaacccgctaactcccagcctgggaagcttacaaagggagtcctaagtaggcctagctttaactgccccccacccctccatgacctccatattgggagacagttctccctgggtctgctggtctctgcacatgttgtaagtagagtcatcgtctgccctttgttctggactgtcttttcaaggatgcttatataatgcgtggccttgggaggtggacatactgtctccctctggcacaaagggcaggcaggattat

SEQ ID NO: 98615 - DNA, 1312 bp, Homo sapiens
gtctttcccacgttggagttggagcagcctcatcatctgagaaatactgccagaggcttgggatccaggattcctaggaaggagacagggtcctgaaggtagaggacacggcactggaccatccaggtggtttcctgtccaaaacgatcttgtggagcccaaggactgaatggtctagagggggtgatccctggcatgagctggcaatcagcacctggcatatcttggagttgcaccatcgggcaactaactgcgggtgccgggaatgtctttcccatctgatgggttaggtaaggcagtgcgtttgagaaatgatctcccttctcgctggcagatccttggttgatgttgaaacacagactgtccttcatatactcactctacctgttcctctgccctagttttgaaaggtcttttcttgctcttttgtctctgctgctttggactcttctcccagctacagtaagttgagagcagggccctgtaacacacacaggaaaggaagcaggcaggacctctgctcctttgatccatgtttttctacattcagcttgtccaggatattctaccttattctgcctgtacctttctttatgcgaacttctcatctgacacagggcaagatccagtcatctggaggaactggctcaggaccagatagatctaggcttttgattgctaggtgtccaaaaacatagaatttcattgacttcttaatattttgatccatgacatagtatttaccgcttacctgttttgaagtgatggttggggaataaaaagcaccttagggtacatggaaactagagagagggcaaatgctgacatgtgtcagaatgatgattttctattgaactcctacctccaagcgtggatagcagttgtcactattttattcttattttttaaattttgctttaagttctgggatgcatgtgcagaatgtgcaggtttgttacatagacatacatgtgccatggtggtttgctgcccgtatcaacccgtcatctaggttttaagccctgcatgcattaggtatttgtcctaatgctctccctctccttgcgccccatcccctgacaggccccagtgtgtgatgtcctccccacccccatgttcgtgtattctcattgttcaactcccacttatgagtcagaacatgtggtgtttggttttctgttcctgtgttagtttgctgagaattatggcttccagcttcatccatgtccctactaaggacatggatgaactcattcttttttatggctgcatagtattccatagtgtatatgtgccacattttctttatcca

SEQ ID NO: 98616 - DNA, 1139 bp, Homo sapiens
ctaaacaaagttatggttatgaaaggcaaaagtatagaaataaaactacccaatgaaagtactggttaagtacatcttaagtagcttcactaatgaatgctatataccttgaaaaataatgagataggatttatagatagtgacttagaaagacggttatgatctattgctaaatgggtatgtataatgttatcccatttgtgtaaaagcatgtatatgctaatgtacaatgataagatttgtggactgttacctgcagtagaagtaggtggagggaaggaggcttttactttcctttaactttatagttttctgtacagtttgaatacaattcagaggtattatttcatatatatatatatatataattcatataaaataaaattctctccctgttatttcctaacacattttgtggtggctgtttccctggatctttctaaactgttttgctttgatttactgtgggtgtgctggagaaagtgggaggtggagagagggagagagagagagagagagagagtgtgtgtgtgtgtgtgtgtgtgtgtgtctgtgtgtgtgtctgtgtctgtgtttaggaactggagcaggctttgaggaatttcaccagagtagataaagcagaaaggcgatgaagccattggtcagcatttatctttccaagggtctaagattcttcctttacatcagtacctttctttgcagctgtcttcccctcccctgcctgtaaagtcacatgctaattaatagatctttgtgtgttgcctttttcaccactgtgccctcaccaccactcctagccctgcctcttcccttggttggtctggctcctcttacagtaaaaatggctcttaattgcatggagcccaggagagtcccagatacagacgcagtggaacctcctgacatgcttgggctcaggtggggcatcgaggagggttctgaggagccctccataagaacactgggcttgctttctggctttaattgaatatgtggggaaatgggagcacctgcccagttctgatgtgggctgagacctgctgcttctcagacttaaatccagtgttctggaaagagaccgtatttttcttgacctgaaacagtcctttcctttgggtgccaggtccccggatact

SEQ ID NO: 98617 - DNA, 1123 bp, Homo sapiens
ctctgcttctcttcccttttcttctttctttaagccagagccttgctttgttgcccaggctggagggcagtggcgtgatctctgctcactgcaacttccacctcctgggttcaagtgattctcctgcctcagcctcccgagtaccttggcctccccaagtgctgggattacaggcatgagccactgcgcccagcctctatcacttttcttaacctccaaattgctcaataaaaaaatagctgacagcttcgtactgatcagttttcacacctgcataaagtagatgcactgaaactgtgggccagtcacaaccactcaatatcatcctgagggatgtaaacctggaagaggctgatgcctggtggagcctccctcgaagctgcttggccgtggaaggtaaaggaaagaacaggagactggggagctttttgtaactgaattctactctgttttctgggcatttatattctaggttgtgatgaccaggcctccttgttttactcttctttagagtttgtcctcattgacctcactgccctggagccccagaaagatatatgaaggccaagggtaacgtaccttgtgagtcctgacagttcagtgaaataggaaggatggacaacaagttggggccctccaggagaaagcagtgcctggaggaaaagggcagatgctggccaactttctccatatccagaaccttgctgtcacagcaacgcattgctgcacctctgcatttcctgcgtattgtgcttgtgatggtcaaaatttctggaaggccacatattaattggcaggcatgtgcaggataatttactgacagaaatgggctctttccattagttttttttgttttttttttttgtttgtttgtttttttcacatcttgcataaaacagggcctgaaaggaaactgaaaccataaagctgcctcaaagcttttatctttaaaaaatcacagtcgatgacatatacattttgaaacaccaggggttaataccaagtcaagcctccagtgacctactcagtattgactttggtttttcttagagtgtctgagatcatcagagatacctccctgtcgtacagtcaaggcacctcctataagcacttgctggcttct

SEQ ID NO: 98618 - DNA, 2368 bp, Homo sapiens
ggttaaggagatgtatgctaactgatatggtttggctgtgtccccactcaaatctcaccttgaattcccacatgttgtgggatggacatggggggaggtaattcaatcatgggggcaagtctttcccatgctgttctcttgatagtgaataagtgtcatgagatctgatggtttttaaaaagaggagttttcctgcacaagttctctctctttgcctgctgccatccatgtaagatgtgacttgctcctccttgccttctgccatgattgtgaggcttccccagccacgtggaactgtaagtccaattaaacctctttcttttgtaaatttctcagtctggggtatgtctttatcagcagcatgaaaatagactaatacactaactatcagatcattctcataaactctttcaagtactgttttggttcaaaaactggtgatgtttatttggcataatgagtgacagaaattctacgcttatcctttaaggctattaagtaattgtatgctgacaaatgcatatacctctcatgacatgtgtctgcctgcctgtcactcatcagcaggaaccacatggtcaccagatgcttgtgtggctggagtgatctctgaaaaccacacttggccaaaccccctgggagcagctaaattttatttttttaaaactacagaggcaatacttcataaatacatacaattactacatgtcaactaaaaataaaagcaaaaaattaaaactacagaggcagacacataaatgatcctcatttataatttatttgcccccagtacgtgaagactacctgctagggtattgccagacattgtaaacacttccttaaaaatgtttaagataggaacagaccttcccccaggggctgtctccaatgtctgggtcatacacttagcctatcatatccctaatacaaaaagggacaacaaaacagagttgattggaatattgggtgggagaaacagggaaaggggggttgaactgatcgtggaccagccacataatgcttaagcactcagaaactgagatactccagtctggctctgcattactgtgtctcaatatgtccccaagaattggacaaagcccactctttcggggccatctgatttttccagaagtgggtgaacattggctacatttggagataggactgcaagttttaccccaaccacggaggagcaaaataactggaaaagggaagcgattttctagataattttgggatcctccgaaggcttctttctttgaggtccagattatctggattcttgaatgcatttattctttcttttactttgctagtgactatttgggtttagaggatttggggcagggtggagggagagaataaacaagcttactaggatctgagaatcaagggttcttgcactctattttctaggtaataatatttatagaatattaccctgtatgctaagcaacatgcttcatgttctccagacaaatactgaatcctcacggtaaccctatgaaagaggcattttgactcagatgattagagactttgtcactggtacaaagtgttggaggaagtgactgggagcattgggatcccagctcaggtcggtgtgacccagaaacctgcatgactagaaacattactccaggctctccagtgagtttagaaagagcgtcagtggaacctctttggtcaaagacaaagttcccaagcagttattggcttcctgcctcgagtagacactccggtctatgtttgctgatcattactcaccctgtgtcaactgagtcatggagtgactggttttggtgttggttttgtatccacctgcttttggccctgatgctattgcaccattcgattactaaaacccatggattataccagaagatgttctgttcatcggtctgtgatgtttctattctttgctcatccccgttctcctttttaaaaaatatataagcatttcttttgattagcattaagagaatcaatgtttcttttttcttttctttttttttttttgacggagttttgctgtgacagaattttgctcctgtcacccaggctggagtgcaatggcgtgatcttggctcactgcaacctctgcttcccaggttcaagtgattctcctgtctcagcctcccaactagctggaattacaggcatgcaccaccacatccggctaatttttgtattttcagtagagacagggtttcgcagtgttggtcaggctggtcttgaactcctgacctcaggtgatccacccacctcagcctcccaaagtgttgggattacaggtgtgagccaccgtgcccggccagtgtttcttactaagtaggtagcacctcagtgctccatgtaagtcagc

SEQ ID NO: 98619 - DNA, 1426 bp, Homo sapiens
aagctgaaaatccagattttcatataaaatgtccagattttcaaataactcaattaaaaaatatgccagctaaataaatatgttttctttccagtaggagatagcttaaaataaaataaaatatgcctatgagctattgatatgtaaagacgtttatagcaaggactactactagttatgattattgttgttttgtccaagataattgaaaaatgaactcaccattgatttagaaggtgaaagagggaagctagacggggattgttttaactttgaatgagttccatatttactactattgcttattttcttttccacacaggataaaattggtacagattttaattaaaaaaaaagtattctggttttggaagaaaaccaaatttcacttactaaggaacaaggaaccctagatattttttgtatgatacaatttagaagctcaagaaaggtattaagaaaaatggaacataatgtttttccttgagtagaaatagcacaaaagacctaggaatgtccatatttggaattctctgaatgataacaaataaattcaagacagtgtatgtacaatctgcattctccttggaatctgaagctggtagaggaaggaccacaaataattaaggctaaatttacagtgttccaaactgaaaaaaagtcaggaaaaaaatatatatagaagagcaaataatgaaacaaaggcattagcttaaagtcatttggtgtcaaaaaaatacaaaacaacattatttaaatctcatagacagaatccaccttcatttacataaggcttctggagctgatggaaaacagaccttcagcagaagaaatgatgcatttgcaaacctctaagtagtggaaaaattattgctcttgtctttgaatgatgccataaagtacattatgtttgcctaagaagtagtaaacagcctcaatgttcctaaatcattatccttatgttcattttcattaaagtagttgtgctttacataacgtgctctgctctagggagcttaataattgttaatgaaatatggatacaacttattatttaataattgtaatactgagtgaacttattctctaagatattaataataatgaaaatagtgccaggcactgttctaaccactttgcatatgttaactgtgtcctctttaacaacaactcactgaagcaggcaccattattatttccattttaagcaacttatccaagggcacacagctgttgagtttggatgcaggatttgaatctggctttatggctccagagatatataatgagtatcaggattgaaatggagagaaaggaacagatattgtttgtgattcaatatagatttcaaaatgtataagcaaagtctgctcataagcctgtctctgtgtcttgttggtgccaatgagtacgaaagggattttca

SEQ ID NO: 98620 - DNA, 1245 bp, Homo sapiens
ttcaccatgttggtctgtctggtctcgagctcctgacctcaggtgatccacctgcctaggcctcctaaagtgctggaattacagatgtgagccactgcgcccttccactttcttcttttaaaagtataaaagtaatgtagtttttaaaagttgcttatgttgccgggtatggtggctaacgcctgtaatcccagcactttgggaggctgaggtgggtggctcacgagatccagagtttgagactagcctgaccaacatggtgaaacccggtctttactaaaaatgcaaaaattagccgggcgtgatggcacttacctgtaattccagctactcaggaggctgaggcaggagaatcgctttgaacctgggaggcagagtttgcagtgagccaagatcacgccactgcactctggcctgggtgacagagcaagacttcatctaaaaaaaaaaaaagttgcttatgttttcttctaaaatgttgaaattcattttccctacagattggatcgcatattatgtactgttctgtactttgcttttttcccacttaatatattttggacatatttccattttaatatgcttagatttacttttttgcttcagggaactctctagtattctcttgcacggattcaccatcacttattcaaccagttcctattgatatttacgttgatttattttttttcctgttggaagcaatattgtagtggacatccatatatatttgtatgacctttcgtagttttttcagtagaattgttggatcaaagtatgtgcatttgaaatgttggaattgtgacagtgcttcatgtattagtctgttctcatgctgctaataaagacatacccaagactgggtaatttataaagcaaagaggtttaattgattcacagttcctcatggctggggaggcctcacaatcatggcagaaggcaaaggaggagcaaagtcatgtcttacatggtggcaggcaagagaacttgtgcaggggaactcgtatgtatgaaaccatcagatcttgtgagacttcgagaacagaatgggggaaactgctcccatgattcagttatctccacctgaccctgcccttaacatgtagggataattaaaattcaaagtgagatttgtggggacacagccaaactatatcacttcattcttgggaaactaggaaaaacacttcaaggtggagaacagaggttgcaatctcagatctctccaggaactaggcaataaca

SEQ ID NO: 98621 - DNA, 1553 bp, Homo sapiens
gaattatccgggcgtggtggcaggcgcctgtaatcccaggtactcggtaggctgaggcaggagaatcacttgaacctgagaggtggaggctgtagtgagctgaggtcgtgccactgcactccagcctgggtgatgctgggtgatgaagcgagactctgtctcaaaaaaaaaaagaattgaatttcctttgttgtcttagcttctggggtactcagtgctgaatttcatatttaactgtagtaattacctctgctcaggtacgtctgttctctgttctttttaaagtgatttatttatatttttggtttgtttttactgctctgttgtgttatgcttaattattaaagacaattcagacctttttgacaatatatttatatattacatagtataagttttaattgatattgtatgttgcatgcatatgacatataacattttatgtatattataaaaccccaatctttcctttttttatacaacagtgataacaatccatattcctcatttggagcaactctggtgagggatgatgagaagaatttatggagtatgccccatgatgtgtcccacacagaggcagacgacgacagaaccctgtacaatttgatagtcattcgtaatcagcaggccaaagactcagaggtgagcaccttttgatgtcttgctgtgcgcggatgatgctatatagtaaaaaatagtaattcctgagaagatccccttgaaataacaaaaagaatgaaggatgaaatgtttgaaatgaagggcaggtattttagcagcatatattatcactggttgctaattatagctagtcttgattgacctgcttgatatagagataaggctcatttctaattcctaccttaatggcacaaattacacgcaaggcaatgctgttgaagagtgtgaagatagtttgtcatcttaaatggcttaaaccgtccatctctaatctttccagttgtttagtaagccacacttacttgattcagactgaagtttgaagggtactttgcattatcactaattttgaattagtgaagcctgaattagtttttttttttcctgtttaaaggtccttaaattatgcatactgatcagacagcagtggatccactatttatttgagatacttcttgtgataagccttgaaccctcacaataactctaaatccaaagtgattgatttaagaacactagaatattaaaaaggagagaactctgtaagttaagaaaacaacagcaaagacaatcatactttttttctcctttctttggaaagtcatgtttgagttaggttttctgacttctgtgttcatcagctacctctgaggagaaacctgtattaaatatacactgcatgcttctttgtgtagaggaattgagcagggtagggaaacttatagttgggtttagtgtgtatattggtggcggggggtggggtgggtggaggtgctgtggagcttgtcttttccttaacgaggtttctttatttttggtaattggtaacttttcttttcccaaaaaaacatattttagcaggaggtgat

SEQ ID NO: 98622 - DNA, 1445 bp, Homo sapiens
acatctccctgaacatcctgcaggctcatcatgtcagccgtggcttctgccccatgtgttacagttgaaggcgtcaccttcgctggtacctctgtgcctcccaccatgggctgctgtcacccgctctctgatgctgctggaatcggtcctcatttccactctcactgctatttccctcgctctcaacctcgcttacttttatctcaatcataatttcagaatgttcaaaattatgtatttgtttagcagtagaaccccatttttcctgtacctcaaacaatcttccttctagctctaacaaagactatttgaatggagaagctgctctggttgtggttggttcatgggcttctttctatctcttccagagaagccctgcccatctctttctctacttctgccccactgtggtcccaaggccccctgacaccaggacctcaaagagcatggcttgaaaattacacctactcccgtgtgacagttgattgtgacaccctcctaagccatcttcttgttcttccttcacccagagttatttctctaaaatccagacctgacagggctcaaaatcctgttgataatgttgcagttcacagaatgaagcttggacaccagcactacttttagtctgaccccacgttaccttttcttcttcatgtctctccattttccttgctccgcacaccacgtgctgcagtcatgcaggaatacttcgattccccaaccccgtgggctcctgaagcctccatatactgctttggcttgagctgatccttctacaaggaataactctgcccttgtttctcttcctggtggaagcctgttcagtcctcaggtctggttagttcttgaacttccttctcatcatacataacgtatcacttcttcctgtttgttcctacaacaatctgtgtagactttttttaaaaaaatgtactgatctcattgcattatagttatgttaagggcagagacaatgtcctatttatcttcatgtccccatggcacccagcccggtactcagtatacagcaggcatttattccacatttgttgaataaacaaacaatggaatgaatgaaatgaatgaatttgacatgctcataaaagttcacatgggcagggcccaaaggcatcattttcctcctctttcactggttcatcattcttaggaagagtcaggctgtggggctgcctgtgttctagcttttgtggtattaatcagtaaaaacagcgtggttctgagcatagtgtgcctgagctgtgtctgatttcccatcatctgcacctttccccatagggccaggtactttgttcagtcccagaccctaaacttctgacctgcagccacaaggatttcaggagcactgttcaatattcagtctctaaaccccatgctgattcaggtagctggtctcctgctagccttggttccaagattctgtc

SEQ ID NO: 98623 - DNA, 1052 bp, Homo sapiens
ggagagacagaaagagagaaaagagagagagaaggaaagagagaatgagagagaaggaaaaaggagagaggaggagagggagagaaagagagaagagagacagaaagagaaggacagggagagagaaaaacaaagaaaggggaggaagagagagggggaagaaagaaaaaagaaagaaaagaggagagggagaaaggagggactgaaggaaagacaaagaaggagaatggggagggaagcaaggcgaggatggagagggagaagatcttaggttcacctgctccatcccagggaggtctcaatagagggaagaagggaaaggtcttgaagccaggggggtagcaggccagcgacttcctagcaggaaatcaaaccaaaagtctgtgagtgtcaagggtgtggacctggcagcctgtttttctggaccgttggttgctgttgactggagattttctttctttgctgttttcagagtttcagtcttaagctagtggccactgccacatggcctgtggggagagcagtaaagtcactggaactgccggtgtcagaggccagcctgtgtgcactgtatttcgtggagccttccaaggtcttttacatgcagcccttgttagtagtgaggaatcctgaggaactctcggtaaatagcttcaatgctgactagcactttgcagccatatccccaggcagaagttagtacttacaaacatttgtctcttttttatatcatgttgaaagaaaagactctggattgattgggtcttgagcccctgggtgggattaagggtgaaatcttaccctaccttttgagagtaaaagcagcttagtgtgtaatatcagagccacctctcaaatgcctgatgttaataaaatatttatcatcagcaggtggtggccaggggaaacacaaccactctcactttctttagagccttttagaactcatgatatgggggagggagagaaagggaaccttctgacttatggtctgtttcccgccatctgtcctcccaggggttttcaggcccagacccccaggcctttgcact

SEQ ID NO: 98624 - DNA, 2364 bp, Homo sapiens
cagcagtatgagaccagcctggccaacgtggtgaaaccccatctctactaaaaatacaaaaattagctgggcgtggtggcacatgcctgtaatcccagctactctggaggctgagacaggagaatcactcgaatctgggaggcggaggttgcagtgagccaagattgagatactgcactccagcctgggtgacagagcgagactccatctcaaaataaataaataaataaataaataaataaataaataaataaaatgttgctaagtgatcacaaaaaggacgcttgtttccaatctgagagctgaaccaagaagcctgagtgttgccttttgacctcggctggggctgtgcgtctcaggcaactctaaattttttgtcactctaggcatgttcatgaatgtccttggaaacatcactagtattgattttggggttacaggtaaattttgacgagtgggcgaatttgcaaatgcagaatctccaaataatgaagattggctgtaattatgtccaccatccccagttggccattgaggagactgagacacagagaacttcagtaacttgcttagaggcacacgtggtcgaactgggattcatatgctagtagatttcaatgccatagaaagagcagagcccttctggtgtgcagagaggtatggaactagctgcttacgtggtgtgtgttagaagttgtgtttggagtttgaatctttccctgaattgttatagcccagggtccagaaacactgggtcttttcctgcattgaagctagggaaaccaggtgccagtgggaaagaagggtgggggtaagggagggctcacaacatgtaaaagggaatcaccaccaactctagaagtataataatcttttacatttgtagggtttttcattttacggtgtggactcacatgaccttggagctgaccaaatcatcttctccccattggaagggcttttagaaagttgacgagtacgtttatgtcagtgagatttctcagaccggggcccagatggcctgacttttttcccagcacatactattgggttttccggagccaggtctctgagcagattgggcagattggcacacctcatctgtggcttcctgcagaaacctgcagtttgcaaagccggtagctccggggccggacaatgattcacaggaagtgcctgcaggggcacaaagggtttttactgaaggaaagtgccctggctggaagattcccattgcaaggctggtgcttttgccttcttgaaagacaggggagtgataggggagggccagaggtgcatgagtgctgtcccagggactgggctttaggcccaacgcgtaggagggaagctctttataagaagtcagctgtccaaaattcacaaggatgacttttaaaggttttcttccccggcaagccacagcgtccctcttctctttttgtgacttgcattagtcatagtgccattggaagttcccgagaagatgaaatttctttctcctacacatcatgtgagagtttcttgcaactttttattctctagactcttgaagtgattttatcactacaccacctatgtttaaaaagtataaactctgcttaaatgctgggtaaaatagtttattctgttagcacctgaagtcattttagtctggttaataaatctttgttttgtgacagttatataccatgcactctattcttttgtgcccttttaggaaataattttggtgacatagtgtgcaacaaaagaacccctgaactgtttgacactgtcctgaattggctcttacttagctttttttttttttttttttacaaaaatcttttaaaaacttgtgttccaatgtgtgatattacagacaaaaaacatacacaaatatgttcagtataaagaataactataggctgggcatggttggctcacacctgtaatcccaacactttgggaggccgaggcaggtgcatcacttgaggtcaggggtttgagaccagcctggccaacatggtgaaaccctgtgtctactcaaactacaaaaaaattagcttggtgtggtggcggcacttataatcccagctactctggaggctgaggaagaagaatcacttgaagctgggaagcagaggctgcagtgagccaagactgtgccactgcactccagcctgggtgacagagctagaacctgtctcaaaaaaaaaaaaaaaaaaaaaaaaagaataactagaaagtgaatactcgtgtaaccacctccatggcaagagatagctattgccagccccttatctcctccttgatcatgtctagacttctagctttcccacctatgtgtgcaccttaaagatgtacttttgttttgcctgcctt

SEQ ID NO: 98625 - DNA, 2816 bp, Homo sapiens
cccgccctcccccagcccggctgccagcctccggtgccctgggattttgaggactggctggagtccctgcttcacccttagagggcggtagcggggcgtctcgtggacgcatgcgccccaaattgcgctcggggaattaaaagaggggaaaaaaagcccgaagaaaactcacgccccaaacaaaacgcaaggagaggagggcgcgcggcctgcagccctcgcccgcgtccccggccgcggcgtgatgcgcgcggaccagcccgcgacgcccgggctgccgctgtccccgcacctggacgctggcgcggtggccgcgccccagcctcgatcgctcgccgcggcgactcggccccaggcttccggcgccggtgggggccctcgctctccatggggctgagggactggctgagaaccgtgtgctgctgctgcgggtgcgagtgcttggaggagcgcgccctgcctgagaaggagcccctcgtcaggtgggtgcgccgcccgggccgggatctgggcttacctgggccgtagccgggcgccgagagtgtggacacctgtgtgcttgtgtgagttggggaggtgggcttgctggaagggcacgcggaggcgccatctcagccccttggttccttatgggatgttttgggtttgttccttgagtaagatttttgccgaaaagcacaaatcttcggagacacctgagacccagctggatgtctgtgcaaagtgccaagaattcgggtgtcctacctgggcagggaagtaagggagagaagttgatcagaagtttccataggggtctgataaaatacaactgtgactgggtatttgatcggtatattacagtgaaacgggcgactgtggatttctgtgccactcagcaaaaaagttgtctatttctcattcaattttattacccaacgaagacgattccagtgactgagtataaggaaatatttttcacatgaaaaaaatgcatgtttcatcaaggggcagcctattcactaggatgttgattcattacaggttaagctatgaagtgtgaggaaatgtaatgctcattagcaataagctaagaggctttgtgaagagaccataccagcccagttttgttcagggctgtgattttaagcaatcattttctatcttgagtttgctgaaatcgaggctggactaggtcatgcctcaggggtagacatgacagaaacagaatatttaaaatggaattaggaaacagtatttcaggtggaattccagggttgagtaagcaaatactaaagccagggtttctttcttttgaagtatgaaactcacgtaatacagcttgcacaactttttctaaggaatgatttaccttttcttactctatcaagtccaaacacccccttgactttggagatcttacataaccccttcctgcctgtccactctgattttccagtacattaaacagtgtacactccttgcggccgtgggaataatccactcattggctccaaccctccctcaagtggtgacctttatccttgctcctccttcccaaaagctattttcaaggccttctcaagcaatcttctttgattactttgcccttatccatcttcctcttctaggatgtagtacttagaaattaccatctactcctcgctgtttggtaagcacacatgtatataaacatgtaactcatgtatattatatatataaagtcatacacacaatatacagtgattttgattgctcttgtcaatgacactcccacttagatttttagattattgtgtgtagggagaaatggaataatctatctctaatctaataggtagtgggtaactgcaatctagaattttatgcttaggttatacactgaacttgtcagggctcttagtaacatgaaatacagacttgagcttagtttcaacctcagaggcttgagtatttccagttttctgtccaggattgctgtttcagttaatagttctggttgttttaaaatcttagatgctctcctgtcttagcttctatccagtgaatacaagtcagtgaattttgcatgtgattttaagaagccccagggtcaattggagcggagtagcatagggcttgtgaatcaggttgcctggaatgagtctgctcacccaactaggtaacctggcacaagttattaaaattatttgtgcctcaatttcatcatctgtaaaatggggatgataatagtacatacttcaaaggtttgccacgagagatgaaaggagataatacatataaagtgcttagtatagagtgtgacacatagttaacactcaataaattgtagttattaattatcattgttattctgagcatgtgggtatgagtggactggtctcatgtggtttggtgtcattctggcaccatttccatataacaatatttgggaagaacagcttattaatggatacgtggaacagtggcgtgtgtgtatatgggtacctgcaggttctttcctatacaaggcatctgaagattggttctgaaaacttttttttagttgatttaaaaattttttaaagtatgcaattcagtagtttttagtacattcacaaagttaagcaacaatcaccactattttttttttttttttttgagacggagtcttgctctgttgcccaggctggagtgcagtggcatgatctcggctcactgcaagctccgcctcccaggctgacaccattctcctgcctcagcctcccgagtagctgggactacaggtgccggccactgcgcccggctaattttttgtatttttagtagagacggggtttcaccgtgttatccaggat

SEQ ID NO: 98626 - DNA, 1115 bp, Homo sapiens
gtctggtttcagggccctggagaacccctgtgttgctagaaatctatgaccattggtgtcccagatcagtaacagaaattacaatgaattttaaagtgatttttttttttcaacataaaagagtggtagttgtctctgaagggtcactagagggagatgtggttccagggattaatgaatttattcaatacagataaacaagatacgagtttgagcaactgatccctagttccctcaactcctcattgagaaatgttgattaaaacgatcatgaacttttaataatgccactcacctccttttttcgtcctctttcagctgctgaaaactttgtagctctagtggaggagctgtttgttgcagatgaactggaagtaaaattctaacagcctgtattgcttcggtatagaaatgaagagttgctatgctacccggtttctctttctcagttttcttactgctgccagataggaactcagaaatatagaccattctgcttccagacaataagttccatatttgaaaccctttgatggcacttactggatacctaattcatgacaaaagtgctttagtcctctagagttttctggtttaaaagtagcttttgtgggtgtgtatcaaataagtgcagcagcatattttgtgactcttaagtttttttaggttatcatgccccaggcattgaaactgggatgtgcattttactgttctcaaaggaattttgtggtttattagcacgttttttttttcaaataatctaattttacttcagaaatctcttagtgcattgtgttgtttgtaaactagtgaaaaataatcttttcttttcatgtgttgcctgagatataaccacatttagaaatcatctataacttccctgataggaattcattcaggtttttaaaacatttctagggtcaagagatcacttaaaaaagagtagtttctttattgatcacttctaaatgttattttttatccctcgtatggagtcgcatcagtctccctgtaacttccatctgttgatcccgttgtctttcttggcagaccaatccttttatacaacagttgtcaaatatctggggggaggccagacacggtggcctatacct

SEQ ID NO: 98627 - DNA, 1037 bp, Homo sapiens
tttcacacctttcctaaatactgatacaggttcatgaatacaataagcaagggacattcttacagtcttttcttacgacttattttctcaaacactctttggaactttgtttccaggcagctgttgtgctgtgtatggacgtgggctttaccatgagtaactccattcctggtatagaatccccatttgaacaagcaaagaaggtgataaccatgtttgtacagcgacaggtaagtttcagattgacactgagcttgtaacccatgtttgaactgcttgttgcctctacctactaatgcaagataccagcctccttatagtgtccagcccctctgtttggggggattctggggagtttccttacatgtactcacatacaacttcacctaccactagagtctgatattttttcttccctcgttttggccccttcactagatattacagtttttatcggaaacaagaggcagtaaaaagtaatgtttaaaagcacaatctctagagacagatggcttgggtttgtatccttgctctgccatgtcatttactaaccttctgatgttgaacaagtccctcaacttgtttgtgactagttcagttatcttttgctgtgtaataaactaccccaaaatgtagtgtctcaagtaacattttaaaaattcatcattcatggttctgtgggatgactgggttgctcagttgggtgattctctattgaggcctcttacgcagttgcaatcagatggcagctggggctggagtcacccaaaggctcaactggaccagatgtccaaaatggctcactcacatggctggaagacgatgctttctagtggctgtgagctcagttggggctgtccgttagaatctctacatgtggtttctgtatagtttcaattttcacatgaagcagctggttctaaggagtatcccaagaatgggttttctatgagaccctgcctatgtggcttcttaagacctatttttagaagccccagaaagtcatttctgttttctgttagtcaagcaagacacta

SEQ ID NO: 98628 - DNA, 1001 bp, Homo sapiens
aggattagaagaaccctttgaggatattcaatttgtctccttcctgcatagaaggctttacccaaacaattagcagattgatggatttttttttttcttaaacagctctagagaactgtgtcctatacagagtgcatgttttagggtagacaggaatgccaacttgggaatcattctaaatacataacatgtttatgtttaactcttttcagatccaaaagttgtggacacatatataaaatttaatttgcttctgttaattcagagatggagtataaaacttcaggggaaaaatatgtatttcacaatttattagggagagaattcctcctcaaaaagtaacttgaatattccctccgggatttactttctctgtgttatatccctaacaaaaatttcttttcactacactaacccttcttgctgcatttgaaacatattttttcttgtcctatttttggtgaaagttgagtgatggtatagaatgttgaattattaatcttctgggaatactcgtttttcaaattgagagctatgccaagaagcctctaggttagagtggtaagcctttggcttcataaaatgcctgcctgggggtattaagaacttgttttgcatgtgtgagtagtcttctcttaagactacagagcgacatctcctttctgtacgactgtggaaaaagagttcagaataacccatcaaaccaatacttgttaagatggtacttcagagaaattaagtgcttttaagtgacacttcttactgagttgaggtttttctcagtacttcagaagcccagcacagcttctggtcctttttcataatctcaggatgcctttacatgttagaagcagactgcatttcagtgaatgtcattcgaaagagctactctttttttccatgagcaatacagaaaagtgcagaagaggaagcatagcctttgcttctatttgctttttatttggttgtatttttttcttggtaatatgctttcttcctgt

SEQ ID NO: 98629 - DNA, 1046 bp, Homo sapiens
ttccatttatgagttccccaccctcaggacttcattacctcctaaagggcctctgtcttaatagtatcatattggtgattaggtttcaaaataatgattttgggggacacgtgtagaccattacagtgtggaagaggccagtcggagagagtgaagccagcataaaggcaaatgaaggtaaaatagagacagagagagtaatccttgccacagttgagaccctgggtctggacttcctaaggccttgtgccaccctgccctttcagttacttggttatgtagtagccagtgattttccccttttacaaaccaaagaggtttcagtcacttgaaactgggagaatattggctaaggtaggtaagagtcgtttgacagatgagaaatttgaaacttgaaaaggttgactgatgtgctcattttctcatagctgatgagttacagttacaggattagaacactaactactgttgatctttcttaatagcttgcctttctcacttggcaaggaagatggaagtggggacagaggagatggcccctttcgcttaggtggccatgggccttcctttccactaaaaggaattaccgaacagcaaaaagaaggtcttgagatagtgaaaatggtgatgatatctttagaaggtgaagatgggttggatgaaatttattcattcaggtaagaattgaaaacattgatgggaatttttaattgtacccacgtaaatttctcttttgattagaggtctcccaaatgtttcctttttctgggccactctctaattagtcattgcttaatattctgagttttattaaagaaatagtacacccacccttaatcaccctttttaaagtttgtgttcttggcacatgtttctcatttatttccaggacctgtgtcagtgaagttcaggaatatatagataccatgagaaattaacaagtcaaattgcaaaagatgaaatagtagatttcttcattatgccaagcttgggatacattttttgggcccttttttttttacacatctacaaaaaacattattaat

SEQ ID NO: 98630 - DNA, 1471 bp, Homo sapiens
tatatacatataaaaatgtgtatctttaatattcagaattggaattaatgaattatagagttgtaaacagtgatgataattataggatggtgccctccctttgatactctagaacagaggttcttttttttttccttttttcttttttttttttgagacaaagtttcattcttgttggccaggctggagtgcaatggcgcgatctcagctcaccgcaacctccgcctcccaggttcaagtgattctcctacctcagcctccctagtagctgggattacagccatgcgccaccacacctggctaattttgtatttttactagagatggggtttctccatgttggtcaggctgatcttgagctcccgacctcaggtgatccgcctgccttggcctcccaaagtgctaggattacaggtgtaagtcactatgccggccctgagcagaagttcttatcctcaggtccgtggttttcagggagttggtagtgaatcctttatattgtgtgcagactcattcatgaatgtgcttttatcacatcctcaaaggtgtgctggtcctgaaaaaatgttaagaacctctggcagagttgaaataaagtattgaataagaggaaaatagagctgttcattttcacctgttagtaaagtaattcagctcctcttcccttctaagccaactcactcttgccctggctatatctcccaacttgtggttgttgttttccggccatctcctgctgtttctctctttataattaacattagctcacttctcattgtagaaaatcaaatgcatcatccagcacaagttaacatttaaaaattgttgctttcattttatatttttctttattaagtgagagtctgagaaaactgtgcgtcttcaagaaaattgagaggcattccattcactggccctgccgactgaccattggctccaatttgtctataaggattgcagcctataaatcggtaagtggcaggtacacatttttaacagaaatgttaccaggcagataaatatgtgtatataaggaacagacaattcatgtgtgtgttactcggaaccataattactgcttttctagttgttctccctgctcatttaatctctgtttagctttttgtgtaaaaggcaggctaggagaggaagtttaaagaattgtctataatagagtttgatttcctcctcttttactttctctccattggtaattgattgttaatcataagttctaggcctgtctcttttttttaaaagaaagaaaatgaaatgcattaagctgtgttattgtagtatcatagcagaaatgtagataatgcaccaaagttaagttcagttttggagctcagtgacacctaattcaattatgaatgatctgatagtaacaacatctgtgaaatgtaaaaaaatgttttgttactgtaaaattgcattttataatatatgtacatttatatacaatagcaca

SEQ ID NO: 98631 - DNA, 1085 bp, Homo sapiens
taggccaggagttcgaaaccagcctggtcaacctgtctctactaaaaacacaaaaatagccaggcatggtgatgtgcgtctgtagtcccagctacttgggtgtctgaggcatgagtatcacttaatcccgggaggcggaggttgcagtgagccaggattgcaccactgcactccaacctgagcgatagagcaagactctgtctcaaaaaataaaaataaataaataaaaatattagacagtctgaggttttgtatagaaagtgtgaatgtaaatatttgtggattacttttgggagaaaatgaaatgtagagaaggttatccagtatattttgttatgaaataaactaaaattttcataataggcatgagcaaacaaaataatggagctagagtaattgttctggatttttgtctgtgccagagagtgtattaggttttcatcttctatcaattggaatcctaactttccttgttttccctttgtgttttggaatgtaagattctacaggagagagttaaaaagacttggacagttgtggatgcaaaaaccctaaaaaaagaagatatacaaaaagaaacagtttattgcttaaatgatgatgatgaaactgaagttttaaaagaggatattattcaaggtatgtcagtaagagttttcactgttgcctaaaagacattttcttcaacatgatgtgatgcaggctggggtttgtattattctttgtttaaagttatttctttgagttatagaaatataacagtttgaaaggataatgagaccctaggtcctttagctcatttgttgggtcttaggcaggttgcttctcaggagtacacttgggtgttccatctctgtgagttttaaatgtcttaagtgatagtactcaatacttggctttattttaaagtttgaaactcactagctaggagcatgtttaatatggttgaactaaggtttttttgtttgttttatttttgactttcatggtgattattcttctaagggccaacttcaggttttatgtcctaccagatatgcttccttaatttaggggctgaaaattatttgtatttattatattgc

SEQ ID NO: 98632 - DNA, 1772 bp, Homo sapiens
aacaaataaacactagatcacagaatctgtccctggatatgaaagttttattgtgtcttggggtaaagatgcatgtgcttttcctttgcatttgtccaaggccagaatccttggattttgatgctccttcttcccacaaaacatagaagatactgtgtattgaaagggtgtgatttttcatagaatataggctacagaacagggctggactttttttttttttttttaagaagccgagagcctatgtttatataaatatcctatgtaattaaaaagaaaaatacagttaaatcccagaaataaaagaaatttaaatatagaaaaatatataacttatcaattgaatgtttccaaacagaagagttttagcttctgtcaggcattgcatatctccagcatacgtttttgagaacattttgttctgaaaatttcctgttggcatttttctctgtgggtctctaggtttctgaataatgtgttcttatgtttacaaatcatgctgtactttagtcaaccatggtttatctttggaggataactagtacgttaacatttgccagattttttcttttaggctgggtaatcattgagctaactagattgcaaaatatgctactttaaaaaatgtaattagattttaatcatctctatattgtatgtgtggtttgtgtatctgctgctgctttttcaccattgatcacaaggggcagtcatctgattccagggaatagaagatggaggcttgctctggcgtgtgcgtgtgttgttaatgtatgcatggaactaatttcagcttgtagaaaatgaggccccatatgcttaacagatgctcttctctttttctccagggttccgctatggaagtgatatagttcctttctctaaagtggatgaggaacaaatgaaatataaatcggaggggaagtgcttctctgttttgggattttgtaaatcttctcaggtatgattgtgaacaaactaaatgagctttttcctagctgttatttgaaatggtatgcttttgattggtcattttatttataaggtatatttatttcacttttaatttttctaaaatgtagtctgggggttaatgttgccatggtatgtattttatacattgggaaactgaggttcagagccgttaagtaaatctatatgagcatagcaaactaaaaatacaggatggtttttgaatggggaatggaagcggagatgaggggtatttgaattatgtgggcctaaccctcatccctttgaggttcagtcttcttgagctggtattatggtgaaagtgctcataatgtctcaactctagaggtgggagggcataaaaatgcatgagaaacattgcccaatacagcacattgcatgttcttgaaaataaaccgcaggctccagatttcatagatcagacaaagttgatcttggtagataagtgcaggtggttatgattttcagaactcttcaatactcattttctaatctggtattagtagagctgtcttgacccctcttgatactgtgctagataagttaattgaatttaagggggtggggggagagacatgcagtacttatttttgatttaatttctctttctttcaacccttcccctctaagtcttcactcaagcctctactgttcatcagtgcctcagtgttactcttaggaggaaatgcaaaccacttagctttgtttttaggagacttcatcatctgatctttgttaatctctgtaatctaatttttcacctttcctctcacacagtg

SEQ ID NO: 98633 - DNA, 1095 bp, Homo sapiens
atttatctattgaagctcctcaagggcaagattatgttttgttcactgttgtgtttacagtgctcagataatcttgaacgcatgctgggtgctcagatatttgttgtgttgtattgaattaaacttcaggtaataaggtgtttttagtatctgaatgtttttcagtaagaggattttgaatggaatttcttggcaatgtgtgtcatggttatacatgttacttattttggatcaaaagcaattcttttcctctcttgtaggttcagagaagattcttcatgggaaatcaagttctaaaggtctttgcagcaagagatgatgaggtgagttggcagcaggtctttgaggtagtgctacagaattgaattgtaagtctatgaaagcaagttgtttggggcttttatagtttaaaatgacatgaattcttgcaataggagtggggaaatccactgatgtttaactgaaaatggagatgtggtaaatggatttgtgttagcatgagcacaagacccgaggacatggagaccaaggaagtattaaaaacattttgaaccactgcatttaggaatgggaatttcacagtcaaatgttaaggagggttggggtcaggttgacattttgtgttgtcataagcatcctggatgtgcacttcagtgactcactagactgcttttgtcattgaggaaatgtgtcttttctctattcctctctcttggtactcttcctgcctccccaagatactctgttttcaggctggtttttctctagctaacagcctatgactgctgcattctatactcacatctgccctttctgtaaatatttactgtttgatctccaagttagaactaactttgttggagatactgattttaactggaagattgcaatctactatctgtttaaggcagctcaagcaggtttccaagttcctgaagtatttgcatttgtaattaataaactggatgtagaaggcttgtttggggtgggggtagggtggtggtataactagtatagttctctttttctcctcacttctggaaggtagctggttgctgatatagtggatgggtatgccattattatctcagaaca

SEQ ID NO: 98634 - DNA, 1806 bp, Homo sapiens
aatttcattaaggaagtgggggcagtagctggactagactgaagaataataatgcactaagcagtggaaacagcatgcctattattttaagaaattcagaggtaaagacaggaaagatactgatagcaatttgtggagagggaaggacaaacaaaagatttgtttaggagggctgacatgagtttatttttagggtaaagataaaaatttagagaaggaaggttgaagcagtaagacggatttagttaatgaggttaagtcccagaagagctacagtaaatgtaatcaaaagcaaatgtgtgcacttcgtccttcaagtcagggggcaccctaaaaaatgtaaaatagaaagaaagtgataacagtcttaaagtattgagttctgttgtgaaaactctcacatgttgaatatgtgttaatacatccatctttcttaccaggcagctgcagttgcactttcctccctgattcatgctttggatgacttagacatggtggccatagttcgatatgcttatgacaaaagagctaatcctcaagtcggcgtggcttttcctcatatcaagcataactatgaggtaaaacccaaagtcttaatgttattttttttcttcagttcctttattctaagcagtgtttctcagctgttaatgttcatgacaattacttggggatcttgttaaaatgcagatcctcattgtgtagttctggggcagggcccagattctctgtttctctcgagaaatgctgatactggtctgtgaaccacactttcggttggaggaaaaagtatacgttataaaaataatataagaatcttttaattataaagtatcataagaatctttttattaagtattatgaaaatcgttttagattaaaagaataatcaataaaggttcaccatggccttttcttggttctcatccttcttgacttattggaaccaaatagagaaattacctccatttttacaaatgagaactatgaataaaggctgaggatatgattttgttgtgatctttgtgaaacggtttatttagggctctcttgtgtaaaatacagttctaaattccttatcatttcctctgtctcagagaacttactgtggccgaactggaaagagaaggcacatatcttgacttccaggtcaaccttctggtcaccctagtcttctcatttgttgtattggtcatgcatttgatagcagtcctttagtattcttttatacatttctcttatgcttaatattctttatactgtttgcagttgtgaacagccagtagcagaagtcaaaacacttcacttttcatatgccagagttgggctgtccgatttttgaaatatttctgttatgctactttcacagaatttgggatcagttttatattttttcattaatttcatcgtttctgcttttaccccctttctttctcattagtgtttagtgtatgtgcagctgcctttcatggaagacttgcggcaatacatgttttcatccttgaaaaacagtaagaaatatgctcccaccggtgagtttgttttcatttagatcactcattgactacacacactgttcttgggaaatcacctgtctgctagttgttggttggggctaggtatttatagggtgcaattagttggatttccaatcatacacttagacacagtaatgatgaaggtggtttacttggtgtttttccagtagtagggataggtttgccttaaactcacccaacactgtctagtttttgccttggagcatgtacctaggggaaagcttgatggtaatggatgtccatctct

SEQ ID NO: 98635 - DNA, 1202 bp, Homo sapiens
tcttgcctcggcctcctaagtagttgggactacaggtacgcgccaccgtggctggctcatttttaaaattgtttgtagagatggaatctcactatgttgttgtggctggtcttaaactcctgggttcaaacaatcctcacatctcagcctcccaaactgttggaattatgggtgtaagccatcacgtccagcccagaatatttttaaaaacccagtttattgataatttattttgtcgacataaatcactcaggatctgaaacattaaatatcttctgttatctattttctgtgagttaacatttgtttacattttctccattggaaaaatggaacattaaagttatttcatgtatttcccagtagatgtctatgtaggaatgcaatgccaggatgatctggcctcctgctaccttgtagtagtaggtgaaaatcactgaatgttcacatgtacaagtactgccccctacctgttgctgggagggccttgaattagcaagttcaagatggtgttggctgtgccattgcctgaaacctccatggtttcaccatgaaaagtccataaatgggtaaaaaagaaatatctgatgataaatatctgtatgctcttttattttgttgtagctgtacaaaagggatatttgaaaaggtgcagaatagaagtataatgtactttttaggaactacttactcttttccaccttttgcctggtgactgtgaatgttccagaaatagtgcctcaggttcaacagctgaactgctgtatgaatcagtaaaatgaaagttacacacagtagtttaggcagaagtatttttgggagaattgcctttcgtccatattgctttgggctgtaccatttttattgactgagtagatttttattgaggagcacttgttttttattagtattaggagagacctaaggaaagaggatgtcgtatttctgctctcatggaacttgagagtttgaatggagtagggcaagacatgtacgcaggtgtgagtagtgtcatggaggcattaagagaggagagagcttattcagcctcagtagattgtgaaggaatcagctcaccctgatccaatggtgtcttcctgttaaggtgctgtactctgataaaagttatattaaagtcattaaaatgcttatgcttcattaccagagaggttttttctttttaatgtttttcttctttagct

SEQ ID NO: 98636 - DNA, 2121 bp, Homo sapiens
ggaaggaaaacatcaataaactgatagtttcatttctttctttgttttttaatgacatctaatcttactgctttctatactccttttagagcatttccttttctgggcaggccaaggcctggcccagtagacttgaggcaggataggtggttgaatgaggtggcatgctgtgtagaacttcactcacatgggcagtggagaatttgccctggccttgatcttggcgcccctcccccttggtgttgcttcttgacaccgctgtcaacaactagagccctggaaaagagcactttattccttcagctgttatcggccaggtgcttattatgtgccaggtagtatttttggtgcttagaattcattcagcagtaaagaagagaagagccctacttgtaaggaggagggttagataataaacaagtaaactaaaaaattgataattttagataatgatggagcctataaaaaatataaaataagggaagtgacagaaaatgactggggtggtagaatggggtggaggggctacttcatatagagtgtcagggaaggcctctctgcggagatagtatttcagcaaagactaaaatgatttttaaaaaaagggcaagggtggagctgactcttgaggtttagggaaagacagaggaggcagaggtagtgttaagcccaggccccaaagttaggatgagcttggtgtatgagcgaagcaggagcccagcctattggggttgtgagtgaggagaacaagtggctggtgatgcgatcgaggaggcaagcagggctgcatcataggaccctagggtatggtgagcagttcattctcggaccacttccagtcagacagtggaaagagaagctgggaaaccagttagaaggtgactggtaggccagggatgaggtgatagggcttgggcaagaatggtagcagtggggagagagaaaggtggatggacttgtgctgaaaagtgcaaactcagcactcagggacaactcagtattctcatctcttttgcagacctctctctgggactcactgagcatgggcagcttccctgtagccacctgtttcatccaccacatggcattctctgagattaagtgagggagaaagcacagcatgattaagagagataaaaggattataacaagaaagttataatcccagattatcaggtcttagaatcaggtattttagggaatcttgtatattccccaagtagtaaaaacaacagctttgatttataaggtgaggctcctttccaggaggtccagagcagaagatactgttgctaggcttggatctatttttacaattggttttaggtattgaccaatatcctgccaacaaaggtggttctaggtgaatcctcttgattgttttttacatgtggtatgaatcacttagccctcccacactaaagatggaggatccctgatcagaaaatataaagaagccatatatgtctccatctgtgttttaaaatccttactttttccaacagtgtctgctgcacagagctttacatccccgggagcctctacccccaattcagcagcatatttggaatatgctgaatcctcccgctgaggtgacaacaaaaagtcagattcctctctctaaaataaagaccctttttcctctgattgaagccaagaaaaaggatcaagtgactgctcaggaaattttccaagacaagtaagtacttggtatagttgcatttaacattggggtacataagagttgtggtcattttagagtggctctggaagtgtcacataggggtctatggaatttaaaaggtgagaggaagaagccttttgctatttggcccttatattgaaatattgatttcttatatctgtctgctgtgatcatattttatccttgctgttcactttggatttagagctaccttctgggctgatgactttttgatcagcatcagattcttggtgaattatatataatgtataattcagataagtttctgaatatctaaggctaaatgtcaccctttttaaagtaaagtactgagaatgagtgtgttgaagatcataggttttttgggttgggaggagattagatgttggggatgtcaatgagatttttggaggaaa

SEQ ID NO: 98637 - DNA, 1964 bp, Homo sapiens
ctaggaaagggaggcagcttgtttgtagaaggactacatgtagctattgtttttcttttctttttcttcttcattatttttcttttcttcttcttcttttttcttttttttttttggtgcttggaaaataagtttcacaatagcaatctggttttgtattgtttgttctaagagaaattttttttttcttttctagccatgaagatggacctacagctaaaaaattaaagactgagcaagggggagcccacttcagcgtctccagtctggctgaaggcagtgtcacctctgtaagctaagcttttcaagtgcgcttccccctttgcaggaaggttggggcttgagggagagtgcatcaatttttgttagtccgttcttaccactttcaagttaagatcatgatcactttctctggtccttgctctatagaagccaaaaagacccattccatacttctttaagtaattattatcatgaattgcctacagaattatctatatgatataaggtatatagagctctttatagaacgtggaacatctcagtgttgagattttgctgttggcattattttgcagcttttcaactagtcaaaatgataggataagtgggggttagtgatacgagccttaatcttcaagtacacacaatttaagttagtataactttcctattttctaacatgcaactttagaacaggattcacaagtttaggatttccccaagaatgtatcctttgatacatgagatttttattgaatgagaaattttttggaacttgaaaatactaccttaattaattaattaattaattaattaatttttatatcttggtcagccaggaggaagaatattttatttaattttagagataggttgtcactgtcacccacgccggagtacagtagtgtgattttagctcactgcagccttgaaatcctgagctcaagtggtcctcctgcctcagcctcctgtgtagctaggactaagggtacatgccaccatacccggctatttttcatagaggtggggtctcagtatgttactcctgggctcaagcaatcctcccgcttcagcctcccgaagcactgggattatagtcatgagtcactgcacccagccaaatagtgccttgttctaagcagcattagtgtgaatcaacaaatcttaaaaattggccgataactttttaacacaatgtactaggaaggatagtcagggaataaagggcatgcctttattctcacctcaaacagaaactcagaaaaattgaatgtgtgaaaaatgatttagatttcatttagatgttttatatataatagtaaaggaaaaagtcatgatcttgttctgagagcttttctgcttcctatatccaagcaaactggaagctttagtatattttggaaccccattgttttctttcttatgagctgagtggttcttaggccctgtgagggttggggccagcagattaaaaacataggtataatcagaaagttccatataatatggcagtttcgtctttcaaacttcctcacccagcactgcagtacatctttgtacataatctgcttttactttctgaggacatgttcaacctgggtatgctttgtatattctaccaaaacttcagtgccaaagggtcagcagcagtcccactaatgggcacttcggtgaatcaggcattaagctgtatttctcatgttatcttagtggggcaaatctattcgaaaccgaccccacactgcagaatcctcggctttctaattggttgggtgacaggatatacaggcagtctgtgctacacaaagccttccagctgggctggctggtggcttgagttgtaatacttttttgacccttctggaaagaaatcagctttcataaagcaaggtgagtgaaagcacagagggcagctcttggaccactgaaatctgccggcctttcacagagccctagaaatg

SEQ ID NO: 98638 - DNA, 2468 bp, Homo sapiens
tgtttttggttttgagatggaagaagagctttttgtcctgctaaaagttgccatataggagaaaaactttgagttttaacacaaaacaaaacctcatgtaaatagaaggagatctgaagttctaagtgacagttttctaggattggtgaaaacagtacttcagaatttctctctttaatgtattggagtgatcaagacactttcacagtattatacctgttgtctgttcagctgtatattgttacagggtgctcggaaagtggcggagatgctgctgtgacaagtcaatgaactcttgtctatcaagactattgtgtttttgaaggaaaattgagactttcctagctttcaattgtatgtcgtcaattacctcagccagtcaaagtccaaggtcccccgtttggaagtgattggactctgtggttggtgtaggcatggtcttttcagggactgaatctagctgtcatcaccattatatggtagccactagcggtttcatatttactatgttcaaggcattgtgctagcacttttatgttattttaattaccctgcattagcagttctgcaaaatcttgtgaagaaatgaagaaaatgttagagctttaacagcttttgccagaattttctgagaggattgctttacttgggaaaataactttgataagtgcttagggtagagaatgagtctccatccccagacttggttggctagtccagaggcttcggaggaaaggaagctcctcagcatcatagaagtagaaaaactggagctggtttaggagaggaggggcttagaagaagaggggagaggcagggagacaaagtgggtgaatttacgcacagtcacggccttctacaatacgtttcaaactcatgaccacaaattactcagtgtcagtacaactctggaaatgccaggtttaagtgctgtatttggggaaactggcagtttggtatctggcattatttcatgcagagcagagaaagcacctgagcacacaggaggccagagtctgaaaagaccaggagagagtcagttactgagaatctactcacatcttaggaaaatatgtcttacccctggccatgggattggggattcagagcagtcttgtgaaaatagcaagggcaagcggaccctagatagcatgtaagttaacaattagtattattatctccattttactgatggataaactgtaaaattggaggagatgcattttcccaaagatcacataggaattcaaacacatgtctctttcaaatactggattttttacgtagccatattgtttcttttgattcctaatgacttcctttcctacgctttttaaaacaacattttaaggtcgtgtatctgaaaccttgtacctactgataggacttttgatgaatagattgttcttttatattgaatttgactttgagacccagcatgttgctagtatttcgacaaaagatgtccctctgacctccgtctaagacttggtgaatcagagccctctagtgatgtcacaaaaccagactctccacagagctgtcggaaaatggattgcttattagcaactagttctcgtgattttaacttggcttccgttttatcccttctgccgttcttggtgccagctccagaattgatgtcctgttctttgttttgggcatcttgtttgtttgtttttccgctagggcatctttttactaacgccctttataagccaagactcacttctcttgcaggcccaaagagttctccctccctagtagtggtcttcttttagagagatttctgtccagagtcgggagacaggaatcccttccccttttctccagtaaatttattttttaaaattcagttgtcaaaagggcgatcagcgatagatagttggtaagattgtttgacccttaggtagaactcggctgttttacctatcattataaattaaaatatgggtgtagttactttttctcaggcctgatagtagcataatcaaactgagagtcttgtgattctgtccccgacatcagcagtctatatatagtaggcagctacacattttcttaacttctggttttcagtgtgagggatgtatcttgttctaagcttactggcagagaggagataaccaatgccctgaaccccaggaagcatgttctttctggctgcccttttcccagtccctttcctccattctccctacccatcaccattctatcaccacagagttagaatagaaaacaattttttttctcttttccttttttgtgaaggggtctcagtctgtcgcccagactggagtgcagtagcatgatcacagctcactgcagcctctacctcctgggctcaagtgattctaccacctccaccccgccaagtacctggagctacaggcacacactaccacaccaggctaatttttgtagtttttgtagagatgaggtttcgccatgttatccaggctggtcct

SEQ ID NO: 98639 - DNA, 2174 bp, Homo sapiens
gctcagaaaaaattttgaccacagctgtatatataataatcatctatcagttatgaaagtagggttgtttccctacatacactattcataagcacatcattgccatcatctgggatttgttacctgtcgttgtgggtttcagagtctccagaggctctttacattgagtttatccacttgtttggatatcttccacccagctaatcaacagagttgctaaggaggaatgccatgattttcagctccttgcgctttcccaacttaggaagaatgctaaaataaaataaaataataaaatgtcaaaagatagacagcaggttcaagaaggaaaagccacattacttctttcctccggacaattcctgcgcgattatgtctgaatttataaattcccactgagtatgggagataatgtaaaatagcttgaatgttcttggtgtgtcaaaaacaggttttgtgaggatcttaagagccagaaaggatggatatatggggacagataaaaggatggaatgtaacttaactttataatgagacgattctctttcagggaccttgtttttgccactgagattgtagtttctgtattaggcttgtgtgtagtgacagggtggcagagctccatgttaccaaattgaattcacttgagcctgactggtttaaaaaaagtctgtcaagagaagacctaagtagaaataatacagaccccaaacagccttaacatttgactcatgtacaagagagcagtaatatgtacttgtccatttgattagaaggtgatcacttcatttttttcccctttcactttgtttggattacgtctcatcctagagtctttttgcctttgttcttcaaccttctttaatctcacttactagaaacatcctttcatttttaaaagatatttcctaaaattcactttttccaagcaatttcagcactagatagaatatggtacaattagtaataatatgatattcatcaaagccaaatagttttcagtgttggttttgtatggtatagcactatcccatttgcatagctgtttacttacatacattatgtgattttctgccaggagtcaagccctaaacagtgaaccttcgagaattgtgatctagcagaaatctctctcgtgtgtgtgtgtgggtttgtgtgtgtgtgtgtgtgtgtgtgtgtgtgtgtgtgtgtgtgtgattttttttaattgatcctgattcatgtaatcttgggtatgaattatataatgaattatactctgcccagatagataagaagataaaaatatggcgtttttctacacagcgctggtaaatttaagaaaaataagctctttcaaataccttgagcatcttaaagatgctaaatacaaacagtcactaaaattttaaacatctttagccctataaaagtttttttcttaaagaatttgacatacttttttagtcctttctccaaatagcattgatacatctaatcatgagaaaattcatgattaaggattccagaggtttagtctgtactttgtatttttattaaatatctcacttgtttttcactggttttctttttgactcattttaaattattaaacctcagaacctgacaatccaggcttattttatgcctcatttatcaggacaagtggtctcattgtaacacaaaaatcagtgtgtttggaattgtagagaatacttgctgaaagggtgtgttatctgacatcgtaattatgcaccattggcctttaaggtgttgttcatctttcatgtgggcggactgaggcccagagtagttaggatgacttttcacagataattgcaaatatgtgaaagactctggatcaaattccagagagccaattcttggcctctgtggcttaaacctttttactggttgtgtatatttcattggatggcacagcaccaccctgaagtttacatcttaatataatgaaactcagcagccaaataatttagatgaaatcattgaaatagagatgaaaagaaaaaataaaaagcacatgacgtagaaactaaagaccattatgcacacataatcattttaagtattttcatttttcagcgactcttcctaaaaggctttcatctattcttacccagcctttaaaatccttttaagttcctgtcaatctgtatcagaatatccctaattac

SEQ ID NO: 98640 - DNA, 1748 bp, Homo sapiens
agtgagcacctgaatttcttcctgagagctttttaaaaagtccttatgaaatatatgacagtgttcctgttttctcccagtgttttgttttctcatgctacataggaaagttgcttcccttaaatgtgctgagtaatttttctctttttatattaaaaatggaaagaataatttcccatctggctgaaaatggaattcatgaaggctttctcagcatcataactagatgagcccagagtccattcaagcctttacttaatatactaaatcactcctgataccagtcttctatgaaggagagagagagagagagagacacttttaaaccatgagatatcaaaagaactcactgtcacaagaacagcaaaggggaagtcctctgccgtgattcattcacctcctaccaggctcctcctctaatttgatatgagatttgggcgggacacaaatccaaaccatatcatttcagcttgcatcaatgacttgggccatcagtgcaacaaggcaggtgctcacaattggttccgatggaaatgcagaactcttgggtgcttaggagaaagggcctgcagcttgctcttagaattcacccttgcagtaagtgctaatgagtatgatttgtgagacagagagcagttcaaggatttactcatggcaatttggttctttctttccacctcctgttaaattctgcagttcttccttccatggtaggtcattgtcatgtcatgtagggtattgtacttggttctccttgaattgggctgtcttcaagattgctccttaagcccagctggttgaaaaaggaaaccggtttcagattgtgctgatgtgcaaactgctttaatcaatgacttgaagtgactgctggtggcaaacaacagacgctcttaaccaattaagatatttaggaaaggatgttaggcttttgttaaaatagtcactaatgaactgaaatgtgttaagaggagccaagaaacagctaggagttccacttaaatgcaataaaagtgtttgggtcctcccctttcaaattgcatgcccaaggcaaaaaatatgctgacacagaaagaagtggcaagtgtaatttggtacagttagcctgtcagatccatgcgtgtctacataaaacctagaaaaatgtcgtgcttgcttctttggccagaaaagggaagggagtttaattcctttatagaacagtttcagcagggctggagaatattaccagcttagatgtctttggaaatgggagaaaatttaacttgtttttagaggttccttatgttttagaggttggagaaaaatcttcagttaatagtcataattaaaggcccgtttttattttcctctgtcagattaaactactgaaatctgtagttatctgttcatgtctctcagtggtaatgaggctcagccataacactcaggataatatggtatttcattggtagccatttgaagtcaggagccattgctcatataagaactacttttttacaattcccttgctcttggaatccaataatgttttcttggggcattgagagtaagatacactgtctaagttttcatacttattctgtgatagaaacatctagtttctctcttctgtctgtggtaaatctctacaagtctcttagataaattgcacttattaattctactttttaaaatagctttattgaagtaaaatcttctactataaaatatactggtaagtataatttgatgatcttttgtaaattata

SEQ ID NO: 98641 - DNA, 1599 bp, Homo sapiens
cccatgaaaattgtcttcctgttgagagctcactagaaatagaaacaattgttttttatctccttgtatgacaatctcttaactgtttcgagatgatttacttgcttcttaggcttccattaaaaataagcacatgcttatatgggggaaaatgcaaatagtaatataatagcatataaagttaaaaagtggacatctccttctttattgtctccctccctttgaaactctgcccatacccacattctgtgtcttcataggaataaccctgttcatccctactgatgccctgtattgtgatcaagatggttaattgttttagggtataataaattggggatatagtcagagacagtacattttgggagaaccctccattcccagtggcatcaagcagcttgatcaaagaaaagaaaaaggtgtacaccaagatgagatgaggcatacttagtaagcaataataaaacgtcaagatgtcttcatgcatataatcatgacaatgttggatgtgatatctcatccctgtacatctgcatatatatcttatatagcatgttattctttctgcatttcccccttcaatagagctttattgtaaccatttccatctctgtaaaattaagggagggaggggataaaagagagttctagactgtctactcccctaagtggcagccagtgctaaatacacagcttatgggtttaaactgaacgaacaacaaaaagacatgttcattccttaggcttttagaggaataaaccagtgaggcctacaccatttattcatccattcaacaattatttgttgaatgcctactgtgtgccagtcataccaagatacagacagtaaacaaataagaaaatatatgtcaaatggtgataagcatttgtgttagtgtcctagtgctgcagtaatggagttccacaaactgagtgccttaaagcagtggaagtttatccttgcagttctggagactaaagtccaaaatcacaggactgcttccttctgagaggtatgggggagaatctgttcaatgctctcttgtagcctttggtgacagctggcaattcttgcatcccttgacttatagatccattactgtaatctctccttctctcttaacaggggagttcttgtatgtctgtatccaagtttgcctcttcttataaggatgtcagtcctattggattagggcctttcctagtgacctcatcttaatttgatcacacatctgcaaggactctctttccaagtaaggtcacgttgtgaggttttggtaaggacaggaatgtgggggcggggtggggatactattcagcccatgacagcactatagagaaaagttaaagcaggatagtgggatagggaatgctgggttgagatgggcttataattttatgtagaggatcagggaagtcctcactgttgaactgagaattgaggatagtgagagagagaacctagtggatatctgggaggagagctttgcagacagagggagcagcatgttcttgagaagctcaagatgactatgcttggctagaagcatcagggaggtccgtgtgactggagcaaagaaagtaggagctgagaagtca

SEQ ID NO: 98642 - DNA, 1730 bp, Homo sapiens
gcaacctctacttcccaggttcaaacaattctcctgtctcagccttcctgagtagctgggattacaggcatgcaccaccacacccagctaattttgtatttttagtagagacggggtttctctgtattggtcaggctggtctcgaactcccgacctcagatcatccacccgcctcggcctcccaaagtgctgggaatacaggcacgaaccactgcgcccggccttgagtttcttcattggcatttctgacaactttgtatccatttctcttctgctttctaatcatcttctaatttacttctcaggtctgtcttttcctttccatcttatcactatccgaattcaggctttcattattttatcattggacagttccagcatccttcattaataaccttcaaagttctccttcattcctgcccatatgtttgtacagatttaagttcttatagcacagattttattctgggtcagcccttattaattactcccattcagtcccccattcaaggcttgccacaatctggtcccattctgccactcccgacccattcttatacagattccctctgtgaaccttgtattcaaaccatgttcctgctaatgcccttgcagcatcggctttctaaagctgattaactcttttaaaaaaatggccattcttatctttacccccaaatcctactctaaagagatgcttgtgatttgagaaccggtatatctttggatcccaatgccgcccgtagttttattgtagtatgactcattagatactgctgctgctttaccatcagtgagacaaaatgacctccatctggcttttttggttttcattgcgactttaataaaacagtgcttgggagtaataagaatttgaatttttgaattgtagcagatttacttctctggttctttggatcaattcctaagtcttagccccatcaaagaagaagtgcagaatctaacgtgtctgtattttgacctctagaatactgtaaaactttcttcataaaattagaaaggatagaggggggaaaatgaaaagaaaaagaagaatctgagaggtccctaaggaaaaataccgtataaaccaaggcattatttatcagtttttagaaggagttatcacatagaatgtggtctttctaaaatttctggtacctaatatttcctttcaaaaaagactcaaattcttgaggcatcctagaagacttgtgtgctgcctcccccttgtccaccctccccaaaagcacattcaacaatggctgcctgtttctctccttggtgaggagtctgactcatcattcactctgtcttttcaactgatacctgcgtttcagttccattcaattaccaacttttaattggatcccattgccagattgattttgtgttcctgttccctcttggctgcactgttactatgactacttggtatcttctacttacttcctatattagtttgatgacatctagtcaggtatgaagctagatagatactataaaattgctacagtaccaatcactattatcttacatttttcctttcccctactgctcatttggaatggaatcaagcatggtgataaggttcttaattcttctctatcaattttagtaagcattggcaagttttagaattctaggaccttggaaaattgtggagaccctcttcctctgccctccctagtcttcaccccccaccacaacacattctttcaggcatatgg

SEQ ID NO: 98643 - DNA, 1027 bp, Homo sapiens
gatttttctgttctgaaagggaagcagggaacttcttttttgttagattgaggaagtttggggcaaagagctagcagaacagtttctagaaggtggaagaactgtaggctaaggcaaagagcagagctatgtctgcttctcagtccagctgcttaaaaaagatgacaaatttcaatgtcattttcaggttactcaagcttatgcttttttcctagttctctgtttcttttgttgccatccagtgatttatttttcctcaataagaatatttcattaaagaccatgcaactagaaaacaagaataccaagagcaaagagcactcttcagtccgaactcttttagaagtggaagcagaaagaagggtgtttaagaaataagtcagcactgtgtgtgtgtgtgtgtgtgtgtgtgtgtgtgtgtgtgtgtgatttagagaaaaaatatttaagataccttctttttgtacttaaaatttcataagtacgtttgacttctgagaggaccagaatgccatgggaagtgctcagttgcatccagtacctgttgtttattgtcatggtccacacggttgcatgtcacaaccgtgttagaactgaaggaaaggaaatgtatgtaactctaaagacgtttcaagtagaagtgaaaacaatatttttttacataatttgttttttatagaaatacagcttttatcaaatgtctgggagaagctttaaatatgcttttgaacttcttcagtaacttttaattgaatttcattgtatcctacctcactagaaagaaagaaacctgcaaattttagcttcccttataatttaaatgatgccttgctaatttctgtgtttttgagatggagtctcaccctgtcacccaggctggagtgcagtggtgagatcttggcccactgcaacttctgcctcccaggctcagatgattctcctgcctccgcctcagcctcctgagtagctgggattacaggcatatgctaccacacccagctaacttttgtatttttagtagacgggg

SEQ ID NO: 98644 - DNA, 1011 bp, Homo sapiens
ccttgtgagttcataacacactgtgcccttagatcccctcctcaccctcccttcttctgtatgccctgcatctgagggaggtgtgggcagagctggctcttgtaggttgcatttcccaggctcctgtgtctaaagacttcctactgggttcggcatgagagatactggtgggaagtagggagggagaaaccggtgtatctcttcttccctttctatgttgggtagcatctttggtcctcagtgtcttcagctcccataggacagatccctgaactctatttatacccttttctttttcctgagtaccaagggatgctaagggtttcttgctgttaccaatcccggggttacagcaccattctcagttggctttaacacacttcgtaacctgcaaaacaatttcctgtcttaagtctcctgtgttaaatatttggagtggtttatattccttgtgttggtccctgactgatacacacaccgcctctacccacaatggccaatttatatccgatagtaaagaggcataaagaaagcccgcttttgatacgtttcttaaattgcctctgttaaaacagactttcttatcaggcaaatatcttttataagtttctggcttaaacaatgattataatttacaggtggatttaatttatggtagactggactgcttgcctagacttttatttgctgatgggcattactcctttttattctcttaataatgaattacctgaccttatacttattttgatttaagtgcttgatttttattgtcacttttaattttgtgttataaagatgcaattgtcattggctacataaatttgtttttttcttttctttttcttttttttttttgagatggaatctcactctgttgcccaggttggagtgcagtggcatgatctcggctcactgcaccctccacctcctgggttcaagtggtttctggctaatttttgtatttttagtagagacagggtttcacaatgttggccaggctggtctcga

SEQ ID NO: 98645 - DNA, 1938 bp, Homo sapiens
cagccaaatcatttgaggtgtcttcacagtcttttatatataatgtgtgacagatgagggaacctactgctttttgggctctgtcagatggaggagaaaatcccacaataaatgacttcctttcactttgttggaaacatctttgcaaagaacagaggtagtgagtaaatgtaaagtcagaggcagacatgcacatggccctgggtgttttgaccttggtgactgtgcaatgagaggggaggtgtagtccattttataggactttgggtggtgttgaatgtattcagtagagaagcagaatgtgtatttcagattaaacaagaaaacttcgccattttcctcttctgtaacatttctaaatctggataacattttgaatatgatactgaagtattgtattgagattaattttgggtgtcaacatctgtactcatttaagatactgggttagtatatgatgcccatatctaaaggttttgcattttctaaaacctcaaaatccaaaacagacatttgaagtaatcctggaaataaatgacagccatttgcctgacttagtatcctaagatggatggcccttccaatggccattttttattttagctactaatgagtattattgagtcactaactaatttcgaaaagcattttggtgaattataattggggctgtgatttactgagtttgaagactgataagccattcctcagccctgtaattaatgtagaagcagagaaaagcaccctgatgatcagcatttcctttatgtggggcaggggagtcaaaagcatattccagccaaatattatagaatattattttttcagccatttctgcattttacttttattaaaaatggcagggaaatgtgaagtgccacaaaactttggaaaggaagtctcttgtttacatcccttttgatactcagtatattcaagcgtcatccatcacagctattccctggtgttaaatggttcgttatagtcagtgaaccacaaaagtagtctgggtagagggacagaatttagaatcatggaccagatttacaagccacgtaactgagtattcctagaaggccaaaatctggttgtttgtattctttgggtttattggaagtttggatatgtttatccatctgtgtttctgaaccctctggaggaaagagcacaacagtctaacatgtaaataagaaaaactaaatccacataggcccacagatacattaggacttcatttttttttttacaaagaaactgggtattgagactcctgctacttccttttacaaagaatttatggtagactggactgccttctttcctgtatcgttgcaaatggattgttggcttgggtatttatttttgtttcttttgaatatttttctctgtaagatagcaactgtgtgtgtgtgtgtgtgtgtgtgtgtgtgtgtgtgtgtgtgtgtgtgtgtgtgttctatcatatttcaggataaaatgagtcaggaagctggttgttttggttttttgttttgctttgttttttcgcaaagcaatttagtacctgtgtagttgtttcatgggctcccagctcttaggattccctacgtttctatccttaattgcctatgctctttttactcttttccgtgtagtctttatgcagtagtttggacacagcagacaactctttcctttaaataatctcttctcttagtatctgtgatgccatgaactcctgacacacacacacacacacacacacacacacacacactctctctctctctctctctctctctctctctctctctctccccgtctccctgtctctccctctctctctctctgactaatccttcttagcctccttcttcagctccctttccactatccaaccgctaaaatttcttctttcttctacactttctaaggagccacgctgtacccctacctcag

SEQ ID NO: 98646 - DNA, 1049 bp, Homo sapiens
gccgtggaaattatcattctcaatatgaatagcagtgtatgccagtggagctaaaaatgacttaaattcatgttactatcactgtcatttctgagatgggataaagatgagtaggtagggtgttttatccctgaaagttggctttttattgtactgaagacctggcctttgctttctgttcctatttagggaaccaaggaaatttccattataacctctggtggcccactcactattgtaaaggatgggctattttagggaaatggatgggaaatatatattggtataattattgagaaagattttatgaagacaggagtagggatctaaatgtcagaaaaaaaagaacactgacaataagttcctcccatgccttttgtgtgggttttgtctgtttgattgttttattaggaattcttagaaaatatttctaaaacttttccaaattatgtataggcttttatatctctaggtaagaagtgagcaagtttaaattagaaagcatattttttaagtgggcacagttgtagtatatgttcttgtgtgggtgcttattaaatacttggcgaacgtatgaatgaattaatgcttaaataatttaggtgcttacaaagagtgacaagaaaatggaaaaatcattaaaattagattcaataacagattcagaagtagataacctgaatactcttagataaaagacaaattttagaaaagtagagtcaggacaagactgcagatgattcagttggatggagaaagatttggttcaatggaaagagatagtaaaagtgtattgcttttttaaagcactacccaggctaggtggagtgtcttataacacctctgtgcatggttgccacccagtgtccttaaaaatactaggtcacattatatctcttaaaaaaaataaaagagagacaagagaagcagaagagacttcagtgacatatcattcagtcttaatggagagattattattttttcttttccttttttttttttcttgagacggactttcactcttgtcgcccaggctggagtgcagtggc

SEQ ID NO: 98647 - DNA, 1961 bp, Homo sapiens
ctgcgatatgctaggcactgtgctggatgataagacagcacccctgccctctagaagctcgggcagttaaaatggagcagagggaagcaacggagactcagaaaataactatacacactaagggagagcttggtctggggctggtgaataggaatctgttagggaagtgacagatgcaaagctggaaatgttaatcagatggctaaattcaggccaaaatttaaatatcttcaattttcaactcaagaaaggcatttggcagaaaccatgtttggaaaagaaattaaaatttacaagaatttttattaagcactttgcctagcaaaagatttttgttaaaaaaaaaaaaaaaacttgtcatccctactttcagggagtagaatcctggaatttttgaagcatactgtaagatggtgattatatctcagaaggggttccgtggtgtctgtaccctctctgccacaggcaatactgagcaccataggcttgagtatgccatttaactgtttggttttgtttctgtttgtcactttatacaatgtttgataatatctcctcattgaactgggctatttcagtcaaggttctccagagaaacagaaccaagagaacgtacatgtgtgcgtgtgtctgtgtgtgtgtatgcacatacacacacacatatatatagagagagagatttattggctgaatttcagaaattggcttgtgtgattgtagggcttggcaagtctgaaatttgtaggacaggctagcaggctggaaactcaggcaggatttctgtgttacagtcctgaagcagaaacctcagcttttgctcttaaggtcttcacttgattggatgagatctacgaatattactaagattaatctttacttaaaatcaggtaattttagatgttaatcacatctacaaaataccctcacagcaacatctagagtagtgtttgatggaacaactggggaccatagcccagccaagttgacacataatattcattgtcacatggtgtgaagacctatcaatcaatttttgttaaacaagtaaatcaggaaaaatattttttgtcattattacattaagaaaatttattatccaggtgacagtacatactagagtttttggaagaagtgaggagccatgacctaaaaaagcttgtgtttcctgccagcagcacatcttaaccaaagatgttccagctaagttaacccagaatattagacaggaaagaaatctgaaaacagatgatgcacttgcaaattgtgcaaggcttgttctgtaatgcaaataggatgtcttctttgaaatgtaaaggcactgagcctaagcatgaggaattttaatgtctaatgatgaagctatagagagaaatttcagttaatgaccaggtaggtataagatggtgtccttagataattctgatatcagaactgatgttagttgtagtttaagacaactctcctgagacaggagaaccgcttgaacccgggaggcagaggttggggtgagccgagatcgcgccattgcactccagcctggacaacgaaagcgaaactctgtcccaggaaaaaaaaaaaaaaaaaaaagacaactctcaaaacttcaccatctttgaatagagagaacatcataaaaaacaagtggagagaatctcttctacttcagccacgggttgcctggctctgactggcatcttcttccttttagagcatagtgtttccatagtcaaggcacagagagtgtgcttccagtactaccagcaaaactgaacttcactgtcatggcagataagaagttaggaaattcaacataaaatgtattgagtaccaccagctctatgccaggcactttgatatatattatctcatagcctccaaaaaaagtacattgcacattcacctagcagactctttcacatctagaaaatgccatttcctttttttccccacatttatcagtg

SEQ ID NO: 98648 - DNA, 1118 bp, Homo sapiens
gttgtaattcactgaaattgctgttaaccaaaaataagtaatacaacatgcagtttgtgtgggttgacaaatgaaacagcccttaaaagggctacttcttaaatgttctcaattaacttaatgtaaacaaaatagaccgataggcatttgaggatttctggaccccattacaccatgttgttgatgtctgggaagctgtgtagtaaatgtcttttgtatctatccttaatgtttggaaacttcccgcctttaagcttcatatgacaactgaccaacaaacactacgtactatgatgtcaatcttttttagagacattctcattactaaaatgagtggatacttgaatgtttaactcctaaaataatgagcggtgaataaatgagcaagtacatgcatgccttccaatgtagagtcattttcattaaaccctctctcaccagagaagcagtggtatgaaattggcctgattcctttctaagtgtgttgttcttgttcacagttggacatgatataggtcgtggatgtatggggaatctaagagagctgccatcgctgtgatgctgggagttctaacaaaacaagttggatgcggccattcaaggggagccaaaatctcaagaaattcccagcaggttacctggaggcggatcatctaattctctgtggaatgaatacacacatatatattacaagggataatttagaccccatacaagtttataaagagtcattgttattttctggttggtgtattattttttctgtggtcttactgatctttgtatattacatacatgctttgaagtttctggaaagtagatcttttcttgacctagtatatcagtgacagttgcagcccttgtgatgtgattagtgtctcatgtggaaccatggcatggttattgatgagtttcttaaccctttccagagtcctcctttgcctgatcctccaacagctgtcacaacttgtgttgagcaagcagtagcatttgcttcctcccaacaagcagctgggttaggaaaaccatgggtaaggacggactcacttctctttttagttgaggccttctagttaccacattactctgcctctgtatataggtggttttctttaagt

SEQ ID NO: 98649 - DNA, 1032 bp, Homo sapiens
ctgcctctttttcctcccagtatactggggaagcctccagggaaagtactctcctaatttctgtatccgcagtgctaggtacaggaccagctgccacattgtctaagctgaatggaagtttatgaaaccaaggaataaatgagtaagtgtgatcacgtagcagaagggcagggtgtcctatttgcttatttatttcttgtcattgcagatgtcaagaccaggaagtggagctttctcttggaagagcacagtaaactaagtgagaagccttccttacttgttttatatcatgctattgttaagctttaataattcaccttaaatttgatgtatttttgaagaatcttctcctccctttgctgtggtgggatgcttgagtacagggtaagtaaaggtgaggatgcagccttgtccacatccactgagatggtggctttatgacagcccagacaaatgccgggcctcttctatcataagggtgaggtggcagtagtgaaatttcccaggcctgtgaaatcttcctgctgtcatagaagtgctagaagcatgggtacatagactttaggaatcagaagtgagctaggattgcttagcttaggtggaagtgaccatagattacttctaagaataggctctcagtgtacttctagaactggatgggatgatcaagaaagataggagagtatcactgggaatggacttcataatagagttctgtttggggcagaagtcaaggccagggacttaggcattttaacaagcactttacagactgaccaaggaaaagggatatgtgtacagatagcataagtgcaagaagaggaagccattttgggtttatcatttttcttctctgtgttttgcttagatggggcaataaattctaatatgcctggaaaaaggaaatatggtcatatctcagactgtaccagaataccagtcccttatctatctggctgtaacaattctgcattgggtttgcagctagcatggcttatgttcctctgcttttctcctaatcctgatggcctg

SEQ ID NO: 98650 - DNA, 1015 bp, Homo sapiens
tcactctctactcaccttgcccttctccaaccccatggagaaccaccaatctaaataaggaaatgaatctaaatgtttttggaataataagatagttgggaaaaagtaaagtatgtctttgaaaagccatataaggacctaatttaataccacttgattgttcctctaatatgaacatctcttagaactatattctgataattaatattacaagcatattttcagcaaataggcataatgaggtatttagattaaatcatacagttcgttggatagcagggccagatcgtgtccagaaaaatgtggattttgtaaatagcaatagcagtcagcagagagaaggtgtgttagattgtaagaaattggtgtcactgtcccctgggaaacgtgacatttttcttcccccacagcactattggctggggctactaatcctaaatgaggtaaatctatttttatatataaatatatgaaagtagaccagatagaagctaaaaagaacaaagttaaaattacctttaatccctccaacagaaaaagccactgttaacagcttatttttccagcatgtcaattattgagcaagatcatcatttttcaataactatggagcatttacatagtggagacacatcccataatttaatcctcagtatcagacatgcggttgttttccatttttgctattataaataattctgcaagtgaacatcatctatatgtaccttgcatatttatcctattaggacaaattcctacaatcagaattgccaggtcagttttcatttgacctttttaggggaggcctctgaagtccagtctggccaggcataacaatcttcactcccattcagtcttcaatcagaggcttttttttcccacatgactccgccctcaggattactggcactcttttaaacagtgaggtgtgtgtttggggttttttggtttagtttagttgtcttttgtctacactggcttttattgttaaactagtgtaataacaaaattaaaa

SEQ ID NO: 98651 - DNA, 1087 bp, Homo sapiens
aacttaccctacaagccatctatgagggaaaagccttgctgtgcaagtacatgatataaataagagtgtctgccttattttttaaatttttaaaagaagaaaaaaagttttcaagtactttaaaaatatccacttacattcaaacgaagtacttataatggaaattgtagtccttagcatagttaattgcaaaccatttttagctggttattgaggcaggaaatttcccaattattaaatgtatttaaaagccgtacacttctttaatcatatatttagttcattttccctgtagatcaatccagattagactgatgctatatagttttcatggtccctcaaaactcttcatgtatgatttggatttctgtcctattcgcaaacagtccactttctaaaaaggatcttctctttcttgactatatgggcccatggcataataatgttcagctagtgatgaaaggggctaaagataaaattgattgcctttcttccccaaactgtcccttcctatgttccccatcttaggccagcatctcagtagtttctcctgccagaaactaaggcattatctttgaattctccttttcctgccttcttgatacacctccccaatacaacaaagaatgccttcctcatcttcacatctttctttccacctaacccagtgcctgatatgtggtaatttttcaattaaagcttgttggattgtgactatcccaaggtcaagtttaaaatttttgccgcatgcagcggtacacacatgtagtcccagctactctgcaggctgaggcacgagaatcgcttcaacccaggaggcagaggttgtagtgagccaaggtcatgccactgcactccagcctgggcgacagagtaagactctgtctcaaaaaaaaaaaagaaaaaagtaacaaattacttggtattttggtgttactaagttttaacctacaaggttaagagctaacaatattagaacataggagcatgctatctgtcttagtctgttttctgttgctgtaactaaataccacagactaagtaacttacaaagaatagaggtttatttagctcatggttctggaga

SEQ ID NO: 98652 - DNA, 1082 bp, Homo sapiens
acgcctgtaatctcagcactttgggaggccaaggtgggcaaatcacttgaggtcaggagtttgagaccagcctggccaacatggtgaaaccccatccctactaaaaatacaaaaattagctgggcgttgtggtacacacctgtaatcccagctactcaggaggctgaggcaagagaattgcttgaacccaggaggtggaggttgcagtgagctgagatttcagcactgcactccagcctgggcgacagagcgaaactcagtctcaaaaaaaaaaaaaaaaaaaaaagggtgggaagctaagaaaaaacacagtggctggaagagagatgtaaattaagggaggccaaacaaatgagaaccttctctccatagtcctctgccttggaagagaattaactgacttaactactggccctgtcatttgaggtctaaagtgggaggagctggagatccttcttggaatgtctctttagtattatgtatgtctcaatatttagcttctagaaatttgtgtactgtcattaattccttagtcccctccctaaatgctttcagatctacagaggacactctaatttgtatttaaaacacattataatgatagtcggaggtaaagtgaaaactgttgatcatcttctatgatcccagataataagaatgtttcagtaacataccagagacacataaaacataaggagtatatgtttaatctgttttgttgtcattgtcaaatgcagtgaatatatcttggacctactggaaagtggaagagagaagtttttagtatttgcacaccataaggtggtcctggacgcaattacgcaagagcttgagagaaaggtgagctccctttgaaattcaccatgggctacttttgccatgtcccaagttgttctaagcaggcttaggtcagatccaagcaaagtgagaccgatggcttccggaagcattgctgaagactttctgaagaagagttcttgcttgtagaaccacagtggggtcaaaatgtttccccagccatgtcattttaacttcctccatgctccaaatagatatcccaggagtcttgctttaggaacatc

SEQ ID NO: 98653 - DNA, 3126 bp, Homo sapiens
atagtttgcgaatctgggtaaacctggatgagagagacgccttacaattgcaaacatttctcaggaggccgcctgaaaacgcccaaaccatagagctcagttcctagctaggcctctaccagccacttccgctcgtccgcctaataccgcgcctgcgcaccgcgtctcttcctttctgggctcggacctaggtcgcggcgacatggtgagtgtgggtctctgtgcggcctagaactctatctgcctgcatctgtccttgttttcttctcccgcacccatctcctctcctgccttaccccgtgttctctcctgtctccatgcctttgcaggagacaccattgtcggaagctccccaaggcggaggggcgggggcgccttggctgggcctggcgcgctccagccgggttaacgccgggccttcggagcgcgcggccagccctgggcactggtttcgttgggttgaatttagggaaaactaggtcatatgtaattcacatgtcggtcacacgtcagtgaggtggaggaacggtgtgtggaggctccagggcctgcctgggttccaggtctatcactggtttctcccttcactctaaacaggccaaacgtaccaagaaagtcgggatcgtcggtaaatacgggacccgctatggggcctccctccggaaaatggtgaagaaaattgaaatcagccagcacgccaagtacacttgctctttctgtggcaaagtaagtaaggcaaagtctctggtgagaggagagggagggcaggtttcttacccaagtgaggcctgacttcaaggtattttataagccgtgtgctggtgggcagttggaattactcataccgttgattatgagttttaagataaaagtgttgatggtaacttcagattttgtgagacgtttttcatttaaagaaaaccgcttaaacgttaatgggtaaaataatcatttgacagagtgcccccagcctaagccaaacctgctttgtgggaaatgattccatcagttttgtctactgatgtttctgcaccaactcccaagatgtctgtgcatctaataccattctacttgttctgcgagggatttttgtttgataaaggtttgaacgtttatgtgcaaaatactgcattacagcaatccctgttttgtttttgagggagaaagggaggctttcacatccctgacaataaggtgaatccaaatttagacttctggatgcttgtaagagaaaatacttacttggttcatagtgaaaattggttctcttttatagaccaagatgaagagacgagctgtggggatctggcactgtggttcctgcatgaagacagtggctggcggtgcctggacgtacaagtgagtctagttccttgtggtatttggaagtgtgtggaccacataggcccaaattccaggttgctgctggatgggctagttttaacactttctcaggactgagagaataaggatgcctttgtattttcaggattcttccgtggtggtttattttcagttattgaaagagtaaacacaaaactaccaaaatagaagtcggaaatctaattcacagactactttagaatttgatggtcactgggcacattgttgtgaacattgtcatgatactgtgcaggtccattagtggggctgaatctactgaacgttgatttgcactgcaagttttgataaaaataggtgaaggggtcagttagttcaaaactgtatttggaacttgaggccatcaggaccaccacagtttcgtctttctgaacagtattagactgctgcaggtttgtgaatctgcaactcagtatcacctgacagggcgatactacaaacactatactacaaactagcatctagacctgtgttgtccaatacactaagcacatatatggctagtgtaattaaagaattggattttaaagtttcagtcaatttaaacttaaaccgaagcagtggaaaatgttgaaatatatatatattccttgtgggggtttttattagggcagaatggaaaatgggaactagagtgctttcttggttctgataggaaagtgaattatttatatacttacaatacaggatggtgattttcaggtatagttcctgaattttatggtaaaacttttgtagtcatttcaatagctgtctttcccaaaggcactttagtgtccgctcttatttccttaatcattgttctcactgtatcatcttgtaatttattcatttcttgtaatctgtccattcccttttaataagtttaggtcagcctcttagaaccatttctttttcatgggatggggtagggggagttaaagcttgcttgtccacaactgagttacttataaaaaaaaaagcaactctggttgagaaatcagatgcatgagattgtatgtctaattctgcaagatcctgaaggcatggctcttaaaggatgccatcatgtagtttagaagccactaatttccgaggagtaatctaatgttggttagatctttggattgactgcagcaaagtattggtagagcagtctatctcagtataattctttctaggaaaatttgggaagcgactttaacacaaaaacgaggcagatttacttatttgccattttctatgttaacatgcttaattatgttggaaactgaatctttctttccagtaccacttccgctgtcacggtaaagtccgccatcagaagactgaaggagttgaaagaccagtagacgctcctctactctttgagacatcactggcctataataaatgggttaatttatgtaacaaaattgccttggcttgttaactttattagacattctgatgtttgcattgtgtaaatactgttgtattggaaaagcatgccaagatggattattgtaattcagtgtcttttttagtagtcaaatggtaaaatgcagcataagaatataagtcttccaagttagatatgagtgttagctttttataagtctgctcctgccagtttgactttgagatacattggagccaactgtaaactttagtttttaaattacagttagtttttttgtttgtttttgaggcggagtctctgttacccaggctggagtgcagtataccagtcttggcccacttcaa

SEQ ID NO: 98654 - DNA, 1023 bp, Homo sapiens
ccgtattgtacaggaatgagattaattcgcccctcaagtccctttcaaaaccaaaatgctaggattccatctccttttacagcaccccagttcagcaggacgtctgcagggccagctgattttgttcttgcattcattaataaaagtagtgaatgcaacaagagccacccttttcttttctttgtcttgtctgaaagagggcagggagggagcaggagagcccgcagacgcaggggacgtgtcagacgtgcgacaggaagggctcagcgaggcgagagcgaagctgtgaggaaggaaggcaggtgggcggaaggcgggtaaggggggccaggagggggccgggtggccccgcagacagacacatggaaccaatcaccccaggcagggggtgggggtgcacctgagaattacagagacacctggcctgctttctggagttggggaggattgagagctgatgaggaagggggttgatgatggagcaggctgggcgggagggaagcacatgggagctcactccgggaccttattgtgatatctggactcttggtgattggagggtgggtacttctcattgtttgtacagtcaaggtccagccagggaagcaggagggagggagttcgctaagtcttattcagagactttaatgaaggtaattggttacagaggtgctagaaaaacctccttggactggaggggtgacaacaagaggtgctttttcagagcccaggagcaacggtcaccctattacaatacaatacaattccctactacaattgtattaacaataacagttattgtatttaacactagttaaatctgaatttcaaataaataacaaataattgctagtattttaagtcagtatagagtgcattaaatgccacagaattgtatactttaaaaaggttaaaatggtaagatttatgttatgtgtactttatcataatcaaaaatgtaatataaaaatgtatccagttggaccaggcacggtgactcacgcctgtaatcccagcactttg

SEQ ID NO: 98655 - DNA, 1475 bp, Homo sapiens
tgacaagaacacgatctcgagttgtagaggagacatcatcagaaaagagatgttcaggaaaggtttagaagccggcccttggaagaactagagtatggtgcaaacaataacaacactttccatttatttaacttctttcacctcccagacattctggagaacttttctctgttattgtaaatattaatattcatccaagtaggtaggggatgcaggatgagtaaaggcctggaatctcaggaccctctatgtagagtctaaatgtcagaaatgatgggcaggagtgaaggctagacccggtttactggaattgctccggcaatggaggggtcctcgtataccacacaatcatgtctattatgtcctataacggaggagccatcatggccatgaaggggaagaaccgtgtggccatcgctgcagacaggcacttcgggatccaggcccagatggtgaccacggacttccaggagatctttcccatgggtggttggttgtacatcggtctggccgggcttgccactgacgtccagagagttgcccagtgcctcaagttccagctgaacctatatgagttgaaggaaggtcagcagatcaaaccttataccttcacgagcatggtggccaacttcttgtatgagaaacattttggcccctactacactgatccagtcattgctggtttggacctgaagacctttaagcccttcagttgctctctagacctcatcggcttccccatggtgactgatgactttgtggtcaatggcagctatgccgaacaaatgtacggaatgtgtgagtccctctgggaacccaacatggatccagaacacccgtttgaaaccatctccccagccatgctgaatgctgtggactggggtgcagggtcaggcatgggagtcatcatccacatcaccaagaaggacaaaatcaccaccaggacactgaaggcccaaatggactaaccctgttcccagagcacacttttttttttttttgaaataaaattgcctttctttcaaaaaaaaaaaaaaaagaaagaaagaaaagaaaagaaaaatgttgggcagatgctaatgccagctgagctgagattggggcagaggaatggagtaggggctgaagtagaggatggaaatgaaaaaaagcatatcccaacagccagttaagagaagaattgtgttagggactttttttctttttttttttttgagatggagtttcactattgtcacccaggctggagtgcgatggcacgatctcagcttactgcaatctctgcctcctggggtcaagcgatattcctgcctcagcctcctgagtagctgggattacaggcgcccgccaccacacccagctaatttttgtatttttagtagagatggtgtttcaccatgttggccagctggtcttgaactcctgacctcaggtgatccacctgcctcggcttcccaaagtgttgggattacagg

SEQ ID NO: 98656 - DNA, 1804 bp, Homo sapiens
aagccacgtgtcagtggtgggtgataccccaggatggaaggagttggtatgagccgactgaaatctacttgaaggtcaaaacggagccttatgtcttttgtgttccccagcggttagcccagtgccggccacaggggaagcgcgcaaacgaagtcctcgcgaactgaactgagagcagacaaaagcacgcgctcttctccaccgccacgccggtcctacccaaacccgcgagttatccgtattctccttcaggagtcatagtcaggccagaagagtgcggagggacggggcccgggaagagcagggaacccccagagcccgcagccaacgcggaggtgggcgagcgggcgtgcgcgcactcacttgccggcgcgagggagtgtcgggggggaagggagtggtctccaaaagggggaggggagaaggcagggggcggggagaagccggccctttaggacccggctgcggcggcgagggaggaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcaggtaacgcggtctggaacaagtagttgggagaaacttggagggcagcggagaagcccgacgggcggctggaccttacggacggttttaggggcggcagagccgagaccttggaccaaatcaagggggactgttgctagcgggacgcggaagtcaggcccggggaggggaactggagttagagcaagtggaagagccctggcgactcatttggtggggatgaatggggagaggaaaggcatccctgctgccatagttttacccgcgtggaacggacccagacttctattctggaggagggatttgctgagaagggggccggtggtcagatccatgggagtaggaactcgaatcttatttggggcactgcttgaggacccaagggtcctggtgggatcgctgctgggaggcggaggctgcggggtgccagtgacaccaggaaccttggaagaggagagggagctaggaggaggcaccggcgtcccaaggggcccttccttctactggggttgtgagttggaaagaaaggacttggtactttgtaggatgagtcgcttaggagaaaaatgaaaaccaccactactatttctccatagggaacgagcagggctcttgctaccacgttgaatggaaaaataaaagggaggcatttggtaggcgaggggtctcctagcagctgaatcaatgtaacttaagcccgatcgccggctgcattccctggacgggggcagccaggctgtgcggtttcgcatctgggccccagatcgaaaggcaggagagat

SEQ ID NO: 98657 - DNA, 3044 bp, Homo sapiens
gaaaaagcaagtgagtcttaagtttctcaaacttaaaaagaaaaagtgaaaagaagaatgcttgctttttagcttctgaggtcttcgtaagccccccaccccatgcaccaacccgcctcccttctcctggtcggctattgtttttttccctgttctccttgagaatggaattaggggtcagagttgaaatctttcttctgtttctctagcacattttgctctggagtacagagcaagttagggcttcctctgagtggagcctctcagtccctttcttctccctcggctcgcttccttccctagcctgcctggaagttaacccttccctcctgcttctcttagaaagtaacaataaaaggaaaaagcccccacgaaatcctttcactgcggggtgcctgtcccccagtcatgcgttcctcctcatcacccctcgtggtccaccggggaggtgctgtgcagtttctgagctgaactctgacaaactaaacatcttcctcagcagggtgaactttttgaaaggcctctaagttcataggatggtttggctgctgactgttttaataaagtgtgtgatgcctttccttctttaacgttttacttttttttttttcctactcttcattcgtcttattctaagcctgaaaaccaattctacttcccaaatccctgaagccggttagggtctttagccaggaacagatgcggcagattttctcccattcacttttccctggagcctgaagggggtggggggtagttgtcaggggaggccagggacaatggggtgagttcatgggaagaatgtcactctggattttctgcctggttatgggactcccttccgccagcttgccccagctgcgttctcctccccagtgcccagacgccttccgcatttttgtgcaccggcctgggaagaggggatgttaagcaggggtggaaggtggggggtggggctggaagctgagtgggtgcactcaaaagaagtgaccaatgtcaggggtgcctgagaaagagtcgggctgggggaggggagcactttgggaaggagcctgagcttgcaagggtgcaggagaaaaaggggtcaaggttggaggcttttgtgtgggagagggtcttaggctggggcagagactggagtcactggatggagagtgctgggtccgagttgggtggggcctggcccagacggagatcttagcactgaatcctctgcctcccactccatctcccgtcccgtcttctctcctctccgaagaatgagcaccccccctccagcctgcattcctctttgagcaggttgcttttgagaattttaaacataccctcttatttcgaggcagcgaacctcagcagttccggctttgctgttagctcttttgtctttgttcccgggactcaggggctgtgttgctgctggcttcctggggatggcaaggatgcaggggtgggggtgggcacatcagtgggtggaaggagtgggtggtggtgagcctgtatcccacggggacgatgggctggggcttgttggttcaaagaaactgagaagtcagtcttgggggaaggggtgggtaggcctagaagaaaaaccgaaaggagaccctgagatctgcttgaagttgggactctaaaagcgtgtgtatgtgtttggtggtggagtggatagaagtgcctagaaatgtcagggtcgaggagggaacagggttgggccagtccaggccctttcagaattaaggctgggctagaccggttccttcagtatctccccagcctccttccctaccgtgtacaatgcaggggattatgctgaggggcggggccgcccgagtggccgtttggcccgctgcacgtataaaggtgctacagaaatgtgtagtcgttcaaagtcccagggcgggcagacaggcaggcaggcaggcgggcgggcgggcgggcgggcgggcctggggaggctctgcatctgcagttgccggggaagaataaaggggggaagaggcaagcactgatttacagtggttcagtgcagcttcaaaaaaaaagggggaaaaagcaatgggacttctggctcagagtactgctttgcatctcgtcttgcataaatttgcatactgagttcaaagtcgtaaaatagactagggaaatgagtgggatctactgtcactgattgttaacaccactaccttccacctcccctccccccatctggacagaactcccggcactagttctgctaagcagcgctgcctgagtcaccagtcaccactgttcatgaaagaaggagatggggaagcgcctgtctaggagaccaagcagggtgtggcagtgtgcaccctggcctcggaggcagggcctctctgaagggtgtggcccgacagattctggaccagtgaggcaagtggtgttctttctgacgcctggggctgccgttgcccatggtgggctgcagtttgaggaagctgcagaatccgggtcttctttgtttgaaatttccctactcagcttccacatatgtccaaaacatttactgtgataagtccctttgtgtggtggtaatgacccacttctttagacaagatatttgaggaaggttcgagaacagaaaaattctacttaacaatgttaaggaatctgagaaaagtggggcacaggagtctctaggttagaataggtggtagagcctggaaggagagaagaacccatctgttgtattcccgagggtctgcccacacaatggctcttggccaagtggactgttgagcttcctgtcaggcagagggaagagggaggcttagatagttctcactgttggcctacttcagcactgagcttcaagactttcaggcaaatcattccttcaggctcagaggctggaaattagttctataaaaatgccatggggccggtcgcattggctcatgcctgtaatcccagcactttgggaggccgaggcaggtggatcacaaggtcaggagtttggagaccagcctggccagtatagtgaaacctcttctctgctacaaatacaaaaattagctgggcatggt

SEQ ID NO: 98658 - DNA, 1981 bp, Homo sapiens
aggttttcaccatgttggccaggctggtctcgaactctggacctcaggtgatcctcccgccttggcctcccaaagtgctgtgagtacaggcgtgaaccactgcacctggcctattttaattttttaaggaactctgtatccagggagtgcatttcgtctcagcctttctctgtatgttcccgactccctcttcctcctcctgccttctccatgctgtcctctttgtccctgcagaccattctttcctttcccacacttctcccttccatgcctttcctactccggctcagctagaacacctgcttgctaggtaggtgggtggggctcaaaaatggtgtggaaaatatagtggtctcagcctcagagatccatccaatcagagggatattatgtaggtgactggagactataatgcttgaaaaaactagaatccttaaatgaggagggtggttgactgggctttgagggaaaggacttctataggccagggaatgggattctctcctataagagttagcactagcgctgcttctgctgaaaccaaggcatagaagcgggagatgatgtttgaattcatgagggaagctggtaacgtggttggcagatattctagatccctctgcttatcctgtctctggccagcaattcactgagatggcaggcagccgccaggagattggtggtgctcgcatctgtcctcaccctattatgaactggcttctgtgcctgctttgtctcctgtcttccacctccctgcgagggaggccgttctacctccattttgcaggtgtggacactgggtgactcagcgatacgaaaatgctgagaggctaacctgggtaccttcccactgcacccctctacctccgtggccgggtaaggagttgggctgttggtagagaaaagcttttgaccgtatcaaccagcagttttgttcctggacagctgccatgtgcaggtgatgtatggggcacagtaaatttctgccagatttcaattatgtagattcccttgactccatggacagttacaagtcctggagtttggggacctcacagttgtaagtagccagcatacagaggtcagtcaagagggacaagaaggtcacagggtgggcctcttgagagaagagctgctgggtagcagatgatggtgcaggcagcctggcctttgctgtcatattgaccggggttggttccattgcaaccctgtctcttaatacttcagtagttagtaaggctcttcctccaatgccagttccctgttggtaaaatagcaatgattttacctctttcccagggtgcgtgttggggtggctgtgataatggcaagtacctggcacatagtatgttcttgtacatgttagctgccttaatcttggcaagtgacatctcctccttgacaattagctggcctttaaaatgaaggccaaactggaaaggtcaggcaggccactcctctctggaggttcaaatcccaggtggtctaccatgtactaatcacccaaggtaagagatttcttgctaagcctcagttttcttatttgcaaatcagaaattgatagtatttcattgggtcaactacacagatgtgtgtaaagatataaactatatataaaacctaagctcttgcattttggtgatgagtcacttgatttccatctcttcacctatgaatggaaatatccatacctctccaacctactttcacagggctgtagtgaggtggtttatggaaagggcaatgaaactgtactttaaatgcaatacaaatgcaattgataaatgcaatataaatgcaactgataagtgcattataaatgcagtgcataaacggttggagaccatcgggcttgcattttttttttttttttttttagacagagtcttgctctgtcgcccaggctggagtgcagtggcgcgatctcagctcactgcaagctccacctcctgggttcacgccattctcctgcctcagcctc

SEQ ID NO: 98659 - DNA, 1054 bp, Homo sapiens
cctccacactcacaaagagcaggctgggtgggatgtcgatttttttttcttctggagaatggaccatctccctatgcctctcctcctccttggctactaacccctgacttttccctcccccttctctggccactcctgttcctgaacaaagccagggaagatctgggctggctcagcccctgggtgtcagtcaagactcagagggagactttgctcaaaaagccagccctcccggaaagaaatacagagcaactgtagtcaggaatttttccctttccttttttctgtgggcggggggagggacacttggcagtctttggggcccttctggctgccagccccacatctcttcctggctgttgggaggcagggcaggagggaagattggggagaagggggcaggggctggcaaacacccagctgctgggcagtggaattcgtccataggccctggtggagttggcctctagtgaagcctggggaggtttctaattagtggaggacggtgaaggtgtggcagcctgtgttcattcaaggaactgagctctctgagccaggaagtcaaagggaagagggggactgagtcccggaaggccttggtaggtggggaggaagttgtacctactcagtgtgttccatcctattagaagttgagaagaggggggtgtttcagctggagtgattcaggttggactctgggggtgcagagagtcagtcattggcactaagcaaagggagccacctcaaagaataagtgatataacagtgataaacaaaatggctttgttctagacattgcctgcttctaccagaaagctcattttgttttttttgtttgttttatattcttcccctctcccacttcctgccccagctctgttttagcctcgagattctctccacttaacaaatgaagaaatcaaggctacattcaggttcaactgccaaggcaagcacagaccagattgtagtctgggtctctagattcttccagctctccatttcaccagactcacacatgcagaaaagcagtgaattatatactgcttcttgg

SEQ ID NO: 98660 - DNA, 1069 bp, Homo sapiens
agacatacccaagactgggtaatttacaaaagaaagaggtttaatagactcacagttccatgtggctggggaggcctcacaatcatggtgggaggtgaaggcacgtctcacatggtggcagacaagagagcttgtgcagggaaactcccctttataaaaccatcagatctcatgagacttgttcactatcacgagaacagcatgggaaagacctaccccgatgattcaattacctcccactgggtccctcctacaacatgtaggaattgtgggagctacaattcatggtgagatttgggtggggacacagccaaaccatatcagatggtcaccttttctaatgtgtaaacattaattgagcacatgctgtgtgtcagctaggagaccatatgaaaaagcagttgtcataccacctgtaacacatgctttttcatgctggagggggacaagaaaagcattttagaaaggtgaataaagaagaaaccaaggcagcagagatgtatatacatcctatgcaaataaacaggtagctcttggtcactaaaagagcttaaccaagtctcttgggaagagcttgatgttaaataatgaagtcccttcatggtaaataaagttatgaaagtaagagaatcaagttggacaggcttctacttcttcagtcttggaagaaaaaaaaaagcagtgtcttccttcctaaaatgttaattgaggacacagaatgtcttctcacctgtccttcattcactaagtatggaaagctgtacggaagctaagaccaagtttatgtcttcaggaagcttctgtccttaggaggactaagaaaatgcacagacctacagctttttggcaatggactcaggctagagtgctgtgaagaaagttgggtcaaattaccagaagactttacccagcagtgcttttcttttttaaaattttgtaaaatttttatttatttatttattttatttattttgagacagagtccccctgttatgcccaggctggagtgcagtggcgtgatctcggcttaccgcaagctccgcctcccgggtttgcaccattctcctgc

SEQ ID NO: 98661 - DNA, 2859 bp, Homo sapiens
ttcatcaatgcaatcaagtgacctttggacacttggaggccatattgttcatccttcttccttctcaaaaggtttctcctaagttataccagagggagtctgtgcaatttcttcccatctgcaatttatcagatttgttttgttctttcttatgaaattcttggatggcttctaacttggatctctcctgttttagtttaaggctgttttctctctggtccttggggagacagaacggctccttcccttcccttgggttttcctggcccttggacacctccaccactcagcaccctctggcagcaccaggatggatttgtcccttggctttcagttctcaggcctgagtcatcttgattacttcatcttccccttcttaattctgtgaccctcttctactacctttgggtcttctttctgactcatttccgagttcttcatggcatagagaacaggccaggagcccagggctaggttctgactggtggacaagtgaccctggtaacatcattgccctggccagtgagagtggtggtgaagtccgccatgtcactatcgtttggtcctcttccagtagggcttcagggacacttgaggttactgatagctctgcttgatgaggaagatgaggggtggttggtgtgagaggtgacttttttgtttttgtttttatttttgagacagagcctctcactctgtcacccaggctggagtcagtggcgcgatcttggctcactgcaaccttcgcctcccgggttcaagcgattcttctgcctcagcctcctgagtagctgggattacaggcatgcaccaccatgcctggctaatttttgtatttttactagagacggggtttcaccatattggccaggctggtctcgaactcctgacctcgtgatccacctgtcttggcctcccaaagtgctgggattacaggcatgagccaccgcgcccagccctgagaggtgacttttttaaaagaatatttaaaaaatgcagaaaagtacaaagaacaatgtaataacacaagtctaccacccagaaccgtgggcggttgatattttgtccactagcacgcagtacttacttagtgtttatctttcttagctaagcagacttgcatatatgtgatagatgactaatatgcctatgtttgcatatattgcatctatatgcatatatatgatagatgaccaatattgtccaaattgttttgtgaaaataaattgaaaatgcacataaaggttttattttccctcttaacattaggtgtctgagatctaatgttgacatccataggtcagaaatattctttttaactgctatatattgttcctttgtattaccctactggttttatttatccattcacctgttgaaacacttttggatctggttgctaatagtgtttttacaactacaagtaatgctgtaatgaccatttttgtacatgtgtccctgtgcacatgtagagagaagaattgctgggtcaggcacattcttcccattcccatagtccctggttcaagtttgaatcaaagcacagtctactcacttgggcctcagcaactaggtcaccttgccaggttcctggatggctttagttgaacccaaggagaaatgtttgggacccgtggaaaggagtgaaagctgatagtgctgtttgccatcttgatatcagtttctctggctcttcaaggacagcttggctcacggggccccagaggaccttggctgaatttgagcatgtttttgttttctcaaactgtctgcctcagccctgaccctccccaggtctttgcaattccaggaatgaccctgatgtttataaaggagccctttggagagtgcacaggcagggaggctctggagaggctgtgctgtttctgttcactcggggggagcccgagatgagatggcagcatgagggcatactctagaaacctccatgacgccaggccaggagaggcccctctgcatgtatccaagcaagcatatgtgtctgtttacaaacccatgagtggatgagcttacaaggctgtgtctctgcaaagcttatacccgagaccacctctcttgaaaagaagaggcattgttctcgcctcaccaggaagttcttcaggaaacagacagaacagagagaatcacaaaggcatgggggcctggcaatgccagagcttgagaggagaggtatcattcaacatacagattccttagtccttgcctctgactttctggggctggggtccagggctcttatttttagcaagctcatcagatgatttctgatgaagagctatgtttgggaacttctgactgggtctaattccctgaatttacagatgagtacactgacacctgcgcaagttgaacaccctgcttagcgtcactcagaatcccaggggtggtggtgaagtcaggatcgaacctcagtccttcctcccacactgggactgcttggccaaggcttcgaacccaaaagctggtgctccaaaggaaatccaaaaagagtttgcagagtggtttgacgtggaggggattcatcggccaggtgggggctctctgccctcccttggtggtgcatcatctcctgtaggtgttttgtcaccgtggaagggcagtagcctgtgcctgttgggcttgccactcaacagaggtcactgagctcttccgcactcagctgggtgattggcctgtggtagctgcaggtggagggagatgattctcagaagagaaaggccagttcttgcagtcgtgtgatcttataacctaggggacttgtggatctgaaacatctgagaaggctgtttgcagttatttactaccacaaaggaaactgggagaggagggaccacctgt

SEQ ID NO: 98662 - DNA, 1038 bp, Homo sapiens
gcgacagacatctgtgcacactattcagaattccagtgtgagaggccactgccccctctgaccttttgaaaaaaaaagtcaggggaagacacataaacagtgtcactcacccacaaagtctcaggacctcaggttaaactttagctaaagaagtaacaaatagaacccccattttaccttcctctttcctaacttctgcctccctccctcccaccagcatggcctgaattactaatcccagcctgttggtgggctgtgctattgaacatagtggccacatgctagatggagtttggtgaccaccatcagccatccaaagaggactggcttcaaattctctccaacaaaagctgtttcttgtatgtgctggcgtgtttatgagccctgtctcaactgagcatgcgtggtgattatgagctactgcctgacctccttccctttgtccctcccgctaaattctgtaaacaaagttaaagtaatttaggcaaattcattcttgcttaaggacttctattaaatggcagagagctttgatatttagcaatgtataaaatttgtacaatcaaaaccaagctttagaagaaatatgcaatagatcatattgcagaactctcatgactcattttttccatgcatttggccattctacaaatcagacattacctagccttcccctcacatggcagatataacttttatttacccattcaagaaattgattgttcacacattcctttttctttgaaacaaggtcttgctttgtcgcccaggctggagtgtagtggtgtaatcttggctcactgcaagaagtgaactccgcctgctgggttcaagcgattcttgtgcctcagcctctcaagtagctgggacctcaggcatgtgccaccatgcccagctaatttttgtatttttggtagagacaggtttttgctatgttggccaggctggtcttgaactcctggcctcaaatgacccgcccacctcagcctcccaaagtgctgggattacaggcatgagccaccatgcctggccaccaca

SEQ ID NO: 98663 - DNA, 1053 bp, Homo sapiens
gttcattggaggaatgataagttcagggttggcttagatcatctctgtggtactcctctttcccaaccctgctcttagattttaagataatcatgagataggaggagaaggctggaaaatggtaagtctttcttcagaataaagaaaagaagaaagaagagagacacatgagctgttaggaagatgtgattgttctaggtagggaaaaggtcttatttcctcaccaggtctggataaggaccggggccacacactctgaggaggaaggaccagggaggtgcttttagattcttggggcttagtttcctaagaaagctttttaaggtctctcttagatcaggaatcaccaatttccaaatagagcactgaggtcagaacattgtgctaggagaaaatgagattttgtgggagtccgtttctatcaaacacaagagtttgatttgttgagtaagatcattgatgcaacaaacaggattacattggaaaaatgagctgtgccaaaattaggtctgaaaacctgggtatgaatgcatagaagtgaacaataaaggctctttctcttgggctgtcagcttccagctgctctccttggctaaattagtaagggtgggccaaaagacaatgtagggaccccatgataattgtgaagaatggcagagaggttgtttgctcctgtgaattcaaatggtagtccatctgggctcaggtttgccatctgtaaaatgggacaacgatccatttcttttcatcccatctgccttcctcatctccagctctcctctaggggtcttaggtagaaaggtgtggcagtctacccaaggcaggggtgggagttctcccctgcccttcaagcccccgactaatggctctggggttgtctgtcatctccctgacttctctttggaaaagcttgaccttctatatgtgaaatcccttgcttctgtgttgacccatttccctaggtgctatgtagggaagaagagctaatgcttactaatctacagggaaagtctcttcaggggccttggaggtttctatcaaccatttctaagc

SEQ ID NO: 98664 - DNA, 1071 bp, Homo sapiens
gtgggcctcctgtggcaaggagttcaagaccagcctggccaacatggtgaaatcctgtctgtactaaaaatacaaatattaaccaggcgtggtgacacatgcctgtagttccagctactcgagaagctgaggcaggagaattgctcaaacccaggaggcggaggttgcagtgagccaagatcgtgccactgtactccagcctgggtgacagagcgatactctgtctcaaaaaaacaaaaaaaaaaaatcaaaaaaccatattttataacttgtttaataaatgcaaatgtattaatattatatagtaagactttttaacctaaaagttattttttttttctgatgttaatagaaataaaaatatgtcctaggcactgtgcctccagagcccaatggacaagttggccctgcctggcgccttcaggcccgaatgcacatttatctgtgtgtgcccctctcctttttcaaatgtgtttccagagattgcagagggccttcttctgaggattaatgttggattgacctctgggacgcagccaagggatggttctttggccactgtctgtggtacaagagggcttcgtgaagatggggagctgcaggctgaaagtcctctaggaagcccagggaagatcctgtgccctgcccccaagaaactgtggactattgtggctgcagatggaagggtagcggaggggtcttagccgtggatgcggaatatagtggagctagatttgctttatatggggcctggagccatttcagcaatgggctatcagcttacaggtcttgggctaaaagcctgactccagaagagtgattctcaccctgggcagttttgcctctccggggccatttggcaacgaatgaagacacattttttgttgttccaacctggggagggtgctactggtttctggtgggtagaggccaggaatgctgcccaacatctggagtacactggatgttccaggcattgagttcgggtgagcggctccttcccagaagctcatggatagaggtacacatgagctgcctttcccgtctccaaccagacaacgtgttgttata

SEQ ID NO: 98665 - DNA, 1198 bp, Homo sapiens
tcttccagaccacaaatgaagaactttaaactgggggttatagtgggagaatttgggggggtcccagaaaggacttaaacccattccatggtcagggcctttcaaatgcattcatccctctgtgtgcctctgttctgccccagccttgtaagagggtccctgtcattcttctagagccagacagcctgatttcaaatcctgaatccatcgcttttcagatttgtgatcttggtcaagtaactgacctctgtgagcctcaaattctccatctctgaaagttggggagggtgctagtagtacccacctaagagttagggtgaagctgaaattgatcatccatataaattgctcagcacgggccctgacaggccatcagcactcattagccgcgcgtcatctccaccctcatcatcattacggtccaggtggctcccggagggcacgtctctctgggaaactggacctggagcttttcttcccttcctctcttggcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccagggtcagtgagggtcaggtctggtggaaggggtgggaggacaaggaaagtggggtctcagctggaggagggcatcctaataagaccctcatctggtgtgacctgtaggcaaagcacttttctttccacaaacatagttgtggaacatagttagtgacctttggggcagtcagtatctctggctgtgaaatagactggacatgtggtttcttgatgttctttccttctaaaaccttcacatttctgtatggttttggaacatagacacagaaaatgaatcccagagatgaagacagagtccctgaaacttgcttactcttttttttttcctccccctgagatggggtctcactctgttgcccaggctggagtgtaatggtgccatcacacctcactgctgcctccaactcctgggctcaagtgatcctccttcctcagcctcctgaacagctgggactataggcatgcaccaccac

SEQ ID NO: 98666 - DNA, 3412 bp, Homo sapiens
ctggcctgaaactcagtcttgttgccatatgcttctctcactgagctacccctcccctctttcctgcccagctctgccatcttgggtcctggccctggttggttttatggaaagaagtggagcttgggcatggggtgggggcatggagactcgagacggccacttagatggatatttggaggcagagcccattctgacacatgaaagccacggtcacagaacaaggagaggagtgaacattcccatccatacaattttctttaggggctggggttgggcacccagcatggcagggagatccccgggcaggctgtcagaagtccctgtgccccctgctggctgtgtgaccatgggaaagtcccctccctgtgcagcagcttctcgctgagcttgcgtctggcgcgtgcttcgtgggcctgctgtcctcactccgggcgtcccctgctgtctgtgcgtgcagactccctgccaacaggaactggaccaggtcctggagcggatctccaccatgcgccttccggatgagcggggccctctggagcacctctactccctgcacatccccaactgtgacaagcatggcctgtacaacctcaaacaggtgagcatggtgccagcctgggccagagcagctcctcctcagccctgggccccagatgtgccttgtttctgccccacccgcctatgatcctctgaggtctgagctgagtgagagactcagactcctgtcaccatggggattgggatgccagctgccaggccggggagggtgcagctcttctccctgcctccgacgggtcagttgctggctccacttgcccagctgcccaccggcctcacttggagtccaggttgggaggaggctcttggagaagggaagtggcttaaaccaagcatctttgctttgatcggacattgacatcacctggagctcttcctgggcccgcccccaaattgccatgtggtaggtcaggtttacagctctaacaagcctcaggtgaggctcataatctgtgagccacactcccaccatcattgatttcaaccactggccgagttgtcttcatggtttcgaagtatctcagggaatgaagagtcaggcatggagaaatgccgttggaaagattctgaaaagccatctagaacaccattgtaaatacattggagaaaatgaagtttaagtaaaccactcaggagcccttctccctcctctatccaccttctgttcatatgcattttaacagtcactgtgcatatgcaatattttccctgtaacatactttttttttttttttttttgagacggagtctcgctcttgtctcccaggctggagtgcagtggcgtgatctcagctcactgcaacctccgcctgccgtgttcaagcaattctcctgcctcagcctcctgagtagctgggattacaggtgcctgccaccatgcctggctaatttttgtatttttagtagagatggggtttaccatgttggccaggctggtcttgaactcctaacctcagatgatccccccacctcgacctcccaaagtgctgggattacaggcatgagccaccacacctggctgggcattgggatttttataaagctaccctggtggttctaatggcagtctgggctgacctaaagtgtggatgtgtgaagccaggagatgggaacagggctctgctgatggcttaggggtctcacctctccacccccttcacccaggcaccttgaccctctaaatattagtttagtattaaaagctatttgtgtacatgccctctaaatgtaagctggctaactccatttggagctcagaagaaaaagtctcgatcacttctcatgggaaacaggctgtctgctgcacctttgggtaactaaagtgatttgcaggagtagttagcttatgcataaaacagagaccttggagtgggaatgcctggcttccatctcagctgtgcttcttaccagctgtgtgaccttgggcaagttgcttagcccatctgtgcttcagttttatcatctgtaaaccagggataataatggcatctaattcacaaagtggttgtgaggattaaatgactatatttgttagaaactgaactagcagtgtgtcttgcacacacagtgcctggcacacactgattttgattgcaacatgaggttttacacctgacgctatgactaagcttcagtatgctgggtcccccccactggatgggacctctttgaggctggggactgagtcttttcatcttcgggtgtcctgaatggccttgctaatcagaggggtccctgggcgggcagcatcagcatcacgttggagctcgctagcgatgcagaatttccagctctccagggacctactgcatgggaatctgcattttatcaaggtttcctggcgcatatttgaagttgcgaagctccacccggcagcgcatgggtagctgcaaggggtggctgctcagtggacgccgggttgagggacagaaggaaagttgctggctgcgggctcctccatgctcttctcctctctccccagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagtaaagtgtgtgtcttttgcctgagtctttggggtcttccagggagagatgcagagcctggcctaggttggcctacccgccatcatccagctttgcccctggctcctaggaaaatgggaaaggccgtttccgtttcccattcatgaaatggcaataagaaggaatgggaacctcctgaatccagatcaaaccctccagtgcagccccaggactcccaggtgaggcttctgcccccatgtggcccctgcctggcgctgtacaggggcaggatgagtcacgggctggggatggggagatgtggagcgtgggtccggcttcctccctcgcacattcagataacactgcagtgggagataaggaacaggaaacgttgggatt

SEQ ID NO: 98667 - DNA, 1065 bp, Homo sapiens
ttccatacaggccctagaagagaagtgaggacgcgggtgacccacacggccttctgtgcctcttcaacagctactctcccagcctcccatttctgccaagccacattctccacaggactcaaacatttagctttactttagacttttccaggaatcttcccaaatctcctttcctcatcccccctcacctcttcctcaccacccacagccccctcctccacccccatgtacaacatccggcttttactcatgcttgtttctaattatgcatactaatttattttctttccttttttcctgacctgcctatattttcctactcattctttggcctccactaccgaaaaatggaatactcctcctgtacagggtcagggtttttccttccccagtgcctaaagctggattcagtccacagtgacttctctaataacagagtgtaagggactccttggttgaaaagaaggaaaaaccccaacttgcctttcagggtctcttcaatgagcttgatttgtgttaaatttaggggctcaggaatttctgccgatttgcagcacttactactcctacccttcccaacatttgtgctttatcgaaacaactaaattaggagcagcttgagggtaggggtcagagcacagacattttctgtattgcctgtagaaactagcacagtacaggcaccccctaagtgcaaaagaagtccttgctgacccagatggaattttcctgaagtgagtgctttgtgtctatctttagaactagactttcctgataaaatagtcaggagatttggctgaattttccagtattcaactggctatgttggggtcatgtagatacaacctttaagaacataatgacctttaaaatatctattcctgaagtcaggtttggtccctagtctgtgggcagatgactgttttcatggtatgctttgttcgtgtccttcctgggtgggggaggatttggggggacagtttgactctagttatctacaaagttgagttatgagaccagcccttttcaactttacctcttgcaaattgatcctgtaataaattg

SEQ ID NO: 98668 - DNA, 1075 bp, Homo sapiens
aaggcagaaggggcttacttctttataaagaccaatacaactctctttggataattagaaatatattcactaataaaatgttaaatctgggaaggatctttgaaagcaggtaggccagtgattttcaaatatatttcatgaaaacctggggcctcgtgaaggagtttcagggatactacaaacatttattttattcacatttcattctaaaaaatatgtaaaccactttaaaagttctaataaaagtaacatatatgagatgccacacttttatgtatttgagaactccaaaaagtatgttgtcaggttgttaggcaatgttagttactataaaaaattacacagtggttccagtaaaattatagaataaagcctaaaattggtgttcttgaatgctgggcacctctcctgcaagcagagacgtggggtccccaaccttttccatcttgtggccccaccatctttcactcaagacttccaggttctctgtgtttctctgcattgagccaacagaaaagaaaagaacacgagagatagggtgtctaaggctctttgggtgcagtgcacatccttcctttcacatgctattggctagaaatctgtcacgtggccacatgtaaccgtaaggaactctaggaaatgtagtccacctgtctggaaagaagaaaaagaactggacttgtaaacagctaacctgtctctgcgttaccaggttctctctcctaggcacatacttacatagttggaaatcagatctgttgatcttaggaataaccattttttttttgagacggggtcttgctctgttgcccgggctggagtgcagtggcatgatcatggctcactgcagcctcaacctcctgggctcaagcaatccttgacttgcagcctcccgagtagctgtgaccagaggtgcgagccactgtgcccggctaatgttttaatttttttgtagaggtagggtctcactatattgcctaggctggtcttaaactcctggcctcaggtgatcctctcatcttggcctcctgaagtgctgggattactggcatgagctaccatgcccagcccaaat

SEQ ID NO: 98669 - DNA, 1287 bp, Homo sapiens
ctatgtaaggtgctttacttctatgaattctaatcctttacagggaaggcccactttcccaagattcaaagaggttaagtgacttgctcagagtcacacagctagtaacacagtcagaatccaaattcagacctgtcagcctccagaacccagcacaatggggacagagtctaaaccgtcttcctggtcctgatcacctgcttcactgctcagttatttctattcttggggtgctctgcagtattccaggggctgggtgctcttatcccaagatggagaagctagagcagagagcattagagcaaactatttacagccctgtacaggtcaacagtatgtgggtgggtcattaatttactacctctttgcaaaaaccgttaagagatccaatggactgcataaaaaatatcaactcactgaaacacatcagtcaaactgacaaagacgtcaaacaccgagatgcacatttgtctagtgagccaagtggtgagaaatgtgggagggtggggtctacactgccagctagggtgacgttcatattcacagcatcagagaaaacagattcgaaagagatctggaaggccaaactgtctggtcctttatcacatccctgacttgcagttgcccagcccctcctaggacaaccacagggacaggaaaatcactatttccagaggcttcaaaattccatctctggacatttctgacttcctgggtgctggagcaatagaaatagaacttcagcactctcagatggagatcctgtgaatgccagtgaggccactgtaatagacacagtgggaatgccaaatgggccagccactttggaaaatagtttggcagtttcttataaagttaaatatatacttaccatatggtccagcagtcccattcctaggtatttacccagtgacaacatatttccatattaaaacctgtatacaaatacctttataatcattaaaaattggaaacaatccaaatgtccatcagctggggaattcacaaacagtggtatgtctatactgtggaataatactagtacagcaagaaaaagaacatgctactgacatatgcattagtgtagataaatctcacatgccttatcaaagcaaaagaaaccagactcaggtcaaaaggctatataggttttgatttaatttatatgacattctggaagaaatgacaaatgtgtacatgtgtgagtgtgtatatgtatgtgtatatatatgtgtgtgtgtgtgtgtatacacatacatttttgtaaatatatacatatacttacaa

SEQ ID NO: 98670 - DNA, 1049 bp, Homo sapiens
tctccttcccactcttcctactttttttccattaactgacaatgattaagtttgaccttatctcacacatgcaatcaaaagaaaaagaattctcgtgatatttttatcaaagcaaataaaaacaattatcaagtaaacttggatacagctaagaaatacagaaaagaatgacagcacccataatagtgagtgcagcagagaaaaggcattcatggtttggggaagtgcaatttgatccgaccctactggaaggcagtttggtatatatatcaacatttaataaatatgatatggtaatttcacattgaggaatatatcctaaagaaatgaccgggcaattcatatgcaagatagagtgcctattagaatgttgtttataatacccaaaattggaaacacagtaaatattcagtaatagagatttattgactagatgatggaatgccaatataatgatgcactatatatccatttagaataacaatctaaattagatgttattgatataatcgaaaggaaaaatgattacaaaatatgtagaattccatttttataaaaacaaagcattaatgtataaaaaaatctggaatgtatgcacatctaatgggaggagaaatttttaaaaatattttccattaattgaattttgattttttcctacaataaacagatatttcttctttaataaggaaatcacacatattttaaatagaaccaagaccattaacttagactttaaaagtacccagaagacatttccatcagaatctcaaagtttctaactttctctctctttaaactagattttcttcccaggattctagacatgtaaaaaccaaacaaacatttcttaagcaatattattgattaattctgtgctgaattacaaatattgccaatatgttattttctatcttttgactgcattttctacttcaattgggctgaaagaaagttgaagaaagattcttagttctgttttcatttttgcatgactgtcctctccagctgcagctttggagaggaaacaaacattgaaaccccatcag

SEQ ID NO: 98671 - DNA, 1014 bp, Homo sapiens
cttcagaatttccataaccaataatctcctaccagcacggccgcaggaagtctcctgaatttcaacccaggggttgatcagagctgcttgagtggccaagacagaggtactaagcttgctaagctatgctgggtgcatttggagttctccctagcctccaatctaaattccttcccctgtattgtcaggtcacccatgggagacctaggataggattatccagaagatcatgcaggattttgaaaaaaggaaagagcattatttttgaatttgaactgagcatggacttagaaagctctgctgatgtggccaaggaggggcaggaatgggggtcatgtgatggattttcagactctggagtgaccggaatgactcactggaggccatccaggccatggggtttgaggtccagtagtggtcagcaaagaagttcctgggaacctaatggggacaatttggggttttgcagatcatctgaaccgaggttgtttcacatatgttggagaacatgcagctctctatatgtctatattttaaagtaaataaaagattccctgagcaaaccacatggtattggatgggctcagactcctgttccgaagcctctgctttctggctttacaggagcctgtggtgaccactctgggctgggagtccgtgtgctgggtcagcttctggctcctgctgaggattcgctatagcaccagtggacaggcagcttgtcatgcgtgggcttagttctacctttccgtgaaacaggtggagccggggatcattgggtgttgtgagagtagatgaaatttttgcttagtattgtgggttgaatagtgtcccctcaaattcatatgttgaagtcataacccccagcaccccaaaatgggacttggaaatagggtccttacagaggtaatcaagttaaagtgaggtcatcaggagtgggtcctagtccaatatgactagtgtccttataaaaaagagaaatctgcacccagtgacacatgtagaaggaagatg

SEQ ID NO: 98672 - DNA, 1069 bp, Homo sapiens
ccatgaaactggtccctggtgccacaaagattggtgatatggtttggctgtgtccccacccaaatatcatcttgaattgtagttcccataatccccatgtgtcacaagagggacccagtaggaggtaattgaatcacgggggaggtttcccccatgctatttttgtgatagtaagttgtcttgagatctgatggttttataaggggcttccccctttgctcggctctcattcttctctctcctgctgccttctgaagaaagatgtgtttgctttctcttctgccatgattttaagtttcctgaggcctcctcagccctgcagaactgtgagtcagttaaatctcttttctttataaattacccagtcttgggtatgtccttgtagcagcatgaaaaaggattaatacagttggggaccactgagttaggagaggatcatggagactggtgggagatgatggcttggttgaggagaaggtgagacgtacttggaatcaggtatacgaatgcaggcacagaccatgcattatttgcctgagatgggctctggcccagaacagatgctcagaagaagggaagatgaaagtggagagctgtggtcagggttgagagagggagaaaagtggagaacactgatacagctctggcaagcccacctctgaggctctgtctgcattgcctatacctgtttgtttgcccttgatgtctacattctacaaataccttgttttggttgaatcttttgttgttcaacctggcaggcttctattcctgaacctattgttttgtccctatatgaccccttcctgctaagaacagcgctgtccttttggggcctgcccctcccaccccattgctttaatgtctgcatcacctcggatttgctggacctttcttttctcttaggacctcactgcttgctcatggagactgatcctctgtgtctgctgccacagtcacgctgctgcccatgggttccctcctgtgggatgagttttgagctccaacatcacctctactgcttctgctgtggccaacctgatccaacctgatcctcagatgcctcccc

SEQ ID NO: 98673 - DNA, 1074 bp, Homo sapiens
tgctttaactggattcctacattcaattggccgctgttacactcacagctttggtggagttagtcctcagatctgagctgcgtcttccccatggggctgcagccctcagaaggcctcttgctgcccagggccacagcgtgacttctgtgggcacttcgccctcatgagtcctacccctggagaaaaatattaaaatttatactttatgactacattggcataaaaacaaatgtaattccggctggattcatgattgtatactcatttgtattctattcattttttcttctgatttttgaaagacaactaaaataaaaacatttttgagggcccctagaaatattgtggcttctaggcactgcactgtgcctcatggagaagtacgccctgcgtgctggaagtgatgggcagtcctaagagtcttgtcctgggaactcctctggacccagcaacctctgctgccacctgacctagagcccaaccccactccttcagccgagcagccctaaggtaagggaaaaccaggattgcctctgccctcttactccaccccttccaccttctctcaaagtccttccaagcctcgtagacaatcagcaaaagaaagtcacccctctaggcccttttaaagaccatttaggccccctctgcctccccagcacaagctctttgatttcatctccttctcttccctgtttggaaacagctgacttttaggaactgcagtgaccagggcaactcaccccacttcccaggaaagtccctctttccttctctcagagaaagattggaggctgctctgggattagtgctgccggctccctccccgaaggctttgtaccctgcagcagtgggctcccagggcctccatagggagaagtgccttctctgctcagccttgacttcagaggggcccagggtgggagtgggaatggagggctccatttcttacttcattcctccatagtatatggctaagtattcaagaattataagcaaagctgcaaacttgtatgttctttctttcatccttgacaaaatactgttaaccaaactgaaatgaagccaggtaag

SEQ ID NO: 98674 - DNA, 1237 bp, Homo sapiens
aacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgg

SEQ ID NO: 98675 - DNA, 1099 bp, Homo sapiens
ttttgcgaagagaatgctgggtcactccagtcctgcgggtgggggtggggaacgggtgtggggtccaccttcccttttattttctggcttccaaggttcttgagcccaggaagaataagtgtgtgtgtgtggaggggtgtgagctacttgacctttgtctccctgaccttgtggtgtctgaggaggctgagccgtttgcaggcagacagcactttcctgattggcatatgtgttgtgtgtaagaacagtcagtaggggtagggctgggatgggcggggagaggcctgtctaggaatgttcccattttattttggtctcctccccacccctcactatccagccttgtcaatcctctgcagctcccctcgcaccccttcaaaggggatttctgcccacccttaaacaaggtgggacactgtctctaggacttggcttgtggtcaggggagtgcacagaggattctcttctgcacctctctgagtccctgatgctgaggcctgctggagggatggggaagagaggttggcctgagaccagcttgctcacctgggctgctgtccacctcctggggttccacttgcccttccctcatgcccgttgccctctcccgcctgcaggctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaac

SEQ ID NO: 98676 - DNA, 1036 bp, Homo sapiens
gcatcaccccagtctctgcctgcaccttccatggtgctctcccctgtgtgtatctctgtctcctctccttgtaaggacaccaggcatacaggcatactggattaaggctcaccctaatcctgtgtgacctcatcttaatttgtctacatctgcaaagaccctatttccaaataaggtcaaattcacaagcactgggggccaggactttgatgtatgttttgggtgaacacaatttaacccataacactttcttcccttctcctgctttagacaacagcccggagacgcgggctaaagtgaagtttgtccaggacacttctaagtattggtacaagcctgagatctccagggagcagggtgagtgctgggctctgtggtgcatcagaggccatagctggctgaggcctgctgtgtcttccctgggcaaggaacagaggcaaattcagtcctctttgtagcagggggtcatcacagagggggctggggttgaagctggacagtaggaagcacttcctgcagtgaagtgtgggaacacagaagcagtagttgtagacacctcttggaagggttcttaaaaacagcaaagccttggttttcctgggcaaagtaaaaggtctgctaagataatatgaaaccttagctctctgtctgcctgatgtgggaggtttttgcattttacagggagagagaacaaagttgggaataggggaatgattctcaggggaaggctgggtgtgggacaggggtcagcaacggcagcccatgggtcaaatctggatgctgcctgcttttgtaaatgaagttttactggggcgcccccacacctgctggcttgcatcctccctgtgctgctgtcctgctgcagtggcagagtggagtagttgtagcagaggctgcatggcctgcgaagcctgaaatatttactctccggccatttacagagtaagtttgccagccaggtgtggtggtgcacacctataatcccagcacttcaggaggccaaggcagggggatcacttggggccaggagttcgag

SEQ ID NO: 98677 - DNA, 1076 bp, Homo sapiens
ctagaattagctggagctcagagccaacgtttctgtgcttcagatgccggaccacgcaataggctctcagctctcctcgcagctggttgactttaacagaccagtggtatctcaaacactctccagtgggaagggccatggggtggattatccagcaagctggcagagcctggtgattgtgtctctcactttggggtgacttcaggggcgtgggcctcgacaggactgaactatctgccaattgcacctgctgagttactctcatcttacagggccccaagtgctctggccagagccacagagtttggaggggaaggttcttaggggttaactcagccacacccatcgttgtcacagatatgcagctgacatcagcactgtgggtggtgttgggggatctgcccaaggtcacagttaggaggtaatggagccagactggagttattggtctcctgtctcttcctcaagtggccatttcaaagtccttctcctgcctgcaggcaccgtgccctgggattccagcgtgggagttggaattgctgcccgtggcctggggagtggagcggggaaggggcagggagcaaagctgtgggcagccagttccttatttcctgactcatgtgccactgcccgggtcagactaaagctcattctttgctgaccctctgaggctctgcttgatttccttgctgatactttgatgggaaattcagaaaaaaatgccagtgaggcaaaaatggccagaggcaggattattcggcttggggaaaagaataatttgagggatgtctgctatgtcccaggcgctgtgcgaaacactttacattcattcattctttcatgcattgattcatttattcataatactttgtgcgctgactgtttgccaggctttgggaatataaggatgtgttaaggcagctggtgaggagagtgatgccaacagacatttcaatattaggcaaaagtgctgagctgaggtaggaataggatgtcatgggggctgggaggagggggcatgtggctcaatctaaaatgtttggaattctaacttttgagcttctagatctgggacc

SEQ ID NO: 98678 - DNA, 1013 bp, Homo sapiens
gggctgcctctcaccagccagcacactcctgcttgacacttggcccacagagccctgggcacaggggctgcgaggggctcaggctcctgagagccggggactcaactatgcctcggagccttggggtcctttgcagggtgggcctcggccttccccttggagtccttctgtggacagcgcaaatcggccctggcctcaccccagctttcccatctccgttttctccacagattctctttctcaagaaataatccctgttaatctctttctctctttttccttttttgctcttcctcatcttcaccacctgcccttctttcctgcctctccttcctcccacctctcttctcgtcttccctcagaggaagatgaggggaaggtggtggtcaggctgtcagaaggtaagtagcatttgctgtgacttcctgctctctgggtctggaaatggcttttcaaagcagggcttgaagaggctggctggaggcagctctctttcctcactgggactcaggcgaccaggcacatggccttcctgtcccccaacgcttggtgatgagataccaccctggacacctcctgagtcctgatgggggagcttgtagctgccaggcgctggctcaggcacagccagtgtctgggggctcctgcagtgtcaccttgttgaccaaaacgctcctcttgcaccttcctctcccagcgccatttgcaccagcctgcctggtgtgcagcagctcatagaggtagacagggagggactcagatcccctttcccgggacgtgctccacaggcatttctcagagaagagattctccacgttggcaccactgacgttttggcctgaatgacgcctttttttttgagatggagttttgctcttgttgtccaggctggagtgcagtggcacgatctcggctcactgcaacctctgcctcccaggttcaagcaattctcctgcctcagccccctgagtagctgggattacaggcatgcaccaccacgcccagcaattttt

SEQ ID NO: 98679 - DNA, 1045 bp, Homo sapiens
aacttgtgttggctgccatcttgggcatgaggaggctgaagctgtgactgattggtggccccaggaagccgtggctctcccttgagcagtactgtccaatggaaatatactatgagcacatttataatttaaaattctctagtagtcacattaaaaagcataacaggaaactggttacattaattttaataacatttttgttaaatccaaaatatcctttcaataggcaaataagtcaataaaaatattgagctattttacaatctcttataaaatttaagaagaaactggtgaaattcattttaatatgttttatttaaccccagtctaaaatattagcatttcaacgtataatcaatgtaaaaaagaacgggatgttttgtgttctttttcatactttaaaaccctgtgtgtgtttcacacttatggcatgtctctgttcacactggtcaccctgcaacggctctgcggccatgtgtggctcgtgactgctgtgctggacagggtgagcctagagcaggttacgtgagagccagctctgcagcctcttgtgactgcggggaacctctctcactttccatggtgacatctgcttccattcactgttagctgtaaatggccagggaaaggacatcaccttgccttgggtggaagccacctgggctgtgctagaactgggttttgccttcttctctccctcctcttggccagccatgggtacctcggtgagaagtcagaggttccatagacacacagggttagggagagaagacagaaggtggagaaacgtgtggaatttttctctcaggaagcaaaagacttgcctggctttagcgtcgcccactcatctgcctcagcagaagggcccaattgcccaggaactgggggaacgaggaattcaggagctggaggtgaacaagggaggaaccaagagagagctcctgccctgtctggtcctctcgtccgcttcacctcctcacgggcccacctgcgcctccgctgcaccagttggttaaacatgcgcgtacctgtgggctggggctgc

SEQ ID NO: 98680 - DNA, 1366 bp, Homo sapiens
tatttttctgttctgcgaataagggctcttcaaggtgtggggcttgtttgctttaagtggaacagtttgtaagtggcagagtgaggtcagagtctagtttactgtccccatcctgggcgctattttcttagctgagatggcagcagggctgcccctgattaataaaaagcccaaagcggagactcagggcaccactcggtaccttctgcatttaatgtgcaaatgccagtcctgctgctctcctgatgcgccccccacccccgattatgggagcccctgattatgggagagtatgagggcgtgtctcagagtggctgtgcctatgtgagtgtaagtgtgtgtctgcccgtaggcttggcagccggcagcctgctgttcatgacaagtaggaaggcttcccaggtggcgctgtttatggcagcctttgtggctgtgccagactgggggtgctggggggcgtggctggggacatgcagtcctcactgtggatggcagaagatgtttctgtctgaatgagggtgatttctgcttggctgtactggcacattcctaggggctggcagtgtgtgtgcagtgtgtgtgcacacacgctgacccatgtgacctgaggcctttgttaagtcctagtggtggtgaaagcagggcggggaatctcttcccagaagagagtcaagaccagaagcccacgcttcaggctgggtcttggcctctgggacccaggaagtgagttttctaggattctgggagccagctcaatgaggcaatggattccgtgcctcagcccagctgtgggaagagggagtgggaaggaaggagggtgagattaacagcatccccaggcctgtggaatgggattgggatgggaagtacagaaaagcagatggagcacacgacttctctctgtctgctcttcagctgggagggacatggtgggatccgccgctatctttggggcagggaaaagggggcggggagctaagaggccagtataaggggagttggtaagaggttcagcggtacaccggatgaagttggggaaccccagagaaagccaaaaatatcccagaggccaactggggctggggacttcgtaacaaggcttagtcatgtctttgtttctccttgggagcaccatttgcaagatgatgcaatttagccctttccaagagttcttccccacaggcttgatgttgctggttggttgatgcagttgccttggagactgtcttttccctccacctcccctcccttgtctggaagctctggccctccgcctccaggggttggaagtagttgacatctgtttcttgtatcagtcctttgtgttcttggtctcagctctgtgtggagagattcctggtgaagt

SEQ ID NO: 98681 - DNA, 1008 bp, Homo sapiens
cgtgatccaggggtggtgggcagcagtgctttgccaaagtacatgtatcggtctgtgtcagggctacagctcccagaattgcagggtgtgcgagtgtgcgtgtgagtgtgtgtgcgtgtgtgtgtcagatgaaggggattaattgcctccagtctggctcatgctaggggagccttggagtgagctgttgtccagcacagcactgtcctggcagaagagtgacgcctccctgggaagggggctgctctggtgccctgctcctcaggtctgggggcctgtgtggaaccctggggctgggataactgctcatcctggcagggctgtggggaaggcctgatgcccgtgtatgaagcagcccttagagaacgcccagggctccttgaacatagggtgttagggtcctaaagatactttgttgtcataagggtaccccagccttctcagcctcctgggagcttctcttcctttcttcctctggccacacggcctcctgctggggtaggggctggccctagaggttctgagggtgacccagtggccccactatgtacccccatcatcccagtgtcctgctgccatttctgttaggctgtgtgtgtgtgtgtgtgtatgtacatgcaagcatgcacatgtgtgtctgtgcaaggcacctgcctctgcctaggtgggtgtaggagacagaggccctgagagagagaatggggccaaagactgagaaagtcctggggtggagggtggtggcgggagggagggaggtggggagagcaggcctatttttattatcagtcagactctgggacgtgagagagggtgttctctccatgacactggttgtcagcttgtgtccagacaccctagcttggctaaggaacaatggggctctcttctctcccctctgccacgccagtctcccctcccatagagcaagacaagagagagggaacatgtctctccaggcactccaggcggatctgggcttgccaagggggacaacagtgggacactgtg

SEQ ID NO: 98682 - DNA, 1071 bp, Homo sapiens
gctctgggtaatgcattttaatgaattgttatttgctggacttggacccaaaggactttttatcatgaagggactcatcctgaaaaccttagtaactcattcgctattcaaaacctacctgctggtccgacagggaagggtctgtcttcactgagtcattgccaatgaaggtgactcctttcttgcagtcaatatggctggcaccttttattcttcatggttgggccgtctgtcctaacatctaaataagcaaaacctccctacttttcatgaggaagagaagtggggtttcttgatctcagagcccaaagtgctgatcagctggggcgggtttctctagatgtcctccagccatgtgtgtgccaggacccctggagagctggcaaaaatgcagattcctggccccaccccaggcctctgagtggaagtccctggggatagggtcctgaaatctagatttttaacaatctccagaggaggttcttgtgaacatcagaattagaaaacagctgccctgaaaccgtgtgactttaacatcccctatttgtttccttcgttcttttttaagtgtgtgagatggctgcatccttactttcctgcatcccagcctgagctgcatggctagtgccgcacacacctctgcacccttttctgggagggagccccggggagtgggtgcacaccctagtcagctggggattttcctcagagctttccaaaagcatgactcgtgcatctggattatggctgccctggaataaaggccccgtggtgcaatcaagctcagcatcgagggtggagtctggaactctctgcagctgctgagaagagcagggagacatcctcagacaaagacagtggggccatggagagattttgggttttgcaaccaccaagaggaatgggcaggacactggacctttcagcccacaagagcagatgtccaggctggctgggcttggggcctggagctctccacttggggctgcctgcagcttgtgtttctgcttcagtttatcccactccattgtcacccgtgacaatgcccacagcccccaaacatgcagaccc

SEQ ID NO: 98683 - DNA, 1031 bp, Homo sapiens
aaatcagcctcttgattgccctgcatggccctgggaacctctgcagcctggtgtgtgtttacagacttcctgtaagtccccttttctgtcctagcctcagggactccatggctgctgcagaaatagcctcagacaagtttggagcctgaagccacccgggcaggtccaagcaggagaggagatacaggcctgccaagtccaggggctctgggatccaaacagtgcctggtagagcatcttctctgagttgtatccttgaggatccagatccaaacaggactttagggatcacctatacttgccctctgccattgcacagtggagtaaactgaggcctgtccaaaatcaccccttagaattctggctctttggctcctagtctgctgctgcagccaggcagcattttctttaggtctgtttgttacaccgtggctggttagagatctaggggcagagttggagaggtgagttttagctgctgctggaaggatggaggtctgacattcaggagaaccctcttgcctttgggggatctgagtaacaggaacaggtgccaggactagattttctagattttctgaaagttgaggagaagaacctttccactccacgcatctgtctaggtaggatgagtgaccatggcttgtggacatgggaaaacaaggcaacttctagagggttctgacaaggtcctagctcattcttgtgcaaaggggactcaggagtctcaccccaaagtcccttttctcctgcccctctttctttgctcaagcattatttacactcacaagactatccctcagggacctggggtgtcctgcctcagacactcctggctccagaatactggacctcagttgttcaatccctgggccatttatctccctgtgccctgggaagcagcaacagagctgttgatggatgtggggagcttcagactgcccaatctttacatctttacagccagtcgatgccctggctgcttatctgggacttatgcctttgattgcttaaaaaaattgttagcagca

SEQ ID NO: 98684 - DNA, 1154 bp, Homo sapiens
tacccctgcacctttgcaggctcccggccccccttggttccccagttccccctgccaagcccatatcaatatggcccattgtctttctccagctccctgggtctggtcccatgctcctggccacacctcacgtcttggctaccgttgtggcttccagttgttcaaagcagctgtggtggcttcctccaaaagtggctacggatcagcaacagatgaaactcaaggggctatttatagcagggtggccctggggcctggagcagggcctagggcctggggagattcagggactcctcattagggaccagtgaaatggagatgggtgaactgttgggtttctgtgttcctctgagggggcagttttggaacagcctggtttgggtcttgaaaaccaaacacagtcactcgttgactcccagctccacccctgtctaatccccccacccccaagcttgactcatgcaaactggagtcctcagggccagaagagctgtgagacttagaaacttccccccagtagccccacttggctcttccctccttcactgctgaggagctgctcattggtccgaggcagctgggactctgggcagagccttcttccggacagctggatggagggtccccctcttagcagagctgctctaacttggggctcagctgggagctggacctcggaacccacctatcctgcctcgtaggcactgcggagccaggagaggggtgcaggggctcctcttcttggagaccccgtggtcaagccccaggttggagtgtgaatcctgcctggccgtcaacttcccagggacttgagggtaagttattctgtgcctcagtttcttcctttcttggcagattgtggtcctgtctctttaaagaagaggctgcaacttggcggtaggaaaagaccattttctgagaggcacatgggtgtttggaaggtgtcaatgggctcaggaggtctgagaatctagaaactggccttcccaattctgcatcctgtgaggtgactggaaggatgggtagaggcgatgcagggtgttggttttctatagaggtgaatgtttggttgtaactacccttttcatttttcttgatacaaaagtaacaacaaaaacaacagctgtcatctggtaaataccaggcatgatgcg

SEQ ID NO: 98685 - DNA, 1054 bp, Homo sapiens
attgagccagtcccctgcccagccacgggactctccagcagtccaccccgggggaggaggacctgggcctgctgctgtgataatgtggctgtttgtcaagctgtgttgctgtctctggcccacggcccaggactcacaggcaggaatggctgttttcctcctgccgagttggtgtgtagtggagtttgtggatagtgtgctgtgtcgcactttgttttggaaaaatccaggctagtgggcaggaaggagaggggaaggggtgtggctgaagggggtgctatgtgggggttggccacagcccccagaggagatgtaggaatggggccgggcccctgacgtaggttggtcaccaatctctggctgcctgacaaggcccctggtgttcgcttacagaccctcctcccaactgtgcccctctggggatctgggctcaggaaatggcttttcttttggtcctgagctgttgtgtttggtctgtggacctcaaaggaaagcagggctcttcccacagaggcattgcttcaaaccaaccccacccaaggctggaggttcgtgctccttgcctcatgacggggaagaaggcagcagataacagaacctggggtcatagaccttgagccacccagtagtgtctgagtggtgatccactcttgcctgcaatgaggaccaaggcaaaaagagttggctgaatctgcagcaggaaggatgagggttagataccaggaggaaattcctgacagtgagaaaagtaagacactctgtctgggaggctgtcgaatttcctttcatggtgccctttcagcaaaggaaggattgtgttttggaggtaaggatggggagagttctgtttggtgtttagagagttggatgaaaagttctgtaatcaacctgtgtcttgagaggagccaggaagaagttcaaagccatttgggtaaggtgatttgtgatccccggagaggaaaagaataggattacaggcaggcagagagcttattttcctttttataaggtttgtaaagtcctgtagtcgttttccctaggggctccacgcgga

SEQ ID NO: 98686 - DNA, 1034 bp, Homo sapiens
tgagtaggtggcctggagtccagtgccccttcactgttggaaagtgattcctccccagtaaccgctgtctggctgcaactccttcctccccctcctcaccctgccttcagatctcccgtcttcagcactgctttgcaacaggagggtgacagagtcaacttcaggggcctgctctgacttggggcagagagagaggtctgtgtagtgccgcggaaggacctgtggcaggggcgtcaggtgacctgctagtcccttttggcactgtgtgacttcaggcaaattgcttccactttttgggctttggtttcctcaattgcgaaatgagaagttcgagttaggggcgttctctcttttcagcagtgctgaaattctgtaagtgcatggatctttctgaacagagaggctcctagtcttggggcctttggcagagctgtccagcatcgaggtgggatcctgttggctcttcaggcatctgctgggatgccatctgaaatgctggggaggtccttccagcactggaattggaacgttctttgcccagtgaccactcctccaggcagcttgatttcttggaacagagcagagggcaacagctgtcagggttgggctggccagaatctcccgtctctgtcccagtgactcaggtggggatacgcttggcaggattggagccaatgaagcaaaggaggggactggggaagatctgctgcctgccttggccacccaaagggaacagagtgggaggaagtgatgtgctggggatgggggtgcagaggcaaagtgagtaacagttgtgagtaatggctcagtgtctccactgggtaggtggctcctagactgcacagagctgtctggggctccggaaattctccccggaggcccagccactgaatcacagcagcctgagctcctccctccctgtcctccttaggagctgggggtcccggccagcagggtgccacacctcatcccctctgcctctctgtgcttctctggatcagcccctcccatcacctatgccttcacaccccctc

SEQ ID NO: 98687 - DNA, 1070 bp, Homo sapiens
tccggccgagcaccagggctgggagccagcactgtaaccaggagctgagggttcttggcggtggaggaggcaacctgggaccctctgcttccaggcgcctggccttgagcccttctggctctgcttccccatccctcatcccatgcttcttcacacttcacttcccgcaaggccccagtgaagaatttcccagggaggtggtggtgtccaggaagtataagcacagagaacctggtggccaggtggagcggggctgggttgggatgcttatgggttcagagaagatgttattgttttgcagaccaacttctggcctctgatgggctgtggctgaagccttggagtttggggaccctcaggctcctgtttctacccagataggagcaggagtcaaggggggccagaaagaacttttgtttggtctaagggagaggagcctcagaggtggaatcttggctcaggtgaaggaagagcttcctaaggaccctggtgggtcagcaggaggatgggctatcttgtaaggtggagagcatcttgtactggggggagtttagacagaggccgaataagggcttggaaggattcctgggctgggatgtggttagaggcgatgacctggatggtctcttgggatgctgagggcctgggatacttggagtcggggagttctctgacaccagaatgggggatcaggaagctgtgtcctctggcctggggcgtgggcgcagaccactcgcaggggccccctccttcctgccaatgtgtaaggaaccaagagcccgacgctctgccctggcactgtgcccctccctcacacccgtggctcaactgcctaccaggtccgcacccagctgcttcctgcaaaggttctgaggttcttcctatgcctcctggcccactctgccccttgcctgtggtgggctgcgtgacagtgtggagttgaggggacagcaagcaccacaggcttcacccccaatccctgcagttagagcccatgttccctgttgaggggctctggggctggtgtgcaaggaccgggggtgggtgctgggatgttgggcatcttgaac

SEQ ID NO: 98688 - DNA, 1016 bp, Homo sapiens
gcaggggttaaaggaggccatggctggcggagggggcccactgctggctggctccgggaaggaggcggtgcactgttggcccgccccctgggctggcctgggagggaacccgactagcagagccctctgctcagttgctcccagcagtggccctgggaccagctctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtgagtgaatgaatgtgcgtgtgtgatggtgtacgtgtgtgtgagtgtgcgtgttatatttgtgtgtagagggaaatggagccggccagggctgctgggctgttgatactgatgctgtcaagaccacagatcagattaggagaaggtgaggtcagcctgcctgttcccatgtctctgggtcaggcaagctgttcagaggccaaccttgtcagtcccctgtcttcagatgtttctgtggttctggcagggatgtctggggtgcggcttgtccctgctctgagagagcaaccagtcagaaggagtttcgtttgctggggaagttgctggtgtcagtggctgcttgggactgaggccagctacaggagtagggagggacacagggaccaagggagggggaagcttgggagtctcttctgctacttgcctgcccattgcagggggatgagtattttttcttcttcatctctttccctgccacccacttgagctgctgtgagggcacctttcttctaggggctcacttagctccctgaggtctgaccttggctgcagggaggggctggcaggcctggcaaggttagggttcaaagcacttttcccatctccactcctcagtgtgggccctgctcccttgcccatgggcacagactggcagaagtgccccctctgccctctcca

SEQ ID NO: 98689 - DNA, 1016 bp, Homo sapiens
agtacaaacttgggaatcaagtcctatcacccctgcttatttgctgtctcattatcattgactttggacaagtggcttcacctcttgcgtctgagctctctcaactgtacaaagtagggttagaataacatctactcccaggtatggggagaggagggaatgagtgaatgcaggcactggggctgtaccagggcttggcacatgttaagtgcccatcagctgttgggatctaaatgtctctccctccggccgcctgttctttcccttcaggtcactcagcacgatttgtgttgtgtgtttgtgtttgttccttcagcggctccctctcctagatcaagtgctccttgagggcaggggcccatctggctgtgttcatgttctgcctggagggcctcacagggcctgggccactgcgggcacttagaaagtacttgtggaatgaaggggtgagggacagatgggatggagccaactggaaaaggatcagaaccagagaaagaaccactgagcacctggcatgtggaagagtacagaaactgaaaaacctggggacgtctagcctgtgaagctaccactatgggagacttccagtgattgcgtggctgtgtgtgtgtgtgtgttgaataaagctttggggagatttgttccctgaagcaaaaccaagggttccaggaagcaggtttcccccagtggtgggagccgccttgaggatggggagtgagccctgagggcctggggtgtgtaggcaggggcgggcgagcccctgtcaggtcaaggagagccctgatatgctggaatgtggtccagccaggccctgaggccctgccggcttgctgcagctgctgtagttaggagaggagtagcaaacatagctgatgtctctgaacttcagtttcctcctctgtaaaatgggattcataaaggtcaatacccaatggggtgctggcaggattagaatgagttaatccccacaaagctctaggaacagtatgtcaattgggaaacactcactaaat

SEQ ID NO: 98690 - DNA, 1148 bp, Homo sapiens
tccacgaggagaaactgaggctcagagtggttcgtgattcagtagaggagtggctaccagacagtcactgagggtaaccaggtgcttttcttggtcttcctggaggacagcctagggggaaacagatcgaactgcagctggagggaattggggttgtcctaaggaggggttgtcctctggtggtagggagactggaagggggacaggggactgaaggagcagctgggactcccttaattggaatctcaaggacagaaatggttgtgttgggcggggaaaggctgagccttcccgcactggtggggtgtgtgtctggaggtgtggatcagaagctgggctgctggtacgtggaggccgagtgctagagtcccagcctgcctggcatggacctgtggaaaacagcatgggccatctgtgccctctaagaccacatctgttctcacatgccccctgccctgcatccacccctgggagccagcctcctagacctggccatgttcccaagaggctgagactgagtcccccactggtcccccttgccctccactgtcagaggcatccagctgcctctgtgttctgtgtggagaccaggagatggggctagtatcagtgagcattcttggcagcacacttgaccacccccagcctcaatttcctcaaatgtaagatagggataatgaaaataacacctggcttgcagggttgctgtgaagagctttgtaaatggtacatgttgtggggtggatgtcctgttcctggatgggtcaatgagtcggggacactccttctgccccccactcactgggtgagttagtggagggactggtggagtctcctaggaccccagtacaagggtaggtgaggggctgtgcagcggtggccctactgagagtcccttctagaccctctgcagctgctgctcctcctcctcctcctcctgccggcttccttctccaccctcctcccttcacacgtgaggatgatgataaacactctgccagctctgaatagggcctgacctcagcggcgaggcatctcccctcactcccaccctcccagccccagccgcattcctggagaggctagagctgaggcccccacttgcccctctctccctccacccacagaggcgtccagctgcctctgtg

SEQ ID NO: 98691 - DNA, 1023 bp, Homo sapiens
ttagatgagctaggtatggagagtgcttttacgctcccggtgcatgatagccagtgacctgtgatggctgtggtgtggtggcggtggcatggttattgtcattagatgcagtctggctctctccaggtgatgaccccgtgccggagcacctgtgccaattatccctgggccagttctgttttccgtgttccctgggtggtctgcattcttcctcctctgccctcttagtctgagcatcccttgtctgattcctggaggtatctcgggacctctcaggttgaactcctctccccttccaaggacttaattcttgaactatcctctgaccctcatctgaccctaatctgtgccttccttagaacccaagtttttgttttgttactttgtattctgagatgattaaacttacacaaaatttgcaaaaatagtacagagtttccttatatccttcacccaactccccctaatgctgacatcttacataaccatgcacggttatcaaaaccaggacattcacattgatctgacgttaatctgaggattgtagtagaatttggccagtgttcccaccactgccctttttctgatctaggatccaatccaggatcccacattgcatgtggtcatcgtgtctcctgagtcttctcctatctgggacagttcttctgtctttctttgttgctgatgagtttggcacttttggagagtgctggttagttattttgaagaatgtccctcaatttgggtgtgtttgattttctctttccatcattctttctacatttattaactggaattctactgtaaagaatggtgccttatccccattttactgatttattccattatttatttgtcagtatggacaccctgacattcactttatggatcataaactcatatggtcatttttttttcttgaatccaattgatctagccatggccaatgggagctccttgtgttggtaggacccatggttcttaactttttgttttctttttgagatggagtttcgctcctgt

SEQ ID NO: 98692 - DNA, 1047 bp, Homo sapiens
ggtgggtgtctccacagtctgcgtgcgtgggccagcgcgttcgtcttacccttccctccaccccggcccctctccccttctcccctaacctcctaccccacccagccccactcagggggcagcagggccgctccctccgtccttgcctcccttacccaccctcaccggcccttgtttctccttcccctgggggcagccgccgccatgatcctgctggaggtgaacaaccgcatcatcgaggagacgctcgcgctcaagttcgagaacgcggccgccgggtgagcgcgcgcccggggccgggggtggcgggggaagcagagttgaccccagctaatccccaatgttgtccagtcccccagacctggaggagagaaatggggtgcctggcagggtgtaggggctgccccagcggggtagacgtgggaggcgattgggcgcggccgggcgaggggcagagatgcgtggggagaggctcagaggagggatgcggaagcagcgagtggtgagggctgtgcgtgccaaagggcaggagacctgtgggacgtgggggaccctggagccggaactcgctccggagtagccccctgccctctggggcgagaaggggaccccttccctgcgtgaaattccccggcattgttctgaacccagagagagcctgtttggaattgggttggaaggagttttcaggaattcccaggactggaggagggaaggagatgcaggcccacatcgccaccagcattctcgttccccacccccatctcctttaaaaggagcagaagagaagactaaaagccgacccagtcttagagccggaaaaacgcgatctctggtttcccttccccgaacccttctgtgagagacactgggccattttgttacatatttttaaagcaaagccaattgtccctcgctccacaccccttccttatctctcctttgaggttctaatgctctctcctcacccactagcctttatctggttatcttgtaaattcttacatcaagaccctaggtctgtgatttcttctgtggtagccctgg

SEQ ID NO: 98693 - DNA, 1131 bp, Homo sapiens
aaatgtggcccattattcggaacttcagttctttctttttcttttagaaaattattcttaaaaagagaagctaaccatttcggagggattaaataggccctcaagtctggaagacataagttagaacttccaggacttttttttttttttccgagacagagtctctcactggctggaatgcagtggcgcgatctctgctcactgcaacctcgccctcccaggctcaagtgagtctcatgtctcggcttcccaagtagctgggattacaagcacgtgctaccacacctggctaatatttgtatttttagtagagatggggtttcaccatgttggccaggctggtctcaaactcctggcctcaagtgacccgcccgcctcggcctcccaaagtgctgggattacagcactgctcctttcctcaggacattttttacaaagatatgcattgtagggaagctgtatagggggtgcactggtgtgtatgcttgtgcacatgtgcgggtgtatgtgtgtataaatctaggcttttattctggcccatctccccctttgagatgtggttttcaataagcaggctcaaaacattctgctgaaaatttgaaactttgaaaatctttaaaaaaaaagagaccatgatattgtgcctggtaggcagggctctcctgggattacagatgtatcacccagtagaagcccgaatgaagcaaatgtaaattatcagacattccagtaaggtaaggcaaggtgcatgcctattccagaacttacagcagagtttgcctagtgtggttatcataaacatgtatgggattctaccagtgctcagcccaggcagcaacagaaaaaaaggggcctctctgagagcctattagccaagttagggaggtgctaaggggtgaaaggtgttggggtggagatcagagaaagacattaaagggagtagtttggaggagaaaccctggagatttgaaaggctttgctggtgtgggaacctgctaggagaggtcagctccaccctactttttgcacttctcagaataaaccgatgggggaaattacagttcggagcagccttttccagagtgcatcttccatctctgtgatgtccaataagatagccatacaaagtgg

SEQ ID NO: 98694 - DNA, 1078 bp, Homo sapiens
taatcctggaaagaaagagttaagctagatttcttaaatctcctttccattctgtgcttttcttacgatggagctccagaacacattgctattcttgtagctaccacaagggtcaaagaaccagccccacccactcaagtgggtggagtaagtaacattcatagtgttggagcagagtgcacagtaaatggctccctgggttggttaaacagtgaccaacccatgataaccacaggaaggttattactttgtcacaggccatttttaaaggtggaatgcctctgctgctagagtgggaaggtaatggtgatgagtgataggttgcctccacccatctcctggtgtcattgggagagggggtacaaactgaaaagtgaatcatggttaaaagtgcaagtgaagtgacaaggaagtgttggctggttttaccaaggggagggagcaaagcagttgaacatgatataaatttggctctcagtacctcttagatctcagaatattaacttagtaagcttgaaattaaactaaatcttagggacttagggatttaaactaaatccccaccacatctgatttccccttcctcgaaataccaatagtacgtgcaacacagacttgtagctcagaggtcgcatgctgtttcaaattcttgggatatgcatgttacttttttttaaagaagtggtatatcagacacctgaaggtcaagtctctctgtgccaccaagaaactctcgtgaccttgagcccctcctctcaattcctcttcggtaaaagaaatacctcacagtggctgtgcaatcaccaaataggaactacaggtggcattatttatcttttgcccttgtgtaagaaaatgtagtcttgcaggttgaaaatttcttccagctataggaaaatggttaaataaatatgtggaatattaggaaattattgttcagccaggcgtgggggctcattcctgtaatcccagcacttttggaggccaaggcaggagcatcgcttgaggtcaagagttcaagcccagcctgggcaacgtagtgagaccctgtctttgtatataaataaataagtaggcc

SEQ ID NO: 98695 - DNA, 1105 bp, Homo sapiens
ggatgagctttgattaaagattctcggccaggcatagtggctcatgcctataatcccagcactttgggaggacgaggcgggtggatcatccaaggtcagtagttcaagatcagcctgaccaacatggagaaaccccatctcaactaaaaatacaaaaaaaaattagccgggcatggtggcgcatgcctataatcccagctacttgggaggctcaggcaggagaatcacttgaacccaggaggcggaggttgtggtgagccgagatcgcgccattgcactctgtcccaggcataaaaagatactcatctcagttttgtgacttgtttggtgactaaatccacttcccctctgtctctactttcccatccaccaaatgaaagttaggaagaatgccaacttaggaagagcttggcaagtgcagtactttaaaaataatgaaattatcatggcctttggattaacgtatttggttttgttttgtttttattttctagttattaaagagggtgtacgggagtttcttggtaaatccagaatcaggtatgtagtcatgtgagcaactatggaatgacatgggaagagaggtgtcctttttatattatgctttttttacccaaaggatttcgtttaaatattattacaaatatttctgcatgagcccattcctaatttcaactccgtccataaaaatagcttttaaggggctttgctttgtccaatatggaacacagtagaggtacaaaattgatgtgtgacatttttaacatttacttgatggggccacatgactcttacttaatctttcagccagagggccacatttgtttgttcatggtgattaaaatggctttgaaaagaatgagcaaacattgattcccaccctcggcccttagtaattctgcatactacatatttggagaaagaagaggaatattcaccacactattcttgtgatttcaagtaataaaaatcagaccctttcttaatccagtcttctaataggttgtctcaacattcatggccagaggaattgaaaggcaccgtgtcatccttgaatagaacagctatgttatactgctttaaaaaggaggtttaaagtggaaaa

SEQ ID NO: 98696 - DNA, 1944 bp, Homo sapiens
cactgtgcccagaccaccctacctgccccccaccaccaatttttttttttttttaacagatgaggaaattaacaagtcaggcaattttttttgtttttgttttttttttttggagctggagtctcgctctgttgtgcagtggtgcaatatcagctcgctgtaacctccacctcctgggttcaagcaattctcctgcctcagcctcccaagtagctaggattacaggcgcccgccaccatgcctggctaatatttgtgattttagtagagacagggttttgccatgttggccagactgctctcaaaactcctgacctcaggtgatctgcccaccttggcctcccaaaatgctgggattacaggtgtgagccaccacacccagcagtttttttaaggtcacaaaatgacaagactaggatttggacccagttctgttcgactcaaaatagagtgccctacacttatgtgtcatgctgcatttggcaagtcacgtcacttctttgaatctccttttccctctgcaaaacagtaaccttatctagcctgcagacttcaaaggtggttatggagatcaaatgaagtaaaatgttttaaaaattgtacaatatataccaataaaagctattggggaggtatatgtatgaacaggtagttggtttttctaccctgccacctcataaagagtttgcagtggcacgtagaagggtttatcttattatcacaaagctacccatttgctggccatactgatacttggcacattaaactatcagagaaatatatgtggctcctttacaactgtgtctagaagggtacatttccaatcagagttcccaggttctgactttctcccattacatatttgtaattagtcatctttgatactgattcaaatttttgattaacattaattatatatatttacaagaatcttataaaaattaagattttatttcacctcattttgccctgtgagatagatggaaatagactatattctacccaggttaaaagtacagataatgagacaaaatgtcaatagaacctgaaaaaagatttttttagttgcctctagtctctgtttacttggtatagatagtatgctgcttttttttttttttttttttttaaatgtaactgctgggttgttttttgtttcttgttttttctttccctccaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtgagtatagaatttggtcctgaagcctggatatggctgctacaccaccatggcacttactgaaagaaatatggcttggtcaaactttcagctgtattgcgtgaaaatgtttttctcataaaatgtcttaagccaggaagtagatgatagggcagaaatcagccactcctcctactctccagatactgagagctgacagatggtggaaagagaatccagtgctttcctttaaggcaccactgttctgagtcatgtttaagagtatagcctggataatcagcaggcagggtgaccataggtccatgttatatttacaagtcaataaaatctacttctgataatttccatctgctgcctctcttagggcattcattttgtgcactgactttgttgaccataaatatcatctcatttggcacacctttatattatgatttaagagatttatgactttagccttctgatgtacttgtagatcaagttattgacaaaaccccattctgattctgtacttatcctcatggattttgttcctctcaggtatgttgagtctaaaaaggacagagtcacagtagtct

SEQ ID NO: 98697 - DNA, 1042 bp, Homo sapiens
aggtcaagaccatcctggccaacatggtgaaaccccgtctctactaaaaaaatacaaaaaattagccgggtgtggtggcaggcacctgtaatcccagccacttgggaggctgaggcaggagaatctcttgaacctgggaggcagaggttgcagtgagccaagattgcaccattgcactccagcctgggcaaaaagagcgaaactccgactcaaaaaaaaagagagtcctgagagttagcagggcattttgtaattggatttttggtgtagttgcattcaggtcattgtgtaccagtctgctggccagttagttgctgcctctaggatggacatgagagttcattggtcaagtgacattcaggctggtttcttctgagatggctcagcattcaaaatctagtacaatggtaaaattttttgaaaacgttactaccttcattctgttccttggcagggtggtaaagatttttaaattctgaagcagaatctcttttgccaaatagagttgaaagacagctgtgcttaacagtaaagatactttgcatagccttctaagtggctaggaaaatcttcaaaagtgatattctcaactgctccatccctagtggcttttgtattttggctaattaatcagaaactagtttgggagtcactatacagaaaaattggaatattgacacttcagcatttgctagtgctgaacttgatgaaggaatatataaatatacatgtatctcttgggtcctaaaagtaagcctctagagaggcatttcatgtgtttttatgcagaattgacaggggaattaaatgcagtagctcagaaattgggctaaatccagagtaacaaaactaattttaaaagctctgaagtatatatttagatttggctggttttttaccaatcttattccattttattccaggaaacaacttatttttatactttaaacagatcttatcttggagagtgtaccggagatttgttccttaggagaattttgtgtattcttttttggcatatgatttaaatgcctccttcagg

SEQ ID NO: 98698 - DNA, 1042 bp, Homo sapiens
caaagtcccagagcccagagaaagtatggtagtttatcacctatgttagtgcaaaggaaaaggattatcactacttttcatcacattttgaagatctgacttattaagtactttgcagtctctcccgtttgaatctgaagtgtagtggtagcagctagcacttgtcatatttcaggtttggtgtagtttatttttaacctcctgctggtctggagggctacaaaggtcacaccacatagaacaaaccctatagcttgagttgccactcatcttacacccacttctcttctggttgcttttgctttgtcttggcaggagttcaaagaaggacgcagagccagccacacagccccacaggtcctctttagccacagggaacctcctctggagctgaaagacacagacgccgctgtgggtgacaacattggctacattacctttggtgagcagggtgcacttgctgcttttgtgccgctttaatgagttcacacagcagaatacctaaatctgcacagaaccttggttaacattttaaggtaggcaaacgcaggcataccaacttgttcctgttgccattgcagtgactaaaggagggatgtcacagggtattaattacagagcaggccatatgctatttttgtacagtaatcctttcctttttttccccatttttcttaaatcttaaaaataagactgaattctgatatcaagagttaaggtcccttcaatagttcagctggtagagcagaggactatagctacttcctcagtaggagacgtccttaggttgctggttcgattccagcttgaaggagacaagtacagttttggctgggcacggtggttcatggctgtaatcacagcactttgggaggttaaggcaggtggatcacgaggtcaggagatcaagatcatcctggccaatgtggtgaaactctgtctctactaaaatacaaaaaaaaattagctgggcatggtggcgcacgtctgtagtcccaggtactccagaggctgaggcaggagaattgcttgaacccgggag

SEQ ID NO: 98699 - DNA, 1003 bp, Homo sapiens
acatggtgaaaccacacctctactaaaaatacaaaaattagttggacatggtgacatgtgcctatagtctatagtcccagctactcgggcaagcgaggcatggcaattgcttaaacccagaaagtggaggttgcagcaagccgagatcatcctgctgcgctccagcctgggagactgtctcaaaaaaaaagataactaggcatggtggtgcatgactgtagtcatagctacttgagaggctgaggtgagaggatcacttgaacccaggaggtagaggctgcagtgagctgtgatggcaccactacactccagcctgggtggcagagtgagaccctatctcaccaaaaaaaggagttaagaagagaaccacctaagcagctagatgggggttctctgtcatttggcaattcttggttttttgcttattaagcccaagctccagccgtgatccacttactccactttttcgcggaataaattcaggtcttccttcagttgctccagcctcatgcactggctgattatgatagcttacagtttggaattaataagcttgttcacactgcacccaatgccactggaatgtctcctttgtgaaatgtaatttaattcacctcagtggtaaaggtgaacctgtttattggtgatgaatctgttgatttaccaaatttcattaaatctaaactatacacttttttcttttttctttctctctgtcacccaggctggagtgcagtggtgtgatctcggctcactgcaacctctgcttcccaggctcaaacaattctcgtgcctcagcttcccaggtagctgggaccacaggcgtgtgccaccacacccggctaatttttgtattttcagtagaaacagggtttccagctgggcacggtggctcacgcctgtaatcccagcactttgggaggccgaggcaagtggatcacgatgtcaggagatcgagaccatcctggctaacacagtgaaaccccatctctacaaaaaatac

SEQ ID NO: 98700 - DNA, 1047 bp, Homo sapiens
tctgggaaggtttactctatttcagcaccaaggacctaagacaggcagctgcatttcctaatcctgattccttaaagtaaactgttacagccagttagtgtgatcctggagtgtgtccagctgcagaggcaagagctagtacctgtgtggcagaccggaaatagatttcaaaatgcacagctgcagaattcaggagtagaatgaaggcctagggtcaagccctgtttttcatcgtgggctcctccattcacgctcgttgacacctttcctggccatgctgtttaacttccatgtcaagaaaaaaccctgacaaagcctggtaatactgacacaagtggagtgtacttaagcagagagggagtgatgttcactaggctgttgttcttccccaccctttggcatttgtgtcgtgtcctgacgccttgtttgtgtcttccgccttcagtgctgttccctcgtcacaccaatgccagtgctcgagacaacaccatcaacctgatccacacgttccgggactacctgcactaccacatcaagtgctctaaggtgaggggggtgccagcatctcagcctctatgctctgggtcttttcctccaccagaactcctgacagaaagtcattccattagtctacgctgtggatattgactcttaggtaaataattctagaggcttcaagaaaccatggtctttcttcatcaagccactgtcccccatccctccctatagcagagatgaatatttgtttccagaattgctcaccttcctgcttccctgcagggcctgggtcaatcccagggtgtatgttcccaaccgcccttgatgacctctctgatgaaagacagcaaagctgtctttctagaccatgactgtgctttagtacctgttatgtttgttcccaggcctatattcacacacgtatgcgggcgaaaacgtctgacttcctcaaggtgctgaaccgcgcacgcccagatgccgagaaaaaagaaatgaaaacaatcacgtaagttaggcagcaccccagcgaccaccttcctctcctgagtc

SEQ ID NO: 98701 - DNA, 1039 bp, Homo sapiens
attgctctgaaccagccacctgccttcatggtgagagataaaggaactgctatctgggagccctgagaggtatacactgtgtaggaggagctgacaaatgaggtagtactaagaagacggtttgagcctagtcggaaattcaggtacgtctaggccatccagaaattgtgaacaagtgattcttctatctaacttggtacgttgaatgtccttgtgggcttaacactgatattcccgggcatccaaagtatccaataggaaggaagagctcgtgaaaccattctgtgaaagccagattttagccgatgtcctgtggttccagtgcctctgcttaaggaatctagccctttccacctctcatttggtgtttctttgggatcccatctagtctaggagtgtggggtgggaggaaagggcagccagaaactgaccttcgcacttatctctccttttgaagggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatcttacatgagaatttgctgggtttctggactgcgagtccaaagtgagaagagaaggaaggaagaaggatagacctatactacccttgaacctgcaaacctaagctgggaagccctagtttcaggagcc

SEQ ID NO: 98702 - DNA, 1018 bp, Homo sapiens
caccaggtaccctatttttttcctctgttttctgcccacttttctttgaaggccataaagactctgtgacttgtgctggtttcagccatgactccactctagtggccacaggggacatgagtggcctcttgaaagtgtggcaggtggacactaaggaggaggtctggtcctttgaagcgggagacctggaggtaagatcatcagagcgggagtcagctctgtggggccttgggttgttgggggtgcaagcttgggaggccagttctgcctttattgcgccaagccagctctgagccaatgcgccccaaggcacaggaagaatatctacctgctacctggaaagtccccgcggaaccccagaggcaggaaaccttgggtggagctcatggggcaggcttctaggtgggatggggtgacgggcctccctgctgccccttcctccctgtccagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatggtgagagcacctcccttgagtgacctttcctgggtgcagaggccgaatcccgggatatacacctcccagagcagccttctgggtcacagccggcaaaatctgaggcctgctgtttgcagtgctgacctcctgggccccaaagttcacagcgcctccttcctgctctgaactcacctgtgattcctggggcagtgtctgggcccttccactcttctttcctctccctctccccattcccttgcttagtgtatgtgagcgtgccctctgccctctcttcatctgtgcctctcttcagggaagagagctgtggtaggctatgaagatgggaccatcaggatttgggacctgaagcagggaagccctatccatgtactgaaaggtatcagaggtgggggaagtgttagcctgggcctttgtagggag

SEQ ID NO: 98703 - DNA, 1564 bp, Homo sapiens
tcccccgctccttccgtcctgcctacagaccagaaactacatctcccagaagcccgcagagcggacccaggagaactactcttcccaggagaccccggaggcgcgcgcgctcgcttgtttccctccagttgggggcggagtcaggtggggcggagtttgggttctctccgccacgccccggccccatcttccaatgccgctctgtgattggtgaggcggccagccaaccttcgtagctattggccgaacggccgtcgctcttcctgctggggagtcgcctacgcctacttcctgccgggaggaggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccaggtgagaactgccgctcctcaggccatgggacaggagacgctcacccctggcctctgactcctgcttttccccgctcccctccacacccgactggtcattcctaccgatatccctcttcccctcctcccccactcccaccctcacacttagttctcaggcctggctggggtgggggttccctgacgcctcctctggcccttcccctcacacacccccttcccatcatccccttggccctcccttaccgcacggtctctggccagccgtggcctcccgtcctgtgtcccgcgcgcccccgcggaccccggtgtgtctgactccaccttcccttctcgccacatgacccgccccagcctcaggcctcctcatgcttctctccgtacctcttaccgcctcccgagccccatcttctaaccctctccccaaagcagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcaggtaggtctttgaggcgatccacctcaaatcagtttaggtgggcgtgtaagcattaaacatcagccatggacagaacgttatgggggacacagagatgggcaagatgctggccttgcgctggaggagcccacaggtgggaaagtgtggcagaatggatgattgcttggcttctggcatcagtcgagacaccctctactttgccagttaaccttgattaacctcttagttttcttttaaaaagttatctttggccgggcgtggtggctcactcctgaaatcccagcactttaggaggctgaggcaggtggatcacttgaggtcaggagttcgagaccagcctggccaacatggcaaaacccagtctctactaaaaatacaaaaatttggctgggcatggtggctcacgcctgtaatcccagcactttaggaggcccaggcaggcggatcacaaggtcgggagttccagaccagcc

SEQ ID NO: 98704 - DNA, 1050 bp, Homo sapiens
tcatcctctgtgctggctgctggagggacccacacaaatcagatcctgtcacttccctgcttaaaaccccgtaactccatcacttcctggccaagtccaaacatggcacaaaaggcccagtgtggctgggtctctgcctgcctctttcctcctcccgcctagagcctgatcctcagcacgagccctgcattcctgcaacagcacctgtgcaggattttccaggcagccctgacgctttccctctctgagacttggccaaggtaccctcccagttttcccctcttaagctaagtaaccactgcttgggaggcactttggtatgggggaaagagcatggagtcacagactaggtgagaatcctagctcagtctcagttccttcctctgtgaaatggggatgtaatacttatctcaaacactaaaacattacatggcaaagtactggcacacctcacatgcagaaaaaaatgttgatttcttcctcctttctctttaatattggtcaataatatgtattaaggtcagagtcagagcccaatcacaatgttcataacgccttctgagtactactatacaactagtacaagctcacatgatctcaacgaactacttacttaaacttgggtctcactccaagctcccaaaagggaggatgaggccagggacccaagtctgaatcagatcaactcagcttactccacagtaaacccactgtcttctcaattccacatactttcccacctccactgccccacccctctgagattccaatcgaacccaacaattctgttcccacaactttggattcagctcgccacctgaaacttggagaagtttctaagtcctgccctcccctacaagccacgccccgttggtgggcaaaggggtggttaaaactcaccaggccagtcccacagctttcatggggttcttgcccctctttctgggaatgtattccagctccggggataggggttcaggttcctccttgccctctggggagctgtggctttgcagggcccgggtcctgttatgagaagccttgttagct

SEQ ID NO: 98705 - DNA, 1245 bp, Homo sapiens
aaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataacagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaagtttatgtctagaagttaaaaccctgtatggctccaggagtatgtgtggctctgcccaaagtatccacttcttccttctgcattctggcttgggctgtcccaccttttccaaggtaatcaaatacactttactgcagcagtttccggggacggatgcaatagactagtgaaggctcaggagttgggtggggaaagggagagctcaaccctatcacactggatcactggatatggaagagacctcttggctgtagtgcttgaccttttctgcaccatggaccctttccaaaagctcatgagagctaactctcttcctcaaagagctgtatgtata

SEQ ID NO: 98706 - DNA, 1068 bp, Homo sapiens
agtgcttttttttttttttcttttgagatggagtctcactctgttgcccaggctggagtacggtggcgcgatctcagctcaccacaacctctgcctcccaggttcaagtgattctcctgcctcggcctcctgagtaactgggactacaggtacatgccaccatgcctggctaatttttgcatttttagtagagcaggttttcactatgttggccaggctggtctcgaactcctgacctcatgatctgcccacttcagtcttctaaagtgctgggattacaggcgtgagttaccgcaccctgccagctttgtatttctgacctgacattcttgccctggttctatcccagcccctctagggagatgaagaacagctttcctcaaaataacccacttagagacctggacttttattcaattccccctcctcaaccctccctgccaccttcccctctctgaattatcccagttgtcataaaagagaagagataagacagtcctttatttgatccccgaactatgcaatgtgccctaaaaagagacgctggtctctcttgcttccagcagagcctctgagagcctctggtgtctgctgacctgcatctgggggtgtcctccttggggatcctaaagccccctgtagatgctctagaagaggtggtggccctgtcgagcccagactgccagggcttgtccttactggggatgcaggggccctctaggggcttccttagctcctcctaagcctgcatctctgctacctcagaggggaccaccaggcccagaggacagtaactggcagaggaggcataagagcaccgcataacatgaaggacctggacccaggatctggaaggcctccgtcctggttatgccactgacctgcgagttctggggttctggggaatcacttccctgttcagggcctgcattctctcatctgaagtgagcatttggggcttatggccctgaggtcccttccaactccagtttggggttccctccccctggtttcttggccctcccctggctatggggctcttcctgctgcagggaaggcattcccttg

SEQ ID NO: 98707 - DNA, 2361 bp, Homo sapiens
aggatggtctcgatctcctgacctcgtgatccgcccgccttggcctcccaaagtgctgggattacaggcgtgagccgccatgcctggccccttccctagttcttttttggggttagttatcagtctcctttgtctgtctctttcccctcctaatcttgaagttcaatgaaaagacaggagatgaaacaaagaaggaagtgaacagggactgtgctcagaagtattatagcatcagcctgctaatggcttcctcttcccttatctgtactcccaggccatcctgacttgggtggggtaacccgagattaccattctgatcacaggattctgctccagacaagggtggcggagctgcggtgcctgggtcctctcgtgatccccaggacagcctctccctcctgggagcttggagccacccctcggtctccatgggtccagagagaggccaccctggctagagagggggctgggaggggtggcctcgagttgggggccagaagtcgagggctggctgtctttttttttgagatggggtttcactcttgttgcccaggctggagtgcaatggcatgttcttggctcactgcaacctctgcctctcgggttcgagcgatccccctgcctcagcctcccgagtagctgggacttcaggtgtgggatatcacgcccagctaattttttgtattttttagtagacatggggtttgaccatgttggccacgatggtcttgatctcctgacctcgtgatccacctgcctcggcctcccaaagtgctgggattacaggcatgagccactgcacccggcccggtcttaactgtttctgagctgagaggtcactagagaactgagagaatggtagcttgttctggcccctccttgggagagggtgtgtgctggtgtctatcactcagagagtgggcggggctgggaagggaagttccaaacccatgacgaagaagagggctgttctggggtggagcaggaactttcttggctctggggtttccttgtctgtcaaatgaccaggtgagatccaaagtctaagccagctctgatattttagtgtttagatccctgtggcttcatcctcttagtcccaaagtccaggctgatggaaggatatttagttgattctgggcccccttggtgcagaatcaggcctggtgacttgcccagacactcctgggtgtatctttttactcatttgctctcgtggctatgaggtcagctgtgccctggggtaggaggataaagtgttttcttgtgggggcagataaaggaaaagggaggggaacaaatcgtcagatctgggctgtgctcctgcgcctgctgggtggggtttcctgagatgtgcattctgagctatttttttccactctgggcatccgtctctggcagggaggagggcaggctgcctggaccagtcagctgctcctttccatccctccctccagtacacatactctcctcttgctgtaaccccagtagctcaggcctcctctgcagattccggagccttaacccttcaaatacccccaggagagccccagccggggcctcagtaggcagacagcaggattaccacactgagagggctccaggggaggaggtgcttccgcctctgcatctgaaaaccttgacacccagcaagtcctgctgtctgagctcacccacttgtgccgctgctgtggtagaaagcaggggctctggttccttcctaatgggggactggggccctgagagaggagcaaacttagatctataatgggcaaggatagggcacagtctgaatgccttgataacaggcattgtgaggcaaggaagaatgttctaatcgagctgtctgcagacaaggggcttgctccatgttgctggagttccttcaagcagaaggtgggccagacacagtggctcatgcctgtaatcccagcactttgggaggcctcggtgggtggatcacttgaggccaggagtttgccagcctggccaacatggtgaaaccccgtttctaccaaaacaaaaagaaaaacaaaaacaagcagaaggtgaatgcctactgtattttgggaaaattcaggcttccagtggggaccttaaagtccctgcagactgtgagcccctctagtagctgctggcagaacccagatctgatttctagtcctcactctgtgtcagtctcgtgatctctctccccttctccctccttcccttaccctccattcttctctagcctccacccttagacatagctacgaaagtaaacactgaccctttccccctttgctgctacctaggcagatgccagccccaaacctcatccctagtggaggccttgctgatgtggaagtggccagggcc

SEQ ID NO: 98708 - DNA, 1051 bp, Homo sapiens
gccgagatggcaccactgcacatctgagtgatgtgcagtgagactctgtctcaaaaaaaaaaaaaaaaaatctaaaatgcttccagtcataatctttggttgattgactcatggggtaccatttgtttattatttttttgtgcttttaaaatattttctgatcttctataatgaaaacatattagtattttaatttttaaaattattattttattaaaacaaagaaagtagtcctctctgctgtctctacctttcacttcacgtccattctcaggccactcaactgggcccctgcctgtactgctccatcctaatttggcgctgtccccttgaaggtcaaacccatttgtcattgttcagcccttatcactgaacctctgggtggcagctatgacaatggagcatgcctttttcctctgccttccctgccacagtctctctggctctcctctcccctctctgacaagctccccttctgctagctctaaattcaccacttacaggctaccacctgtatactcattacttcaaaggagaaatgtccacaagagcctcccttggatgccccacggtaggggtccccaaccgcttccctccaaccctatactggtccttggtctgttaggagccaggccacacagcaggacaggcaaagctttacctgtatttacagctgctccacattgcttgcattaccctctgagctccacctcctgtcagatcagcagcagcattagattctcataggagctcgcaccctattgtgaactgcgcatgtgagggatgtaggttacatgctccttatgagaatctaatgcctgatgatctgtcactgtctcccatcaatcccagatgggaccatccagctgctggaaaacaagctcagggttcccattgattgtaccttatggtgagttgtatgattattttattatatattacaatgtaataataatagaaatctagtgcacaataaatgtaatgcgcttgaatcatcccgaacccccctaaccccattgcctcccccagtccctggaaaaactgccttcca

SEQ ID NO: 98709 - DNA, 1047 bp, Homo sapiens
gctatttgaaaatatgcaggccagtgcctgtggctcatgcctggagtcccaactaccgaggaggctgaagcgggaggattgcttgaaccctggagtttgaggctgcagtgagctatgattgtgccactgcactccagcctgagtgacagagtgagaccctgtctctatttttaaaaaaaagtatgaataagacccagagttggcacaaaaggggacatgcttaagcccatgaaggatcctgctgggagggttcaagaagagctttcttggagagatcacacccaatttgagtctttggggaacaaagaataaatggcactccacgcagaaggcacagtatgtgcaaaggcatgggggtgtgaaacaatatgatagcttgagacaatacctaagtagttaagtattctagggtataaagtacaggagaggggtaataataaggcatcagcctggatgggatagaaaattcttatggcagaggaagtgaaactaaagcccacttgcagcagacattagaagtcttccagaacagtctaagggtggggttatggctccctgggcctgcatgactcccctaaaacactcaccctcactccttttcccagtcccgccttgactccatatgtttcatcaaacatatcttggatttattatctataatcttgttaattgtctggcttgagatttagaatttggtcatctctgtgttctctacaagctcatgcttgagcatgcatttcctgtttcagattacaggactgcattttaatttcttgatagaatgcctgatatagccttacctggcacagccttacctgcagaaagttgtgtgcacaatgacttttgatgatgcctccatgatccttcactttgcatgtacagacacagacacggagatgcaaactcctgcatcctacaagggtcatctgcaaattggcttatcagttttctcactcctctgtctcctctgcggtaccagccctttatatgccaggcactgagaagcaacctaattacaggcgaggagacagggagggagcaggccat

SEQ ID NO: 98710 - DNA, 1047 bp, Homo sapiens
gaggagctagaaaagtaattcggcgaatgaataaatccatgaatggcagctgaccccgatgatctctcaggtttctgccagttgagaaagtgtagcagtgccctggacggggaggcgggcggggcgaactgcgagctcctgccccttcccagggctcaggcgactgtggaccccgatcagcgcaggctcgcggcccgctgtggccccgcctcctggccgccagccgggcggagccaggccgccccccaagccgggtggccttcggggtgcttgcccggctggaggtggtgagggggcgggtccaaaggagaggtcaatgggcggggcggggccacaacgcccccacgtccagagccggcaggcaggttccccgcggggggccggggccgggccgttgcctagcaacgccgagccccgcccggccggcgcgtgcctgcccccagcatggcttggcagggctggcccgcggcgtggcagtgggtcgccggctgctggctcctcctcgtccttgtcctcgtcctacttgtgagcccccgcggctgccgagcgcggcggggcctccgcggtctgctcatggcgcacagccagcggctgctcttccgaatcgggttagtgcccgggctccgaagcgtgcgggctcgggaggcgggcgcgctgggagaggggactgggaggcgggggctggagctgggggtgggcgtggcggttaggaaggggcttggtctaagggaagagggatcgaggagacggactggagaagccactgagttggggggcctgagggatttggggggctggacaattgggataagctggggaaggaggatcggagaggcgggccagggtggccacggaaggagggcgtgagaggacatctggagcaaagtgccacagaatgggctggagaccaggaagctggacagggggatagtgcaggagccagggctgggaagaccgtccctgtccgggggtgaggtcagcagatgcccgggctccgatggcaagtgccggagagaaggaatgcctcccaccgtctgacatttaaaa

SEQ ID NO: 98711 - DNA, 1050 bp, Homo sapiens
aaatatacaggattgttttgcatgctttttatttttatttttatttatttatttttttattttagagggagtcttgctctgtcacccaggctggagcgcagtggcacaatcttggctcactgcaacctctgcctgccaggttcaagcagttctgcctcagtctcccaagtagctggaattacaggcttgcaccatcatgcccggctaatttttgtatttttagtagagacggggtttcaccatattggtcagactggtctccaactcctgacctcaggtgatccatccacctcggcctcccaaagcactgggattacaggcgtgagccaccgcgcccagccatgcttttgtatttttaatgaatatagtcatattgttttctctgtggtatgtctcagcataacaatacgtgcttgagctttgtgaatgttgaaacctgttgctctagatcatgtgtttcccttgctgtgcagttttccaaggtctgagtatgttgggatttatttgtacattttgctggtggcagtcatttagggggtttccgccctttcactcttgggagcacgggattatcactgggcggtacaggaggggaggaggcagtccctgctgtggtctcagtttccagaaggcctgactggaagttggacatttgctaataagcagtgaggagccactgaagacttttgagcaggagcaagtctcagcaaaatgcggcgctttaggaacttctttttgccagtgctttgcagtttgggttggaggtagagagctgggggacagaggctcttgtaaggccctaggtgagtttccagggcctgttctcacaggtgaggctgcgctgggggcagtggaaggcaaaattgagagggatcctgttttggttgcatatgccagggagagggctaaatgcaactgcgaggacagggggcctttcccagaaagagaagaagcaggatggggagctgaccatggggactgtcactcaccaattctgcaggcagatggagggagagcctaagctaagtggcttagagagtcctgtggaag

SEQ ID NO: 98712 - DNA, 1181 bp, Homo sapiens
accacacccgactaagttttgtatttttagtagagacagggtttcgccatgttagtcaggctggtctcgaactcctgacctcaggtgatccgcccacctcggcctcccaaagttctgggattacaggtgtgagccactgcgcctggcctctccaattttcttctgtgagttcctcagttcatgtctccctgatagattttgagttctaggtgtgtccgtctcattctccatcttgtcctgagtgctaagcagggcaaacagtaggcacataataagtgagagtggaattgcattggctcacagggtcaccaaaggaatggagatgtggggcctgcaggcatcacgaaggagtctaggggagctagggagaaaaggctaatcataggccacccactcgccctctaggtacagcctgtacacccgcacctggctcgggtacctcttctaccgacagcagctgcgcagggctcggaatcgctaccctaaaggccactcgaaaacccagccccgcctcttcaatggtgagctctgactgccccggccagcatcccccattctgtgcccccaccctccccgcctgctccccttcacataccccagcccctgggctccctgcctgttaccccgcccacagcccatctctgtccccaggagtgaaggtgcttcccatccctgtcctctcggacaactacagctacctcatcatcgacacccaggcccagctggctgtggctgtggacccttcagaccctcgggctgtgcaggtgaggggagggcagggagcagggggtgcctggagtcaccttggggactggcagtttcgccttgctagagagggctgacccttgtccgtctgcccgtgggatgtgtcccatatgctccatgttcacacgtgcacatgcgcacacatagcctggggaaggggggtacagggcatggctgggcagaaggggagagcaggagtgggggatgcagagccagagggctgggggtgttggcccaggactctgggtctagtgagtttccaggctggctttcactcccattggcccccttcagaccccctttctttctgtcacctctgtctgtcagtatctgggtctctctgtctttccctcccattccttatctctctgtgtctgcctctctctatgtacaagtgtccctctgcctccatgtgc

SEQ ID NO: 98713 - DNA, 1085 bp, Homo sapiens
agaatgggagaatgtctgtagctgagtaaagccctgcagggaattagtttcccctgggtggagactggttctctgatacagtgactggcaggactaggttatgaaaagttaagaacagctaggtgagtgggtgggtgaggatcacaagtcccaggctgcatgaaatcccaaagggcagcctaggcgaagaagtgttccgtgggaaagagcagccctgcgtctaccaagcctggggcctgcagcccgaagattccacagcccctcccttcaggtgtcactgtgtgcaacggaggcctcggatgggcttggtcagggggtgaccagttgggcccagttcccagtgaggagggaatagatgcctggggtgggtctggaaagtgcacagtcagggctgacggccagccagagcattacaagctggttcccacctgtctgggtgtgccttatgccatattgtgttatcctggcaccttgtgacataccctccaacccccacccagggcggacctttgagggcaatgcagagaccatgctgagctcactggacactgtgctggggctaggggatgacacccttctgtggcctggtgagacacccccttactactccccatcctccagccccacgctcagcctgggacaagggccttcccaccccctcactcccctagaaagcaggccagcccagttcctggcccagaagcgacacagctccacctctaggggtagggacagagttctggcctcccttcttcctggagtgctggctccgtaccacctctgcttctcacactaccttcccctgccagtcagccttcagcctcttgggagccttgcaggccccagggcattccagagagatgtctaattgttcatagccttagcccagaacagaaaatagcctttgcttatctggggagaagtcagtaaatccactctgcatgtaaccattgccttgtggtgcataaaaacattcacagatatctgttaatcctcagaacatatattcattcattcattcattcatcaagtactttatgtgcacctaacacataccaggctctgttccaggcaccaggaacaca

SEQ ID NO: 98714 - DNA, 1367 bp, Homo sapiens
ggcccttgttcttaggcccgtctgcccgccttcctccatctaacctttcctgttttatccgcagcccttttcttctttgagttagtaaagatttattctgtaacctgacactcatctggccctttgcagtttgccagccatattcccatgtgatttcccactggatccaggcccccatccggctggcaggagggggctctgacgtgcaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacactttagcaataccaccagactagttagagttccccactcaccaagcaagacatgcagtttcatgcctctgtgccttcgctcatgctgtttcttccgactggaatgccttcccctgctcctcctgccttgtctgcctggcaagttcatctctcacgatcccctcaaaggccccctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaagacttgatcacccaacagcttgtctttgttgctacatgagtgaaaacagcagagaactttctcacagttttcccatctcagttccaggcctgctaacttgcagttaggcacttcaagagttttgatcagaaatgatgcccaaaggctgggcgcagtggctcacacctataatcccagctctttaggaggctgaggcgggtggatcacaaggtcaggagttcgagaccagtctggccaacatagtgaaacctcatctgtactacaaatacaaaaaattagccagacatagtggcaggagcctataatcccagctactcaggaggctgaggcaggagaatcacgtgaacccaggaggcggaggttgcagtgagccgagatcgcaccactgcactccagcctgggcgacagaatgagactctgtctcaaaa

SEQ ID NO: 98715 - DNA, 2066 bp, Homo sapiens
gagggatctcccgccaacacacagctacgttccccacaaacttcgcgtcacgcgtggaggcgccgaccccctcggaggcacagagaggacggccggcacttccaagagtcgcttggcgcccgcggggagagtcgtgcgcctagtgggcacgcaccaccccgcaaagcctcgccgccccgacgaggctgcgtcccccagcgtggctgggccggggtgggggggtctgtcttctccttttccccgtgtggacctcaggatctggacgctgcccccaggtctgcccaccctcgcctgggtctggctgccccggaactgagggcaaggtggaaaggctagttgcagggggccggaggggggtggggtgggaggggtatctgtcaatcaggctgctgggctccaggtcggaggtctgggcggggcagggcaaacagatggccactggacactggccccaggccgcgggactgcacccctgcctctgggcccagccgcagtgaggacttcgtacccacgggggtggagaggatggagggagggcaggggtggactgccctgggtcccaggccctggctgtcctgagcaggggtgctcaggtaaggtggggtcaggaggcaccgcaatggggctgatcagcagcagtcatggaggctgtgagaggcagggagagagcaccccaggacctccttctccaggccacgcactccctatgtgggcgccttaatacctgctagacctatttgtctgggagctgcaggagccttgcagttgattgtggagccctgacaggggcgtttcagagaaagtcaggagctgccttcgtgtgtctggatgaaggggccacggcaagatcctcctggctcaggggttcacacctgggcacacatgcaggattctgcaggccagtgtgcaccgagcctccaacttgtgcctccctacttcaggtgaccagaagtcagcagcttcccagaagccccgaagccggggcatcctccactcactcttctgctgtgtctgccgggatgatggggaggccctgcctgctcacagcggggcgcccctgcttgtggaggagaatggcgccatccctaaggtgcgtgggggccaggtggggccacgggggcacctggactcagtcttcagggctttaggggaaggggctcctgactgagcttttcaggatggacttgcagacctgaaaggtgcagagtaggagggtggcagcctcccctgccaggccctgcccactgtggggaaactgaattctccctcataagtggaagctttttcctaccttggtttttagagaggtctcaaagagccaagaggcctacccaagccctagagctggcaggggcaaagctgggaagggggaagtatctgttcctggggcctggggttcctctggagacggctagggggagaagcctgcgtgggaggaaggaccaggcccggagagaggcaccccagccagccccgccctccctacagcagaccccagtccaatacctgctccctgaggccaaggcccaggactcagacaagatctgcgtggtcatcgacctggacgagaccctggtgcacagctccttcaaggtgggccctgctcaacagccctcagcccgggtctcggggggcatcccccaccctggcctgggagggaggtgtgtgctggaccccatgccctggggctcctcctccaactccagcagctcttttccccccacagccagtgaacaacgcggacttcatcatccctgtggagattgatggggtggtccaccaggtgagggccaggaagaggcagtggtgggcttggcatctgcctccagaccctaggctcttcccaccaatccggagcgcctcggatgggaattggatacatgtggaatgtcagaggcccagagagggtgtgagacttgtcccaaagtcacacagaacctcaagggcttgtgctgactccaagcctgcagagtgggctcctcctctaggctcccccgtgctgtgctccctcgccccaccctgcccgggacccagttcaagtaattcaggataggttgtgtgctgtc

SEQ ID NO: 98716 - DNA, 1581 bp, Homo sapiens
gaattgccagttgtgacctactgatggcccacagaattaatttagtgggttctgattgggaattttaacaaaatgaaatagaatagaaaatatccggtcgggtgcagtggctcatgcctgtaatcccagcactttgggaagctgaggtgggcaggtagctgagcccagtagttcaagaccagcctcggcaacatagtgaaaccttatgtctacaaaaaatacaaaaactagccaggcgtggtggcgcatgcctggagtcccggctatgcagaaggctgaggtaggagtatcacttgagccctggaggcagaggctgtggtgagccaagattgtgccactgcactctagcctgggcaacagagcaagaccctgcctcaaaaaaaaaaaaaagtatccgagtgcttcgcacagataaggttaggaattgtgaagcttttgcattgttacgttataaatgtgttttcctggggattgctgtcaaaaaagtttgaacactgtgggtgaggggttttcagaaactgcatgatctgagtagtggctacatagggctggcctggaaattctgcacccaggaccacctgcccccctcatcttcctacacccacttccccaggtaccggtggcctcgtggtttgacaacatgagtgacacagagctccacgacctcctccccttcttcgagcaactcagccgtgtggacgacgtgtactcagtgctcaggcagccacggccagggagctagtgagggtgatggggccaggacctgcccctgaccaatgatacccacacctcctcccaggaagactgcccaggcctttgttaggaaaacccatgggccgccgccacactcagtgccatggggaagcgggcgtctcccccaccagccccaccaggcggtgtaggggcagcaggctgcactgaggaccgtgagctccaggccccgtgtcagtgccttcaaacctcctcccctattctcaggggacctggggggccctgcctgctgctccctttttctgtctctgtccatgctgccatgtttctctgctgccaaattgggccccttggccccttccggttctgcttcctgggggcagggttcctgccttggacccccagtctgggaacggtggacatcaagtgccttgcatagagccccctcttccccgcccagctttcccaggggcacagctctaggctgggaggggagaaccagcccctccccctgccccacctcctcccttgggactgagagggcccctaccaacctttgcctctgccttggagggaggggaggtctgttaccactggggaaggcagcaggagtctgtccttcaggccccacagtgcagcttctccagggccgacagctgagggctgctccctgcatcatccaagcaatgacctcagacttctgccttaaccagccccggggcttggctcccccagctctgagcgtgggggcataggcaggaccccccttgtggtgccatataaatatgtacatgtgtatatagatttttaggggaaggagagagggaagggtcagggtagagacacccctcccttgcccctttcctgggc

SEQ ID NO: 98717 - DNA, 1051 bp, Homo sapiens
gtctcactctgtcacccagggtggagtgcagtggcatgatcttgactcactgcaacctccacctcccgggttcaagcaattctcatggctcagcctcccgagtagctgggattacaggcatacaccaccacacctggctaatttttgtagttttagtagagatggggtttccccatattggtcaggctggtctcaaactcctgacctcaggtgatccacccacctcggcctcccaaagtgctgggattacaggcatgagccactgcacccggccctgtttgtaatactcttcacagctcctgtacttcacctttctggcacttaaccctgaaattaaataatagtgtaaccaggcttctctgatctctctcctcctgggatataaggtggcatgaaggcaggatcccatctgtcttgttcatccccagcacctagtcacctgcagggccaaatctgggagtcaactatggtggtccaacaaatggacttctttgtcttcctttgagaatctgacctacctccttcctgctggggtccacaccctcggggagctcctctacaggcttgttcactagctgctccagggggaagatgggcagaggcccagaactgaggttgctgttagcattgaacacgtccactttggggcttgtgacctcctaggaaagaaaaggaaaccactggttactttagctggtgcacagctacctcccaggctgcctttctctctgaagtctctagggcaccaccttcaagaagcctcccatgtcccaccccaccctgccacacacacactcataagaacaacataggctgggtgcagtggctcacgcctgtaatcccagcactttgggaggctgaggtgggtggatcacttgaggtcaggagttcaagaccagcctgtctaacatggtgaaaccgcatctctactaaaaatacaaaacttagccaggtgtggtgtcaggcgcctgtaatcccatctactcaggaggctgaggtaggagaatcgtttgaacctgggaggtggaggttgcagtgagctgagattgcg

SEQ ID NO: 98718 - DNA, 2523 bp, Homo sapiens
ttttgcacattgtgatcagtttgcccagaattggggatggggcagttagcatgttggggccaggaagggacaagttagataaggactgagtgcttccgttgcaggcagtttgcacaatacctaattaaccttcctattgaaaataccaaatgtgtggttacattactttaaatgacattgaattggaacttgatggcaattagttctagatacaaccttttgatctttgttggaattttaagggaaaaatgaactaaacttcatatttgttgattttaatcacctaatagtactgaaggttggaaagttgcatgtggctggatgctgttaatttctttaatagccatgactataatttaagcctatgagaagatagactgtttcgtagggatatattcacatgtgtgtgcacactcatgagttttgtctcagcaggatagaataagcaaatccatgaactggtcttctattaatactttgattctaaaaattatttgtttacttgctatggtctgttcattctgggcctaaccttaaaggctcaataacaaatacaacaaatgtaaatatgtttacattttaagacatatgcagtggttcttacagatcagttaattaactccagaaagcaaatgttagactacacatttatttttctccttgatcaagtataaaattctgaaacagaggctttaaaatttaaaacctcagcaaaataatccatgaatttactgattcttctgtatcgtgtgtagttaccattatgtaactatacacacatacagctacggatataatgaaaattatctgcaaacacctaaattaaagagaaaaaaaagtagtttgtaaactcatttgtgatctactgaaaagaggttatattaaagcaaattaaaatattttccttctctgtcctctgaaatgactgcagtagatactcttagttatcccatttagggtggttggagggcctttttaatttaattgaccccccgaggtggtcttttgttttaaacagggggcaacagctggatctccaagtacatatggattttgtatatataggagatttttagaaaaatcaacaacctaacaccagattcaagtcacataaaagtgttccaataaaatggatggatgtctttttcctccccattttgctttatactgagtaatgcactcttgcaagtgtatacaaaaactaaatagacttctgccctccaacatctttttattgcattacttcaaaatcctaattttgtctctactgatatgtcttattaacatctgaaaaaatatatattttttattggaaaattctaatttgttaggccttgaaagttttgtgacaattattttgctgtgtttaaccacaatcattcaccttatggcatgctttgattactagacttcaggcagtctcattcattgtatcatacttacacacaattagtaagttgtctccatgtgtgctatatgtctgaggtgtatggagtttttatttaaaaagtgtgccagtctgaatataagcatttgattttgtaacattggacttttcttaaaagtacagaggttcaaagtataggtatgtccattggcataagaatagagtgggtgagggtctggaccaggttccaggttggtccagtcagatgccagaacaaagaagaacagtcaactaaactggtctacttcaaaaatagtgggcctgtgtgaagagtgagaccacatgtgggtgtgcacacctcttgtccccaggtttccctccctttgagcttttctttccctccctaacttctctggcctattgtcattgttgtttctttaaacttaaggagagaaaaacaaaaatgagattcctacactttgcctaattgagccactaccaggttttctggcagctgtggccacattatttgtgagatgattttttttctttatgttcagagtgacttttgattctgattctttatgttttgtatggagcggcacttttatctgtgttttagcagaactgttcctctgtatcctttacggtttttctttgtttttgtttcctttttaaattatgcatagagtttttttgtgtgtatgaaattaaagcctttattaaccttctttgatttgactgttatttctgaaaaggacacattcttgctgatacttgtaacaacctgttcaaagttgtggaaatcaccttctgttggctttctgacatggacttccttgcagcactgttacttcttaaaaggaacagaatggcaaaccagtgtctggccgtagtccccattgattcctgttattttcatctgaggagcctgtgaagctttgcagaggcttctgggtaagtttgtaaacctagcattggccttcactaggctcttgctttgcctcattattaagggttgggagagggagtgaagtagcatatgcatttcatacttgcctttaggtctcaagcctagccccagtggaagtgctgctctcactggtactgtttggaatttgtgaaacctcttaaga

SEQ ID NO: 98719 - DNA, 1751 bp, Homo sapiens
agaaactttgccagattctaaataatgagttagaaatcaccggaactcttttttttttttttttttcctttgaggataaaatgtttccatcagttgattggttgaaaatttttggtttttatcatctttggttagggtctatctcttgatatttccttgtaagtccagaatattttctctcataactcagcattaattgctcattacacagttgtatctaggtatggaagttaagacagtttgttttatgatagaagatgtcctgtcataaatagttttggtcatccagttttatcagctagaagatctgatttatatggatgggaattacctagcatgttcattaaagctaactgttgtcagttcccctctattcttaaaaatcagcattcaaagggttaagatcaaatgagtgagctgctttttaaataaaatacaggcatgaaatggaattgtgaaggccttatccatatcaattttattttactttttctcctgcctattctttggttctgcttactaaatttccagttttattttttgcttgttttatcttaagggagatctttgatgagctgctggaaacagaaaagaactctcagtcacttagcacggaagtggggaagactacccgtcaggccttgtgaggaacaaactcctgggttggcagcatgcactgcatatttgttactgctgcccacctcacctttcctctgctgaaggagaatttggaattctacttgatgcgggagcaacaaacagctcagggccaaaccaaaagacaaaaattggagtaacgtagaatgctccatgctattttatggaaactttggtctcacatccgtagctgattatcctctttttctcctatgagtggcacttcttttgtcttaggaatacatgttgtaaatatatatctgtgtatgtgtgtatacacacacacagacacacacacacacacacgggatgaatggagccttaaagagttaggatgagccaccagaatatgcctgctcaaaattaatagcacagcagtttggagaagaaatgaaggtgtcaaagagtccattcacctgagaaatgtgtgaagacatacttatcagttggcttttagcttttatgttccttgagtagtttcactcaagtctgtaaccttttgtgtttccttattagtaaaattcactggaaagccagctcttcatgttacactaatgacagtttgttctctttgcaagagaggggcattactgtcacctgacttgaggagctgttttgttgttgttgttgtctgcaaatttcatgaatttgtgatgtctttgctgtttacatgcagtcccaagaaatggattgttggtgctttggaatatgttacagtcccacatttgatatttcttatatactttgttttctctaaggagatttcttcacacagtatgttcatcatatatcatcatcattattatggtggtaaagatagaatcttttttcttttttgtcattctgccatggagcagcattaccctaatggattgcaaccaaaactttaaacaagtagaaagataatatttctccaattgggactccccagcaggaatacttagggataaggaagaatgctagcatctctgtctctcaaacatagggaggataagaagagtgttcttctggtaaagctaaaattctggaccactgaagctaaaagccctattgcaagtatgaaattaagtacttgagctgtaggacaaaccttg

SEQ ID NO: 98720 - DNA, 1045 bp, Homo sapiens
agtcttgctctgtcgcccaggctggagtgcagtggcccgatctcagctcactgcaagctccacctcctggattcatgccattctcctgcctcagcctcccgagcagctgggactacaggcgcccgccagctaattttttgtgtttttttagtagagacagggtttcactgtgttaggcaggatggtctcaatctcctgacctcgtgatctgcccaccttggcctcccaaagtgctgggattacaggcgtgagccaccacgcctggccttccttccccaaattttaccttatagtgctgtctgcagtgcatgaatatcactttttcagttttgctttattttaccaaaaatattttaatcatattttttaaaatataaaagttcactctgatccctacagcaacatagcaactctttttaacatttttgttctattgtccaatgcctaactcttaacgtaacatttttttaatagagttatagttactatgtgcattcatatgggtttggaaaaaaggttaacatgttcctgatccatgtagtttttttatataactgaacattattatattgaattgatatactaaccagttagctattattggatatattgttggttccagcttttcaccagataatgccacagtaaataatttgatacatatactcttcttttgacttatttccttagaataaattcttagttgagggtggaattcttgggtcaaagggtatgaacagattttttaattgattcttactatgccacataccaaagcttagccatgtcagctttgataataaatttatattcagtgttttgcttttattcaaatgaagacttaaaagttatacccacttctgttttccagacaggaaatctgcctcattcgtaccggctcatcagtgttgtcagtcacattggtagcacttcttcttcaggtgaatagccatcatgatttcagcattttataaatgaactagtcagcatttgctctttattatattgctctttgcctagctttgtgaagtgtgtttttcttttt

SEQ ID NO: 98721 - DNA, 1045 bp, Homo sapiens
attttatttccagtacttggtcaagtgacactatgacctatggctgttttttcttccccatctttacatagtgtgtttctgatgattaattaacttttagaaccatcactgtagatcatttgttctcaaacaagaacaattttgccttccagaggacatatagtagtgtctgtcatttttggttatcacaactgtagagggtggatgctactaatatctagtaggtagaggccagaaacactgctaaacgttctacaatgcacaggacatactcttctcccctcaccccaacaaaagcttgtcccacccaaaatgtcaatagctctaggttgatcaaccctgacgtagatctagtaaggtgaaattgtatgtcctaagcaaattatagatgaaattagggtaaattgctttatgaacagtaggtgtcactctagttcagaaatttccatttattaggattttccaaattaatgttatgttctgcttcctcagatcctgccagttttactgagataactaaagactgtgatgagaataaagaaaacaaaactccagaaggatctcagggagaagttgattggctccagcagtatgatatggagcgtgaaagggaagagcaagagcttcagcaggcactggctcagagccttcaagagcaagtaagagatatttatattgctactttctctgtacttacctttcctgagaaatataataataataactaatgtgttgagcacttactatgtgtcagacattgttccagatgatttacatagagtaagtcattggggaaaaaaaagacttgtttgaggcagggtttggtggttcatgcctgtaatctcagtactttgggaggctgaggcggacggatcacttgaggccaggagtttgagaccagcctagccaacatgacaaaaccccatctactaaaaatataaaacttagccaggcatggtggcacacacctgtagtcccagctactcagaaggctgaggcaggagaatcgcttgaacccaggaggcagaggttgcagtgagctgag

SEQ ID NO: 98722 - DNA, 1050 bp, Homo sapiens
ctgggattacaggcgtgagccacctcgcccagccttctttacataatcttgatgtcgtgtttatttttctcatttattgttaataagatcagctaacatttataatggtgtagtaggcataatgatagaatatttactgtataatctatatatatctggaagaaaataaattgaaaatacttagagtaattatctctgagtaatctattttgaatgaatttattttattatttttatgtattctccaaatttgtacaaaatatatacttatttcaatcaagaaaaaataatgtattcttatgtatttattatttttaaagttagactcaccatttagtttatatattggttattgattgttaaataacccaaagcatcaaagaaaggaaactttttagaaataaagttgctactttaaatactaattaagattgctatatttgtaggtattctggtttcttctaaaagtaactctcttcttcaggattcaaaattatgcccaatagagcctgacaagtctgaattggaaaactcaggatttgacagaatgagcgaagaagagcttctagcagctgtcttggagataagtaagagagatgcttcaccatctctgagtcatgaagatgatgataagccaactagcagcccagataccggatttgcagaagatgatattcaagaaatgccagaaaatccagacactatggaaactgagaagcccaaaacaatcacagagctgggtaggtttaatgaagattaaacctctgtgaaacaaaacataactctttcaaagttttgtagtgacaaataacctccaaataacgggagataaatagaaaaattagctgagcatggtggtgtgtgaccctaatcccagctactcgggaggctgaggcaggagaattcgcttgaaccgggaggcggaggttgcagtgagccaagattgcaccactgcactccagcctgggcgacagagtgagactccttctcagataaaaacaaataaagggaggtgaagtggatctgtatataacagggttgatggcattt

SEQ ID NO: 98723 - DNA, 1018 bp, Homo sapiens
ataagtggataagtggaatgttactgttatttttaaagtgcatggatcataatttaaaagatcacaaattagtcttcatgcactttgttgtcaaaaacatttattcattgctatgcctgcatgaattcaatagcataatttataaagacaatagcaaatttcattggggttgatcattaaaagaaaaaaggcacaacatgattagtttactgatgatacgtagtagcataagagttgtccagttttcaaagcatggctcttttggagtggggcaaaggtaatgctgaaatatacctcttttgatatatcttttttttctgttaagtaattttccgtaatggaaaagcaatttgttttgatatttttacaataaaagaataacaaagacaaatgtttatcaggcttttttttttttccttaaattacaggaaattcaccttcaaatccaagagctccttggctttatgccttgattcagacagtgaggatgagctaaaacgttctgtggccctcagccagagactttgtgaaatgttaggcaacgaacagcagcaggaagacctggaaaaagtaagtaatattttcttaaaacatctgacaaagatttgtttatctcttactgtccaaacaaatgtctttcataaccatcatcaaactaattagttttaaagaaaatgccttctctggctacagaaatcagtctgtttacagatggatcaagacttacgagaaattcgttgttctaaacaaattactttctttttttgcccttcaaagctacttttgcatattcgtcctcaaataattacttgctttattttggtagcagttttttaagacagggtatcgctctgttgcccaggctggagtacagtggtgtaatcacggctcaccacagcatcgttctcctgggctcaaacaatcctcctacctcagctccccaagtagctgggactacaggcatgtaccaccatgcctggctagtttttaaaattttttgtagagacaaggtcttact

SEQ ID NO: 98724 - DNA, 1019 bp, Homo sapiens
caccacttactacaacctccgcctcccaggttcaagcaattctcatgcctcagcctcccgagtagctgggattacaagcacccgccgccaaacccagctaatttttgtatttttagtagagacagggtttcaccatgttggccaggctggacttgaactcctgacctcaggtgattcgcccacttagcttcccaaagtgctgggattacaggcgtgaaccactgcacctggcctattgctagtaatttaaaaagtattataattgttcaattttcaagaggacataaaaggaattatagtaagaataattcattttataatttaaatatatatctttaataattcatttgtatacattatatattttctaattttctgatagttctagaccattgaaagcctctcaaatggtgaattcctgcatcaccagcccttctacaccttcaaagtgagttatatttcttatgtacccaaaatctgtgtttaaggttttggcttaccctaatctccaagattgcctccctgccttttcattattgtttttctttttgcatgataatgctctttattacctatacttttgaaactttcctgaatttggtttagaatatattgaaggatataacaaattttaatcagtgacacaaggttagctcatcctctcaatattctgtcttaaaacttttaaaaacttattattgttaatatgtaatactttcatcctaaaactctaaaaattaactgaggacaagggagtctagggatttaagggataaaataacccctattagtctaaagcactcttccttaaagataggcatggaatcccaaaacattttttacctgttgttagccagtctggaacttcttgtctttgacaccgaataggagttgttttgaaaggggacaggaaaacaagcaagcattctacaaatgccctatttttttgtttaagaccaaactttatccaaggagggaagcacatgccttttttgtttgctttttaaatatatttcctc

SEQ ID NO: 98725 - DNA, 1093 bp, Homo sapiens
agaaaagaaatcagaccaagaaggagattttaattttgctttactttgttttagtgttaaatcactgcctgaagtaattgaagaaaatgcttaaaatttttccaaagttattagttgcttttcatagtgaggtgcttttttaggaagtgctcttggttagagtgctagaagacagtttgatatacttcttgaatatgagtcaaacttaggtgataataagagtcacctagacactaaaaatactgatttttgtgttttttccctggaagttctgtttcagtaggtctgagataggcgcttaggaatcaatatttttagcaaatgcttcagttgactcttcaggacatgcagatgtgagaaaccctatactcaatgttatgccttcatgcatatattatcagcagtgtaaagaacttaaatggctcctgaaatttctcaagaaaaaaagaagtaatctttactttaggtttttgcttcatcatgtatgctgggaaaaccttcggacttctttgagtgttccccttttttctacatacttgcattactttgaagccatatgttatgtcattcttttctatacttgaacactagtttggtagaataataaaattgtagaactttgaagatggaagagattttagaggtttttgtccaaacccttaagaggaccaaggaaattaaatgattttcctaaagtcatacagttagtgtctgaaagagccacgtctcatagaagtttacactagtgtctcaagggtctactaataaaggcatgtgcccagagagtctaagtgtttctggttttttcctctcacagcttttcacgtttttgcttggtgcatactaccttctgctggtagagctattactcttgctggcagtagtactatgtcacactaatagtgtatgatcacaggcctgaagccaagctatctgactgtacaatttgatagcttttagaccttgcacagattccttgacttgtctataagaaaaacaataggatggttgtgaacattaaatgaggtaataatatgtagagttcttagcacagtgtctgacatccagtaaatcctccataaatgagagctat

SEQ ID NO: 98726 - DNA, 1065 bp, Homo sapiens
tattaccttcccccccaccttttactgctccatgcatagcagggctacactataggcagtgtgtccagagtagcctcatattaccttttattttggttaggttatttgaaattctagttaaaatatttaattttgacattggtttcatatcagttgtgtccttgtattctctcaaattgtatatttgaagatcctgagttctagcacgctttttaaagagaactacaatctataacttcagtttgcaaatttttgtttgtggcttctgtgatgaaggcatatatggtaagaatcagttttttatagatcatttttgtgtgtgtgcctagaactgaagtttattcccataagatgtttgaaattcaatttttaaagtgttcttgtgggttgagaaatatatttaatccatcaagcagagatcgtgttctgtgtgagaagtgaaaaggttaccacaattttaaccacaaagaattcagtgcttctaaagagctaaaagcctttacagacccacagatcagatttggcatgcaaatttttgtaaagcttttttctaaatggggaaaagttttgtatttcctccttagctttctacagagaaagtacttctgaaaataaaagaataattctcatcaaaaatcatcttgaagtaattaatgtttaccatcaaatataagagctatgtaacattttaatagacattattttactagtagtggttatataaaacctattgctttttaaactatgtaacagtgaagtaaataatttaaggatttaacccaatatcagtgccaaatttaacattcttgtctgctatattttatttatttgtgttttttctaggaacattataagtattttacccaaaccacactaatccaccattatttgtatgctttttacctagcccaatgcctggcactaacaggtattcagtaaatattctttgacgtgtctttggtttggccaaatggattttttaaatcaaaagtcgtctaacatagagtgatctcttttactgtaagaaagatacatgtattatgtatgaattagtaaggttgtcat

SEQ ID NO: 98727 - DNA, 1027 bp, Homo sapiens
ttgaagagaaaaagggtcttgagagttccaagaaaatggcaacagaggatacagctgctgagactttggaataattataagaactagctagtcaatttttaattcagtaatgtgtaatattcagttatattttgttgccctgtgttgtgctgtagtctttttctgttatcccatactttcagtaaaaacctgctatagacacatacacacatgtatataagaataaaacagggagtaattttttgcagtttgtgcgttccttcattctaaggatcttataaattagtaaatttcctgtaatcataagataaattttctgatataggaatgaaattaacttatattgtatctgctctgtataaacataaaactgaagtagttacaaaaaattattatgtggttacaggacagcttttagttctttccaagaatagatcgcaaacaccaaggttgttattaacattaagtatttatgtagcactttgcctacagagtgctttactttcttttattagcttcaatattctgtcagtaagtgtggaatttctggaacctagcccctagagactagttcttttacatttcataatctactcctttctagaaaatgggagttggtttttttttttggttgtttgttgttgttgttgttgttgttgttttgatacagagtcttgctctgtcccccaggctagagtgcagtggcacgatctcagctcaccgcaacctctgcctcacgggttcaagcgattctcctgcctcagcctcccgagtagctgggattacagctgtatgccaccacacctggctaatttttgtatttttagtagagacggggttttgccatgttgaccaggttggtcttgaactcctgacctcaggtgatccacctgccttggcctcccaaagtgctgggattataggcataagccaccgcgccgggccaaggaagttggttttaaagaaatgactttataaaggctgggtgtggtggttcacgcctgtaatctcaacattttgagaagcc

SEQ ID NO: 98728 - DNA, 1063 bp, Homo sapiens
agaataaacctgacattgttcacatatgtcattgactttcaagggttttcactgtataaattataatgttaataagctattattttttgtttgttttgttttttgttgttggtttttttttcttttcttttgagacggaatcttgctctgtcacccaaactggaatataatggtgcgatcttggctcactgtaacctctgcctcccaggttcaagaaatttttctgcctcagcctcccaagtagctgggattacagggactgccaccacacctggctaatttttgtatttttaataaagatggcatttcaccatgttggccgggctggtctcgaactcctgacctcaagtgatccgcctgcctcagccttccagagtgctggaattacaggtatgaggcacaacacccagcctcagtaagctattgtgacaagaaatgtttttatctgattaaggatattgttgtcttattaggatgctcatgaatttttaagtcagtgtttggaccagctgaaagaagatatggaaaaattaaataaaacttggaagactgaacctgtttctggagaagaaaattcaccagatatttcagctaccagagcatacacttgccctgttattactaatttggagtttgaggttcagcactccatcatttgtaaagcgtaagtagtgtctaagaaatgatttccctttttacttctttatggcaagtgattaaaattcttctatgacataccaaatgccatgaattcttttctgtttttaagacagggtctcacacagttgcctaggctcttgggtgcagtggcacaaccccagcttattgcagcctggatctcctgggatcaagtgatcctcctacctcagcctcccgagtaatgaatttttatctcatcttcctttctacgtcataggggaaatataaaccaacagattatatcaaacctttttttcagagtctttttctatagaaatgcttgggctgggcacagtggctcatgcctgtaatcccaacaatttgggaggatgaggtgggcagatggtttgagcccaggagttca

SEQ ID NO: 98729 - DNA, 1093 bp, Homo sapiens
gtgtccaaacctactgaatcagaaaccttggggttagggtgtagtaatatgtagtttaacaagccctccaggtgattctgaaacataaagtggagaactcctactatactgaacatactttaggaattcctgttgccttctaaagcactatttctttaattttcagcttctccaatttgggaaatacctgctatatgaatgctattctacaatctctattttcactccagtcatttgcaaatgacttgcttaaacaaggtatcccatggaagaaaattccactcaatgcacttatcaggtaatcattatgtactgtacttactgagtaaccttttacttcattgattatagaataatggaattttagacactcaaaaattttctgtgccattattagtaattattctttaaaatatcacgccatgtcatgtaaaacgtgctaactttgtgttttttgttttactagacgctttgcacacttgcttgttaaaaaagatatctgtaattcagagaccaaaaaggatttactcaagaaggttaaaaatgccatttcagctacagcagagagattctctggttatatgcagaatgtgagtattaattgttttaaaacgtttcagaggcctgacacggtggctcacgtctgtaattccagcactttgggaggcctaggtgggcaggtcacctgaggtcactgaggtcaggagtttgagaccagcctggccaacatggcgaaaccctgtgtctactaaaaatacaaaaattagccaggcgtggtggcatgcgcctgtaatcccagcttctcgggagcctgaggcaggagaattgcttgaacccgggaggcagaggttgtagtgagccaagatcataccactgcactatagcctgggtgacagagcaagactccatctcaaaaaataaataaataaatatttataaaaataaataaaataggccaggtgcggtggctcacgcctataatcccagcactttgggaggccacggtgggtggatcatgaggtcaggagtttgagaccagcctggccaacatggtgaaaccctgtctctactaaagattaaaaaaaattagccg

SEQ ID NO: 98730 - DNA, 1061 bp, Homo sapiens
tactgatatttccctaaattcaagatttttttccttaaacattgacttctcttaatctattcaaggaaaatagtagtattcaaaaatttattttgcttcttcattatttatgcttttttgtaggactaatgtttcaagccagactccctctgccaaaagaagtttgggatttcttcctcagccagttcctctttctgttaaaaaactgaggtgtaaccaggattacactggctggaataaaccaagagtgcccctttcctctcaccaacagcagcaactgcaggggtaggtcaattctttcattttactttcttttttataaagtgattcaatagaagtgtgctttggtgtaaaatgtaattaaaggagtcacattaaagttctaaaatatttagaaattagatcacttattaaagatttattacatccataagtaatgttaacttcattttctgttcaccaaacaattttagaactttggaatatatataatattcattttaaagcagaaaatgtgtattttccaacccagtacacttcattctgctgctgagatactttcaacattttttatatattttccctaggttcttcatggttatatatatattaaacacaaaaatgagatcatagtataataactgtagtaattatagtagctatcttttaaattttttttttaatagaaatgggatctcactatgttgcaggttggtagaactcctggcctcaagcagtcctccctcctcagcctcccaaagtgctgggattataagcatgagccactgttcctggccagtagctctattacctaaagtgtttattacatgccagatactgtctgctaagtgcttaaattgattttttttaaattttaaatcttcgcaacaagtctttgagatagatatattaaaaatctggttttatgaataaaataaggcttagcaaagttaattaacttgctcaaagtgatatagtcagtagtacagcagtagtaaatccaggcagtagtgctgcagttgcattcttaatcactatgctatattgcttctctgttatct

SEQ ID NO: 98731 - DNA, 1056 bp, Homo sapiens
ggcccaagaagagagacagagatggggtaataatgacaatttggtggagcagtcagataaattgagtttgccgtcttatatgggtgcagttcgtggtaccccaaaacagtgacaacagtaacatcaaagatcactgatcgcagatcactgtaatagatataattaaaaagtttgaaacattgcaagaattaccaaaatgtgacatagacatgaagtgagcgagcgtatactgttgggaaaatggcactgatagacttgcttggtgcagggttgccacagccttccatttgtttaaaaaaaaacatacaaaaaaacctgcaatatctgtgaggcacaataaagcaaagagcaataaaatgaggtattcctgtatttgatgagaaggaaaaagagttaaatataatcaggactaatgtatacttttattattaaatgaacttgaatggttgatttaggaattaagtttttcctttgttcatttgttttatagggcttttacctttacagtcatcatccttttatggtagcagagctggatccaaggaacactcttctggtggcactaacttagacaggtatgcattggttatattacttgtgaaaaacttaggagttctttttttttcagaatattgaatgattggataggttatgtattatcctcttaagtgaatatgataatttaacaaaattgacgagactcatagaatcctgacatgttagttagaaagtattctagaaatgagctgagcacagtggctcacacctgtaatcccagcactttgagaggctgaggtggaaggatcacttgagccttggagatcaaggctgcaatgagccataattatgccactgtactccagcttgagcaacagaacgagaccctgtctcaaaaaaaaagagacaagatctcactgtgttgcccagcctggtctcaaatttcctgacttgaaacgatcctcccacctcagccttccaaagtgctagggttataagtgttgaaccactgctcctgctcctggcctctacagaattttttttttttttttttttgtt

SEQ ID NO: 98732 - DNA, 1050 bp, Homo sapiens
tgacctcgcgatctgcccgcctcagcctcccaaagtgctgggattacaggagtgagccaccgcgcctggccacagtttactttttaattgattcttttggtcttagtagctgaatcattttatctggtcttgcttttggccaagaaaatctaataatcttgctgtctctgatttgacttttatataaagaaaaatgctcctttacttttgctaagttatcagagtcatggattggattggctcttgagatagtaattaaagattatttttgtaattttcatttgtttaagtcattgaccttttgagactaacaatcttgtagcttaattttcaagcatatcaatgaatttggcactttaaatgtaaatgttttaatgacaactatttaaaattaagaacaatatttttatacacctgtactatattgatgtaaaattattaactataggaacaacaaggccatgacagatccctccagaaagtatttaaccagcagtagagaaaagcagctgagtttgaaacagtcagaagagaataggacatcaggtaagtgtttgatcttacaataaataaggtgctcatttattatatatttattagattagaaataaaaacctaacccatctgtacattctttttatttttatttatttatatatattttttgagacggagtcttgctctgtcgcccaggttggagtgcagtggcacaatatcggctcactgcaacctctgcctcccgggttcaagtgattctcctgcctcagcctctcaagtagctgggactgcaggtgtgttctatcatgcctggctaatttttgaatttttagtggagacgagatttcaccatattggccaggctagtttcaaaatcctgaacacaagttatccacctgccttggcctcctaaagtgctgggattacaggtgggagccaccatgcccggcctaatctggtgttagttattgggtgccaatttgtacccagtacttggctaaaatattttaaagtattagaaatccagggaatttgtattctgtttataaagaa

SEQ ID NO: 98733 - DNA, 1052 bp, Homo sapiens
acataatcaatatgctaccaaatgactggttttctcaagggatgcccttggatcagggtctcagtctttgctgttaaccaactggacattcagcagccacagtagataaaccttggtgaaggggaacccattttttatagcttctatctgccaccatggctgttacgttattcatggtccctttgtggaaataacggaatgtctaaggacagaggctggctgacatgcactggacaagttatcctgctgattgtttagtgtctctttagtgttgttctctggtgagcattaacatgtaaaacagatcactctttgtacatactcccataagtctgtccatatgcctcttccataaatcatttctttccaatcttccaggcttgctcgttccaagcccctatttatccaaatcatttgccacaacccaggagtccatgacccacttctctctccatacaaagtagatgatgagatgcatccctccaagctctgcacaatggaggatttcccctcacaactgtctttcaaggcagtccctagtgggactatagtgcaacagtagtttatttgcagtttgtaccaatgtaccaagatgacctatccattaatcaggcccaggtttattcctcgtttcagcttgatgtaggaaatgcccctaacgcttgttcttgtcatctctttcttacttgggcccaattccaatatacctgcttccattttatgatgaattgctgttgtactctcctggtcttatcacttcatgggtgtgatagcacttagctcctgatggttagctctggttgcacagtcccttgatgaccatcagtcagatgctctgtctcttccagggcttaataatatgccaagagtagtatgccatactttacagatgaggtataatttttggctgcagacagcatggtcttgctttacaaggtctgggctgcaactctcctgtgggtgactctacacattgtctttgtcctttaagttggtaattggctcaactgagcctgtcttctctcttgaacacataaatactcagcatcaac

SEQ ID NO: 98734 - DNA, 2031 bp, Homo sapiens
tgtacattagaatcacctggagtgcttttaaaaacaacaacaaacaacaacaacaacaaaactgatgaatgagccttaccgcagatcaactagaatagaatctctagagatgtatctccatttgtattttttcctttttttagagatagggtcttgctctgtcgcctaggctagattgcagtggtacagttgtagctcactataacctcaaactattgagctcaagtgatcctcccgccttcgctttctgggattacaggcatgagccatcgcacctggctccatttgtattttttaaacctttccattggagaatcactgttctaaaagtattccagttaatttgaagatttaactatctcaaactttatttttacaggcttctgcaaaaagaggaagtttggaaactaaagatgatattccatttcgaaaagttcttggtaatccgggtagaggatcgattaagactgtagcaggaagtggaatagctcggacgattccttctttgacatctacttcaacacctcttagatcagggttgctagaaaatcggtaggagagacttttttcttagtcactagctgtatctgtaaatgtcttttaggccttttagaaataccagtaatttgaggagaaataaagtatagagtacatttttggtagatgtaatgattacaagtatttgtcatatgtagtttatgtcagtgacatgtattaagcatacaaatatacagcatataaatttaaatatgggccaggtgtgatagctcacgcctgtaatcccaacactttgggagactgaggcgggcggatcatgaggtcaggagattgagaccatcctggctaacatagtgaaaacccttctctactaaaaatacaaaaaaattagcctggtgtggtggcacacgcctatagtcccagctactcgggaggctgaggcaggagaatcgcttgaacctgggaggcagaggttgcggtgagccaagatcatgtcactacacttcagactggggtgacagagcgagactgtctggaaaataataataattaaatatggtgtagagaattagataatagtagtcccatttcctgtccttcagtatgttgatttatgaatttttgtgatatgaattgtggctttttaaaagtaaccttttctttgttctctgtagtactgaaaagaggaaaagaatgatatcaactggctcagaattgaatgaagattaccctaaggaaaatgattcatcatcgtaagttactttaagggcctttatagtgttagagcagtgtttcttatattggtatttgtaaccactggggaagattggggaaatggttttaatttatgagaattccaaagatggaagagcagaatgtaaagtagtttggtgacagtagactgtaggctcaatagagagggaaattagccagtgctattgctttggtcatttcattgcatttctcttatcctgccttttcttaaatctgcagtacttagtgggagaatagaactgaagaactctaaacaaatgtttcttgctggctgctgttttagtgtgaaccccttcttgtcttctttatgcttaattaaaaaaaaaatttttactttttcattttactcatgtaaaaagtcagcctagaggttaaaggatgtgagcctatgtgttctaggcaagtagcattaatctttcagagatgttttctgggttgaacaaaagggaatagatcaacccagggtgctcgccaactcgtaatcatcgtcctcattttgtgaggatttttttttttgtcttctaggggagaaaactaattatacagttatcagttaaaatctcaattaataccttaacagaatcagttggtagacagttaattggtacttgaggtcaagaggtcactagaaaggagttgggaaaaagccaaagaaactttatgtattaattgatttgctgctgtaatagatgtaaaagtctgaataggtggtaggactggtatctgaaactataatcaccaaggactcagattctttct

SEQ ID NO: 98735 - DNA, 1028 bp, Homo sapiens
gtgatcctcccacttcagcccctctagaagctgagactataggcgtgtatcaccatgcctggctaatgttttttcagtttttttgtagcgatagagcctccctgtgttgcccaggctggtctcaaattcccaggcttaagcagtcctcccacctcaacttctcaaagttttgggattacaggctgagccaccatgcctggcctgaacacactttttttttttttttaacttatatttggaaatccagacccattagctttcatgaaggaagagaataatcaacactttaatggtgaaggcaatcactttgagaatgggatcttattcctgttgacatgtctttagcggtagcagtatggttgtgaatgatacaaaatgtagaatttaggcactaataaatacagtactggacacatggcaaagaagggaaaatgaaggcgcagaagaaatgcatggtggttagaaattaattactagtaagttataacttatcttatttttcttccttagaacctgccaggtaaaggtatatttttgctttttaatttagccagaagcaatttttaaagaaaatatgtctcctctgaagatacatggtcctatcagaattcgaagtatgcagactgggattacaaagtggaaagaaggatcctttgaaattgtagaaaaagagaataaagtcagcctagtagttcactacaatactggaggaattccaaggatatttcaggtaataccaaatattgatttggaatagctcttgaagcagatcatttagtaaatagctattctgtgccatagtaaacatcacagtagccctcctcctagattaatatttcttgcttcttatttctaggacattaatatttttatgtacatgttttataaattattcatcagtattgttgttggtatataataaaagcaggaagtagtcaccattattgaaaagaaaacttgtgggaggaagctgacaagagttcggatactgtatatctaagctatttttaaaaccactttaagataat

SEQ ID NO: 98736 - DNA, 1774 bp, Homo sapiens
ttcattataaggctgtctgaaaggtgtatggaggtagaatttttttttttttttttctgagacagagtctggctccaggctggagtgcagtggtatgatctcggctcactgcagcctctgcctcccggattccagcgattctcttgcctcagcctcccaagtagctggaattacaggcgcacgccaccacacctggctaatttttgtatttttggtagagatggggtttcaccatgttggccaggctggtctcaaactcctgacctcaggtgatctgcccacctcggcctcgcaaagtgctgggattacaggcatcagccacagctcccgatctgtggaggcagaattgatgggattctcctgactttccatctctaatctaataccaataattatcaagaaggaagccaaagacaagtcttctgtttctggcatgggaaactggagtagaagagtgatgtattctttgtagcactgagtggcggagtggaaaaaagtctcaaggatgtatccaacaataaagtcacaaattataattgcagaaaaaagtattacagatatacattgctggctcaagtttctgtagctctgtagcattactagtttgagccaaatgtcatgttaacagacagttctataaacattaatggactctattactttgacgaattcatattacccagcacattatactaatatctaaatctgcccatagtaagcacttaaaaatttttgatgagatgagtgaataataatagagtacttatgatacttaacacctttaaactctcgaaagtgttttcatatatcttcttttatcttcagttatttgccatacagtaaccagagacctccaactaggggcccccaaactgtatcctgcctgtaggtgagttttgtttgatttgtagctgttaaaaataaatttgaattcattgccaacaattaaaaatggacagttttacataaacgtttggatgtctttattttcttgaaaagttagatggtctggcaatgctaggttcgctatttctacatggtaataattggctagattgggtagcaattgttcaaattttgcctgcttaagtcatttctgtcacctgctagcccctatagatagttgagttagtgactcctgttaacattgtatttattgaggtctttggagaaagaggtattatggacatggaataaattcagaaaacagacattaattccattaatattaattactgctgtctgctgagtgcctagtatgtattatttcattctacaacactaaaacatttgctattcctattttgtggttgagaaaacttatggttaaagaaggtaagttacaaattagtaagtgatagggctggctggctgctgatttctagacctagcatcattttcctttatatactagcctttctggcttttcttgttgagctgtttaggcaaaggtaatgtttaattgtgtttaatttagtaaattataagcaagaatccactttagaagtagtgtttttaaaggtttgaaatagtataaaatttgagttcgcaattttaaatgattgcatatttatgtatgtaacacactatttgataacattctttgctataactgtaattttatttacttgttgacttttgcaaaagctaatttgaagagttttacacatccgattattgctgtaagtttaagttttttgtgttttttttttgtttgtttgttttgagacagggtctcactcagagtgtcacctaggctggaattgagtggtgc

SEQ ID NO: 98737 - DNA, 3084 bp, Homo sapiens
ggatagctgaattacactatctttcttttttgttaaaagatcacgcgggtaaaacgagatgtgtcgaggaaaagttttaaatgcagagaacctaagtcagatgcaaaaattatgcacttttccgggcctcaggttttccataaataaagcaagtggtttgaactagaagccatttccttcccgctgcgacgtggtgagttctaagagcaggggccgcgtcagattgaccatggaattcccctcatcgacgccggcgcccagaacacaactggcgccctgaaactgttggtcagcgcaataaatcaatgaatggcctgctacgggcgtgggaccaggccccggcgcccgcaaagaacgcgatgggtcgcgctgaaggccgcgagaggcgtccggcaaggaaataggggccggctccaccacaaccaaagcgtgccgaggaggggaaccggggccttggagattgagggcagaaaaaaatcagactagggacccgacaccgggaattaggagagaaggccgaaacgtgggtctgagaaaggattctggttccaagcctgggggcccagccactcaccgcagccgtcgccaggctgtgcatgttgtgagcggccgccgctctcttccacagccggacgcgtccgacccgcgtccccccttcagcacccctgcagcggaaaacaatgagccgccgtagccgccatccgactccggctcgctccgcccacttcgcggccctctgacctctcacccctgaccccacccacacatcctcttcccgcctccagggcctagttaacagtcccagagtatgtcctttgccccttaagatttaggaccggaaggacgtccgcgaccactagtccccgcaacttctggctttgagcagttatttccagagagcggcgtgaactctgaccctcctccaaaagccagtgaacggcgggaaaagatggacagtcccggcaagacaactattgcgcatgcccgactgggttgcgtaggagggaaatggtgggggggcgtcgaaatcgggtgaggtggaaagtgcgcgtgcctactacagtcacggcaggggcggggctgcccgggctaggccgctctaggtactggcggggcggggcgagggcgtgtgaggggcggagttttcgactgacgcgcacgcgcctgtctggtcgcgtcgagtgtgcgtgcgtgcgtgcgtgtttgcgtgtggtcacagttcccgccatcagccgctctccctgactaggggtagctagcggcctccctcctttgggttcggtatccctacttccattaccctcggctcctcccactcctcgcgggctccgtgctttccgcgggtctgtccgggggctccggaccctcggcgcaggtaaggcgggccggggtagcttctcaattgagccgttttccctacctcctcctccttctgtgcgatccgcccactcggcgttcactcctctggagttcgccctgctgctactcagcccgcccacaacccctcgatgcacccccagcctcacaggtactacctttgggtgcactgccccggcttccacctctcctttgacttggtctccactgccactcgctccctccgaaactcaaacctggccccttttctctggggctgttgtcgttcgcctcttaccttctaacagggcctgctgtctcttcaggtgactttcgttacggcacatccaccaggccttggacatgatactcattcactctcttgaccatcttcaccttcctcttgaccagtcctcactgcaaaacatgaattgtatttttgttgtgcatttccttgcgcccatttctagccgccagatcaggttgttagatgtaactattttaagtcatgatccatgaaaggaaatgatgattgatgataaaatcctgtgtcctgaagagttgtcctaaagtggttttggggtattcctctcaaaatttcagctctgtataaattcctttattgaggtggcaattcctgacaagtgtctaactggaagagatacctgagagggaatgtcaagtaggcagttggatatagtgggtttggagatcttaggagagttctgggctgcgtacgtaaatgtgcgcggtgtgtgtatgtgtttgtcatctgccatattgatagtaattgaagccatggatgtggatgaaattgccgaaaaagagtatagtgctgtaaaataaaggcacctaggatggagcattgacgaattcctgctgtttaataaccaatagaggaggatgcgtcttgcaagccatgaaaaaagtcatcagtagtgttgcattctgctgaaaggtaaaatggaaggaggactgaaaaacccagtgatataaaagtactcacttgtcttaaagatgtttgatgaagtaaaatgagtatttgggttcagtcctaggtcctcttcttttactcttatattcctccctaagctttaaatttgatctatatattgatgacttaaaaattgttatttccagcctattccctttgttttcagctccacatctagatagccagctgtctgcttgacatctcaacttgatttttttcttaggagtttcagatgcaacacagccaaatccaaagccttgatctttctctccatatcgaaattctttcttctccagtgtcccagtttattaagtggcacatgacacaggctacacacttgggaggcattcttgacttctactctctccaagttctatcctacttccaatacgtgtcttgcatctttttctgtacattttcactgtcacttttctagtttaagccacagtccttaaaaaacctggacttgattgccttggcttcctgtattatcatctgtaaaatggaaatagtaattttcagcctattggattgttatgaggattaagtgagataaccatgataagcacttggcacagagtaaatggccagtaagcattaattgttattgttataagctgatcaactcaatactcttctatctggttacattattttcttctgttcttgctcttagtcactctcccaaaacccaaaccaaccatatatgacttcctcattcagtagtaacatat

SEQ ID NO: 98738 - DNA, 1047 bp, Homo sapiens
ttcatctgatgctgatttccattttttaggaaattgtaaatatttatccatctatcaacccacccaccttgacagcacaccagtctaacagagtttgcaatgctctggcattactgcaatgtgtagcatcacatccagaaaccaggtaaatgctttgggtgagtcacttgggggagatatacattgaatatggtcctaaacgttctctgaataataaaaggaagggcatggaggagagagagagagaacgtttgtgtgtgtgtgtgtgtgtgtgtgtgtgtgtgtgtgtgtgtctctctctctctctctctctctctctctctctctctctctctctctctctctcctggtcttccggattcttatttacttttacccaatgaactttaaagaaacagtgttcacattacaggaaaggtatcaggcatacagctacttctcactccctgacctgttattgacactatgtcatctgtgaggcatagtgcatggcatataagaggagtttagtaattatttttccagcacttttcccacactgaacccagatttgacttcagaatccttcttaacatagcattctgggcggcctctataatagacgagaattggcatgtaagttaaaatatttttgccacctgtcatatctaaaaaattaagaaaagggaaatcctgttcaggaatctactttgtgggcttttatggccccaaaggcacttaatagtcatcttattaaagcctttcctctttgtcaagtttccttatgaaatatgtatgctaggttggcactgaccttacacagctttagagaaattactaagaaaattacttttaagcacttaacaaaaacacaagagtactttgagtgttaaaaatcttgggcgttggctcttctacaaggtgtaactataaataatataaaataatagactgatttccttattagttgcctgactaaactgttttcagaatggtttgtgtatctgaaatgccctaacaaaaaaagaagaatgtgcttattaaagtatagcaggtaagcctgataat

SEQ ID NO: 98739 - DNA, 1023 bp, Homo sapiens
tgctgattacagggaaaatcatgtgttttcttaaccactgtgatctggactagggttttcagctttggcaccattaccatttggggctggatgaatctttgtgatggaaaggagagggcaggagaggactgtcctgtgcattgtaggatgtttaatggcatctctggcctcttcccactggatgccaatagtgcttcataatcctgagttgtgacaatcaaagatgtctccagacattgccacatgtcctccagggggcaaaatttaccccatttgagaaccattggttgagactaatgaccagtaacattgttttcctaaggattccttgctctgacaatgttaaggccttacagaattaaccacctagaaatttgaaagttcaggatccttagaaatcaaccctgggctgtgaatgtaattattgttttcttccaggtcagcgtttctcgcagcacacatcccactttttttgtacccctttttgcacactgtcagcaaaacacgtccctttgagtatctccggctcaccagccttggagttattggtaagttattagaattgttttgcaagcctgaaatactcacagtagtagtctaagttgggtgttttgtcttgccggttatgatttttgtacaccagtcattcatttttgtctttgaggttgtctcattcactaatcaataagtatcaggaacatgatgactcctatcaagcactcttctaagtgttgttaataagactttgagatccaacatttgggattaaattcagcatatatgtggaaacatttgctggaattgtagggagagtaaagcataagaacttgattcaatatataaagagtattattaaaggaataagagtttaaatttgggacttctcctcttcccttctctcttctcttctcttcttttcttttcttttctttctgatagggtcttgctgtgttacccaggctggaattgaactcctaggctcaagtgatcctcctgcctcagcctcccaagtaatagggacca

SEQ ID NO: 98740 - DNA, 1015 bp, Homo sapiens
ttagagagagtctgtcacccagactagagtgcagtggtgcaatctcagctcactgtaacctgtacaggttcaattgattctcctgcctcagcttcccgagtagctgggattacaggagcctgccaccatgccttgctaatttttgtatttttagtagagacggggtttcaccatgttggccaggctgatcttgaactcccgacctcaagtgatctgcccgcctcggcctcccaaagtgctgggattacaggtgtgagctactgcgccgccctcttcctttttttttttaatacgagtgtgaatctgattcctttaacaaaccccagtttgtgttctgttatttaagttcacaactcactggataaacagttcgaagttaatgttaactggaaaccctaactgtaaaataattttgtttgtccttattttctttaggggccctggtgaaaacagatgaacaagaagtaatcaactttttattaacaacagaaattatccctttatgtttgcgaattatggaatctggaagtgaactttctaaaacagtatgtacttttaacttagattttacattgtgttgactcttaagctgcttccttatggtcctgggatcattttctctcttcaagcttttgaaatttgtatgaatattttctgttttgaataaaaattattatgaaacaattattgaaaaacccaaaccattcagaagaaaatcaagttaaacactaaatttcttttctccaaacccacatctcactccacaggtaaattctaagtatattattacggtttcatttttttaattttaaaatttcaatcctgctccttctataaccgggcttttttaaaatacataatcaattatatgtacttgagcttctgcttactatgtactttaaccatgaatgacaacatgacaaggtacagaattcttactcattgtacagaattcttacctcattgttctgtctcagacctccattgccatagtccttttgtcttctaacattga

SEQ ID NO: 98741 - DNA, 1056 bp, Homo sapiens
ttaacagttataccgggcacatagtaggtactctgtaaatgagaaggtctctgagtttttaagaatttgataattacacggaacctacccttgtatgtaaagtgagaataataatggtacctacctcattgatttattataaaaataagataagcatgtaaagcctctagaaaaaaaaactggtacaaagtaatgttcaacatggtaatatttattattctttgtactatacatatatgataaagttgtacataatatacaaggatccctgcttgctcaattttctgactgatagtcatgcctgggaaaatgagtagaaaatgagaagattaaatctgagcaactttataaactcttcgattttgttttgcttcaggttgccacattcatcctccagaagatcttgttagatgacactggtttggcttatatatgtcagacgtatgagcgtttctcccatgttgccatgatcttggtgagttctttcatctatcccctttacaactacttctcatcacaaagcttaatctctttataactggcattgaacaacttcagtcctctgactagaactaacaattttggaaccttttatgattcttggactatctgatctctgatgtcaattagaatttgtttgtgttttgtgtgttttttccaacccctccccttattttgggggaaacagggtaagatggtcctgcagctatccaaagagccttctgcccgtctgctgaagcatgtagtgagatgttaccttcgactttcagataaccccaggtaaacatttataggatgtataggactttagggaaatactctgctgaacagtttcctaatctcatggcatagctcctgtgtctttaggacagggaagtggggatataactgcatttagtttgtctgagacagaacttagattcttttaaaaatctgaaatgctgaattttagtagccatcagtttcatcttctcactgtaactctccatcctactgtgaaattccagagagtctaggcgattccaaaggaaaccttatgatgcattactcctgttg

SEQ ID NO: 98742 - DNA, 1063 bp, Homo sapiens
actggcactgtttacaagtctgttagctgcataagctcaataaaaagttggtctgggcattacatcccctctggcaggccaatagctgcatcaagctgttgggagaaatgggagggcaggggaaagatgtaaagccaaagtacagcaggaacccaccacctgtttcccttccttctcccattctactcccagtccggaatgccacgaggaccttaaccttgtttctggctttagctgctagttttcccaaatctcagtgctttccctttttgaacttcccttctattaaacttaaaacagatgtcttaattaatcaggctgtcttggaagggtattgtattgggagacaaggggcggtggtggacctcaccttcaatccaagttttcaaagatattttctcaataactctaaaagggaggtgcttgggattaaggtgacagtccacttgatccttttctttgttttagtgtgaatttcagcagctccatctgtcttcatgattgtacttgagcagtattagctgtatgagttaattttattcagattgaagatggagggctgggttctgctcactcagtcttttttttttttttttttttttttttttgaccattctcttttagtctatgggaattacagggttgccgctaaaatattcacttgttcatatcgtgtcagagatttcctcttctctggagcttaggtggctcttcacaatccataggcttgaatctgcaacctagtgtaaactgccttgctttccccggttctttcccctgctagcacctgctttctcatccctatctccagtcaaagatgggattgcttaatccaactctggagagggaccaagtcttttctgcccacatctcacacaattgaggtgtctgaacaagcttggggagggtctataaggggtaggctcaaaaaaaaaaaaacccatttgcagaggcagttttgccaacacaagggctctttcaagccgactttcacaaagagagccggacttgttagttggcttctgtctctttagagccaagaaaatagtaattaagtggccta

SEQ ID NO: 98743 - DNA, 1040 bp, Homo sapiens
caaaaaagcatgagagagcagaggagcaggaggaaacagagaaaacgggccaggagaggccagaattctgataagagaaggaattgcagtctacccattctctactttcagccccctatgacctcaatgacctcgctgctgtcagcttcatggagtctgaaagtggtgctctctgaggtttgagttactttagactggaacattgctaataacttagctcttcgtcctcctattttcatcttgagtggaaatacatttatacataaaacccaagatctccttatgctaaaagtgggagagggtgattatttcagccagtaggtagagaagtataagcatttagtgctgttattggctcctgtagactttatcaagttttatgtatctccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggtaatgacattctgaggcttgaagcccttggtggtggggaagaatggattgttgaaaccctgccattgaggctctggggtttgttttctgagctttggttcggatccttttattctgttctaccttgactcaaaagtcaaggtctagtgggaaaatgataaatgagtgaatggtaaagactttagtaatatagcattggggtaaatcgagtttgcttcactgggctggttttcctcaggcagaaaactctagcagggaagcaggaggtgatcttcatcatatagagatgccagaagttattgatgatcagcagcctattttgtctggcactgagccctcaaatacttttttctgaatctttgcttcccagtttttcacctcagtagaatatttgaaagtcatcccacaaggagcatagttatcaagtgaataagaaagattgggttgtatttattaccaacttcattattatctagagcct

SEQ ID NO: 98744 - DNA, 1031 bp, Homo sapiens
tagggctgttggaggaccaaatgagagcgtttattaagcctttctttatcaaagtcttgcccattgcttttaaaacggcagcaattattatggagaataataattattttcagaaggatattctccattttatccattcctgtgcctttgtaaagctctttacagaatttgaaagtaaagctcttaaccatttatattgcagatattatccctagtttgtcattttcttttggaagtttctggttttcacttgggcaaaatatactgtcttaatgctttctggatttgcttgcttgttcactcatttaacaaatatttattaagcacctatcttgtgccaagtattgtgctaggaatccaaacacacgtgccagatagatggtccctgaccttatggggcctacagtccaggtgtaggaccagacttaaagtccatctgtactctacgaatattaaaagattcacctacattttctactagtaactaactcctatgagtcttgttccatctgattctatgcctttctctgtcggtcctctgcctgcaggtgtcctggtaaaggtggtggaggtgtacttctgtgagcgctgtgaacagagcttcgcagagcccactctgctggccctgcaccagtgcagtgagacccatatacagcctgtgcagggcctctctagccccccatgctctgtagagctgcctcccagcaacccaaccctccctggccctctgcagggccagagcccgccagttagccccctatcatgccctgtgtgtagacaggagtttgcccaaccccaggccctgaagagccacttcaagattcaccggggcactcctgacaccttctcctgcccagaatctggctgtgtgttctctgctgaagatcgcaagggtctgcagcaccacctgaggcagactcacagagcagttcctgtgccctgttctttccggggctgccccctgcttttcgggagccagcagggcatggagctgcaccggcaggcgcattaccctttccactgcagccact

SEQ ID NO: 98745 - DNA, 1033 bp, Homo sapiens
aaattactaaaaaagctatacatctagggagagagactgacaggtaaacaacagtgcagtgtgacctcgtttctgatagggctgtgtacagagtgcccttaggacgccagaagagagaagataagagtttcgggaagccaggcccggcgcggtgcctcacgcctgtaatcccagcactttgggaggccgaggcaggtggatcacctgagttctggagttcaagaccagcccaaccaacatggagaaaccccatctctactaaaaatacaaaatagtagccaggcgtggtggtacatgcctgtaatcccagctactcaggaggctgaggcaggagaatcgcttgaacccaggaggcagaggttgtagtgagctgagatcgtgccactgccctccagcctaggtgacagactaagactgtctcaaaaaaaagaatgtcaggaggccttcatggtggaagtgacatttgtgcagcttcttcaaggatagttaattggttagccagataagagagagagattgagaaggggaaaaggcatatcaagccaagagacgcaaaaggctgtgagggtatgaaagcaaaagagaatgtggtgggtctggagaatggcacatcatctggttcagagatctgctgaggggagaagtgggagatgagtcaggggaggtcagcaggagccagatgatgaaggaagggccttccttataatccatgctgaggaatagtgagattatcaaaggttaagagggaaagggaccaggcaaggtggctcacgcctataatcccagcactttgggaggccaaaacgggcagatcacccaaggtcagaagttcgagaccagcctggccaacatggtgaaactccatcgctgttaaaaatacaaaatttacctgggcgtgtgtggcacatgcctgtagtccagctattggggaggctgagacaggagaattgcttgaacccaggaggcggaggttgcagtgagccaagatcacgccactgcactccagcctgggtgacagagcgagactctgtct

SEQ ID NO: 98746 - DNA, 1694 bp, Homo sapiens
gccttccatgcataggtgttttggaattctggatcccagttctgaggctcagccgaggtcactgctgtcagctcacctccctgcatgccaggcgcagggcaaagtggccggggttcggggttggaggagaggtgtactagaaacaactttgctcttgtccctcaggatcttattgtctacgatgtgacgatccgtggagaaagtagcagatgggcagattttcatttggggagaatgagggagaaaagaacgggcattccgagccaagagcactgcatgagcaaggagttgggaggttgcttacttgttgaacatatttgttgcgtatttgcatatttgctaaacaggtagtgttaggagctaatccatgaaaggtaggtgggcgccgtattgtagagagccttgagtaccaggctgagtttatacccaattcaggggtctgctgggagccagccattgaaggtgctggagcagagagagatatggtattggagctgatccctatgatgaaagatctggacccttgtgtagatgttccgtgaagcaggaggtgaagacctattaaaatgccatttcaagaactacgattttaaagacagtttaggtgggaggtaataaaggtctaaacaagacgttaaatattggggacgtaagggggaggatatttgaaggacattactcataacaagacatagggttactgacaagtcaacggacgcttctcccttgctgactgcagccaatggacccctttttatcatagctggtcccagggaccacaaaaatcctgtccatccattaccctgatgtgaagcctgtttatatagctctttttggtttaaggcatctccagacatggtcctctggtaggaaacaggtatgagtagactaatgaaggacaaaatgggatgagggacctggagcctccacccttgcattccaataccacccttaccccacaaaaggagggtattgacccacacagtaatgctgacctgtggccagggctggggaggtccaatttctaatctgtgctttgtcccatctccactgttccccacccctaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtaaggtggggagctagggagggctgtgagagtagaaaagaatgatgggagctgggtttgacccattcactcactcagttttgatcgttcttattcaggtatcgggggaaatggattcgggtagaacgaagtcgagagatgcagatgatagacttgcagacggggactccttgggaatctgtcaccttcacggccctgggcactgaccgaaaggttttcttcaacatcctggaggaaggtgtgggatggcacaggcag

SEQ ID NO: 98747 - DNA, 1048 bp, Homo sapiens
gcagggctgggaatgaacgtagatatccggggcaaaagacatgatcatcctggctctatccctaggcattccttacagacgtggctacctgctttatgggccccctggttgcggaaagagcagttttatgtgagtattcaaaatttctctcaacttggcaaaacgaagcctttgtggaaacactaggctgatagggttggaaggggaaatgaatctggggatcggggaccaggataaacatgaaacgtgtggaacatcagggtgtgaggtagaagtcaggcctctgagacacatgtccccaggcggtgaggagagtagctgggcctgaggaagcatttccaggttgcctgctacctcctgccatcccatgctccatagcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagagtaagtgaggggttctggaggaagtggagtgggtaactgtggaacaggggaagaaagcagaaatccagagggctggtggaagatgcctgggttagtgacaagagcccacaagacacatggataagtaggggaacatagtggggcatgctaattttatgctgggctatgactactcatgcttccttatctttgccttcctccagacccagtaaagtaccaaggcctaggtcgcctcaccttcagtggactgctcaatgccttggatggtgtggcttccaccgaggcccgcatcgtgttcatgaccaccaaccacgttgacaggtaggaaggagccaggcatcctgagacttaggcaagagcccacctcctcccctagtgccttgggaggaacaggaggtcgaggggccatctctgttgggtgctagtgtgacctgctttccctgtcttctctcaggctggaccctgccctgatacgcccggggcgagtggacctgaaggag

SEQ ID NO: 98748 - DNA, 1084 bp, Homo sapiens
aaattctgatttccatgccttctatttggccagttgacaacttaaggtaacatattccttgtttttaaggagtttagcaggagaatgcattctggtagattgccatttttctacaaagcctgcctttattggccttagcaggcttccacagggagagctgtaatggtaagttagtctactcctgtctctctagggtccttccctctgaagttgaagtattggagtccatctatctagatgaactacaggtgattaaaggaaatggcaggtatgtattcaaccagtggtgggcaggagtccccctagtaatgaggagaggttctatgctgaatttgggtcttaagacattgtgagccttgattcagagataatatttctcttgtgtagacaaaagctattcctttaatcctaccccaaaagaaagagtccaatgtgtacttcctttgcccacttcactgtctcagccccatcctccccagcccccaagcccctacccagtcacatctgcgtgtccacttgatccacctgcagaacttcaccatgggagatctacatcactttgcatcctgccactgcagaggaccaggattcacagtatgtctgcttcactctggtgcttcaggtcccagcagaggtgaagcccctactgtgtggcagcaaagggaggaaggggagagtccctggggtggaccgcttcagcagtaacttgttatttgcccccactagtatccccatgaggtgccacagatctctatccgaaatccccgaggactttcagatgaacagatccacacgtaagttgaacctgtcagaacagggaaaactcagctacagctttgcccggtgacagaaatgggcaggtctaatatttggtttgccctcttcctccaggatcttacaggtgctgggccacgtggccaaggctgggctgggcactgccatgctgtatgaactcattgaggtaagaggtgcgctagtctgagatatgttctttccttcaagctagagcagtttctagctgtaaaagggaaaccatgggcctagaatcttaaacggatctggagtcattaggtaaggcctaaat

SEQ ID NO: 98749 - DNA, 1022 bp, Homo sapiens
cagcctcccaagtagctgggactacaggcacccgccaccacgcctggctaatttttttgtatttttagtagagatggggtttcaccatgttagccaggatggtttcgatctcctgacctcgtgatccacctgcctcggcctcccaaagtgctgggattacaggcgtgagccaccacacccggcctggaatgataatcttatgggacattgtcttctatggggactatctgttgactgaaacattatgtgaggcatgactgttaggaaaatactggttcactgagttatgcagatctcccacgtgtcacagtttattgtatagtgtcaaaaaaatcatatcaccacaatctcttcagagaagtagttaaatattgggaagcactcaaactcgtggtggcagataccattttgccaaaattctaattttctttgggaagctcaaattttatcattggcaacaagtacagtcagttggtttccttgaagtgacaggcttactttgtttcattttccagaacctttgccaaataatgacgtcggaataactattacttatgtgtcattcattctttcaagtaaacatggcgttccacagaaaaatcctgcaattcagacaatcacacaagtgctttagagataatcaacatgttctgcatgcagcataaatgttttatatgtacttcacattttatcacacagaatattaaaaagcatactcaaggacactttttaatgagatttaatataatttacactgtgtcgggctgggcgcagtggctcacgcctgtaatcccagcactttgggaggccgaggcgggcagatcacaaggtcaggagatcgaggccatcctggctaacacggtgaaaccctgtctctactaaaaatacaaaaaattagccgggcgtggtagtaagtgcctgtagtcccagctactcaggaggttgaggcaggagaatggcgtgaacccaggaggcggaggttgcagtgagccgagatcgtgccactgcactccagcctggcg

SEQ ID NO: 98750 - DNA, 1145 bp, Homo sapiens
taattggctcatggttctgcaggctgtatgggtagcatggctgcggaggcctcaggaaacattcagttgtggcggaaggggaagcaggcacgtcttcacatggccagagcaggagagagagaaagcagggtggtgctacacacttttaaacaaccagatctcatgagaactcactatcatgagaacagcaagggggaaatccgcctccatgatccagtcacctcctccaacattggggattacaactcaacatgagatttggtggggacacaaatgcaaaccatatagggactatgagaggagacaagaagtgggaaatgaccattgcagagatatgagatctggaataccttagagagaagagaatccactctactctagtacctgcccaggtgtgttgtttaacactttgtctgggagcaggccacctgcagcttctgaggagggtaggcatgtatccttgtcctccctcttcctcttttggattaaaagccaagccagctgggtgttgggctatttgtgttcatgtgcttggcactgagggttcatgtggtgggatgtagcaaggcaaacattgagcaatgtgtgtgcaaaaggaagtgttgtgcagtgagtgcctgtggctacaagggagagtgggattggctgtggtgttgatgagaagtcagtgatgtgcttttagggactttccacaaagggccttggtataaacatggaggagtgtttccaacctggcttttgtctggtacctaaagattaaagataatggaggggatggagtctaaatatgtgtttcattctgtttaataggcattgtagactcagacagatttgagttttaatctaggcactgctacttattggttatttaattataggaaagttacttaacttttctgagtcttggattcatcatcagtaaactgaatgtaaggttttttttaggattaaatgagataatatggataaaatgcctagcatggtaccagacattcattaggtgcccaaactagtattcaagtttgtttccccttcatttactgtgcttttccagtttgtttactcaacagaatattgagcacttcctgtgtatcagtcactgtgttggggacatcagctggaggagaatgtgctccttgctccta

SEQ ID NO: 98751 - DNA, 4261 bp, Homo sapiens
gctcagctcactgcaacctctgcctcccaggctcaagcgatcctcccacctcagcctccccagtagctgggacttcaggtgcacgccacaatgcctagctaatttttggtagtgacggggttttgccatgttgggcaggttggtcttgaactcctgggctcaagctgggattacaggtgtgagctgcctcacctggactcaaataatctttaatctttcagaattgatttatgagaaggaagatactgagtcctctctctcacttcagatttgctttattcctagccacactggttttgggtgagggaaggtagcccctcatggaaagttgtgggcggtgagacagaaagatgtattttttgttggagagagaggaaagctttctgagtgacagagtggggactcataagcagcttcacagtggtggtggcacctcagtgttttagtccgtaatgaagccagctttgatcctatgagggcagtaggaagatcattgaaaactccctggaaatctggtgttcttctcccagtgccccaaatgacgaccaagactggttgcccaaaaatgctgaagtgggactgtactgcttacctgaggaccactgtagcatggtgtccgttctcctggcactgtaacatttcctatcatttctctccacttcagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattaggtatgttggcaatgtttttggttcatttagagcagtagaatgtatataccataatttggggtggcaccgaccctgtacctctgaaggttggttttattttttagctgccctagaatttttggttttcacttcagggcaagggttgggaaactatagcttgcagaccaaatcttgcttgttgcctgcttttgtaaataaagttttgttggaatgcagccttgtccattcatttgcagttgtctgtggctgctttcttgttacgatggtagagctgagtagttgtgataaaccgactggcctgcaaacaaaaatatttactctctggtcctttagagaaagagttcgccaacccctattttaagtaaaaaccaggagagaaataagaattgtgagcaccaaatgttgaagcctgtgactttcctactttttccaaaccaaatgaggttctcagtcattcttggcatgacagccatttatagttagggcacacacatagttggctccttctgttgtgttttgttattttcctgggaacttggtccactaaggcctttttctgagttcccagagagtggcctagggacatttcaagtcaattaccagatatccattgatggttttttagatgtagaatgttgtacttatatgctatgagggacaccaaagaaaatggaaaacatagtgcctctttgcagaatgggagatgtaaggttgaggagctatgcctagacctaagctttgaagacaaaagaaatgagttgtgaggtccaggcaagaagtagcagattggtaatggagaaggggcaaatactgggagatgatgaaggaatgagaatctaactgtgacctctttgatggagttgactaggctgggggcatgattctttcttttagttcagctactgacctccagccagatcaggctgagactgaagatacagaagaagaactagtagatggtttggaagactgttgtagccgtgatgagaatgaagaggaggagggtgagtaggaaaccctttcacttccaactaggagttggttatgacctgttgggcagggggctgacaattgtgtactaggtccttgactcacattacctacatcagtcatttgctttgggggtcttaagtgggggtagtgccttctagaggacttgggtctctagtcctcctgtcccactggtcttaccttcccgctgcttctgttgaggaaggcagtgcaaagcagcggggtggtgcttgtggctccccaagaagggttgagcccaggatattcaaggaagagttgcctaggcttggtaagtttgtgctgcagcctcttctagtcagaatttctctgttcttccttcctctaggagactcagagtgctcctcattaagtgctgtctcccccagcgaatcggtggccatgatctctaggtaagtgtggctgtatagatcattgttacatgctcatcttttgtctcttaaagattataaagagataaaccactcaagtcattaatggcctggagaactctaatgcatttttaccaaatttttatgtttgcgactttagtttttgaacagggagtaatggggggccagaagcacatctcatctgtggggcttaaaaacagtatcatgggccaggcgcagtggctcacacctgtaaccccagcactttggaagctgaggcaggcggatctcctgaggtcaggagttcgagactagccaagccaacatggcaaaaccctgtctctactaaaaatataaaaattagcaaggtatggtggtgcacacctgtaatcccagctgctcgggaggctgaggcacgagaatcacttgaacctgggaagtggaggttgcagtgagctgagatcgcgctgctgcactccagcctgggtgatggagcaagactttgtctcaaaaacaaaacaacaacaacaacaacagtataatgggctgggcgcagtggcttatgcctgtaatcctaacactttgggagactaagatgggtggatcacttga

SEQ ID NO: 98752 - DNA, 1221 bp, Homo sapiens
ctcacctctgccctcttcctgcactcacccttttcccttttgtagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccagtgagtgaatcacagtgggcaggagactatggtctgtgagtgggaacaacagagtattggacctggagcaaatctcatctcctttctgctcctagccagcatcagctcgaggcattggcatccaggttattcacaagtggagtcagctccccaagcgaaggcccctcctggtacagaggtgagcctgtagcacatatcccttaccccatcctcccacctccttggcctcgaggttcccttcttacaatgttctgccctttgttctcccagccaaagagcttccttagccaactgttctaaggtctttatcttggggactgttagctggcttttcctgtggcttggttacccactgagccccatcatctggctgtatgagaagctggcctttgtcctatgtaggtatctacacaaaccctacctcatcagcggcagcaagtttgacctgcggatctatgtttatgtcacttcctacgatcctctgcggatttacctcttttcagatggactggtccgctttgccagttgcaagtatgtgacagtggtgaggtatcctctgacaatattggggattttattttccttggagggagggaaactagaagacaccaaacagaaaaatagtttttgttagcaaggggaaaggcaggaaatgggaaatatggaggctctctacttcgttaaatctggggagggtcttcctgcatgcgggactgaggtgggataaaggagatgagtttagctgtggtttttcagaactttgccagtagacacacttctcaggctcttgtggctatgaaaagatctgtgtacttgttctacacctcttcaggatttggggaaatgtttggccccttctccatctgctctgttaccatcttacctctgccttttgtttccttacttccaggtattcgccttccatgaagagccttggcaataagttcatgcacctgaccaactacagtgtcaataaaaagaatg

SEQ ID NO: 98753 - DNA, 1502 bp, Homo sapiens
cggatgtggtggctcacgcctgtaatcctagcactttgggaggccaaggtgggtggatcacctgagttcaggagtacaggaccagcctggccaacatggcgaagccctgcgtctactaaaaatacaaaaattagctgggtgtggtggcaggcgcctacaatcccagctgctcaggaagttgaggcaggagaatcacttgaacctgggggacggaggttgcagtgagctgagatcgcgccacttcactccagcctgtgtgaaagagtgaaactccatctcaaaaaaaaaaaaaaaaaaaaagaattggtctatttgcatccaagttcatctctttcataatttaaactgcgaaaggaagagatatgaagaaaataccattaggtctcttcttcgtttttctttgtctttgtcactcattcctagaatttaattcctaatacttcctcttcctcctctgcagggcactgaaggctttgtggaactacctgagccagaagggagtcaatagcgacgccatctgggagaagataaaggatgttgttgtcaaaactatcatctcgtgagtcacattgccaacctggatgtggggcctgctgctgaccccctcctttctcctgggcctcacactgctgtgctctggactttggccatgctgtggtttggttttaaggacagagaataggaaggagtggccagagttaagttctaatgaacctcatccccaggagctggtcccagatcagaggtgtcacttgagagctacctttcctgggttgcttctgcctgcctatctctgggccactcttttggcaggatagctctgagtagagccctctgggaggagctgaactgagtacttcctcatccccatgaccaggtcagagccctatgtgaccagcctgctcaagatgtatgtgcgacggccctatagctgccatgaactctttggttttgacatcatgctagacgaaaacctcaagccctgggtcctggaagtcaacatttccccaaggtaggtggtattctcaggacactcaccatagaatccttccattattctcacgctcccattgccactccagtaagttgttctttttttttttttttctttgagatggagtctcgctctgtctcccaggctggagtgcagtggcgcaatcttggcttactgcaacctccgcctccggattcaagcagttctcctgcctcagcctcccaagtagctgggactacaggcatgcaccaccacacccagctaattttttgtatttttagtagagacagggtttcactgtattagccaggacggtctcgatctcctgacctcgtgatctgcccacctcggcctcccaaagtgctgggattacagatgtgagccaccacgcccagccagttgttctttttaagtggatccttactgcttgctttcctttagcagatcaaggtcatgggcaggttattcaccgtctttggggcaagagagtcttgtgatggtgatcctg

SEQ ID NO: 98754 - DNA, 2112 bp, Homo sapiens
atttgggacccaaaagcaaacagcttttctttttttttttcttttctttttcttttttttttttttgagatagagtttcactcttgttgcccaggctggagtgcaatggtgcgatctcagctcactgcaacctccgcctcccaggttcaagtgattctcctgcctcagcctcccgagtagctgggattagaggcatgcaccaccatacccagctaattttatattttttagtagagatggggtttctccatgttggtcaggctggtctcaacctcccaacctcaagtgatccgcctgcctcggcctcccgaagtgctgggattacaggcgtgagccaccacgcctggctgcaaccagcttttcttaagagcacggtttcttaatccaggcctgtgatcctctgatgcacagagatttgttggcatgtctgtcattctgggagagtgttaattgtctttaccatgttttctggccccctcttgtccaaactatagacttttaccctttgggtttctttctctgagaggcacagtgagagaccccaggaagctgactttctcagagcagataaggaagctggatttaagcatggcagatacaagactggtgccaaatctgaattgctggatcctcatcttgactttacccaacaaactacttaacctctcagccccagtggctcccctgaccccaaacaagagtgccttcccccactagctaagttcagtagacttaggaacagatgtctttcagagctggcccactaggctgccctcagtagttccatgagagtcccggagctgtaggaccccaggggtgtgctccctgttccccagcttcttgagtctctgcccctggcttacactctctcacaccctttttctccctgttccttggaccacaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggtgatgtgccctccctgccctcagaaagccaagtttagtgagagattaaatcccagtataccaagaaatgggcctctctggaaagaattggccaattgattctaccttcttaaaccccaactcctgctaatcttgtcctaggagtagatctgctccggagttggtgctacaaagggttccacatgggagttgtctctgattctgctccagtggtgagtgctgccagtgtggaggacagctccttctcaggcccctccctcctctgccttatgagtgcagcaggagttgggttggtatgtataggcctctctcacttctccgctaggctctgcttctgtctcaccattctttcctttcaagggaatagttgcctccaggattccctgggtacctttctttcaaggatcaaaaagtgctttgtaggcctcaacttcttgtttgattcagaagagaactgagacttttacccacctgggcccatgcctgaggggtagggaaggggagaaccccatgatccatttagaggtagagctggagggtaccaagaccccaaacactcctgccttgcctccgccaagccttttggtctcattgcttcctttgctcttagtggtctctcccgacatcacttctgactatctcaaaggatgacgtgatactcaatgccttcagcaaatcagagactagcaagctggggtgagtgctgcctgggcaagggaggggctgctggctgtgagtttgtagagttttcttccttcccctcttcccagactgtggcagtgagatcagcattctccagctgggggttggtgggagcgtcaggacatgcagccatagcatcctttttctggtagatcttggtatgcccagggaagctgagctggaggacagaagtgcttcctgaagcagccactgtcagccatacccactagctgtgggaaattgttagccctctacccgcacccccattcactcttgcactgcaggtctcaagcct

SEQ ID NO: 98755 - DNA, 1157 bp, Homo sapiens
ctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttctaccttaagtgagccatgtgtggtttgtctgggggccctggtgtggttgctgagttgtagctcaagaggagaaaacatacagaacatatttggaccggaaatcctttgttctgaatttgagggggtcttctgaggtccttacttccttaggtctttcctcacccctctcccaccgctgtcctgaggagaaacccttgaacttcctcagtagacaggcggagaggccacaacatgccgaacccatttcctgtcatcctagtcttgggtcttcaccgcctccttccaaatacccaccctgccagcagccctaggtcttcctgttctgaccccccatcactgctcgttcagccttctagatgtctctctcgtggacatctgttctttagctgttggctttctctgaggtgtgagagggtctatgaactttgtgaatttcccatggccccagtgaaggagcccagataatcccagtagctgttacctgtctccatgtatcaaaggacacagtccagggggagggtggaaggagatgtggtttctctatagtgcaacaaacatggtttctcaatgttctgctgtgcagcaagcagggtctggcggcttggtaggtgggtttcaggagcagtcactattgtaggatgggcttccaatcaaacctcagactaaactcttgtactgaactgattctacctccctcctctagactcagtaaacagtgactattcaataaatgttgactgagtgaactgtatttacagagatctcaaaggaccccagcacttgaaccagaagttctaattgtctctcatctaggtatgagaaagtggaacctgggaacagcacaagcggaagagttcggatcagaaaggttttctctgaagccgtgctccttcctaaccctgcacttagtggttgctgcttgcctcctccccagcccctgtagtccctttactta

SEQ ID NO: 98756 - DNA, 2561 bp, Homo sapiens
gaaagtggaggagggcagtcactgctgtttactttgcatccactttggaatgatgagaaactcagtttcttagaagaaatagtaatgaagagatggccttgtgtcaggaaaggatcgggaaccttgaatcaggctgaccttgggtttaaatcccagttctgccacttactgtgtgaccttgggcatgtcatctaacttttaagtctccatttctttgtagtatgaatataatacctacagtgcagggttgcgaagatttaaaccaaatgtagtgaaagtacgtaggacatagagggcactttgcatggtcacaccttctccacttgctgtccaagccctgtgccctaggtgggaagagacaggcaagaaacgtaaaaccctctcctccaggaggtggagctgccatcgagatattttagaagtgaagatgccagaacagggtctagatagctcatggccctcaccttcaccccagtgcacacacaaacatcaccattcaccctcctattacattatcactcctctggggatttattctttggttaaacacttcacagtcagagcacagaatccctgagaaaggaagcacattaagcattagaagtatgtgaactgagtgggattattaaattatttcaagagaagctttgaaaagaaggggaaagcaagcacagtgggtgtcaggtggctggaaaggggagaagcagggtacagaaaataagagaacttgattggaactggacccaaagagcagatatatggacctaacagctgtacgaaggggcagttgtcattacaggtaccttctcttggtttcaagctgtttggctgagggtgagtatccccctgtcaccctagccaaagtacatacccagtggcttctggggcagtccagtgctgctgagggccagtgaaggagactgatcatctggacacaaagacctttctacttccttctcagctgaattagttacccaagataggtgaccaacaaaggcagacagggatctcctctcctgggctccccttgatttgtcctctaagattaaggcttacctgtgactgttgttcgaatcccccaactgctgtgagacttggaaacactgatggttttcagatggctaagagagctccatttcttgccacctgagattctgaccaagcctttcacaacccttcttggccttttagagttccccctgtagcagagtttgcccgctcattaatatccggggatctatgccagctcatttggcttgccccttcaccagcgttggatcagtgaaagttgcaagcagtcatatgttgctctcggcaaatgttttacaggtgaaaacacaagaagggtcaatagcaggtggtggttttctaaaacccatctgtgtcataattataatagactgagatacatggaatgccagggactgccacaggcaaagctaacagaattttgaaaagatatttaagtttcagttagtaaactggggacaccaaagcctactcagaatagttatgggactaaaatatggaggaaaagcacctaacaaggtgcctgataatatatgatgcagatttaaagtagtggattctaaaacagaccaaaactaccacccagaacatataaagtaaaagcactataacatgcaatagtgttacaatactattacaatagcgtgttaatattaccaaactatggtaaaatatactttgattttatccataattaaagctgaggatgtattgatagttaacttagaaagattaaagcccccatcattagcagtcagagaagagcagtttaaactgcaagataccacttaacactaaagtggctcaaacttaaaagattgaaaataccaagtgtcagtatgatactgagatattgagaaggtgctgatgggaatgcaaaatgatgcactggaaagcagcttggtagattcttacaaagtgaaacatgtccttaacgtatgacctagcaattccactcttgcaggcaaatgttcatagcagcttattcatagtagcaaaaatttagaaacaaccatatgtccaacaatcagtgaattaacaaattgtgatatctctgttcagtggaatacccttagatataaaaaaggaacagagggccgggcgtggtggctcacgcctataatcccagcactttgggaggccagggcaggtggatcacctgaggtcgggagttttgagaccagcctgaccaacatggagaaacgccatctctactaaaaatacaacattagctgggcatggtggtgcatgcctgtaatcccagctactcgggaggctgaggcaggacaatcccttgaacccaggaggcagaaggttgcggtgagccgagatcgccccattgcactccagcccgggcaacaggagcaacactccgtctcaataaataaataaataggaagagttcaggtgctgtggctcacgcctgtaatcccagcactttgggaggccaaggcaggaggatcacttgagcccaggagttcgagaccagcctgggccaacacagtgggaccctgtttctacaaaacaaataa

SEQ ID NO: 98757 - DNA, 1027 bp, Homo sapiens
ggcttgcagaggatgggcacagattccatctactcaccatggctggcaagggtcccctgttggaaaggccgctgtccctcctatgtggtcaccatcttcccttttcttttccccacaggcttcttcagccctcccaaattgcccttgccctacctgtgctcccagaagccctcgggcatgcccagtgcaccatgggatgatgaaattaaggagaacagctgagtcaagcttggaggtccctgaaccagaggcactaggattaccccagggccatctgtgctccatgcccgcccatccccttgccgcctgactgggtcggatggccccagtgggtttagtcagggcttctggattcctcggtttctgggctacctatggcttcagccttcagctcctgggagtcccagctgttgttcccagcaacgtcgccactgccctcctactctccaggctttgtcatttcaaggctgctgaaatgctgcatttcaggggccaccatggagcagccgttatttatagaactgcctgttggaggtggggagtcctccctccattcttgtccagaaaactccttagctctcgcagtgagccatgttcttagtctccagggatggatggccttgtatatggacccctgagaatgagcaattgagaaaacaaaacaaaaggaacaatccatgaacttagattttattggtttcactcaaaatgctgcagtcatttgacctgaacttgtggcaagagacttgtgctttctaaattcaaagactagaaggaaaatggataaaaatcacaagtgccgtttctcttgcaatgtagcgctattctactgaaatttctttcttctcttttctttacaaaatcataaagaaaaaattaattcattacttatatagtaggtacaactcagcctacaaactctaatctgcaagaagcataactttatttttctaacacagaatgtaatttctattaggaaccccgtttcagcaggtggtagaaattaatctcagtcaattcaaagtct

SEQ ID NO: 98758 - DNA, 1061 bp, Homo sapiens
gcgagggcccgggcttcagtgcgagcgcggcgagcgcaacggcggcggccgggaggcgagggatccggcggcggcgggggggcccatcccgggcgaggagggcgcggcggaggcggagagcggacggggcagccagcgcctgtgtctcctgcggagctcgctcgggagaagaaatcagagccgggggcggaggtgggaggggagcggggccgaggcgggggcggggggcagggggccggagggaggtggcagttgcgacagtcaggcagcgggactctcgggagcgagccgtgcgccccggggcggctggcgcggagcgcagcggagggcgggagcggggtgccggggcggggccccagcgcgcttcgggctgtgggacccgcccgcttcgccccctcgcctcgcctctctcggacttggagccccccgccgctcgcggccgcctggagtcgggggcaaggaagggctgggaagaagagtagagaggggtgaggggggagaaagaggagctgaggaatgggggacgggctggaagggagacgtttgacaggtttgttgactgtaaagagagaaaacttcccaggaatgagggagtttggggcggggggcggtgcggagggagatgctggcgcggaggcaagagaggaagttggcctggggcgcggggtgcttcggcgagggttgtcaaactggaccgcccgacaggcggatgctggaggggtcatctctttccgtgtccctgttcgatgcctcatgccccttcgtcagcctctccttgaagaagggaggaagccctgggcctccgctctcgctcccccagccatcccacctctcaagcccgcgttctagggcggggaggtgggggaaatgagagggcaagagtagccgctccagggcgtgcgcgcaagcgctggcacttgtaagcgagcgggagaatggaggtcgcagactttcaagagatcgaggggtcagaattcgctttagcccggcctcgcgtgtccaagagtccctgcctcgagttcctcccccaacctggcccgggtagaaggggtgggagagcc

SEQ ID NO: 98759 - DNA, 1112 bp, Homo sapiens
aggggcgtggcagggggcattgggcaaaacaccaagcttcgcttccgatctctggtttctgtcaactctgtgtgggctgagccactctgatcaagtcattcccctttgtgggcttcagaaaaactgaggagttagcatgagagactcacgtaccccctataactttggcttttgacaacacatcaagtaataactcccccatccccactcacctttcaccttcctcgctttatgcttccttagggagtgaactctgcttttcaggcctttgggtcagcattggcctaggatcagcccagagaagatgtgctcctttgggagaatttgcatgttttggggcctgaagcacagtggtagtagggaatacacaatatataggatctgggatcctcatcaaacagccattcctgggcatagaaaaaaatgaggctagccctaaaagaaatcagtatgcggacaagaagggacaaggcaatggatggtcattctaaccggcttggcctgcgccaaggtctctctaccaaggaccatggttggtaggatcaattgcctagggaggtggtatcaggggccagccagtccctattggcaatatgtgtagacctaagccctggatgtcctaggtttctggcctaacctacctttccatctcttgagtcagagggccaagaacaatgtcagagatcacccagttcagccccacccacttcaccctcgttatgcagatgagcaagacaggaggcgactgactctggccactggtggagggatccctattgcaagacacagtagatgaatatttcaaacataaacagtgctggagggaaatgggcacgtgagatatcagaagacttccagtggcctcccacaccatcctccacacagccccgtacccctagcaaggttgattaactctgaatctattccagataacatcgctaaaattctggattcagacccaccctaagtcatcaaaatcttagcatctctccaaactcacctcagatcccacttgccctaaggagcctccctgggccccagtccccacagaccttcctccatgcatcacccggggcgcctctcatttgggggcgtctgttatcctgccagtg

SEQ ID NO: 98760 - DNA, 1002 bp, Homo sapiens
ccaggagagggctgcacacaccctagcccaggacccaaggaccttcccctgcccctggggctgctccacgaagagccctgctgtagtccaccctctccctaaacctgcctgggatctgtccaacgccatctcgcccctcccccttctctctctgtgccacggactcgggctcagcagatcctttggggcctctgggtagttgggtgacataggggcactagagcgggtggtggtggaggggacaatccagcacctctaggaacatgcagtttggagggacttctgaccctggttcccatctcccggggctgcctctgcctgagctgagggccacctacctaccccaccccagctgatggaagcgaggatgtgggattctgaggtttgaggaaggtggtgaaccgctgtgcctgggggcttgtccttttcagtcagtctgactgtctcagacgtttttagactgaaagagggaccaagggagtgtcagggagtgacatctcaggatgtcagcagcaccacagagatccgaggagtggatttgaggctccatggtggccctcagcttcccccgcccagattttccacacctcagccttggctccaactccgtgagggcctgcatcttccccagcatgaccaggagcccaggaaccgggacaggaggctggggagggcctagcccctgcgggaggccagaccaaccgttcactgagcaaatgggaaaaccaagaggccgggaaatgacttgcccaaggccatagaagtcgcggggacagaggcggactagaatccgggtttccacctccagaagggtttctgttctgggccacggcccccttcgccacccgctggagccggctcagcccgtattacgacgcagaatggagcctggcagcccagaagctgcgggcagggcaaggcagggcgggtggggccggatgggagccggatctcccctggagcggcgcacagcctctcccacccgtacggttgagatggcgg

SEQ ID NO: 98761 - DNA, 1584 bp, Homo sapiens
gttggaagcaagctgtttgtgctttgtgtgcttctggagagagtagcagctttactcttcactgttatacttgccacccaaaaaagagggtggagagaatgaagatgaaaccttggcttcttgggtaggtcctgaagaattggagagtaaaggagagctttgagaagcaggggctattttggggaggtaggaagacaatacctactgagtaggcaccctttaacatatcatcccatggaatccttccatcagcctcatcaaagtagctgttggtctcctcatttttctggtaagggagcagaggctaaaaggggttagtaacacacctggtaactggcaaagccaggatttaaacccaggaccttctgatgcaaaagccatgctgcctcagtcattgctagagaccgaggagttggctagtgtggtgatgggggacagtgaattacccacaggttactgggtagatttctgtgtctccctgatctggaccttgactggtcactgtattactagataatagtatgctttgggacgccagtgaagagaagttaatacagatgcttctcaacttatgatggggtcgcatcccaataaatccatcctaagttgaaaatagcagaaccaagcgtggtggctcatgcctgtaaccccagcactttgggaggccaaggcgggtggatcacctgaggtcaggagtttgagaccatcctggccaacatggtgcagccccatctctactaaaaatacaaaaattagccaggcgtggtggcaggtgcctgtggtcccagctactcaggaggctgaggcaggagaatcgcttgaacctgggagagagaggttgcagtgagcggagactgtaccactgcactccagcctgggagacagagcaagacttaatctcaaaaaaaaaaaaaaaaagcaaagaaagaaaatatcctgagttgaaagtgcgtttttgacttatgagactatccagagatagccccatcataggtcaaggagtgtattgaatgcctgtcactttcacatcatcagtaaaatagaaaaatcctaagtcaggaaccatctgtaattagatcagacctagtttctctatgtactttatcattagggcacttcttgagtccacttagcactcattggagtagggccaggcaagagaagtctcaatgtgccttgcaaagggaaggaacagacatttcttgggcacttactcgattctctcatttaatcctttcacacattctgtgatgtaaatgttgttagtcttgatccctcagtgcctgactcccaatgtctctctcctttccctcctctctctctcaaaataaaccgttaagtatgatggctttcccacagtgtcacagctagcaaatagaagaccaccttaggtacaaatccacatctttgagaccttaaggccagaacttaaagtgtatttcttttttttttttctagtaattttttttctaattcctgaatagccttgcttcttcctctttgagtgagaacctactttggactttcttttttaaacctttatactatcctcgcatgttgggttcatctttccttctgactctc

SEQ ID NO: 98762 - DNA, 1810 bp, Homo sapiens
gaaaatctgtggtatgccttttatgtgttaggtggaaaaagagaaccactatcttaggcagtctgacagggcctgtttcctcctggcctgtgaattgcaggcagtcctgagggctaggaggagatttgatgtttttctctcctttctcacctttgcctacctcatatatactcccaacccacgcctccttgcccctcccctttcctttattctctgccagacaccagcccgcctccagcacgcagagtctgcctgcattgtgaatggttgtagttgggacacagagagcccttgatgcagcaagtgcttcttgtgacatcagctctgtggctttagggggaaggctgtggctctgggtccccaagggagggggctgtttttctcttcttgatccttcacgttggtgcccgtctgacttataaactttaatggccagttttaaaggttactgccatggggcacctttgttgccagttttagttttttaatttggaaactttttttttatcctttgtggtcttgggaggaaagatttgggaccatttggggctgggaattggtatttgtgagtgatgatgagatagcacagcagcattctggttctggctccaataaccagaatccctggcatattatccagttgcccaaatgaaccccaaaatgagaaggaaaagactggcattgagatgtgtagtcttaggcagcatcagtcaaggatgtagagggttgggggcttgttgttctgtctgagaatggtaaccatagtttaggtgctggggcactggaaaaagaaagagatatctcactcttattctaagtctcttaactcttctttcatctctagtcccaatcctttgttctgaatatagatgtcattgacagtggttaagtttaattgggatgggaacaagggttcagatgtagaatacacaggggaatgtggcccatggtggtttccccactgtagcacaggtatagaactaacagagtaagcttcactgagtctttttgccattaactcttataccttagaaaaacctttttttttttccacccaggataacttcacaaagcctcatatgccaaaaaagggtcattgcccatctcagtaatctgtatctctagggggaaaacagtattatagaataatactcaaataatagcatcttggaatcagaagggattatttatagcactctcataaaactatcttattcaggtcctctgtctgaaactaagaatatgtggaacttaaaatgtatttggtaagtgctagaaaagaatttttagaagtttagttctgagcgtgcctcctgcctgggtacttttttgtggatgactagagtagtaacacaaataaatggacagataatctaacaaatagaccctaggaaaaggcaaacacatgaatccaagggtgcttagatgcttgctcaaagacataggctctttacttaactgttggctggtgtccttgatagccaaaacctatctttcactctctagcatttggatggattagactgaactcaggattcaactctggatgaacttagagaattcaggaaaggaggctgctgtggaaggacggacactcagctcttcaagatgtgtggaaggagggcagagccttctgacagttttgatactgttcacaaggcatataatacagggtcttggattcagatctcactcctggctgttcttcctgggctggacaaagctagattttcttcttgttccctgtgttacagggcaggggaggaggtgtgggggttggctcggggctgggccacaattagtgacctgg

SEQ ID NO: 98763 - DNA, 1748 bp, Homo sapiens
agtgaagaccataggaatggtacagcagcataatatatctaagtcattgctttttgggtgatactgcgttcattagtgtttgatgacaaacactagatcatgtcctctcggtgctaaattcgaatttctgtgccaaaccaagaaagccaaaacagtgtgatatagtaatttcaaaatatgtggactctattaagtagagaaagggtttgttgagtatttgtctttctcaaatcggccagactcttggagaaggaacgtcacaaagagctgtaggactggatataaaaatcctatgagaatgttctggctagttagggtccaaggaaacaggagaagattggagcactggatttctccagtgtgctccacaggaatactctctttaatagaaattatggtttctcttctcttagattaaattcctttaggatttatggtgaattaaggaaggtagcttgaggtccactcaattcaaagatctgttctactcagttgtcatgaaaggacagcaggtggcgccaaaacattgtcctacttgtgctgggccaggggcagggtggcggggaggactcaggtttgtgagggggagggattctcttctgaaatagggatgggggagtgggggattggttaccctggctgttgctcaggtaagaaattattgtgggcttaatgtcttctagctccccatcactggaatctctacccttaacgtcttgatttgacaggaaggttgatggggagagggggatcccagcaatccagagtggaagacagttcactttctgtccctggcaagactcctttagggccaattccaccagatgccatagtttctacactattgtctcattctgtgagcctctttttcttttctgtgaatttgtttctgtcttttgacagatttccatcttgaaatacttttcttgcttcaggacacttctttacagataggtttctttttttcacttgcccccaactcttatttctccgggagactgggagtggggttaagggagtgaggcatggagaacatcggctcctcgactaatttaaactgcaggtactggttgggatgcagaggaagacagggaaagtggtttgttagaggtttgttggtcctgagaaggaagcagagcactgtcaagactgtgggacaccaaagcagatggttcaagtccccccaggatctgctgaaactcagagtctgccctttagcatctgtctgtgtgctggagcgggccccagctcccaccagccgccattgattcccacagctcagtcattagctctcttccagcattgtctctgacgcccctaatttccccactcccttcataagcccgccgggctgtctccagccttcattccttcagcttgttccttgggcctcccccttccctggggcgggtttaagggctgggcggagctgtccgcctgaatcccctgtggcccctttggttcctggttctatatatatccctgtccttctctgcacagggtttgatacggctttatgggcatttccatccgctttacagacacagccatcacagaggcgtgtttcacccgagaaacctcagcggagcctggcctgtagcagactcagtctggccccctgaatcaaggctctcttctcttcctgccctccctgtccctccccctccatcttcccactgcctacccccaagtgaataacggagctctggggagcactcagtctccttggcagagcattttggacccca

SEQ ID NO: 98764 - DNA, 1346 bp, Homo sapiens
ttcaaaacggtcagatatgctggatggtgagaactcaaatttagctccagaatggaaccttttaaagcttacattccactcattctttcaactgatgcccgctttcctctgcttcccagccttttcaggcctaggctccacagttttgctgatatcaattctttattcctcttccctactcctcccagttcctcacctctttctttgttaaccaggaagaagtcagagacggactgttgtagagggagtgaacagtaagccatgctgatctaggttgatgacagctggcctgatgtcccaggctgaagtctttgaggtttacccagggtggcgaatgctgggggctgccattgctagggttattgctaacaatttcgattcctcctatttccttctccctctctctacctctgcccccaccgccaggattctataaatactttattatatggcactaataaaacttcaagtatttctttttattagagctacataatatggtaattgtgtgacagaacacagcgcctgagagtagcccccaccctcttcctaggtgtggcctctcaccacctcagcttgggctaggcctacaggcctctctgttcctcttgagtgtgggtaaagggggtcggatcagcttttcaggcagagctaaggggtgaaggcctttgagtaggatcaggctagaggagtaaagacgcacttttctagttttaaatgtagtctgtcttggtggatgagtacagcaggaatcttattagcattaattccagccactgcatggggttacttaacctgcctttccttttaatagttctgtcatgtgacatagaagtagattttgaacttagacccagggctaggcgtacatgggtttctttggttaactttgattcacagtactttttgttttgttgtttttgtttgtttttaataatgatcatcattctttctgatgtttcctgggttgaggatctgtaggtggaaaaagattctgactccttctgtctctcactgcatcagtcgtagaatagctttccgcttaagtctcagtcattgttttctgtgtccactagtctcatgggagggtatggggctggaaactccagtctatagaactttacttactgttaatgtgtgatctacaaaatatgtctttgttgcctaattgagccttgtaatttgattctggtttttgtcctatgtgatctgactgtcaacctttcctacccctctactgtagctattgaactaggtcagtgtatccctaccagtgtttttctgaattgagtatgatttagcctctacatcctaacttctccaaagcttgagaattggggattcct

SEQ ID NO: 98765 - DNA, 1020 bp, Homo sapiens
gccgttccctctggaaacccccttccaccttttcacttgggtaactcctgttcattgtttggatttcagtgaatatgttacttcctctagggaattctccctggccctctgagttcagtttacttgcccttcttatatgctattctgtttgctctatcgtaggccatatcaacactgtactataattactggtttttctggctcctcctactaggtggtaagttccccaagggcagggatatgatgtcttgtttaacttgtctgatccattgtaaacactcagtgaatgtttgtactactatgaattctgcagagaacttttgcctttttgatttcatttgattcgcataactgcctggtaaaatgagcaggcttccttgggtaaagttcaacacaaatatattgatcacctactcagataaaaagaagaccaaattgacataattattattttgaggatttgtttgtttgttttgaaagcccactagggccacttaaggatgaggaggtacgatgggttggctcagagaaattgaacggcctcgagttgcacaagtaataggtagaaaacagaaccttgtcctttgactttctagtgcagagcttttccccattatcccatgctatcttagaggctttgttgtaatgaaatatatttgaaaagggagaaaactcagtaaatagcgttcctgtaactcatcctaaaatctgcccattgaaccacaggttctgaaattacagaaaaatggcaaagtcccaaagtggaatatcattacacagaaggtcaaggaaaaatgttaggaccatgaaacatggaaatgagctaagacacagttggagggaatcctctatcttggagaaggatctaagaaacagtgacattttcagctgccaaaatattttccttggggctaccctcagaacagaatagccaagtgggatgagagcagaactggggggatacttgctggcactcttccaactctagcaattcctcagccacggaacaagtaaggcaga

SEQ ID NO: 98766 - DNA, 1068 bp, Homo sapiens
aaagagtaagctcccttgattaatcagagagggaggaaggtttgctggtccccaaggttcttgatttatcagagtaaagtcataggtgggacttgctagtcccacttctcagagctcttggagaaaatgtcccaaagtctttcatcttagattagatggcaccttcatgtgagtctgagagttgagactcttactctgtttatacctccaagaactaggctcccaggtgttggatttttgatctttggttctaaacttcctagctaactccttggaagtttagttttgacattctgcatcatgcataggtgcactgttttacatattttagtcttgatgataactggattcttgaagttgaggatctaatgcaatcaagtaagtctgtttaggtaaaaatagttgctcagaatattctattgaagcctcaaatattgttcttcttgggcacttggttagatgatgatcttcttggatttagtttggtacagcataccatggcctttgttagagtggtattccaagacttaattttacctacaactctagggaaggggccaaaagcctttgcttttagaccaaaccatatgggggatagaaagtaggctataggaagtgcattggaagagttgtatggactaggtactgggtcattgggggtgaagttcttgaagggtgacctaggctggcagctacctatggccccacagtggccctcgaactgaggaagtggtggaaaaggaaaagcaaacaggggttgtggtcaggattctggctggccggtcattggccaggactctcctatttgtgtgtcaggggtggttgggcttctcctgaggccgggcaagaacgtgtcaaggagaggcttcttgcagctcttgttttcccaaaacaaaggaagctccttgcattgctggaagtcgcgtgcttggatgctgagtttgttattgcctgataacctggccgccaactcctgccctcctcttcaccccatgcagtcagtggcttggtgggagcagcttcctgttcctcatccgaggtagcagattcactatctattgtacccag

SEQ ID NO: 98767 - DNA, 1048 bp, Homo sapiens
tgactaagagagatttcttaggccgtttttctcttagatagcttcccctgtctataagtttaggtatcaaggctggggataacatgctggttccctgcctcatccccttagttaaacaatgcaaggcttgttcttagctcagtagagaggtctcttcctgatctagtgcctgcatacctctccagcttgacttcttgacatttttctctgtgtactttatgccttagctatatggaatgacttttaatttgccccaatgctgtttcatcttgtctttagatacacattcttcccatgatctagaatgtccaatgttctggccttatctaacttgcaaacttctattaatcttctagatgtcagcttcaccttgtttgggagaccgttctgtactctgcttgtaaagactattcttcttccctgctactatagtaccttggattatacctctgttttaccacttataacattgtaatattactgtttgtatgcctgcaagactatggctttctcctccactgatctgtggactctttgaggcaaggaccatgctgaatgcatttctatatccccagcactgtgcgtggtgcctacaggtagtaagtcttcaataagtttggattaatattttgataagtctatgctagggggattttatacagattatgacactgtggcctgtggatacagtgttgcttttttttggctggagtgcagtggggtgatctcggctcactgtaatctctgcctcccgggttcaagagattcttgtgcctcagcctcctgagtagctgggattacaggtatgcaccaccacacctggctaatttttgtagttttagtagagacagggttttaccatgttggccaggctggttttgaatgcctggcctcatgtggtccgcccaccttggcctttcaaagtgctgagattacaggcgtgagccactgcacctggctcagtgttgcttattagacctatatttggggtcttcagttattctcatggctcattttgcagctttggataaatcacttctcatttata

SEQ ID NO: 98768 - DNA, 1047 bp, Homo sapiens
ctcccactactttttgcccacatgctctcagcccttcttctcccactgaactaggtgtctctgcatgatgcaccttcctcctctttcctaagtagccctgttctgttccctttccatcaggtaagaaactcatcctgtatgactcatatttcttttttctgatccttcttattacagatcgattgaagacagaaccatttgaagaaaattccttcttggaacaatttatgatagaggtaaggtatttgtcattttcttgtgtgtctttgccctacttcctctttccaggtgcctgagtggccatttgtgttttgggtgttaggtggcttgtgtggttggaatgccctttgtctgaaaaagttgcccatagaaagtctgataaggcttgagatgtacttagggaagatgagggaaaaaacggggaaagaacgtaagaggcggaagtggactgattgatatttataaaacatctctgttaaagtaccagggatttcatttggaattctctaaccttggaaaggttggttgaccagttattaaatttttgcttgttgagatctggtcgtaaggtctggactgtggaggagaagggtaggcgtcattacttgtctaggccctttcaggatcctgcaggagaggaaggtaaaaagcttagggctaccatttgggggctgtcttgtgggcacagtaggttgtggaaaatcacagtgtttatacaaggggactggcaaaggaatgaatggggagtagataattgtggcctgtcagaagctcctgcctaggtttcccttctaaggattgagctcagccaaaagaaacatctattaaatgccaaatagggaaagtattaataatagtgacctttgataatgccagtcaatattgatcttctccttccctccctcttctgtgacttgttggttgtacagttagtaccttagtattattgccccattttcttttttttttttttatttttttttgagatggagtttcactcttgttgtccaggctggagtgcaatggtgcgatctcggctcacagcaa

SEQ ID NO: 98769 - DNA, 1032 bp, Homo sapiens
tgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgcatggcctggacttttccttctgcggcagcccttgaagatttttcctccctgtatctgccttccaagcctccctgcttcctgatcctgtcatctcacaaactgttttctcagcctcatctcaggactttcctatcgtttgataggcataggcttccatttccaactttgttcctgctcccaggaccctgggccctagcactgctcaacttgggatgccatgggacacacatggtgactgtcctgtccctgagttggccttgtctgtcacttgttctgggtaagcactctccttgtggatcccaaagcacatctcgtggagaggggccaggccttgtaaccagcagagccttgtgagctcctgagggcaagccacga

SEQ ID NO: 98770 - DNA, 1026 bp, Homo sapiens
tctgggtttaacaggcttcccagtgtttcctggtgggtcctgagtggtatgagggtgccactgggctggctgcaggacagttgcatactcttgtcatttctccacttcccccagtgtggctgagcagcagggacggtggcgaggctggtacacctacacagacctgtgtgtgctgctggagcagccgacctggcagttggccctgggctccctctgccagcggctggtaaaggtgaggaggggctcggaaggatagggagcttgagcaggccggtgtgtagggtgggatggtgtgaagtgattgctgaaaagcccaggagatggggttgggaatagatgggcagagtggggtgtaaatggctatagagacctccaactggaacacagatttctagagacaaggggtgaatgtgttaaagacagattccttctttcttatctcctctcctgcagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctctcgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgctcctttcacttcctcagcctcagcaatgttcccttttcagtgtcatggagctggctcgcctcaagtctttcgttttcccaggctaggtagggctgtgaggaatgcattaagagggt

SEQ ID NO: 98771 - DNA, 1048 bp, Homo sapiens
actgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgact

SEQ ID NO: 98772 - DNA, 1925 bp, Homo sapiens
cgtggaggtttccagctcggcctggtcgtcagatttcccgccctgggcacgtgaccaagccggctctgcttctctaatttgcattcgttgcctgcaccattccccccgctcccccctcggagacatttggccaatgggagccgtgggtaggggctgtgggcggggctacagccgtggagcgcggtgcgagtccaacaccgagcattcccgtgggcctgcagttggcaggagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgaccagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctggggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggtgagggactctgtgggaagggggaagcctctgctggccgggcttgggagaaagcactgcatgtccagtcacactgcttccaggctttaggatgcctctaagcaaagggagaagggaggggctgagtcctgccgggagctgatagccagctggtggggtgtgtctttgctgagtcactgtggttttgcttttttttttttttttaagcctgtaagtgctgaatgtgttcatgacaccagtccccggccctattataagtagtaatacaatgaaattttatcctcaatgatactctctccacttatatttcattctaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccaggtacacctcagtttctttttttttttggagacggagtcttgctctgtcaccaggctggagtgcagtggcgtgatctcagctcactgcaacctccacctcccgggttcaagcgattctcctgcctcagcctcctgagtagctgggactacaggtgcatgacaccacacccagctaagttttgtatttttagtagagacagggtttcacagcattggccaggatggtctcgatctcttgacctcgtgatccgcctgcctcagcctcccaaagtgctaggattacaggcgtgagccactgcgcctggcctctttttgtttttaagacggaatcttgctccgtcacccaggctggagtgtagtggcgcgatctcagctcactgcaccctctgcctcctgggttcaaacaattctcgtgcctcagcctcccaagtagc

SEQ ID NO: 98773 - DNA, 1708 bp, Homo sapiens
cagcaactcatactccagaactgactcaggcttggtctagcaaaaatacttcaggatagcagcgtctctgccaagactccttcctcgagggccacctctcctccccttctttttccccaccaggattcaggaaaatggctcccttatcaccatcctggtcattgctggtgtcttctggatccaccggcttatcaagttcatctataacatttgctgctactgggagatccactccttctacctgcacgctctgcgcatccctatggtaagactgggaagttgggcagttagcccatagtctaagacgtattgggaggtgtgggtgtattcctgggcatcagttatccttatctgtcattgacaaatcaggaactgtctcttaagctcacaacccctgaatctcacttctaatatagggcaaaggggtcgaggcaacaaccccaccttccgtaccttgtctcttccccaccccaccccgcagtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtgggccagggccacaggcgggagcaagccggctagcattcctgggaaaggcatacatctcaccatgatcctgatcccactaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgagtggagttggagttagggcctgctagagactggctggtagctcggtggtgagggctgggctccctcctgctcgcttgtgaccttggtcccgcccttttaggtgttcattttggaagagttgctgagccccattgtcacacccctcatcctcatcttctgcctgcgcccacgggccctggagattatagacttcttccgaaacttcaccgtggaggtcgttggtgtgggagatacctg

SEQ ID NO: 98774 - DNA, 1272 bp, Homo sapiens
ccccgccggcggcgccccttcctccgttacccgccgcgagctcacttagggctccgcaggcacccctgggcaaggccagacacggggcctgggattccaataaccggtctcacgtcttacctcaggaacagcgacccgggtgattccagaggctccgccggctccgctcggctcggctcggctcggcgcgacccgcggcgctaggccgggtgtctgccactcactgtcacccgcagccaggctggccaataagcacggggggcggagacacaacggccaattctcggcttcagggacgggactaaagtctcgaggcgggtcttggacagtcagcggcccaatagtgtgctctacgtggggcggggctcaggtgcggacgccgccggttgtcctcttcgctgctccgtagtgacggggattgttgtgttgcagaaatccggcaatcgacctgaggacttgcgagccgctcagctcccgggacgtttggtgcgtcttctaagggcgtgggcgagtttacgcgggccagttgttgctggtcgcatgggtaacgaagaaagttcggctaggcaagctcagtgatttttaactctgttggactcgatttgggagccgaatgcctatttcattcttttgtgggctgagactgggggtttgagaaagtggacgggggccaaggtattcatctcacagttggtagcaggatgagagacgagaagtcttgcggtgcaggagaaaccaagtcaggcaggcaggagacgcagcagtaggatctcgtttgcaggagccctgtttcttacacgctttctactccaggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggtatcctggaaggtttcgtgtgaaacgtgacagggctccttacagcgtattgcccgttcagggaacacattcttattggtattcccgagcttaggaggccaattgatttatctttctgcttgattaaattcacttaatctctgggtaatgtccagcacagcccttgttttcaaacaagtctttttgccattgcatgtatctcctcacgttaacaccattcccttcaaaaacactttaaactttgtagagataaaattctcagatgtattccacatttaacc

SEQ ID NO: 98775 - DNA, 1051 bp, Homo sapiens
tcaaccttagctgaggagaagctagcgcaggtttctctcaatgcagatgtagctgggctgcagtccaaggcttagaaaatcctctggatataccaatgagaatggaggcttaggttggagagaacaggaaggtctagggaattgggatctggagcaaaggctcaccatagacatgcaaagtggtcagcttatggagcacacgctgtagctcttggaaggtgggtctgcgggtggcgagggggatatcccaaagtcggggatcccccctttgcaggggtgctcccttgcctccaaagaacaaagaccggccagagcggggagcacgcaacagtattgtaccagcctcctccagcgccttagcccagcttggccctgccagcaggtcacgaacatcctagagaagagagtaactcagtcctgcataccttcacttgctatttataaatctccaactaaaaaaaatggcccacagaagtgcaaggggtggaaagtagaggataacacggagaaagaatagaggactaaggctcctggggaatccctcatctacctttgtctacctataatgaaaattggaaggatatgagtcaaaaacctccctacttaacagtgagttgaacagagatgcaaaaaaagtatggatcagtaccaccagatctaaaaggcttaactcaccttatatagtgtggcttcattgtagcgcctcaggttggctccagcagagtgtgatggcccacctcgggcatcccgaagcccctgggctgtgccccgcttggcccgaaccgtatagcggtgaaaagttttgtgtgtcaccacttctcttctgtagacagcacagactcagtactggagaccagctggtgctccctggctaacaggatccactccatccttacccccatgcagcaccctctcacccttgaaatatagcaccagcaaagtgcccagctgcagccatgagcaccacgcagtctctgggacctctactttgcaggttctgtagcagcagttctgcctcttctgggggatccttgatgacagagaagcatca

SEQ ID NO: 98776 - DNA, 1240 bp, Homo sapiens
tactccctagatggatttcacatgtcaggtttttccctaggttcagggtcggagggagaagatggctttcaggtagagttggagctagtggagttgactgtggggactctggatctttgtgagtctgaagtattgcccaagcggaggaggagaaaaaggaataagaaggagaaaagccgagaccaggaggctggggcacatcggactcttctccagcaaactcaagaagaggagccttccacacagtcatcccaggcagttgctgcccccttgggccctttgctggatgaggccaaagcccctggtcagccagagctctggaatgcactgcttgctgcttgccgagctggagatgttggagtgctaaagctgcagctagctcccagccctgcagaccctagagttctgtctctgctcagtgcccccttgggctccggtggctttactctcctgcatgcagcagctgcagctggaagaggctcagtggttcgtctgctgctggaagcaggtgctgaccccactgtgcagtgagtaaaggtccccatcctgagtcattttgggtatagagaggataatttggaggttaaagttggcattggctacttggcaatattcccttggtctggttgggtgatgttgggaaaggcaggaggcaagttaaacccatttttggagtttttgcacctagggactctcgggcccggccaccttatactgttgcggctgacaaatcaacacgtaatgagttccgaaggttcatggagaagaatccagatgcctacgattacaacaaggctcaggtcatctggaataggaaggacaagcagagtgggaaggcatcacagatcctggctagatcctttctacttcttgcagttttaccaaagataacttatagggtcttatatttgaaatcctccaggtgccaggaccattgacaccagaaatggaggcacggcaggctacacggaaaagggagcagaaggcagcccggcggcaacgggaggaacagcagcagaggcagcaggagcaggaggagcgtgaacgagaagagcagcggcgatttgccgccctcagtgaccgagagaaggtgaggctggaggttctcttgtccatggcaaggcttcctagaggtctaaccccttccccagcgtgcagctgtcacctcttgggtgccctactcgccactggggccttgtccttaacacaacttgtctccctcagagagctctggctgcag

SEQ ID NO: 98777 - DNA, 1018 bp, Homo sapiens
cccctttggcccacagtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaaggtcagaaagactcctggttatggagggggttgcagcagagccacctactcaagggctgtgtgagcagtccagcatgttaggaagcagggaccatgtcctgggtttggccactttagattttgagtttgaggtgtgtatcatgaaagggctgataggctttgacatagggaagggatcaggcctaaggagcagaggctccaaaaacatctccaactgtagggaaacttgtgttgcagagaggtacgctgtggaatgagatagaaaggctgaaggacaaaggcaacttcctgaccgaggatcaaatcctttggctgctgctggggatctgcagaggccttgaggccattcatgccaagggttatgcccacaggtcagtgggaggaccctgtgtgcttgctggggcccagaggaagagcctcaccaggagacatgggaggtctctgttctcccaagaaacagcctgtatgattcttttgcttgctgggattccagccttcctgtccagagatgctcataggtcacttctacttctctacagagacttgaagcccaccaatatattgcttggagatgaggggcagccagttttaatggacttgggttccatgaatcaagcatgcatccatgtggagggctcccgccaggctctgaccctgcaggtaaaagagtctccaggttccttttctcacctgttccccattcccaccccttctggtgcatgtcccagtttggtcacatgaccatgacctgtgccccacttttgagctctgggatcactgttc

SEQ ID NO: 98778 - DNA, 1745 bp, Homo sapiens
caatgtggacctgacagagttccagaccaacctggtgccctaccctcgcatccacttccccctggccacctatgcaccagtcatctctgcagaaaaggcataccacgagcagctgtcggtggcagagatcaccaatgcctgctttgagcctgccaaccagatggtaaagtgtgatccccggcacggcaagtacatggcctgctgcctgctgtaccgtggagatgtggtgcccaaggatgtcaacgctgccattgccgccatcaagaccaagcgcagcattcagtttgtggactggtgccccacaggcttcaaggttggtatcaactaccagcctcccactgtggtgcctgggggtgacctggccaaggtgcagcgtgccgtgtgcatgctgagcaacacgaccgccatcgccgaggcctgggcccgcctggaccacaagttcgacctgatgtatgccaagagggcgtttgtgcactggtatgtgggtgagggcatggaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgcacggtttcttgttccctctgagtgcttgagcttctgctgccttccccttcatgctgctgctgctctgtttgctgttcatgacccttatcccttccatcgctgaaggtgagacctgcaaaggggttcttgccaggcccaggaagcataaccccagggactttaaattgaagtcctagggttactcagtatagggaggaaatgaggaccaaaatccaggcacaaactgttgaaggatgagtcttcagctcctttccaagtaggagtataatccagtggtttctgtctttgaaagttagactgctaccctgttcttcctgctgcctctacatttaccaactctggaagcaaggcttggcccaggctcctctgtgcattatgagggtttgggagtggggctgggctggcccagagttcctgggcatggagccacgtcataagcttgggggatgggagggaacacaggcgatctcctagagttgtttgtgccactgcacctctgagcagctttgcatagcttcctgtcttgctgctttgctggagctggggctgtgccattaaaagtcaggtcatctcccctctgtttgtgatttctttctggcctcagcctctgtgctagctagtgggagactcctgctagggccctggggaaagcttcaactttgctaacaggagccccaggccccatgctgatgtcatactgtggggtagacatggttcgggggaggaggcttggatcacaaaagagcaggagatgccaaccctgcccttgcctttcctccctggtgattcagggaacagagcccttccctagggaacaggtttgaagcccagctaagacagggcccctgtttactcagcagagtaggcaggaagtggcagctggatactgccacaccacactgcctcattaatcattaaccatgtatgagcttgaacgatcagggagacacaggccaaaacagctgccgctgccacctccactcccctcgcccctaggctgaggatgggagacctgtaatctacctgtctcaaagcttcctcaggtgtctccacccagaggcccttgcctagcaa

SEQ ID NO: 98779 - DNA, 1112 bp, Homo sapiens
atttatagcccaggagcgggggccgaaacccaatccccgctttgggctgggaaataactgtaaagactccagagggagagcggatgtagggctgggctgcaggatggcgcccatcctgcccgggacaaggcgggtcacctctggggcctcaccgcaggttccacttcctttctgggtatttggaaaccgtcaccccgccatttcggtgtgggaagagcgcgcgggccctgccggactttagtgctttaggggttaatttcgggctgacagggacggagcctaaggcagtgagcgccccagtaccctcaaaccttattgctggcccctgctgtctgagcttacaagcattaccgccgctatttccgtgcgggctgacacgggagatgaaagtggtgaagacacccagggtgcgggggtggaggtggggagaggagccagatgggattgatccccagagccagatgggatttaaaggtgagggaggagggcatcctgatggcgtgtggtcagttgatgccagattggatggctgagacacctctgcagcttacaggaaagaaagagggaaagggttctatgaattctagctgttcatactcaaagcaaataattaatcaagtggggggggggcctctagctgtaaacccatacctctaggaaaccttttgtcatgtggagccacagtgctcacttgacagattccccactgagaagtgggctaagaggttggcctgcattgctgggtgcctccaggtggggagtcctgtacctgggagcccgggcaggctgctactctcttctcacctctgcccagccccaaccctccactcttgccaactgagtcatcctagctggtagatgatagggtggaagagagactcgcaaggtgaggacttgtggatgtggggctcatgctgtgtcccctctctctatccctcagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctg

SEQ ID NO: 98780 - DNA, 1087 bp, Homo sapiens
tttttatcaggagaaaaacctttccttgaagcgccctagcagacttcccccttctatctcactagcttttgcctaaaccagtcactggagggagggagttaaatggccatggatggtttggactaacctgtacacacccctaggtctgggggaaagctgtcttcctcaagcaagtgcaagggtgaatactcaaataaaatcaggaccttgctagtgaagaattgggcaggggcaggcaaggctgttgagaagctctgccaccacctacactagtatgtccttcactttactgccaacccagctacttctcaccaccccctactaccatcccgttattcctagatgccttcagcagcctctgaaccagcttcctgcctctaggcttgaaaccctaatgcagtctccacacagcagctgcagtcatctctctgaaacacaagctaggcaatgacgcttgtttcaaaccctcctgttacacttatataaaagccattctccttccaaggcccctccacctctatgatctcatcttgtagagctctctcctttcctcactctgggtttttggacacactgggctagttcctacctatgattgtttgcacttattattctgtctgtctggagaactggtttccagatcttgcctcgctgactcctcaccattcagccctcagttcaagtgtcaccttctggccgggtgtagtggctcacgcctgtaatcccagcactttgtgaggccgaggcgggcggatcatgaggtcaggagatcgagaccatcctggttaacatggtgaaaccccatctctactaaaaatacaaaaaattagcctggcgtggtggtgggcgcctgtagtcccagcaactcgggaggctgaagcaggagaatggcgtgaacccaggaggcagagcttgcagtgagctgagatcgtgccactgcactccatccagcctgggcgacagagcgagactcgagactctgtctcaaaaacaaaacaaaacaaaacaaaacaaatatcaccttcttatagagtggcttctgttcagtctaaaatagcagcccctgcatatctttctgttccattat

SEQ ID NO: 98781 - DNA, 1973 bp, Homo sapiens
tgtcagtctctggacaatcctttgaacgtcctagcctgggaggggagcccatcccagagggagggtgaaatgatctggtctctttttgcagagcacaagcgggagatttacgaccgctatggccgggaagggctgacagggacaggtaggtggagtggtgaggcccaggaatggaggtggggcagggaggagaggggcagggcagattcttgcaatggaggctctctcaggctcctggctgtgccttaggtgaggtcccccgctcagggcaggatgcatgccctaagctctctcctcatcctgcctttccaggaactggcccatctcgggcagaagctggcagtggtgggcctggcttcaccttcaccttccgcagccccgaggaggtcttccgggaattctttgggagtggagacccttttgcagagctctttggtgagtggactctggaagcctctgaatggctcaacttccccctccaggcctgtccttccatcagctgggaggccctgaggtggaaggctgagaggggacgggaatgccacggacagaagattttgtggagctgggtccagtgagagccgggacagaacctcacgtgtgccagaacccccgtaatccaacagtgacacttcacagactcaccttattaaattacaacaataatacattgttagacttctatagtaacagccatgaaagcaagactcaaagcatcttgtgacaatattgttattattacctataaaacagatagtggtattttttaatgatagatatgtgccaaatattttacatttcgtaagtctctagtgaatcctgacaggtgggcaattttctccccatttgcagatgagaaaactgaggcacagttaatagcccagagtcacataacacatggcagagctggactcctagctgtgtctgcctgtcatcgcgtcatgatgatttgcctgtactgaaagagccatctgtcctccatccctcttccccctccttccttcctttattctttattgtggacagaattaaccagtgagtgttttcgaattcaacattaaaaaggaatttataaataagcccaactaaaaagcggaaaagaaaaaccctacccagttgcttagtggtttatacttccagacttgggctcacacacttttgaggggaaatgtcattaccagatgactgctaatctgtttacttgttgcagatgacctgggccccttctcagagcttcagaaccggggttcccgacactcaggccccttctttaccttctcttcctccttccctgggcactccggtaagttctgccccttcccacgtttgcaagctccgattcctggaacccctggcttgagcttgttgcttttccaagcctgtctcctgtgttgggagccctgcctccagcagccctgcgaggcggcctggagcctcggtgaccacaacaggcagcgcagtcttcttctaaccacctctcctcctcctcccttgtcccgatgccagatttctcctcctcatctttctccttcagtcctggggctggtgcttttcgctctgtttctacatctaccacctttgtccaaggacgccgcatcaccacacgcaggtgagagctccttctggggccatagaggggtgagaggtctgctggggagctgtgttcaaatagaaagttggctccttgagggcagggcccagtctgcgctctctactgcggtggccagaactgggaccagcgcctgcaggattctgtcactgctcgttgcctgaactgtgctgtctcccacagaatcatggagaacgggcaggagcgggtggaagtggaggaggatgggcagctgaagtcagtcacaatcaatggtgaggagcagctcccctacccagcccctggcaggaagccccagccccaacctcagcagcctcctccccaaactgctgctctctgaactcacttagggcttgggagggag

SEQ ID NO: 98782 - DNA, 1168 bp, Homo sapiens
tggtggggggtggaggagcagtcctgaatatttggacatatacttggagagccaggtgtggggacatggcacacaggggcaacggggacagctgcagccacagttcatctagagaaattcctggttgccttcccctgctcctgtttgccccttctccatccccagcctcatgattacccagcctttgcagttgtttcagagactcagccatgctcaccagggaggcagatacctctgccctcagcttggccctctggtccctccccattcccacccagcccatctctcttcccctgaggtcactcagtttctaaagaggtcaggcctgctcttaaccgctgagcctgcctggccccgaatagttctgccttgcaggctctctatgccctttcccccgctccaacacacacactttgctttcctctacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccaggtaagtccttgactctggtcccaccccaaccgcagtccctcagcccggacttctgctcttacccagatctctggttttccacagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccaggtaacaaggtcctcagcatccacctccctgtgagggct

SEQ ID NO: 98783 - DNA, 1050 bp, Homo sapiens
tttgtaattctgttttctcttacactgaaaaccttgatatctagcatcatattttcattttcttatttttttaccataatataaagaaaatcatttcaaaatgtcagtagcaatatttttaaagacactgataccactgagtgatttttttctgtgagtgtggatattaagcaagagggtgacaaggatggatacttttaaaaatcccccttcctgctgtgtggagaatggattggaactagggtggtggcaatgcagatagaatgggaccaattcagaatatattgtcctttggggtctgccatttagcattggctttgattttatgctccgaatggaccatctcccaggccccttcccaccctgcaattctaagatggcgtcctccttggctctgataagcacacactgcatgttgctcatgggtctcctgctctccctaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaaggtaacacccaccccagaccctctctggcagctgggctgcttcccctctagtgcctggattggttgctgggacaacatcgccatcacaaagtgactggcctgagtaatgggggctggttgtcatgctggggccatgtaggaaaacaagggtcctggccaaccacagtggctcatgctataatgacaacacttggggaggtgggaggattgcttgaggccaggagtttgagaccagcctgagcaacatggcaagtccatgtctctacaaaagagaaaaaagagataaaacaacggtccttattcttctcaaggctcaggggccctgacccaaagaaatggaaaatgaggggatgggaagaggggatcagggctgagaagactggggtggctgtcaagaacagatgaaacctcggtgcttctcttgctggaacatatgttgg

SEQ ID NO: 98784 - DNA, 1047 bp, Homo sapiens
agggtcacctctgcggagtcttccacagccaacttgttgtgccaggcatccaccgtgagccagggctcttctgggggccccaagacaggggagatgctgcctgtgcctccttagcacttggtgtctcctctgactcaacatagatctgcttattcgagggtgaccgtctctcctgtatctctctttgtgccacatggtgagcttcttcctttaggacagggactctacccagcccatcctcgtagccccagggctcagcacagagtaggtcctcatgatgcctgcgtgtgtgaggctgcagtctcagctgcataacagagcttgaacagctagtgctctctcatgtaacaacccaggtcagagttagcagtttaggaggggtccctgccgtcctgaacacatgacttccatttcaggattcagggtggccgttccagctctggccatcatgtctacactgagttagtaggaagggaagagagggcaaaggggcagtagacaccccctggctttaagggcatgatccagaagtgacattcatcactgcttacattccacagaacttagctgcaggggagcctggaaatgtcatctctagctgggtagttaagtgcttagctacaacttgggtgttctaaaagatatcatggacagttagcagtctctgtcatacacataaaagaaaattgaccagtgtggtggggcacctgtgctgagccccagatgtgagggtcacgagaggaggaaggggagcagtgcaggaaacccaccagtactgttaagaatgtgagttagtttggtctcagcccactgtctggtgttcagtgacgaccccaggttaggggtgttgctaagaacacccagtgactcagtggggttttgggccagttgggcaatgggcccctctcactggcttccaagatcaggcccctaagcccagattcccagagtcaggactctactgtcgccaggtggggtctgagagtgcacagggagcacagtcactgctgacagagctggtgctgcggcggatctcagcctcgtgcc

SEQ ID NO: 98785 - DNA, 1106 bp, Homo sapiens
tgtagcccctgctttctaagtccaccctgggctggggaaaggaaagtaagagaccacggggacaatttcaagccccccagtctccacaggggctagtccccctggctacctgcctggctttctctctcctgggctaggggctggggaggtctgcggggctcagtcctggccctgcagtatcccaacaccctgctctggggctgtctccagagccaaaggctagtgcctgaggtcacagaggtgggagggacagggccaccgctcccgcctgggctccatccagcacaagagccaggctcactcactgccaacagccaaggctcacagctggggtccgcagaggtggccggggcatgccctgtgaccaggcagggatgggctatgtcgctgttggggaccacgagggatggccagtgaggaggggtcagaggctgtgaggggaggactgaggctgggtgtggtgtcctgggatggaagaaggctggcttcagggagcagtgaggacaggggtgaggacggtctctggtggcagagggtctctgtctttagagcacttcatgctgctgctgtgtggcctcactgacgacctggggaggaagagaagcccagtccaaccatgtgctagccagagaatggagcctcagccctgagccatccccaccccagggccgcaggatctctcttgccccactagccagggacctagaccagcacagctgggtggaagacagtccccccagacacatccatagcccccaccaagggtaaggagcccagacagaccacttacctccccatcccgtgtctcgatggtcttgatcatcaccgtcttcttggtatggacctcagaacccctttgctcagggctggtttctgtaacagggtccatcgcacactcagcctgaccaagtccaggctgggctataccaggggctgggagtccatctggggccacattgggcagagccctagcagaccccaacccccctcaagacaggcttgttacttcttcaagactttaacacctttccttcagcccagcacccagcaggtggttctgcagtccccagcgcctgtcccatagtttagatggtctcaggagccaa

SEQ ID NO: 98786 - DNA, 1003 bp, Homo sapiens
tactcccaggaaccttttctcctaacctaaccactgggcatttttgaggacgattcaacagtagaagggagggaccttgaggaaggtgcctgtcacatcatgatgcagacagataaggggttggtttgcaaagaggggtcaaagcacaatgcaaatattgtaatagagggtgggcctgactcctaatgggaggcccaggtctgcggctggactggacacaagcaggtgtgtgtgtgtgtgtgtgcatgtgtgtgtgtggccagtggcagcaccagtaagtgccaaggataccagaaccactggggcagctggaataacaagcccaagtatgggggtccccagtgctgggcacatcccaggtatctccctccccacccattgccacaggacacctctggggactgggtgcctcacgccccttctgtcttgactgccctccatgccctgccccacaaacgctctgataacagtctgtccctgtctctctcctgctgctcctatggaagcgaagttttccgctcctgcagaaagcaaagttacggtaggaaactggctcctgctctagccccccgcatccccccctttcccacccggccccggcctctcctcaccctgcctcagctgcacccgatgccttgcagctggtttggggtagaggacaggctggccccgcggttggtcgagtgccctggcagtacgactctgaggtgactcctctttgttcctggggtactggaacccagactttagagccttggaacctaggacctgatgattttggggctgcacaggggcttaagctttcactgacaaggggaggagggagaagggaggaggctctgataatccattaagatattggcaggcggggagggggtggcagtttggagggccctacggaggtaaacgtgagtaaccaggggcccagagatggagccagggcactggcatgggaggggttatcctgagcagcccaggctgggcaggggatgtggggagcaaa

SEQ ID NO: 98787 - DNA, 1030 bp, Homo sapiens
gccacggccagggggaggctcccttggcttatcttcttggccttacccggtgttcctgtgccctggacttgcctttcccttcctgcctttctttaccaggccccagccagagcctggagttgctatggcaacttcggaggaacccatttccttagtgatgtctatggtacagagactggcctggagctcagagctgccggcaagaggcctcctctgctgtcctcaatttctctccaggcctcacccacttcccagaggctcttccctggggactctgcggcccttcccccagagaagacacttcctccctgcaggtggctggctggggtttctgtctctcaggccactctgcattgccaccaccccttttagccccagtcagaggtgggtctgtcatgtgggtggctgactcaggtaggctaaaacatccttaactcgggacccctagaactgctcatggctggcaccctactacttgtcctcccttctgtgcccctggaaacccagacactttggaggaaataagggctcaggattctgactgcctgggtttcaatcctagcaccaatcatttcccagctgtgtcaccttggtaaggcatttaatcttttttatgcctcagtttcttcatctgtaaatgggggtgatcacagttcttacctcacagggctgttgtgagtattaaatgactcaatgcattttaagcacttggtacaagcctggcactcaggaaatattcaatgagccattttacagatttttattaagctctctctgatgtgtcaggtatgataatacatttaattccttttttttttttttttgcttatctttatgtgtgatgtgccccctcacccaccccctcctccccgcaagggtccagatggggaaaactgagacccagctcttgggcaccaaagctctgttaagtgaaagggatactctggggtgaccggctccttccctcctccttttctcccacactccctattcaggcccacttagtagctatttctgagctgagttattt

SEQ ID NO: 98788 - DNA, 1036 bp, Homo sapiens
agagtctggtggctggacccgttcggaggggcccttggggtggcttaggcttggagcatcacagggaccctagggtgccagggtgagcacagctgtgacgtgtgaagaggcctgggcccccagagcctggggcatatgtgcaggggccctctcaggcagcagaaatgccaggccctggctagggggccctcgagggccatgggttttcctccccaaaggccacaaccgtttatcttgccttccacctcacccttcgcctcaatggctcctcgcttcctctcctcgcttctcactcagcccccagcccctgaccttccccaaggctcagagctcagaccctgacagtcatggtccctctgctggcccccctgcctcagttcccctcctctgtgcctgccgttcctgtagttgccacttccttggtctccagattcttcagccctcctccccggcctgctttctctccagggcctggctctgcctcgcttctctgtattaacccatgtcttggtgcttctttctcttggggattccttccgacacccccaggctttggggtgctcctgatcccatgaatgcctggttgcccggggtctctgcctgcccaggaaccccgaggaaccagtctctggctagctgccggccctcgcagcccagagctgtccttgggggagccaagagtggcagtgctgccctgacggtgtgagaggcagccctctatgcagaagggccctagccaggtctgcgtgcctgtgcgtgcatgtgtgcgtgtgcgtgcgcatgcgtgcgtgtatgtgcatgcatgtgtgtgcatgtgtgtgcgtgtgtgcgtgcgtgtgcatgtgtgcgtatgggtgtgtgcatgcgtgtgtgtgtgcgcgcgtgtgcgtgcacgtgtgcgtgcatgtgtgcgtgtgcatgcgtgtgtgtgcatgtgtgtgtgtgcgcgtgcgtgcgcgtatgctgcactaacctgccgcttgctgactgaggtttttgtctgtacacaggcgagtgagctcagggggccacctgt

SEQ ID NO: 98789 - DNA, 1049 bp, Homo sapiens
gcccaggctgaaggtgagaccccactctgcaggacgaggtgctgctgaccgagagcagccatgtgagcttcgtgtacgaggagaatgagtgctccctggtggtgctcagcacgggggcccaggatggaggcgtctacacctgcaccgcccagaacctggcgggtgaggtctcctgcaaagcagagttggctgtgcattcaggtaggcaggagttccggagaaaggtaaagcgcacaccccctggaatctgatgtgaccctccatgctctgcccaggaagcagccagccctggactcgagccaccacacccccagcccagcaccccgccttgagcccccaacattcttgcacctcttctctcttcttcttctgtccacctgtcccagtctctggcctgcttgctttcttcccctcccacctaacaccatgacatctctgccccagctcagacagctatggaggtcgagggggtcggggaggatgaggaccatcgaggaaggagactcagcgacttttatgacatccaccaggagatcggcaggtgtggggctaggagggaagccagtgggggccgagagaggctgctgggtctgagggttgggaggggtggagagggccacagtgatggctgatctctgaccccctccctgtgtcaaccaggggtgctttctcctacttgcggcgcatagtggagcgtagctccggcctggagtttgcggccaagttcatccccagccaggccaagccaaaggcatcagcgcgtcgggaggcccggctgctggccaggctccagcacgactgtgtcctctacttccatgaggccttcgagaggcgccggggactggtcattgtcaccgagctgtatcctgggacaggctgggggctagggggatccatgcctaaatgactggtccttgtaacatccaataggcaacatgttttacagtttacaaagtagtcccaattgacaattgggagggatacatctggagacttctatgaaaaccaacagttttaagcccattgttagcttaaattttcatagcatt

SEQ ID NO: 98790 - DNA, 1089 bp, Homo sapiens
caccagtttcctgcctctcccctggggggttcaggggatttgtctttaggtgtgcatcttggctgtaggcattgtcctgacagacccagggggaaggggacccccaggagcccagactcagtgctgctcgatccactctctcctgccaccccgccccatggactttgtctctctgttgccaaacctggagggtctaggttgacagctttccctcaagccctctttcctgggtttgcagactcaggcaaagggcgcagaggtgagcacggatcacctgaagctattcctctcccggcggaggtggcaggtaagtgtggcaggccagcctctgtgctttccaccttctccttttctctagcactgccttccccctcccgtgggccttcatctcctgctcctgtcttctcgctttcactggctccatgcctagcttcctgcctgttccctgaccctctgcatgctcaggcctcttccccagggctgaggtgggcctgggggggacaatcctgccccaggggtccctcaggtctgactccagtaccctgtctccagcgctcccagatcagctacaaatgccacctggtgctgcgccccatccccgagctgctgcgggcccccccagagcgggtgtgggtgaccatgcccagaaggccaccccccagtggggggctctcatcctcctcggattctgaagaggaagagctggaagagctgccctcagtgccccgcccactgcagcccgagttctctggctcccgggtgtccctcacagacattcccactgaggatgaggccctggggaccccagagactggggctgccacccccatggactggcaggagcagggaagggctccctctcaggaccaggaggctcccagcccagaggccctcccctccccaggccaggagcccgcagctggggctagccccaggcggggagagctccgcaggggcagctcggctgagagcgccctgccccgggccgggccgcgggagctgggccggggcctgcacaaggcggcgtctgtggagctgccgcagcgccggagccccagcccgggagccacccgcctggcccggggaggc

SEQ ID NO: 98791 - DNA, 1035 bp, Homo sapiens
tgcaaagatgggcggcagctgctcagcatcccccgggcgggcaagcggcacgccggtctctatgagtgctcggccaccaacgtactgggcagcatcaccagctcctgtaccgtggctgtggcccgtgagcctggggcagggccccaggggggtagtgatggggatggtgggacagggcttgaggggttcttagctagggtataggggctcactgggactcttctttctcttgccaggagtcccaggaaagctagctcctccagaggtaccccagacctaccaggacacggcgctggtgctgtggaagccgggagacagccgggcaccttgcacgtatacgctggagcggcgagtggatggtgaggatggggcagctggagggttgggggagcggcagggggagggtagaggagtctggtaaggccagtgccctcccaggctccacagatagcaccgtgggagctggggccaccgcttctgtgacctcagcccctcccccatactgcctataggggagtctgtgtggcaccctgtgagctcaggcatccccgactgttactacaacgtgacccacctgccagttggcgtgactgtgaggttccgtgtggcctgtgccaaccgtgctgggcaggggcccttcagcaactcttctgagaaggtctttgtcaggggtactcaaggtcagtgcaatggtatggggtgggaggaggaagggggctctgagcctagggttcttgtggagcaccatggccttgccccaaggcaccacggtgatgattttctctctctcttagattcttcagctgtgccatctgctgcccaccaagaggcccctgtcacctcaaggccagccagggcccggcctcctgactctcctacctcactggccccacccctagctcctgctgcccccacacccccgtcagtcactgtcagcccctcatctccccccacacctcctagccaggccttgtcctcgctcaaggctgtgggtccaccaccccaaacccctccacgaagacacaggggcctgca

SEQ ID NO: 98792 - DNA, 1036 bp, Homo sapiens
gcgggtggcagcctcagcccggcgccgccgctgctcgcccaggaactccttgagccggttggtggtgaaggtgagcgtctggcggcgcagcttcatcaggtaggcgtcctgcaaccatgggtgggccaggcagtcctgcagggagggccggctcctgccaggcagagccagggatgatgaacctggaaggaagctctgggagctgccggggctctgtcctcccgcagacccatgtcccagtcctggatcccacccctacatgtgtgatcttgggcagctcaagagctcagttccccagtctccggaatggggacagtgagtctgccttgcacggggctgcctcaggctttaaatggtgggtagtatgaccatttagtagaagcagcagacttcttcctaggagcaggggaggagctgggagatctctggcacaggccaggccaggggcaggtaacactgggggatagcaggtgtggggctcactcaccagggatgtacagagagaacctttcgcaagaagagggtggcgctctgggatgtattggggtacagctggaaggcatcaaagcggccccccacaatccgagcctccgtttcctgggggtctggctcatagaacggggagcgtccactgagcctgttggggaagatagcttgattgacgtatgcagaccggaggccaacacccagacccagaaggacattagtgtcaggtgcacagtgctcagggccatgctactgtgcacctgagtgtgagtgtgcagtgtggatgtgtgtacaggggaggtggggcacgggggagagggtgttggcagaaggtgagtccgggagctcactgtatgggcagagagggctgcggtggggtaggggacactcacataatgtaagtgagcacacccgctccccagatgtccgtggcagagccgatgggttctcccttcaccatctccggagctgacaggagacagaggccaagctgacccagcttcctggtggcagggaagtgggggcgggggaggtccctgggtgcttgagc

SEQ ID NO: 98793 - DNA, 1050 bp, Homo sapiens
agcactggtcccagccccagggagggaagggtggtggtcggatggatggagggtgcccacgctgcctgagttctgggtgccggtttcttcactttgtcacagcctattgtgtgtcctcgagcaggtcacttatgccttatctgttctagaagggagttgggtttggggatcctccaagtccctccagggcttatggtgtgtgcttctctccacagctgggccccaacgtctccatcgggaagggggtgaccgtgggtgagggtgtgcggctccgggagagcatcgtcctccatggagccactttgcaggtaggtaccagcatacacagcagcatgtgacaccccaagaggctgcggggagggcccaggcatccccccaagaacagagaagggtgaacgccgtgggctctgcatctggccacacctcacaccctccggttcctgctgcctcctgcctcttccccttacctttcactgtcctctttggcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggtatggcttcctgggggccagggctgggggaacccctcagctgatggccagtggccccggggagcattcgttcctctgtgtgcacgcgtgtttcttcttttagcaaacagttaccaagggcctgctgtgtgccaggccctgtgtgagtcaccgggggcatgagaccaggggcacagatgggcaggagggctccctccctgctggcagtggcccccagctccctgcccctgtctcccctcccatgacctcccctggtgccctcatccatgctgcaggctgccgagtccggatccctgccgaggtgctcatcctgaactcgattgttctgccacacaaggagctgagccgaagcttcaccaaccagatcatcctctgagtagggctgccagaag

SEQ ID NO: 98794 - DNA, 1071 bp, Homo sapiens
ttttttttttttttttttttttttttgagacagggtaactctgtagctcagactagagtgcaatggtgtgatcccagctcaccgcagcctcaacctcccaggctcaagcctatcctcttgcctcagcctcccgaataggtgggactatagatgtgcaccaccacacccagttcacttttttattttttgcagagacagggtctcaccatgttgcccaggctggtcttgaactactgggctcaagtgatccacagaccctggcctcccaaagtgctgggtctacacttgtgagccaccgtgcctggcctccctcctctactctttctactccctcccctgttctctgccctgcagccacacagacctttcagtgccccggacacagcatgctctttctggccacaggtcttcagtgtatgtccccctttgcacctgactcttatacacccatcaagcctcagctaatgtgtcccttcctctaggaatcctccctaccttcccaggctagggctgcacacccctccttggggccttgcagcacacccgaggctcccctctccaggagttgacgggctgtgtgggaatggctgtccacagccctgccggggtgtaagctctccaagggcagggctgtcgcccccactctcacctccagtacccagcacaggctgtaaaggtctggagaatgcgcgaatcgatgaatggatggatagatggatgaactgcagatcaggcaagatctgtggacagatggggtttgccttacccacaccgatagccagcaatgcatttttcctgagaccaagagagaagtcatttcactttctcaaagtgggtgagctcattggctgaaccaagatgagaagcccagaccttcactcccagtcctggcttctctgcaaccccccaccctgctgcctccacttacccaagtgtctgtacctgcagaggtccgcagacctctccccaaccccactgaagtatgggctaaggctcaacccccaggaagaaccctccaggaagagattgggaggggaggatccaagacagtgaggagaagagtggacagag

SEQ ID NO: 98795 - DNA, 1042 bp, Homo sapiens
accacggggcgctgggagctcggaggccgcccgctgagacccggagcccgcgtccgcatccgacaggaaggtctgcccgcctggttaccctttcgggcccctcgctgccccgcccaggctcgaacagatcccgccccaccgggacaagccccgcccctggctccgacgggccccgccccacggccctgtgagcctcgtccctgttctttcccccgcccccagcccctagtcccggacctctaggcttcccgctccgcatccctgttccgcccaccctagcatacactaacggcgtccgaaccgacccaggggcctgctgggcccccaccttcgtccccaacgctcctcagaggtggctccggcctcgctagcgaccccctcacccccagggaagaaacacattctggtgcttagcgagctgcgcgccgaggacgccggtgaagtccgcttccaggcggggcccgcccagtccctggctctactggaagtggagggtaagcacctggggtgggagcgacagagagtgtacatcctgtctctcctgccatgggactgacggacttggggctggccccaagaacgctgcctctctcttcccttccccccgaggggctctcctgggccgggtcacagagggcagcgcgtttccccggcaagaggagactttgggtctgaggtgcaagggaacggactggtggcatagagggctaaggccaggagtggagacttcagggagggaagatgcatctctcctcctgggggccatgcgtgtccctattaacttaagcccccgccccctacccccagcattgcctctccagatgtgccgccacccccctcgcgagaagaccgttctggtgggccgccgggcggtgctggaggtgactgtgtcccgctcggggggccacgtgtgctggctgcgggagggggccgagctgtgcccgggagataagtatgagatgcgcagccacggccccacccacagcctggtcatccatgacgttcgacctgaggaccaaggcacttactgctgccaggccgg

SEQ ID NO: 98796 - DNA, 1060 bp, Homo sapiens
gccctgcagctgggtgccgaggggcccacccgcaccctgaccctgccccacgcccagcctgaggacgccggggagtatgtgtgtgagacccggcatgaggccatcaccttcaatgtcatcctggctggtgggtgctcctggccaacccagggcagggaggcaagggcaagcatgggatgacaccttcctctcttctccagagcctccagtgcagttccttgctctagagacaactccaagcccgctctgtgtggcccctggggagccagtggtgctgagctgtgaactgtcccgggctggcgcccccgtggtctggagccacaatgggaggcccgtgcaggagggcgagggcctagagctccatgccgagggcccccgccgagtcctctgcatccaggctgcaggcccagcccatgcagggctctacacctgccagtctggagcagcccccggagccccaagcctcagcttcaccgtccaggtggctggtgagtacagcctgggcattaagcctgagagtggcaccaagcctgagagtggcaccccaaactctgcgggattcctgcttttccagcatgccttgcccatccctggccccacttctctcagtaccttccccgtcatgcctccccgtgccctcctcaaagccctgagcctctccctcccagtgacctccagctctgactccacagagccccctgtgcgggtggtagctcccgaggcagcccagacgagggttcggagcaccccaggcggggacctagagctggtggtgcacctctccgggccagggggccctgtacgctggtacaaggacggggagcgactggcaagccaggggcgggtgcagctggagcaggccggggccaggcaggtgctgcgggtgcagggggcacggagcggggacgctggggagtacctgtgcgatgcgccccaggacagccgcatcttccttgtcagcgtggaaggtaacagtgtacccctcacaccctgtgggctgtggcaccccaaggaccatctgccactttctagggcccccttactcctccacccccgcttt

SEQ ID NO: 98797 - DNA, 1016 bp, Homo sapiens
ggcccagcccagctccccggggtcacagagacagccctgagccctggaggagctggccacatagccccagctagcaccccggggaggagggaggtgtgggctgcaggtgcatgtgccagggttcttgctgagatgagcccagggcccctattcaaggaaacaagcccctccccggtgcccaaggccaggcctagctctgctccacagctcatttactgagcactttccctgaatcaggcactgggagtagcaggtgagtaatgcaaatacggtccctattctgaatgagctgccaggctaggtgaggaggcagctgttaaccaggggtcgcaaacgggtagtcctggggccctgcgcattccacacatgtgctttgtttggtctgcagagtcttaccaaagtcaggacagttcaaataacaatccggagttatgcgtcctcttgaaaaagccgaagacccggcggctctggtcccgcttccccccatggcgacgaacagctggcactgagtagcagctgcccccatagtttggggcccacattcctctgtcccacctccctgccattgctttttgcctctccccagactgcttcagccgctaacctaacctggcccctgtgggcatttgagtttgcgacccctgtgttaaaccaataaacatgcaaataaatgtacagtgacacctggtgataagtactgtgagggccaagggcagagggctcaagagcacagagcaggagggtcagggaggcctgggagaaagtcacccttccacacacgggagccagcagcacgcagacacggccgcttccctctaggactgcacagcctggcaggaaagccagacgcattccaggatcttagagcatgggttgttgagggccagtctagggaccctggggctgggagccaccaccctggccaggcaacaggaagtgctttcaaagctgatactggagctaagtggggtggggtgtgggggaatattcaaagcgggagaagcacaggacaactg

SEQ ID NO: 98798 - DNA, 1120 bp, Homo sapiens
caggttggtgctgatctggacctccatcaggaaagaaaagcccggagggaaggctagaggagcttccccgagttgcatacacacacgcacacaaaaacttgcttctccagcagccctagttaatcctctgatttccaacatcctgttttcttttcttttctttttttttttttgaaatacacttttgaaaagggttaaaatagctaggcacagtggctcaccctgtaatcccagcactttgggagactaaggtgggcggatcatttgaggtcaggagttcgagaacagcctggccaacatggcaaaaccccatctctactaaaaatacaaaatcattagccaggcgtggtggcgcctgcctgtaatcccagctctacttgagaggctgaggcaccagaattgcttgaacccaggaggtggaggttgcagtgagccgagattgcgcgactgcactccagcctgggcaacagagcgagactccatctcaaaaaaaaaaagagttaaaatattttaaattctactcagacccttgcagaatatgtgaaatgactggggcggggggagccagggaacagtttggaaatcaccaatctagggcctggaggaccccagggaacagtttggaaatcatcaatctggtccaaccccttctctccctttccccattttacaagtaaggagactgaggcccagaagcattgaaatggacttgcttaaggtgatgtggctagtgtcagggctggatgagaactcaggtcatcttaggaaccaccacttcccttctggtagttttctgtgattccacagtgcccgctggctctgcatgaagagcacacagcatgagctaatgcgcttctaggtatcctactcctagtctgggccttctccagagccctctcttgtctctctctcccctctccacagagccccgcctccggttcacacggcccctgcaggacgtggagggccgtgagcacgggattgccgtgctggaatgtaaagtacccaactcccgcatccccacggcctggttccgtgaggaccagcggctgctgccctgccgcaagtacgagcagatcgaagagggcactgtccggcgcctcatcatccacaggctgaa

SEQ ID NO: 98799 - DNA, 1005 bp, Homo sapiens
taagtgagaggctgtacctagagtgcatggcaggtgggaggcatttgggaagtatgcgctgggagaccgggggtctctaaagatggagatatttgggcttgagccccttcctgccacctttcctcctatctctgcctctgctcgctgctccaaaccctgtttctttactcccaggtagctgacactgagaagctatcagagatacaggcaaaagattagttgggaaacttttctggaaaactagtctatcttctcttgagttcctgtctcaacatatatgtgcccccttgttccactgactgaatggataagccctcctgtgggtgggctttcttgtcatctggtccacctttctcttagagaggacccctgcctccctcacttcagtccgttcgcagcacagtggggagaaggatggctttgggatcaggcaaaatccaagcctggccacttagtcgttgaacgtcatttcacctctctaagcctcagtttccttatctgcaaaatggaccaattgtgactagataatgagagaagccatgtaacagtatagttccaattgccagtccatgaacgagtgctgctccaggatgattagtatagtctatgagtgtgtcagtgtgaggatgctaactacacattcttgaaaggactgccctctgttctgagttacagccctcctccttctcttccccctcttccttgttctccattttcttccctttcccacttgcctttccctccttcttcttttttttttttttttggtgtaaacctgtcttttaaaaatggaattattttaaagaatttatcctacaatattcctgacatgccaaagatataaagagtaatataggccgggcgcggtggctcacgtctgtactcccagcactttgggaggccaaggcaggaggatcacaaggtcaagagatcgagactatcctggctaacatggtgaaccccgtctctactaaaaatacaaaaaattagccaggcatggtggca

SEQ ID NO: 98800 - DNA, 2844 bp, Homo sapiens
ttgatattgtactatagctatataaaatgtaaccattagggaaaactgggtaaaggatacaggggacctttctgtattatttctgcagcattctttgactccatacttattatattttttaagccaaaaaagcattccttcatgcctagcttgtagctgcacttttttaggtgcagtgatgaataccagagtgatcaaaagatgccctcaaggatgaaagtctcattagagagagcagttttaacagacagcaataacaatgccttagtgctataatgaatagttattctatgacatactttttagtattgtttgaaagtttctacagatgtgctttgcaatcagaaaaagaaagaaagataaaacttccaattaacttttgtgtaataatgagtgactgcaatatgaaaattcagcagtattacttcttgaggcggcttcctggaggaggctggtctcaagctgggcggtggaagggggtgtctcataacaagagagaactgtgaaccaagctggctgtatttccagcactgtcagtagatgaggctcttttgagcagaaggtgaaagaaaatttggaagagttggttggagttgtgtagccaagcagtctcatcaggctgaatgaaatgttaggactttttttgaagatgaggggagccattgaatgcttttgagctgagaaggagatagaaaatttgatcctgcaatagaagatctacaatatggattggagtgggtatattttggcatcatagagccttagaataaagagaaaaatcttttcactgtgtcttccctcctgtttgcccctttttctgcaggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaaggttctgggtgtggggaagaggcaggatgtgcaaggagcccaagagaatgatggaagttggggatagggtaggggtgcagaagtctgcagtgccaggatccagagggtgtcagaggtaccagtggttgtgctaaggaaggaatgttgagggcaggaagatctgctgtgcctcagtaaattgagtttttttttttttttcagctggtccatgttgctggtcctggccccacagggcccatcaagattttccccttcaaatcccttcggcacctggaggtatggggacacggggggatgttggtgcacagcacccaacttgaggcagccccttggggatgggaaagagaagagcctctttggtgaggaggccaggcctgagtatacccattgctctgcagtcatgtgatatccactgtctttccatttactgcttccctaaatcatagctgggctttgtggtcttctccctcctcccaactaggggatggggatgaggtctttgtcttctgtggggttctgccttcctccctcctctttccttgtcccagctccgaggtgttcccctccactgtctgcatggcctccgaggcatctactcccagctggagaccctgatttgcagcaggagcctccaggcattagaggtaaggagagtgaggggtgagctcagacacctcaacttgagagatgtagaagaccaagctctgatgttctcccctctctgcagctctccctgcctcctgcttccctctagacagtgtcctcactccctctctgtgttcccgcagcactctgtaactgcctgtatatttatagtcgtacctaccatattatattacatattctagtgtctaccttcccactgtccctacagtgagttcttgggtcagggacctgggctttaagcctgtatcttcagatggagttcagtgtataaaaaatgaatgagtgactgggtggtagagcttggccttggcatagggaggaaggggagggtggggtaatgaagcacccatctgtctgctcaggagctcctctcagcctgcggcggcgacttctgctctgccctcccttggctggctctgctttctgccaacttcagctacaatgcactgaccgccttagacagctccctggtgagtgcctcagagggaagagggtttcgaggaagggcaaggccaggcctttggggaggagggccagctggttgaccagatagtattgtagtgaacatcgattctctgcctcctccccgtctctctcagcgcctcttgtcagctctgcgtttcttgaacctaagccacaatcaagtccaggactgtcagggattcctgatggtgagtatgggcagtttggcagctggcacaccatgggtctttgattgctctgctctcactctctctccttgaccagcttttactcccaccttgctcttgccatgagggtggagctgcattctgggagatagcactgcttagacactagcatcagacaaaccagagttcatatctcaacttctaatacctgtgcaactttgagcaagttagttacctcttggtttctttacctgtaaagtagaaatcacaagagtacctggtttttttttttttttttttttttgagatggagtctcgctctgtcacccaggctggagtgcagtggcgcaatctcagctcactgcaacctctgcctcccaggttcaagcaattctcctgcttcagcctcccaagtagctgggattacaggcacgtgtcaacacacctggctaatttttgtatttttagtagagatggggtttcaccatgttggtcaggct

SEQ ID NO: 98801 - DNA, 1019 bp, Homo sapiens
gtgggctggggcgagctgaggccaggggcccttgggatgtttgtgagtggtggggcctggcgggtggagggccagttcgggggagggcagagtgtgggtactttccctccctgcaggccttttctcttggtctctccacagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacggtgagtggggcgtggcagggtctctggaggagccagttatgggaacatggctgttgtgtgccctgcactgggctgggcatttctttcagtctctccttggcactaggagccgaggaggggagcctcagaggttgcaagcactcgggaagctgggctgaggagcagggattctgtgctggagcttggacgtcagtacaggcctttgacaggcttcagaggtcctgccatcctccatgctctcagcatcccctcatccctctgatcaccgcccctgctgtttttcacccggtccccctcttgctgcgcagggctcagatctgctccctggagcccccatcctcagtctgcgcttctcctacatctgccctgaccggcagttgcgtcgctatttggtgctggagcctgatgcccacgcagctgtccaggtgatggcgcccagagtgggggcccaggaggctgtggggattaagagagccagagggaagtggcagcaggcctgagggccgggggcctgtgggaggtgtccgtctggggtccgcctgctcacagctgcctctgatccaccctctgtcaggagctgcttgccgtgttgaccccagtcaccaatgtggctcgggaacagcttggggaggccagggacctcctgctgggtagattccagtgtctacgctg

SEQ ID NO: 98802 - DNA, 1041 bp, Homo sapiens
catgtgtaaatgatttaatattttctttcttctttgcaaaatgggatagggagagtttctctggtgatgaaatgcgatcatagtggcataggaggtagcgcatgcccatcacggtgtagctgctcagagtgctgcctctctcattgctgatccatgtcctgattccttcccagcttcctgacactaaggatgagtataagatagatgctattgtcatccctgttttatagacgaggaaccaggctcacagagcttagatgacttgcccatgattacagagccattaattgatggagcctggaattggaccgaaatttggcaacagagttctctgcctttccagacctgttgattttggtctttcagacgttgctaggagagccctgaagtacttgatcagcccaagtctgtaagagggcataagagcaggtcctggttgtgtttggcccagtctgagagggcctagagttagaaggtagagtgcactttgaggagtttgtgggccagggttagctcatccctccctggggtggggagtgatcagttggcagctgtgccgggagagggagctggtggcctggggcgcggtggttgtgtatgaagctggaggcttgggctcaggggagacctgagcatggggaaggagcatcgtgagcatggtgggagttgtggcactgtggggggggctcatggggaccgtgtccatcctccctccagaatctcctgctgtgtgtcctaactgtggtagtgaccacgtggttctcctcgctgtgtctcggggaacccccaacagggagcggaaacagggagagcagtctctggctccttctccgtctgccagccctgtctgccaccctcctggccatggtgaccaccttgacagggccaagaacagcccacctcaggcaccgagcacccgtgaccatggtagttggagcctcagtccccgtgagtataggcaaaacaagacatagatgagtttggggaagggaaggggcactgatggggaggtggagatggagcccaggggctgccatgggc

SEQ ID NO: 98803 - DNA, 1047 bp, Homo sapiens
ttttgggcactccgtgtggtgtgtcaggagcagctgacagccctgcttgcctggatccgggaaccatgggaggagctgttttccatcggactccggacagtgatccaagaggcgctggcccttgaccgatgagggtcccacgctgaccttggccctgacctcaggagccacgctgtagacattccctctcctggtctctgggtctggcttccaggctctggctgtggatgtcttcagcctctgggtgctggccagtgaggtcccaaatgacccagggcttaagggagaggcgagagaatgatctggcctcaggggacaggccacctggtcaggaggaatatttttcctgcactttttctcaggtatcaataaagttgtttccaactcataggtcatgtgtggtacttagagtcactcataaggcctgcagttcccctaacctcttctgacagaagctatcccacccatcacctttcctgaatgggcagctccaagcagccttgtttgtgccatgagaccccatctccaacccaactgtggtcccagcatgggagatcaagtagagctcctgacccacaggcacacagccccaagctggcagtgacttgtcatgtggcccggcatggaattgctgccaaacaagtagctgggccagatacggtcctgctctcttgaactttacatggaaagtagtgaggacttcaggccatcgcagagggtgtctggggagagggtgtgtggagttgagtggtgacctctggtgcttcctgccattgccttctcagcaccgcctcactcagcctggaggcctggatggtcagccccactccctcacctcttgtctccaagtctggccccagtgattggttcaggaatcctcatgtgaattcgtttggcttatgaagccccagcgcaggcatttgactagagcaaccaagaaggaggcaagtttcctctcagggttgctgtgaggataagcctggagctgctggctgtggggaggcgctttcctaaagtggaaccatgagagagaggaagatggcccag

SEQ ID NO: 98804 - DNA, 1146 bp, Homo sapiens
cacttagtgaaaaagccctcccggacgcagggcgggaggggcagtcccagcggcctggcccccatccttcgcaggaagaagaagaagaaaaagctggaccggaggcctcatgaggtcaggatgctgactgggtgggcctgtggcttcctcatgcccctcggccccggagccctcctctctttgcccccctgccttgccccatcacggtgttccccacacctgttggcccctgggccctcacctttggcacgccccccaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggtagggacccccaggcctggcccgaggctgcaagccctcttcagtctgtgccaggctgctcagttcccaggaacactctctagagtcctgggcacaggcaagatccaactgccacctgggaccgtgggggtccatttgcctgggcagcccgtgagccccgaggggcagggctgtatctggtgcatgcagtcagtcaacaaatggcttccccttccttggtggggaggggccgtgccctcgtttccatgctccattttcacggcccctctctgactggcctgtggcaatatggagctgtgtatccatctgggtacattgggcgctttgcccttccagcacattcgcatgcttttggggggcaaggcagagtgggaggagatttttcctgtctgatgggactgtgccctctctgtgcctgactgtccccctaggagctgccctcctggacctggagcaaaccaccctgccaggcattgcacacctcgtggtggagaccatgattgtgtctgaccagatccggccggaggacagggccagcgtcctacgtaccctgctactgaagcacaggtgccggggtgggtccctgggaggggcctgtccagctcagctgcccttccaggagcacatcctcttccaagtggctcccagcctctgcttgaatgccacaagtgacagagagctcatttctatcttttgacactttcaa

SEQ ID NO: 98805 - DNA, 1027 bp, Homo sapiens
gccaaggaaagaaattccattctgttacgagtaattgatcctcatttttaggaaaagggaaggctattgctataaacagagggtgaggaagaaaatatttgactcctatgtgatttgctgggataacttacttggctttaattaaaaaaataataacaaaagtgaagccactactgcctgagaatgacatgagaatcaggagctaggaacccccagaaagaaaggtctgggtcatcccaccagatacaccatttggactaacagaagttctagccaagagtgaaaggaatctagaataaatgtggtggaagagaatgataagtatcggttgcagccttgagaccaactgtaacagcaagaattttcttttgtaagtctttgtcttataagtttttttttttttttttttctgaaaacaagatcaaccagaatattggaaaaactgttcctatgatgggggcaggctttgctataaaaagcgagtggatctgaatttgtaaggggtaggctgcaactgatactgttctgctccattcagatccctctttagaatagatggatccattcctagctcctgggaatatttgctgataatggctcacggctctgtccctcagtggaaattgctttgcagttccagagagctgcctcatccaaggtgtgcaccccttcctacaagacagctgatggccaatagctggctaatgtgggtataaaaggcctggcctcttatctcaatttgggacaactctcaggggccatcccagcatcagagtctcccactggatagtctgaaatctgtgttgcaaccacattgtgggtcagttttttcctctgcatgatcctgccttcctcacttccctacatcctgacagcactccccagtaaaccttcagaagacaactttccatctcagggcctatttccaagaaccccagtttaagacacaatagaagtggaaacataaaccaattctttggtgcttgtccttgaagccaaggcctagaaccttgattggatggaaagt

SEQ ID NO: 98806 - DNA, 1024 bp, Homo sapiens
tttgattcaaaataaaaggttggagacatttatatgtctgtgtacgtgtttattttctgtttctctaatatcctgcttcaagagacaaactggtattcatcaaaacgagctagttttatggaaaatcagtgcaattcagcatcctttcccaaattggagtaatttagatagaaataaatcataatggtgcttatttcaggcttcttagcatgtgcaaaaaagtgttcattagctgtccctatagaggttcaggacactaagaaccactgtatctggatagtggcacacagccatagcaccaccacaagcagcattggtcgataagatcactcatattttcaagaccaagaaaactaaataacataaatcatttcagttatgtatgaatgtgctaaaaaatgagaagataacttttttcctaatggcttcatttacactgaatttggatttgtgtgttgttattttaaaaaaggaagaaaaggtgaaacactggaaatcatggtctgtgtctaggaagtagatgaaaaaccaacagctgagtgaataaattcaaattctagaggatatttctgtaattcataggctatcacaagtgataaatgaaagcaatgttctaattcctccagttagccaatttttttgaaatgtaaatctttggtggcttttcttggtttatttcttggtttatgtttttactgtaagcactttatatcactaaacttgaggaaagatcaattgaatttaaaaagtctgaaaaacagagaaaaataaactaaaatacatgaggacctgtggaataatagcagaagatccagcatttgtattattgtagccaataatacaaattgactatttctgtagactactattattgtagtcaaagaagggcaggaagaagagtgaggagctaaaacagcgtttgaagaaatagtgggtgagaactttccaaatttagtgaaagatgcaaacctacagattcaagaaactgaataaaattcgcatatttacatattttttatttcca

SEQ ID NO: 98807 - DNA, 2712 bp, Homo sapiens
agcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtctgtatgcgtgcctgtctgtgtgcgggtgtgtgtatgtgcgtagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcagggtctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccctgcaatctggttgtctctttcaataacttttgctatatatatggtgtgcctaaatgaattaattatttgttgtcatttaattaaaacaaaaaatcttaaattccaactgagcatacttagaggttaaaaaattattatcttctaaagattcttcacccttcagaacaatgcatttgaaaaatctgacttagaccatcgtaattaagactgtagactatg

SEQ ID NO: 98808 - DNA, 3076 bp, Homo sapiens
aaggtagtataaaataaccccatgaaggcctgctctatggttattcagcaattgggtgatgaagataactaactataattctcttaatagtttttattagtaaatgattttttatatgtcaatatcattaggaaaggcagaattccagcctgtaattgcttgtgacagtgacctaatagaaaacacctggcctaagaaatgagtaaactaataaataagttaataagaagtgctttgaatttgttgaaatcattattcaggaaccccagcaagggaatacgagaagcacattccacaatccaaacagtgatcaaagtggccgttcttctgccagccttggcactcgtgctggtcaggcatggattgattaaagaggggattaactccctgctgtcccaagtttgtttgaatgccccaagcctgcctgtagactaggctggaagcatgctggacttgaattcttgctgttttctctgcttccatccagtctggcaggtggcaagctcgcagttttccttactcatccttcactagggtttccatagttgctgaacgaaagtctgtaatattcagtactggcagagactggactctttctgcaaagattgaacaggtttcggccatgagggctctcccagtcttcaccccaggctagggtgttaaaagacctgctatgagcatgaatgccctcagagggccacataaaacaagcgcaggaaatagaattaagaaaaaataggatgattgatacatgctttagcagctttgtgaagttaagagcaaaatattgcatagttacatttaacaacaattgttccatttaaaaccttcccttagcttttcagttctccttgcctatttgaggcaatcagatttctgagtcttcttgtctcactggtagctccgttctgcttatattttcttgttctctttctagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggagtaagtactcaacgatgtaacacgaaagggtaaatctagatttaatagtattttctttttttgctttgagctgcgtaatcatcctactcatttaaaaaaaatctggaatgcctctcattttgattgagtataattttacacagcctctataaagtatctacattcttgcattaaattgcttaatgaaacattttaatacacctgccttgttgtgctgtattaattgtggctgattcaaacgtgtgtctgcatgaagcccaagaaaagagattgtcagtccctgtgacttcttctgtcccttttttgtcgccctatgtacagggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaaggtaagtccaacaaccaagaatgattttttctccagtgaaaactccttttgtgctttaaacttgatctcattcgaaatactgaaaacagaaaaatactctctcatgtctctcaggttgtgttgatgtttttcaggatttcagtccttttttgacagcgaaagaggagaccaaacacagtgtggtttccctgctattcttccggggagaagtgacatatgacccagatgaggtcaggctctgagggatggtcctagatgctcactggctgttggctgtgtgctttccatcacgaagggctcctcctgtcctttggtgccattcattcatggtacacatatttattatcttctgggcaccaggcagcaagcacaggaggctttctctctaaccttgttaggtcatgggtcccgtcctttggagagtttacctcaatggagaagtactggcgagacttttccattagcctcattttctgtcctgctccaggaaactccatccccaaacagggccaaagaggattcaccaagatgccagtggtgagacttggaactcgcctcggctttctcatgatcagaaagttgaactactgaaaaatgcactgctcatccataaacctattagctttcaatgcttctatttttatataccagcattgagtttgttcattcctagaaacaaaggacataactttggactggacacattttaacttttcattcttttttttt

SEQ ID NO: 98809 - DNA, 1055 bp, Homo sapiens
aaaagagaactgtggaatagatagtagagataccctatattctccaccaggttttcaaatccctgtcattagccactacacaaaatgctcaatggtctatccagctcttttcaaataacactgaaaagggctgaattaacatttcacctctgccacttggtcactatgtgaactaaaaaaaattaaaagtctcctactattgtgaggctatttcttgttcttctgttctccaggagggtgaaatagatgactataaggcctcctttccagatctagctgacttctcttccaccttttagatcttcagcaccagagcccatgtattttgtctgagggtccattcaaggccagttttttggtgtttggtacttcttctgttagcataagtcattcaaccactactatcacatagcatctgctttgccccaaggtacagaacaagttgaggtattagatacactattatcagttctaaattctttttgctgatggtacttaaatagctttgaagcttattatggcttacctataatgagatgtagtataacatggtatgtgattcagcacaaaattaggctaacatcatggtgtgctaccaagagcacagaggcttccagaacaagcttaagaaccacccttaaagttaattgacatcgagtgaagatattttcattgtaaggtcattttgaccttgtcggtgctcagagcctacatcttcctcattaatgcttttggcttaaagtcagaagtaaatgcaaactattggcttttgtctaataacaaatattattgctatatatccacactcaattaaatgtccaaaattctatgtggtaacatttgttgttgactcaaaattgaaagaataattatatcttgattatttttgctgtaaacatttacagaattgtacttagaaaatcaaacttatattgaaataatggacacaaaagacaggttacaatggcaaggtattatttggacacaaaactgactgataaaacaaatctttgttaaaatatttatataaaaaagaaataatacaagtcaagtca

SEQ ID NO: 98810 - DNA, 1046 bp, Homo sapiens
aagtcagagtctcttttgcgaagagtgtttaggtgtgctaatagcagaatggagcggggcaggggactggaggcagggggcagggggcagggccacatgatctctgagggccgtcaccaaaactgacaccacattgtggatttgactgggctctagccacttgagaacattgatgcatcttccctttagagtacacctcagtgcaacagctggcttccctctcctgttgccagtgatactcaggtctagctttggctcatgtgaaggagttggagctgttcccaggctccagcttgctggcagcttcatgcacaagaaacatgccagtcggaagggtgaaccttgaacagcagcttgcctggcagcttaacataccatcctgttgtcttccataggtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccaggtcagccatgcttacttaatagtgatgtatgaaagaacacattagaggaggcaggcaagtggtgactcacttaaattcctgccttttcatcagaggccacttcatggctctctgcaacctgggtggcttctttctcaattagtagagtatttcaggtagttctattcagcattttgaataactaatacctgtcaggcatcaaatagttataaggaaaaaactttaaaaaataataatagtaggaaagaaataactgaagtgcctattttaggatgccaggcctgaaatttaggaagaggggtgaaatgtacttttagaagacgttcagatcagtaggtgctatattttgaaatggggcaggaacactggaatagtaagaaataaagattagaaaacaggtctttaagcacggcaattttaagttgatttataaagtgttaattgtaagaaagagatt

SEQ ID NO: 98811 - DNA, 1009 bp, Homo sapiens
tggcatatggtaaatggagtgaaagtaactgttgaaaatatgtcaaacttagcaagttttttgtttagtttaatcctctgccccccaaaatatttagtagtaaactgagaaaatatgctttgctaacctatgagccatcttccaagctggcagtggatagggagcttatgaaagagcattaatcagtctgaggggttataacaatttatgttccgctggcatcagcccagtgttgctttcattctcctcaattcagtgcaaaatgttctcatcaagtctagagtcaacacgatgcacctgggaagataaaagaaacccaggtgatcaaactgacgtagtgtaattgctagaaacaaatagaataaggttcaataagacagcatagagaagtctgctttacaaagaaaagtaggtgatactgatacatgatattggcaaaatacataggagaaaaaggatcagagggcttaataaatcacaagatgatttgttaaactgaaacggtgctcttattaaaaagatcacagtcatactaatccatggaccctggacccaacagactcttttctttcgaaggccaatttctgagcagtcaatagacccaccacagggtgagtccagtgaagtcattgggatggctcaaccactgcttatttctctggcagctatcatgttgatagaaagaaaaataaatggagtgatttaaagcaaataaaacttttagactcccaaacaaataaaagcacctccagaatctcagaggatatccataaacaaaggtaatgagtagccaaaaaactgtgaagtagttctcctctataaatttggcatgtcctaccatattattttcttggaatttataccccaaagcagggggaggatgttagagaaaaggctataagaaaataatttaatgcctgtgaagacagattagaaaaattagaattagcaaagagactgttgaatgagttatttatgacttactaggcaaggagaccactctgggcac

SEQ ID NO: 98812 - DNA, 1018 bp, Homo sapiens
tttgaaatgatacattaaactcaaatttcttaatacagatatatctagcaagctagttcaacattacaaccaatgactattgatttcaaggacaagaattaaatggcctacatggtacagtatgggagatagatacatacgcacatagattcatggataaaaaatatgggatagtatttttacttggtgaactttcaaaaccagagtaaaacaaaattaaactttgacttttaagaaaatgcaaagattatgaaaaaataaatttcacatatgataaaacggacatgaaaggcttattgaaagaaaactagtgaatattttaaagctggcatcgttgtaattagagctcaccccttgaggactctaaaataaagcttcactcaatgacccttggtaaattatgcacatccctttaaatgtaccatctggactacttcgtaagggagtatccacaatgactgcaatttcagaaaaggattcaataatgacactaataagattccagagtaatagaatttaattacaaacatctccagtgagaaagaaagaaaaaaaaataaaagaaagcattgatcaaggggtcttcctagaacacgttttagctaattctggaaaagtttacattagttctggtaagattgggaatcatattaaaattaaatggccacctatacttttcgaactttcctaattttttatgtatgtggtagtccattatcagagagtgtttacaaatgcaaggtattcagtttatcagttataattatattttggaaacttcttttcaaaaattctctctgtggtggaatgttacctatccatctgccttgtcttcctccaacaacaggcagttgcacagccttgacagttagagccacgtgcacttaagaaatgggatgcaggttgccttatcaattaaagaatgttcaatgcaggccgggccctgtggctcacgcctgtaatcccagcactttgggaggccgaggcgggtggatcacaaggtcaggagttcgagacc

SEQ ID NO: 98813 - DNA, 1589 bp, Homo sapiens
aggcctggaaataatgttgagtttcattgcataccggatacagatacccaaaaagattcaagtaataaatgcttggtgagaattaacttggcctaatgctaatgagattgttcctcactccttttctatgcagaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccagggtaagaaagatcggtgacatctgggctttcactctggtgaaactgttcctctcttctcactttgagattgaagccctttgtaatttttttattttttaagttttctcatcccttgaagcctcctcatattcctgcatccatttttaaaccatgtttccaataaaagagggattttgaagctgactgtagatgtatgaccatattaacagccacaaactagaagcaaaatgaattatctttccctctatgtttttttttgggagggcagggggaagaaagtgctaatgaacaataagacggtgtcttaaataaaaatgagctgagaagcaagcattaaggatcagtttacacaacaaatgatcaattactgagaaaatcaggaggtagcttcacttatttatttttttgcacttgtatttgcctgcctgtcttcctgcctctttcttcctttttttttttttgttgttgttttaggttttgtatttgccttttttctattctttaaaaaaaatccttattctaaatgagacaaagcaatgtttctagttggttggctaccaaatctcagaatgtatatacaggatttataaaacatttataccatgcaaggttttccagtatctaatggccttcattttaccactggtagataagcggggattaggacacagtgaagagttttaagtacacagttaatggctgtgctatcttagctcgactatctgaatataaaatactaatggaataaacacagaatcataaaacagttattggccattaacactgacactgttaaaatcaacacgaagctgacagttaccagccattttccccttttaacactcttcattttgcatctgcaatcccaagcaatgggggttttttgttgttggttggttggctgagctttttttggaggggggcaggggggtatagtattctatttctttggctccagttttgattcttatgcttgtcctcttttgaattccaagtccattcgtttagaaaagaatagatctttgtgaatgttgaagatcttttattttttcccagtagttggagaaagaaaagttaaaggaggcttctagaatgatacatttacatagataaaaccttagccaaatatttaagcaggggggaatgcagtacaagtgtccttctgtgcgtaacaaggatgaatgcaatacactgggttttcagagtttactgcaatgtatcaaagcaatttccagtacaatttatt

SEQ ID NO: 98814 - DNA, 1057 bp, Homo sapiens
ataaatgcttttgtgagtatattatatgtgtgtatatacatgaaatttccttttttgagtataaaatatcatgtgttataaagaactctagtacaaattttgattttattcttagagagaaacttaatgcaatctgaaatcagattgattgcattcaaaagatttactctgtttcttactaactaagattttgtgtaggttttttgcattaagccttagttttctctaataaaatggggctaatagtagcatctacttcagggttgcatggaggattttgtgaaataatctatgcaaagcactagcaaacagcctggcgtgtaacaagcactcaaggaatgttagctgttattctttcatcttgaatgtgtttctggtccatcgtagattctttttctctctcaaaggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtacgtgggtcaccccctttacaaagccaagctagaagttactgggaaattaaacacacattttctttccagggaaatgacagatggcgcagacccactgattgctaataggaggaaatcagtgcaggacaagtcattaatcttgtagtcagctctaaatgggtctttggttttggctggataccctatctccaaggcagcttgtgtgagattttagagaaattaatattgcagatttgtggtatgccatgccatccttcagatatttgctaggccaaactgattgtcatagggtgggctcaagcagatggtaagcaaaataaaatttaagtacttttcctataaagcacaacaaaacctggccacaccttgtgctggaatctttggttccagatgcagagagtgaagcttgggaatcttgaatatattgcgggatttgcttgtctgctctgcctgatttatgg

SEQ ID NO: 98815 - DNA, 1100 bp, Homo sapiens
gcctatgtgggcggattacttgaggtcaagagtttgagaccagcttggccaacatggtgaaaccctggctctactaaaaatacaaaattagccgagcatgggtggcgggtgcctataatcccagctactcaggaggctgaggcaggaggatcgcttgagccctagaggtggaggttgcagtgagctgagatcatagcactgcactccggcctgagcaacagagtgacactctgtctcaaaaaataataaattaaataaataaataaataaataaaaatagaccctttgaaaagttaaatgcaaaggaaaatgcaagcttatgatttgggactgaaatactgtacttcacagttagctgtagtcattggggtctctgttttgctaagttggttcctgctttgcaaacagttagggaaggagataatatatgagatgagagcactttgaaaagttaaatgcagtgtaaaagtgcaaggttttattatttgccagggaattatccccacggagaaacatctgtaggctctgagggtctgattgctgagctggttcttgcgctgctgacaattaggagaggaatgtgggagggaaggttggagcatgtgaccgggatccgctgcctctctggttgcactgcctggctcctttaggttctctgttattctctctttttcgtaatcatctgcctttctacctgttcaaagtttaagagttcagggtataggattttgacaggaccacactgccaagacacctggctttgcgggaatttttacttatctcagaccgtgtttctttttctgtaagagtcttgccttaccttgtctttgaagctctaagaaaacatagaatgtaaattccagtgtaaattgtacctttctgacagaaacataaatgtatacattttatttactaatttggtctcaacttcccaagctttagacagctgtgatatcaacggagttgactttctgattcctttaagtgatatatattctcctgactcactatgtatatatattcaagatttttgatttgcaaggcttgagttgattttccagtttgtataagagagatatatacatttctgattgaatatt

SEQ ID NO: 98816 - DNA, 1063 bp, Homo sapiens
ttgtttgttatattgaatagtcaaggtgccaggaacagcacgttggttgagagggctcacgctgttctgcaacaatgtctgctaatacccttattaccatgtcccttggactgcaggagggcttagttcacactctttcaaagtttcacctgcaatgtgggctcttttctccaactcctgcggctgaaagggtccatgtttccttctggagcattcactaacaaaacactccactccttcccagttttaatcagcttgtccacatctctgtaattagaaaaccttcaacaaagttttccttctgtcattcaagtgatcagcctgagatgtcagttttgagttaggacttcttcaggcagtgtggcttcctgcaggctggctgccccagtggtgaacttcaatgggctttctttcctgggatgataatgggccacactgtcctacactgagccaaggcaaaagggccatcaggtgttaaaggtagaacaggacacaggcatttttgttttccaggtatttctaaaaagcaaacagactactattagcctttcaacagtaatccttgtggttttttttcagccatttcctgcagtcttaagggtcctctcctccaaataacactccacgtaaaaaaatctcatttaaaaacacaccttcaccactaatttaattcctccttctatgtttagaagtctgaggaagggatgggcgtgtcaaccttataattaatgacccctgtcattttgtatttcctctggctttgcacatatttaatgaatgtgcttgatgtaaaacagataaacgctttcccgggcagcttcaggccatgggtttctatggtatattccaggtttttgtttcattgacaattttaagttggtaccaaagctttctcactctatgcatttgtttttccttcttcaaaggaaagaaattcaaatcagtgttcgagatcttaagtggtttaaaagagatacttgtaattttagataatgcttttaggagctctgataagacacaatgtttcaggctggcaggaccctatcactcccttgggaccaat

SEQ ID NO: 98817 - DNA, 1737 bp, Homo sapiens
cgagatctacttttttcttttggccaaatggaacatgtaagcatttagggatcgcggtgaaagaatcaaactactaaatttataaaatacctaaaatgagatgttatactaggcacattgatttagctatattgtatatttttaccacccacatttatgttaagcaacttaattttatattttctgtaggcatctttgatctgtgtctttctcatcactcaagatataatttcagaattctttcagctttccagagcacataattgtacttgttatctaggttagtttaaggcagaacacttcttgtacctatatgatgctgtccctataaattttatttcaaaccacaaacaaatctctatttgtacattctctccagcaaatcaacatttccacatgtatatatttatatatttgtgatctccacaacataaccacttttctatattgtttttttaaaatgatctttaaaaggactgttcacagtgacatcctaaaatacaattataaggtcataacctccaagactaatgactgaatctatgctaattttctctgacaccctcttcccttttatagtaatgatttcatcaggttatctccaaaagcatcacaaactagtattaattcagattattttagggcagtgttttttccaaaacagtattaccgtattgattgattgattgagacagagtctcactctgttgcccaggctggcatgcaataactcagtctcagctcactgagacctccgcctcatgggttcaagtgattctcatgcctcagcctcacaagtagctgggattacaggcatgtactaccacacccagctaatttttgtatgtgtagtagagacagggtttcaccatgttggccaggctggtctcaaacccctgacctcaagtgaactgcccacctcggcctcccagagtgctgggattacaggcgtgagctaccacacccggccccaaaacagtattttattattcaaatgtgaaaaacaattttaagaaaagtctagaatacaagaatagcccctatttcttaaaggataacttggtagtgagggaaagtattactgataaccaggcacatgctgtttttatacgaaccttctaatgattgctagtgacagtgggtttccatttatgttagggttataaagtaccccttttacctggataaggaaaaagaagtgaattgattttaagaaaaaaatgaagtggttatggcaaaatttatatatatatattaggtactggaggcctaaagagattaaacaaataaacgaaggtcacatggtgagttagttgctgatcaggacaggaattcagctctcctgacttccaatactgggatagatatattattttaatatcttcttaactgacaaagttgacctacataaaaaagctgacattggcagttctatggaaccaaagcttcaagactctgctagtgatgttggtaagatttgtaatctgtgaattaatatgcaaatctgttgcacaatataaagtcagagtttgcaagttaattttctcctcctattgaaggttaagatattccactttggagctaagagttcacacaatgctgaaacagttatggttcagcctgtgctaccacacctggttaatttttgtatttttaatagagatggggtttcaccatgttggccaggctggtcgcgaacccctgacctcaggtggtccgcctgggccctaatttcct

SEQ ID NO: 98818 - DNA, 1084 bp, Homo sapiens
ttttaaagataatcacttattggcttccttattaaaagtagaaaagggacaggattttcccattgaaaccatgttacaacacattttacattttctagacagaaaatagaaaaagataagggaccttctcacagttatttcttttaaattgctgggtgtggaactagaaaagccaccaaccatcatttaatgttcctttcaaaaaaaaagagtaggaggaaagatctggatatggtcagcgtcaataacaatcatacctgaatttgcatttctttcaacaagtaagaagtaacaatagtacttataacatccaagagaatacaggctccagagagtttattcatctccatttactttcagtttctgagttgactggcttgactcctttaatattgcacctagtaagtaagcaggagatttattttgccaccttccccaattttatcttgccatgatgtaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacaggtaacaaggaccacccagactcagtcacttctgaggctatttttataatacagctgaatcccattacagtgaaatctaaggagttgtctgtaatttttggttcagcagacattttgctgcaatgaatatgtcttgaaataagttagccaatgtctgtaacttagaaaacttcatgtgatttagagaaaagcattttcgaaatactgatttgtcttttcctatgaatgaaaaatgttgcctatttttctcttgttttgagccttctagaaagcatgaaaaatgggattactaaactgacaaattgagggttacatagctaccctacattaatatagggaattttctccctgagaagattaaagaaggcgccaaaaatattttttacctacttatttttaagaatcatttaaatcaagttacataagcttttttttttttttaaagaccctttggacaaacatatc

SEQ ID NO: 98819 - DNA, 1045 bp, Homo sapiens
ttgcatgaaattaaagtccagtaagatggcactcataatactgggaggtaggattagatgtagctttactgagcttaaaatgaggtcttccaaaggctgttatggcttacaaaaggttaaaaaccagacagccttctctgtacctacagccttttatgagaaatgtctctacgtgctgtggaaatggtactacaggcctgtgagcccactaggcttttacttcagagattctctttttaagacaaacacatgcaaaaatatactggagagaaggatgaaaatgatatgcttctatactgaagagtaaaatggtcaagggggagacaagacaatctttcacacttttcttaaataagatgaaattatttctggctaccaccaaaaccatttattttcctaaagaaaatatcttttgtcttttgtttttttctaacagcaccatcatccattgctttggtccaggctaaagaagtcacaagatacagtgtggcactggcttggctggaaccagatcggcccaatggggtaatcctggaatatgaagtcaagtattatgagaaggtattacttgagtgaacaacactcctttcctttcttccttccttccttccttctttgttttcttctttcctttctccttccctccctccctccctctcttcttttcttccttctttcctcgactccttcccatcctcctttgctccctcccttctgtttaagggttagccagttgtaagtcatggaataccagtgaatcctcaaatcaaatgcattttgcttcccaattaagtatgattatgaaatttatcatttacttagttatcctgaaaagtagaaaataacaataatgataatacattgtattgtaatataactatatctttactttctagtaatggaaatcaagatagctaagaagttctaatctatgaaccttctatcagggagagtgactcataacagttgaaataatgatctgtttaagtagatcactgctattcagaataaagatgtgggttttgatgacttttaatagaaagtc

SEQ ID NO: 98820 - DNA, 2139 bp, Homo sapiens
ggactcaagaaaacaattttctagctcaggaaccatgtgaagctttcctctctttcttttctccgtatctcctcttctcttctccatcccatttgggtgtcacaaggaccaaactgctgcagtaaaatgacttgtaggtgtttaatggcaagtcattgaggaagtgaataaaagaaaattgcagcattcacgtcagtggggagcaaggagaactgctgagctttgaaccaaagaaagttaaatttaccattttcttaaagggagccacctctgtttgacatcaaagcatctcctgtaatttctccttgtgaaatgcaccactgttagagagtcatgatagagccccctaatctgtgctgtttctgtttatcaaaaacacacacagagagaaaacccacatgtaccttctcagtgcattgtggtctgctctcaaaccaaatgtaaccacaggtacatagcaaatggggattctatttcgaaagcattctcagtttctcagggatttgtagaactgggaatacaacattctttgggagtgaaatttatcttggacctctattggaaagctcagatcattcaactggaaagctttggtgaattttttcctttcctcctcttttggtttttgcttcatcgttttttaaaaatggtattttgctacaatttcacttgtgtccatttggtatgtggaaaaacagagtctgttcctaataatgctgctcgcccacactatgactgcaaagggctctccaccctattacccccatgtttcaagtttatgtccattggtggctgttgcatatgtagtaactaatggcttctgctggcagtgactggctttgccctagtccatctttggaggcttaggatcctttctggatttatcattatgacttgggagtctcaccatcactccaccttggcagttaagaagtcaggagaactatttgcatatgccctacagatacagaggagaaatgcagagcaaattgtcaacaccttcatcagcctaaagagcagaagctcaaaatgctgtctgtaacaggtgcagtgatgcctagttttaatgttaacttacatttgaatgacattttacagcctgtgtttgaaaaatgttcagaagcatcacacagaccttagaaacagagactccatttataattagagttgtcatttgcttcaccccaattgtcaatatctcagttaacctaaatagtaaaaccaaccccacaaaaggtcctttgaaacaggtgcagatggaaagttgttttaaggatggcttacttctggtactttatgtttagaaaatgtttgatatctacagtaaagattttttagataaattttaatatgtaaaaacttttattcatttgacataattattgagcaccactgaatgcatgtgtcaccatgatttgtaggttaaaaagaagaagaaatgagagacaagttttgggttaaaaactgctgaaatctccttaggggtaataaaaaatgatggtctcggggataggcaccttagaccaggaaaattgacatctatgagtcattggagattttgctgtaaaggtttgaaaattaaggactccattgaattaaatcacacatcttttttaaagagctaccctttaggagtgcttgccttatgatttttacatagtcatctttctttaaccatgctactgtcaactagcatgaccagctctcattgctatgtgtcatgtctgaattctagccattaaagaatgcctgcatttgtctggaggcacaaaactgtccttaaaacaagtatctcctctatgaaagaagtccgtgggtagataggaatgcttttcaatctatgatgcatctctttcttgtagtaagaatgtaaaaaaaaaaaaaaaagaatgtgttcatcagccccccagcttcttcctggctttgcttctgacactcagcaggtgtattgagtgtctacagatagaatgtgtgagaaagtgccctctacttactcctccccatcacccatgagagaacttgaattagaagaggggcagtaggaatcgtctcctcttaaattctagaaaaatgggccctctgacttgacattagaaagtgttttttctttaagactactataaaaatttcccaatagtt

SEQ ID NO: 98821 - DNA, 1025 bp, Homo sapiens
atacccctgtacctaacagagcagactttagaaagatttacgttgttgctgctgccgctactgctgtgggaaaacagtcacttaaaccttcaagtctcctatttcttaccatggaaaggaggggcagagatcagccgctttctgtagatcagtggttgagaatgagggctctaggaccagatttttgaattatgaccacatataagctataacttggagcaagttattcaaactctctgtaccttatcttcttgatctataaaaatgaggataataatagtacctgtctcatagagtttttgtgaggtttacatgaattaagtcctgcaagagatttagaacaatgctcagcacatcataattactcaataaatgctagtttcgtgtgtatgttgttacagacatgtggcatagagggaggatcacatacttttgagccaggtggacttgagttttaaatctcattttatggctttggtcaaattatttaatttctttgtacctgagtttccaagtctgaaatgtaagggtgatcattataactacttcagagagttatagggatgaaatgatgtcaggtgtgcgtgtatgtgcaagtgccttgcccaggagtttactggcatctgatttgctcctttccccattctttgttttgtggcaattcacagggcctcagttttcatctgcttaagcagttaataattcagtgaaaactaaattaactcttttctacaaagaaaactcaaccaaaccattttgagaaccccaatgtgttttcccatttagcattagcataagatcagctgaatcttttggctcagtgttttgcgattctgccgatttcattcactgttagaagactagtggccgtgattgtggccgtgattttgtccgtgggaagccacgcggcctctgtcactggctttgctgacctcagggcagcgcattccagtttctcacaaatgggtggatatctgctcatcgtgcatgaccagctggagtttccgggagggaacccaaaggcc

SEQ ID NO: 98822 - DNA, 1057 bp, Homo sapiens
catcactgagatagtgatgaagacggagtaatttataatatattcaggctccattgaaagccaaggaattcagccccttgagctggcaccttgcaaatattgtacttgtctcatgggttctgttagtttgagaaataaaaaatagaaatctaatttaaaaggatttctaataactcagaatagctaatgttggtttcctctgaggtcatatgagcctctcgtgttggtgcttttctcttcattgtgtattatagtgattagatattggctatgaaaattattacttttcatttgtttgtgtgtttggaggttgattacctagtcacttgtttataacaaaagctgtaaatgatactctttgacagagttaaataaggctatcttcatgcccttgtgaaatggaaattgatgaaaatgtaacactgagtaccttttatcaacataaatttcaaaacatggaattcagaaggattcatccaacacatactcttttctattatctggattaatatacctcacttcattcattcactctaatcaggttcatgacctgaagatgatttggcccctgttggaagagatcgttagtattactagtatattaatgttttgcccattgatgttttctgggttcatccactgactttttctttaacttcacagatgatttggatttccctatagcaagtggcaaagccacaacacttctgaattagttatcacacttaaaaagtcaagatgacaacaaccatagtggatctatttattgaagcagacaggctcttttagcggaatgatcaatgtcttacctctttctgaaaggcttttcagaggtaggaaatcatcaagcatctgatataaagtaatgaacaaggcttttgattggtcaagtttctggagcaggcttttaagtatttctgcctgtaaatgtagaaatctgagtgtgaaaagtaaaggcaacagcaaagatttactgggtgcatctatcaccctggcttttagagtctttgtgattaatacctgtttaattggggactgatctagatgctttggacgt

SEQ ID NO: 98823 - DNA, 1047 bp, Homo sapiens
gatgtattgtttggggagaaatatcaatgagagccctttctatctcactgtaaactcttcaaggattcaccttaactgtacgtgtttgttggagggtagcattttctctttccctccacttctttttcctctacctatttcagaaaacacaaaaataatttccattaacttccaataacttcctccatagtgtgcaggagctttcctccagtgtctttcttagatatcatgctgtggaactatttctaggtaagatgcaattctaataaactcctccagtatttaggaatggactaaatactgacttctttgggtggagccagttatgctgaatttcacacttcagcaaattgagttcatgagagaggcccctgtgacatgctgtgaaccccctggttttctttctttcttcctttttttaaaaaaataaaaacaaaaacaaaaaacaagtcctaaaacagtaatagctttcgtaatacattctttattatttcttatgactacaaaagtcatctcaattctcaattctcaaacacagatccagttgaagatatctactgaccttaataacattttaaaatttaatagctcagttgtttctgccccattcttataatgcctatagaaatttaaactatctagcacatagaacttagtttctagctgatactctaaaaataaaaaataaaataaaaatacaattctagggttacagatttccaagcttaaaacctcttctcctaaatgattatcctgttcctaacctgtaccatagcttttgagaaaattgtcaaaaagacagattttcaaatatgaggtctgcaagaacataattgcatggccacattttcagagagcgtagcatgtggtgaccatttgtgtaagatgcattctcaaaatgttctgactgtaatttaacccaaaggtctctatcccacttctttccactcaccaggtgcttccttacacttgtctacatagcaagcaagaaacagggcaggaaagatttcttctttataaaaaaggttccctaaagtgatactttag

SEQ ID NO: 98824 - DNA, 3096 bp, Homo sapiens
gttgtggtctgagatcaaagggacaagcagaaagcacattcctgctgattctgagaattgttttggaatactaaacctaaatgagatgatgtgatctcggttcatgcaaccactgcctcccaggttccagcgattctcatgcctcagcttcctgagtagctgggattacaggcgggcgccaccacatccagctaagttttctattttttagtagagatggggttttccatgttgcccaggctggtctcaaatacctggcctcaagtgcatccatctgcttcagcctcccaaagttctgggattacaggtgtgagccacctcacctggccaaatgatgatatttttaagacacaaatgtttgcttcctttagtgccctaaagcaggggtcagcaagctatggcccaagggccaaatcgaatcctccagattgggacaacccacgaatattggcttttatatttctaatgggttcaacataataaaaaacagaataatattttgtgacatttggaaattatataaaattcaagtattggcattcataaataaagttttactggaacaaattcccactcatgtgtttatatattgtgtaagagtgttttcacgtgacaatggcatagttgagtagctgcaacagagggcaaatgtccggcaaagcgaacatgggcactatctcactgctgacacaaaatgtttgctgatctgctctggagtactaaatcaagaaaggagaccagtaagaacaaggttgagaagctattgaaatactggtatcatttgtggaatattgttttggcaaaggatgtgatgggtaacatttaggtaaatctcacatttgaaacaatcttcaagacaccttattttgtaaaggttttgactcagaaaaaaaattaactaaaataattaggatttcagtcataactttgctttcttgaaccacaaattttttcccattggcactcagatttaaatggattatgtgagacatgcttcactgatattctggttctctttaaagtatgcattcttcacactattgcctaggtcctatagttgctgacagcaattttctttttaaataattctatgttagcctggtgcagcggctcacgcctgtaatcccagtactttgggaggctagggcgagtggatcacttgagcccaagagttcaagaccagcctacccaacatggcaaaaacccatctctactaaaaataccaaaattagacgggtgttgtggtgcacgcctgtaatcccagctactcaggagactgaggcacacgagaattgcttgaacccaggaggtggaggctgcagtgagccaagatcttgccactgcattctagcctggatgacagagtgagactcgatctcaaaataataataattctatgctctgctcctgtgccttatcttctctccgagatgatgtcatgcttgcctttgatctccagtaaatcgtgttatttttccttacccctaagaaatttaaaggaaaaacaaatgatggtactagtgaaatcgagaaaatgaagaactccttctagagattcattttaaaatccttcaaacagacaacaaagcaattccactgagagattttgctgaaacgttgtttgcgcatcctcagttgttagtagggaatcggtagctggttggagagtcctttctgtgcctggtaattataggcccaagcaagcacacaatgagcttcagaggagccaggctgtggttttctcattaatagctctggtctagccatgggatcctggtttacttcataaggcctatgaaatgcacatttaaaaacaacatgcggtacttttttttttttttttaagaaacagtctcttgattctaaccttatactgagaagaatttcatttccagaatactgttgctaccactataattaataagcatactcactaattatgatcgtaattaaaaataaaataaaccagcagatatacaatggcgcagcctcttgtgtgtggcaccagtgtctgtgaatttgtattcggggtgggtgccacaagtcctggtgaggagaaaaaaaaataaaagcctgccaaaagagcctactaaattatccaacttttcaaggttgactgaatagcacagacaaatagtatgtctatagaacgtagtggtaattattgcatataagcaaaagttagattgcatttttttaaaaaagatgtgaatattccactctaagaaaatgaagtctttatttatacacccaggactgagaacactatttttcctgagtcctttccttttgctcctacagaaagatatatgcatgttcatttgtaagaagagaaattcattcaccagtaatcacttgacagcctaattctggtttgtttctcatctctcagtgttgtgcttgttccatcgaacactaaccaccaacttttacaccctctggagaagccatcaagagatttaaaaaataagtgcctggctgagatgagaaatgggcagggcagggctagcaagggtttccaatgggcttctaaattatctagttgtcactccaactggctcaattaattactgtctccccagaggagccagatgggtctccagaaaccagtctgcaattgaacatcaatgaaaagatccagagaaactttatcaaagcttccattaaccccctgctgatgtctttaaatagttttttttttttttttttttttcctttaaacaccttgaaaacccaaaagccatgcacaggacttatcttgcattaagagatcttaaatctacagggactaattgaaatgcctgtccatgtcactcaaatacatagagaattcttctgagtctcaacatccctgtggcatttttgtgatgtgggtatacaataagagggtatcctgtatattttcttcaggtaaagactggtgaggatgttttttagggtttacatgttaatctgtcaagataagcaaacctttggtctatctgtcagtattaaaaatatctctcttatttaatgaaccttcttctggtgtccacctttccacccgccacccccacaacctgtactcatgctttctcattctttgcttctgccaaa

SEQ ID NO: 98825 - DNA, 1122 bp, Homo sapiens
aattctaagagtgggaaaacattctccaaatgcttcagcagaattatcacctgaattctgcctgccctccttctctctaattccttgccttgccaagggatttacgttgcggggggaaaacagtaagatagtgaacagttgttctaaattgggggtgatttctgctcctacccctaatgggcaatgtttagaggcaatttttggtgcagttgcatctagtgggtagaagccaggcaggctgataaacatcttataattcacaacacagcatccccaatcctccgcaatgaagaattttctggtccaaaatgtccatagggctaaggctgaaaaactctgttctagcaatagtttttaagaacagacttcatagcagtgcccaccatttcagggttccatagccatgtggcctttgcttgagctggcctgtggctgaacacatagggaagattccacatttctctggctccattgccccatgctgaaagcatgatgctcccgttactgttctcagagaacaggcagttgtaaagggcctttcaaggcccctcatgaatcctgttgtagctgttttgccatcagatgaacgggcgctgcttgttaggctgaccttgttctctagggttggacaattaagcattaactgcaaaataataataataataataataataataaaataaagtggcattacacctcattataatgccactgtgccacatgtagtcattgtacagttccatctgtttgttgattaacatttatttacagtaaaatcaaatcagttaactctctttgtcaagtaatgataaatttaataaaaccaaaataatgaataaagaaaagaaataactaagtgtaagaggcacactgtcttttattattcaactggtaagttcccattctttctctctctgccatcttttaattagacatattatgttatttgagtgggataatggagaacagtgggaattctcatccccactgggtataattgctacctgtcttctagatagtaagaggaaagcttcaagaaaatggtgggagaaaggggaaaatcttacagcaatcaatttaggtaatatgctgtaggcatggcagagccagactttgtggagt

SEQ ID NO: 98826 - DNA, 1085 bp, Homo sapiens
tcgaagctcccctaagcatatttacatacacacaattatgttctaattgcaattgctcctatcatttcattaaattaaattccttgaggaccactataggcaatggtgtctcactctataaggaatacatagaattaatgaacgttagcatttagcacctggaggctacaaaagttagtggttctccatctttgctctgttttcacagggttctttctctcatcagtaatatgttagaaatgataaatcaaatcaatcacgcaaaacctgctagaattcttgggtcctatgttcaccacctttgagactttaagagttgaggagcagctccatgaaggtgaggtgactcacccatgctaatgtcagagccagtactaaaaagcagggagaatcctactcctgaaagtagaaagttgctttcctttaaaattaggagataatgaatggcattcatgtattcagcttggcattctccccatttatgagaccagattatgtgagtatctgggcatggacatggagattgaactgggctttgatcatttaattgtagaatgtggtgtgaatgggcctgtgttctcacaaggttatttaaacaatcctaacccaaatcttactcctggggtcttagggggttaataaacacccttttgctccccttctgggttgaaaaccagttgacacagaagacaaaggaaatctgaatgtctgtcagctttttgctgataagctgatggaaggatgtgagctttatatctgtggccaaaagggcttgcttcagtgacacttgcagcccagctggctacctgcagcctctccgcctgccctgctaaggttgttggaaggacactctgtgcaggcagacaggtaggcagataggcagataggcagatagacaggtctgagagtgggtggagctgaggacagagtacttttcccaaattctctaatgagatgagtcactcccagcctcacccccatgccagaaacaatgaagggaagaggtgggaaaagagtaagggtgggggtgttacttttccagctgaagtcgtacccagtaaaattggagaagaggaagctcttgg

SEQ ID NO: 98827 - DNA, 1045 bp, Homo sapiens
aatccaaagccattatttttccattttgccctgaactctttggaataaataaaaagttaagacttggggaaggttttgagcaggggctagaatggcaagtcttaccggaatgtatcttcagctctgcaaatgtgaacagtcttttaaaatatctaatgtgaacgggtcatccagctaggcctttgtcttttaattctgaatttttaggttgtgaacactgttcgcagtcattagttttatttttctacaaagactagtatgatttaggagtttttgatagaaacatgagtactctgtgattgccaacagtttattagttctcttttggaagaatgcaatggaaatattacatacagatcctgggaacacgcatcggtgctgctggtctctctgaattaggagctgatgcaatgcagaacgatttctgcaccatctggagaatctggttgatgatccaatcagtattcttacatgcagcccccttctacctttttggctattcattcgcaagcactacatcattttcttaaccgaattataagtagggatggacttttggagcctcatctgtaaaaggtgaagtcattctccttggcagagaaaagcctgtgggagatgcgctgaggacaggcttggctcccacagattttgggggagacttctatgaccccctgtacacgtagggatttgagccaagaagttatgtcaacacctactggggcaaaaggtccagagagcacaaagaagacacactaaaatcctccaaaagaagaaaatgcaaaaacatttccgggggtggggtggggtggggtgggatgaagttttattttaaatgtaggtataattcttctagatttaggagaaaagcagacagagaattactctgacacaataaggttttctttgccatggcatgtagtcctgccaaggaggtttgctgaacaggacaaaattccagctccttattttaattttcatgaagggtaatgctgggaagctgttcaaaattaaaaataaatctttcaataaggagacctcctatgtg

SEQ ID NO: 98828 - DNA, 1159 bp, Homo sapiens
gcctgggcttggagcccatttgctggagagttgcttcacatctcaaagtgacaaccgatgccttgtttgtttgcgtgggaaagagaatgacactcacgtaacagccttctattatattgttcttttaaaagatcttttatgctggcttgatttgctttttgctttctttgccaagtgggtttgccttgctttggagagctgcagaaaataatacaaactctgagagattccaaaagggtatttcggttcttggtgtgatgatgtggttttctttctccaggtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcaggtaggaattgaatctactttattgtatgatctgaatgtatacagagaaaaggcttaaaataatgaattataataaattgctataattgaaatagaatcaatcaagcctgggagctgcgttataatgtaaaagatacttaggggctgggcacggtggcttacacgtgtaatcccagcactttgggaggccagggcaggtggatcacttgagcctgagagtttgatcaagaccagactgggcaacacgatgacaccccatctctacaaaaaaaatacaaaaattagctaggcatggtggtacaaacctgtagtcccagctactcaggaggctcaggtgggaggattgcttgagcccagcagtcagaggttgcagtgagctgagtcactccatgctggatgggattcatctcagtcatttgaattatgatgtccatggctggacatcagagcacttatagattatgtacaattataaaattgatttttaccaatgcagagtgctcttttggtatttgttatattttctaacaaaagcattagc

SEQ ID NO: 98829 - DNA, 1142 bp, Homo sapiens
cccagagccttccttcagaatcgctgcccacaggaagaaggctgccctagcttagcacgtgttttcgtgccagccctccattttgaaatcctgcagcatctttgtcatttttttttccacgtggaagtgctatatctctgagtcctgaaaccatttagttttctgctccatttcttctctgtttagacactgccgtgccccgtcctacatactaattactgactttttgcttctgtggtgcttgattcattgtgtcacattttcccatgtgaaagtggaccaggaaccttggcaaggaggttaatggatttcagagtcactcttatttaaccctggaagtcacagcaaaagaagaaccaatgactgacccatttgataaaccaagccctggtcagcttcagctgcagactagtaatggatttcactatggtggcaagcattacagaattaaaacagggctgaagatagctcactgccacctccatgtttgccttctcaaactggctgaaatttttccttttgttatcattatacctttagtgaggaacacatggtggaataaaaataactccaaatggcagatagtacttttggatttcagtcaaattctgtcactaattagattgcatgaactttcagtattattagatttactttccagatctcagcttcctcgtctttaaaataagggtatttgtccaaatgattttaacatcctatgtagctcttagagtcggtgattttatgtacttcatttattcaaaaagcattcatttgtcattatattccagttaccatgctaaaaactgtaaatgcagttttgaaatctaaacaagaaagaaatttgtattttctctctgaggacttatgtgaagtaatcttccctttaatacaaattttacaatacttttgtgaaatgttttaaaggtttgcatttttctaagtttcacaggatggggagctgatcttaatgcttaaagaggttgttggtaattagtcctgaggggagtttgggaagtcctgcttaccttgttaaaataaagtcttcaataagtgggataaagagaaaaggagagtgaattacccttattaaatgttaccactaaaaaataattggccattaatcactgcaagctatgtaa

SEQ ID NO: 98830 - DNA, 1027 bp, Homo sapiens
tattattattattttgagacagagtctcactctgttacccaggctggagtgcaatggcgcgatctcagctcactgcaacctccgcctcccaggttcaagagattctcctgcctcagcctcccaagtagctgggactacagacgtgtgccagcacacctggctaatttttttttatgtatttttagtagagacgggggtttcaccatattggccaggctggtcttaaactcctgacctcaggtgatccactttggcctcccaaagtgctgggattataggcgtgagccactgtgcccggccaagacatcaattcttgaggagcacatatactggtgatagaaacagacatggaatggtgtctaagtagcaagacaccattatatgttacaaacaaagcaggaaaggaaataaggaactgaaatgtcaaacaatgacataagcataaggactggtgttatgccagtcctgtattgaggctagtagtgggtagttttgaaaacaaaatcttgccattcacaatgaccctcaagctacccgatgggtgtatgtactcagtaggtcgattcagatgtggagactagaaaattagaacaagtacaacagttagcccttttttgttataaacctcatatttgtaattggagacttactcgcaggtggacatatttctgatgacaaaggcaatcactctgtcagaaatttaattgcttctaaatagccagacacaatacttacataaatgaaagagaaaataatcggagttaggttttttacttctggatgccttgtatttattaaaagagagctcagattactcagaataccagttttctcttctttttagccatctctgtaggtaattgtttaccaagatgctgcagttcggtattaactacaggcccagattggcttttggctatattcaagcccatatttgtttctcaatgtcttgagaatagaatacttttattctcctcctcctaaagaggagatgggccctccctttaaatgagaaacacacttatat

SEQ ID NO: 98831 - DNA, 1005 bp, Homo sapiens
ttgggtgtgaggtagagtacatagggtacctggactttccatggaatggtttataccaaacttatagacacactggagacatttctgactttaggtttagtgttggctgacggcttttaaatgacattattaaggctcacacagatttcatgtggatatgtaaatactggcttgtcctaaaggggctactttaaatcttgacataagccagcaactgtgttctctaaactactcaagaattaaattttagtctaatccatgggaggaaagaattaagatatgtggaattactggaattttcttttatgcttggaatattgccgttcttaaatgtcacattgacagtatgtggttcatttccagaagcttgtttttttccccagagaagagcacatggttggtaaaggaagatcaagattccttttataatacaacatgatatgatgtgatattttataatatgatatgatagccctttgtatctactatcatgtggctatagtttctttggggcttaatgctgtcaaactcctgtcaactgaatgtgaggtgacatcccactagaaaataataattacccattgtagcacctttctctggtacttgctgtgtgatgcagaaagtatttcacaccagtgaagtgaatggatgttcattaaatgtatctataatggcaagaaattcagtgcccgtttctttcagagcaatgagaaactcaagaaataagccatatgtctcattttattccctccttagtcaataaaggtaggtctaacttggactttagcagccagagttgtcacctgggctatatacataggttaatcaggggttcctggactgagctttttagataggctttttagttcctggaattacatgcagaattctgagggtgccagagagcatcttcctaaaaagaagatgccttgctttcatcatattttcaatagcacgaaatggtctgaaggtcaattttaacggccacctatttttgcaaataag

SEQ ID NO: 98832 - DNA, 1016 bp, Homo sapiens
aggagatagaaccagaaaaataggttatgggaaagtctcacaacaagaaatgaacctctataggaagccaagaatttttcatgacagcagcaagtgattgatgcatccaaaaggttctggtttaatcatggacagccctgcttggctgtctttgttgtaaaaacacataaaccaccatgataagaggttatgcactgttcatatatgtcaggagggatgtctttaaaacagccatctttatgtaaactaacccacagcagataggactgggagaaagcaattagtggtggcaacatatacaaatgtcaggggaagcatgggctttatttcagagtcaaaacgtaatgcatcccaactgttgactcttccttataacctgtctttcagctggagagagattaacaacaaaggcttatctgaagggttgaagggttttacagctaagacgctgaagtgctattgacagtccaaaagttgtacatgattaatgaagccttaggaaatggaactacagacccaaggtgctgcttcctccaagatatgtgttggactggttgccttagcattttagtgaggtgacagcagtgcttaaatacatcgatcatgggagagttacctttctgcccatgctcttgggggatgctccatttcccatccagaatgaatttcatagcccaggcattgaattttaaaatggcgattaaaaatcagttaagtattagatgtctgtgatagctctggaaactactctatcacatgagaccagagactttggtttttctatcaactgtcttcttgccttggttgcagacttgattttctttctttcttttctttttttttttttacattttagcatgtgattgccattttttctctctttattattattattattattttgcttagcttttgtgacatacaaaagtgctatggcagtgggtttttttttttttttttgagacagggtctcaattcatcactcaggctagagtacagtggcatgatcccagctt

SEQ ID NO: 98833 - DNA, 1398 bp, Homo sapiens
tacccgaaagcatatttctttttgctttagagctgcaagtaactaatcatataatgatgggggaggcatacattctgtgaaataggtcagtgagggtgcagttagctctagtgaaagactagttagaaaagtgagaacaaaggccaaagattcccaaagtgtcgtaaatgaaagtgtttcagaagattcattggttgatctctagccattttatcattcatgcaatcaatcattttcgtgaacatatttttatgaaaaatctcaaatccaagttttccaggggaatttctcattccatgtcatttatcaaatttgcaatgtaatagtatagtttcatactgcattccatttgtcataggacaaaaactcagattgagacaccaactcctccactgccagattacatagttggtttttagttcagaacatatggtcctgctgcctgttagttggtaagccagctaatgtgtctgtcccatggactgtacaaactgatcaaagcaaccaaagacatttggacgattcagatgcagccgtcaacgtatgctgctgcttcagttagagcttagtagttcaacatctgatgttagctagtgagtataccacatttttgtttcttcctttcggattgcctttcagcattttagctactaaaaggaaaaagtacctctagacaaccaagtggatggtttttgtttgaagaaaattaaagataaagggagaaagatcaccaggtgagcttcaacgaaggcactagatagaccccagactgatcatttgccatttggttgtttgcaaaattttaagagcctcatgatatttcataaagatcaggtatcatctcactgaattctttttaaaaaaatgctgttttagcttcctcttttttttccccacatactccccattttatagtcataaacagcccattatggattccactggaaaatgcaaagattcgagggacactaatatatgcccaagtggaaggcttgaataatctgccaatgccatttagccaggttattacaatttttctaccaccctgaataattaagagtggcttgtcattgaccgagtcctgtcatttctggatgccatttttgacactatgcatggaagtcatacagtggttattcacagcatgcttctatgaaacaaggttaattacacatttttctgagatcccctggggtgagaacggggtatcttctttttttctttttttaagacagagtctcactctgtctcccagtggtgcaatctcagctcactgcaacttccacctcccagctcaagcagttctcccacctcagcctcccagggtgctaggattacagaaacgagccaccacactcagcccagggtatcttctttgctatcaacatttagatttat

SEQ ID NO: 98834 - DNA, 1009 bp, Homo sapiens
taaaacaattctcctgcctcagcctcccaagtagctgggatttacagacatgcaccaccatgcccagctaatatttttgtatttttagtagagcctgggtttcgctatgttgaccaggctggtctcgaactcctgacctcaagcgatccgcccgcctaggcctcccagagtgctgggattacaggcgtgagtcactgcacccggcattaaggtaactttcttttccaaccccttattgtatttcaaaatgtgctagaaaagtaccttgtaaaggtagtaaattggctttgcatatctagaaaaatgtagctcatctgtcattttgccaccttgacttctgagcactgttaccagagtagtttttcgtatttttcaattggaaatctgtccctgtgcttttgggtgctctttatttaacttgtttgatgaaacttcttagagcctggtgattgggaacactctgtaaatgagagattattattttagattgccaacttgaagggcctttacgaatctgtctccaagtaaacagcctcgaatgtgccaaacaaacaaagagtgattgattgatacttagacgtggccgaaaatattccaaaattgcagctttcaagacattttatactaggagagctcagagctaatgagggcagatttcctaagatctatgaccagaggtcctgatttgaaaaaactttctccaggtttacgttatcaagaaattgaaacagccaagttccaaacaacaaacatcacttactttgtctctacatttgccttttctaattgaatttagtgcgctgctgtatttcctcccagaaagtgtattgttttaaaattaccatttcagttctattactcaaagccctcgctgctaatgctttctgacagttatcaacataatgagccataatgaaatgatgagcaatcttcggtggaaacccaatgtcgattcgaccggtgctgtgtgactgtgttgtgaaaatttgaatgcaaattaaaataacat

SEQ ID NO: 98835 - DNA, 1062 bp, Homo sapiens
ttagcaagaacgtctcccttcttctgaaacaaggaggtggctttgcatttttgctttggtctatttgcagtggtttctatttgtttgtttttttcttcttccctgcagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtaagttgtatgcttgtctctcattcctgtgatgccaacagctttcattaccacctagcaaggcactgccaggtcttctcctgggataatcattcagggggcacttgagatcaaacattcatcctttctcaatcatagcaggggaaatgcttgtaaaaagaaagggtctttcccactgcttctggttgccttcagtgtgcacagctgcctacagactacttggtggagaagagattgagtgttcagaggttgtctgacagtgtaattagagctgagattggaatttattagtggctttgccattgcactgaggactcagggaagcttgacaactggcaggagaaacaggtagacggcagggtttgggaatgtggtttcagtctgtaaaggacagctcagtgtgcactgagatcattgcttaggttgtcattacacctcttccttctctactcatagttttgtgttcataagacttaggccccaatcctaataaatgcttgtttaatgattgcatttaataaatgctgggttaatgaatggatgaggctgggaagcttggtatgaagagcaggagtgaagaaatattttctcacactttatatggacagtgttcctaggtgttaccattcctttcatgtacacttgggccttcacagaccctacaatggctgtgaccttgatcggaatggggagcactgggcccatgaatttccattaggtgaatctgtgcttggagggctagcctcatggctcaggtcagacaccttccacagattttgagtttgtttcccagcctgt

SEQ ID NO: 98836 - DNA, 1105 bp, Homo sapiens
gcttggccttaccacttaactgtatgaccctggacaagttactgaaaaccctgtttcttcatctgcaaagtgggaacagtgataatgcctcaagctcacagaattattgtgacaattaaatgatcaatgagcatataaacaatgaatactcaatgaatacttgatatttattttcacaattgctattattagctactcttaggcactaatttagttttaaaatgaactataaagacaatcagatactatcaattattctacatttcttaaaaagcagaaaaatgacatagccatatatatatatatatatatatataaaattttcaaatagtaggtgtaatcagctcattaaattgggcattatactgtcacgtacacacatcaatgcatcaaaaatccagaagatactacgttaccaagactatcttaaaattcgactttgttatggtagtgggtgagccaatgaaagaagagttggttcttctttttcctcctcctccttctcctcctccatctttttttattcaaagccagcagaaagagataattaaagcaaagctaaaggaattgaatgcaaagtttgcatcatacgtgtgaactaatcttttctccatggcatatctagaagatcaagtaagacacccattcagatggttcattaactagtgaaacttcggtggaaatagggcaggaggaagtagtttcttgctcacaaagtcattagtattcaaaaatacagcatagcagttctcacctaaaatagaaggataaaaaatactaacagtcaatgcttgttatgccaagtacatctttcacaggggttttgtttagaataaaagagatagtgaaagttttcagatgctagtaagtagtgaataaatgcagaatgtacttacacatttatgtaccaaatgctggaaggctgtgcaccacatagagcaaagaaatgtactaaaccatcaatttactaggtcattttaaatgtaggcagcaaaatggctatgtgcgtgaaaagccactactatattttgagagagcctttctaagaatcctgaaatattaataacatggtcttaatgtagttggagacaaaagaaggtgttaa

SEQ ID NO: 98837 - DNA, 1073 bp, Homo sapiens
cttgaacactttctgttgtctctgtctttatctcagtcttgggattgagagtaaacccttttcacaggcaaaagattaaggcattatttctctacatcagtcatcaacacaaagcatttcaattgctattgtagttgtttcatgaacttagtggctcagaaattaaaaaaaaaaatcagtatcattctttcatttcatagacaaaaacagtttaagcccaggatcctcagggaagaaaaaccctaaaacaatgtaaatgtaaaattaatcataatatataattgcagaaatttgaactgattcaaagaaattgtccccacaatggtataggaatagcttccaaatcaggccataccatttaatcaaaaaaagaaaatcaattgaaaagtggttttacttataatgatactgagtaaaatcagcttttccagtaagacagttgatgaaaagtttactcatttgcagcgatgacaagaacatgcactttattatgctttgtcattcaaaacttggggaggcactgcagagtaacagacgaaccatggagtagaggctcaatcctagtatgctccagaaaggacccgtggacaagttattcatctcaaaaatgaacatgtcctacaagatcactggttggcaaagtatgacccatgggcaaaatctggcctgccaccagtttttatatgatctgacagctaagaatgttttttaatagatgacatttggaattgaattggtaataatgaacattttccttgaaaccaaattaagtgaaatgttctctctccaacaaagaattccattcccctcactaataactctatattgcaaaaaagtacttaatgatttactattatattttgaattctatcactaaaaaaataattgtaaaaatttgttttctatcttattacataaataccttcatcatatccttggtcttcctcttggcctctggctctttacagaaatgtttgcccattcctggatgagatgattttgaaggtcccttcaacaatctaatttttaactatgctcaacagatagcagtcaaaccacttgtagaatgcagg

SEQ ID NO: 98838 - DNA, 1338 bp, Homo sapiens
agtccacctaggcctcccaaagtggtgggattacaggtgtgagccactgggcccagccttaattctttagtaatttttaacaacaatcaggttgtactattctgattttactatccagaaaacagaagagtatcaaataaacaaatacttgaaataaaataagtaagaattaactgtgttatttaatacttgtgaaacagtatcaaaaaacaacaatgatcagttcacaatattgatgtgagaggataactacttacttgagacagtattagtttggtaagtttcctttgaatttcatggtgtaatttttagcataacagagttctgtgtgagagcttcatctcttttcctttctctttggcagctacccatttctataaggatatttcactccaggctctgtcccataatttggggggcaatacagggcacattcatactggtttgagaaataatttaaattttatatttcaaacatgtcagatttcttttctttcttactctttttttttttttttcctgttttgagacagagtctcactctgttgcccaggctggagtgcagtggcatgatcttggctccctgcaacctcagtctcccgggttcaagtgattctcctgcctcagcctccagaatagctggaactacaggcatgcacaatgcctcctggctaatttttgtatttttcagcagagacagggttcaccatgttggagaggctggtctcaagcttctgacctcaggtgatcagtctgccttgacctcccaaagtgctgggattacaggcgtgagccaccacgcccggcctcaaacatgtcagatttctggcatgccctctccccactccaaaatgaattccaaaaccaattattcttctcctgataatgatttgtccctttagcatccgggtattagagaaaggatgaggtggtttgaacctatttaagatgaactgcattgttaagagtttacttagacacgggtctatttacagttaagcagtggttctcaaaacatgtccctggaccagcaatgttgtcatcgggtccagggacacattttgcctgggagtatataagaaatgcaaattctcaggactcaccagaccatcataaactaggagtgaggaccagcaattggtcttttaacaagtcctttgttaaggtcattctgatacatgctagactctgagaagaaagattagaaactactgatcttccaagattagaagcttctgagatgagaagtttggtattcttgctgaatttggattcaggtaatctccagtttaaaaacttttttttagttagctaatgtccagactagagcttaggccg

SEQ ID NO: 98839 - DNA, 1097 bp, Homo sapiens
attccctttatacatatatgaagcagagctgtttttaagtagagtttatgacagtggaagttactcttcagagaagtaaattagagagtttagttgaatgtgtttagtttacttactttggaacttttactgtttaagcttactccttccaaactcaccaaagagaaatagctcctcaaataatcagatgatctgttctaaaggcaagaagggaaaataataagtcatctcccccactgcattctttttgtttgtgtttaatattttttatagagttaatttagatttagcaggctttatgtaaagtttcttctggaagatttagtgaatcttttgtgaaaaccatcttcatctgacattttagaattactcacctatttatgggattatactgcattctgttcttgaaagagcaaatccattttcagcatagtttttttctgtcactttttttcgttgtctgtttttctgaaaactacctccaaggtaagaggggaaaaatgggaggagatggaacgtagaaaataggatagaactgtgtcttgccagaggagatgatctgaattagaaactattggttgaaggaagaaacctccaaagccaatacaataatttatttaactttaggaatggtgtttaaattgtctaaataaaaataaatttttacatacttccaatcttgtctatagttactaaactgcagatgctatgagttagacttcaatcttgggttttctaccccatgttaataacagaagaaataaaaacaataatgaagaagttatcccatagtgttttagaaattatatccaatcttattttaaaacaaaacaaaaaacttgaagttttatgaaaatccattggtcatttccatcttcccctcttgcagccatgcactgtgctataggaataatgagttactcttagtgagtagcttatacacagaacacactgtcttttatcctcctgtgtattatctcatttcatcatcatttcagccctacagatgaaaaaattgaagttcagagtagttacatagtttgttcaagttcacacatctaataaggggcagagctaaaaaccaagttcaggccttt

SEQ ID NO: 98840 - DNA, 2392 bp, Homo sapiens
ctccagcctacaggacagagcaagactgcgtctcaaaaaaaaaaaaaaaaaaaatcattgaatctatcagatcatgggaaccgtatagacttggaatttttgaggattaaaaagagatattttaaattatttagtctggtactcttagaggaaactgacccctagaaaccttaaattgttaaatgttaggaatggaatccaggtccccttttcacagagcctggcctcttctcagtcattgtatttcagccattcacttcctccacttctacatagcagggaacggattcctggttgtgtttttgacaggagaaatgtaaccttaacacagccttgaggaaaacatgaaggtgatcatccatctgccaaaatttttaatgctatgttttgtttttctttcttttcctgggggaaggatttatgacttcatctttttttttttttttcccttcaaatctgagcctctttagaaatgatcctgcctcaaggctagggggaaaaaatcctattttaaaaaataaaatgtagatcttcttatggtctgctttccagacacaaaagagatctatgtcttttattattattatttttgagacagggtcttgctccgttgcccaggctgagtgcagtggcacaatcacggctcactgaggccttgacctcctgggctcaaaggatcctcccacctcagcctccccagtagctgggactacaggtgcatgccactatgcccagctaatttttaaaaacttctcgtagagacagagtctcactatgttgcccaggctggtctcaaactgctggatgtaagcagtgttcctgtcttagcctcccaaagtgctgggattacaggcatggtaagccacccaccgtgtgtgatgtggccaggatctaattttgattgttgattaagagtactttttaagtaattttcaactgttttgtgatatatgaaaaagaagactaattaataatgagatatcaaataatgtttcttaaattgaggtagcttggctggccgtggtggctcatgcctgtaattccagctctttgggaggtcgaggtgggaagatcacctgaggttgggagttcgagaccagcctgaccaacatggagaaaccccgtctctactaaaaatacaaaattagccatgcatggtggcgcatgcctgtagtcccagctacttgggaggctgagggaggagaatcgcttgaacccaggaggcagaggttgcagtgagccaagatcgtgccattgtactccagcctggccaacaagagcaaaacttcgtctcaaacaaacaaacaaaaattgaggtagcatcttgtaaatagaatcctagaaaaggttttcaacttcccatgccttttatagtcatttttgaatgttggtctagagatctgcttgggatgagtaagatttttttgtacatctgagataaatttaggttgttagtgacatgctgttcttttgtatttgataataagcctgatctgtttctcttgctttctttaaatgggtcagttctggcttccagctcatccatgttttacaaagaacagttgttccactttttcttctctcatgaccaaacactttgggagcatgtcaacatcatggtcttgtttttattatgattaatatcaatttttcacccatcgtttgtgtttaatatttgggatgagaaacggacaaacaaatgagcagattctgacttggtatttctcctgcatgccatttgtgatttataatttatacatggaaggatttactgacctacctgatagtccctcccaacaaagataaacacacttacacgtcatcagggtaagtaagatgcacttgaaagggacaaataattcacctgcaagcacttttggcttcatgccttttcccatgaatttgaactgttgacagagaatgctcaggctgccaaaacacttcccacagaacctcccaaaatccccgaggttgggaccagctccacttgccatgctgtgagaaggactaaacactaaccttttgtgccctacaagagtgcatcacacgaaagcaagaaaatggtccacttcctttgggattcaggtctggggatgtgctgctctcctctgttcccttttgtggatgtggtcctatgaaaggctcacctgtaaggctggacaaactgccaagtcgtccttgtcaaactgggtgcagaggaccttccactgtcacactgtgtatttcggctgccgattcaaaccgatttcttgggacaatgacccatcaagctgaagagttcaaaatgcattaagtagattttcaaaccccctccccccggcttacaggagtataactgagtccgtgggaaagggtgggttgttgccagcacccttttgtacttttaagagga

SEQ ID NO: 98841 - DNA, 1037 bp, Homo sapiens
ttataggtgtgagtcattgctcctggctttgtttgtttgttttgtttttttaattccatattctccaattacctctgacatatggtatttacaaggttcttccttaaactttttctgaatctacagttcatgaactcctgtgacacttacgcttttggcagatattttccaaatctctgcctctagtagtgctgacctccagacctgtctctccaattgcttcctgaacatctcaactcaaacatatcatgacccactagctgacctcatgcccttccttttgaaactgacatgtcttcctgtcttccctattttggctatagcatctctactgtctctggcatttggtctgggaaacttaagtccagtttcaattctactttttaaaatatcctgtaacatctaaatggaaatgagatcctcccgttgcactggtcttagatagagctttcttcctttccttactcaagggcaggtttggaatgaagttggattctagaagttaggccaagcaataattagttcattgacattcacaacagtaggtaatagagtccgagggttgagaatagggaagaattcttacaagaattatccttgggttaacactatatggtccaagccttgttgtgtatgaaataatcagaatttcataatttctgtttcttcaaaaagtagttttaaatgttgttttctaaaaagcgtcaaagggggcgcaatataacaaaacataagttatagccaatttcaaatgcatgcagatcctaccatggttaacaaaatgcaaatatattttaaagacttattgaatgtgtagtagccttttgtcattctatactttttctaaaaattcatgctaaaagtgcaactggcagaggagtttcatgaaactcttacgatgttaccttatgaaatatgaatttcaagaatgattgatgattttcatttgttcagcgtcaccagctcatagaaaacaaaatcagagattacatgaattttcaaaaataggatgtgggggaagagaaagtaaaattgaa

SEQ ID NO: 98842 - DNA, 1001 bp, Homo sapiens
gctcatgaccttcgagggacacatgtatcctgcctgcaaccttcgaggcacacgtgtattgtggctgtgacctggaattacactgccttacttcaaatcctgacactgtcacttattagccaaatttactcaagcaactgcttaactgtatatgccccagtttccgtagcttaaaatggggataatgtgtttccttattcataagtgtcttatatatttagtatgattatgtatataaagtgccggaattacactgccttgcttcaaatcctgacactgtcacttattagccatatttactcaagcaactgcttaactgtatatgccccagtttccttagcttaaaatgggaataatgtgtttccttattcataagagtgtcttatatatttagtatgattatgtatataaagtgctgagccataattcttcaataaatattagttataattatttttgaaatgtgataaacctcaattggactcctgctttggctatgtaaccagttggacctttgctaaacctcaattttttttatctagaaaataaaatgggaaacacagtatctaatagagagttataaaagaattatacattatttctatcactctggagacacagtccctaaaagtacttggtagaccctttcctatcctcccagcttcttttcttggcaacgttttattttttttcagagaatctcagttcttccctgtaagggatataggctccaactttgtttcctggagaggactcaggtagtggtgtattgagtgctggtgccaagtactttgtgggcagtttcttattattattcctcacttaatatcaaccccattttgctgaggaagccacagctgagagttaagagccacatctcgcctgctctctcaagtggcagcaacatcattcaatgtgtttgtctgactgtcgagcctgtgtctaaccactgagtcgttcgtcctccatcagatcaaacctgggaaaggcgtgacagtgag

SEQ ID NO: 98843 - DNA, 2733 bp, Homo sapiens
tccttgttcctgacacgttttccttgggaaattcagtacaaggtatttcgtctctcattcagtcatccctttgctcagcaaatatttgtctttaaagactctcacgttctctgagaaaaaaatcatggccttcgcacaaaaacaagaagattctatttagatttgaataactaatgtaaacaataaaaataaaatagacatttacatattttatctatatctagatacatagaaattaggccgaatgtatgtgtgagacagatagatgagtataactgttttcatcctatttatattggctttgttcttcaaagaaaaaaaaagctttttagatactacaccaatgaagaaaaaggtatcatctagaatcagccctgagatgaaaaagaagtgtgcttatttatataggaagtagctttgcatacttttcctttctgttattgttcaatcttgaattaaactgtcttttatttttctacttccatttgtgattactatgaaatttctgcctaagggctgccaggaattttgtaaaaattaaacaatacaaaattctttgaaagaggattttgagtcccaggcatgctgactttttaagctcaaaaagtacgcgtggcttttgcaagcagaagcaagtcctaatgctttgaagaatgtaaaatataatcagtatttcagaggcattgaggtggttaatctattaatctatactagggtaataaacctaccagtataaacatctgctaactagaatttggagctctcaccttaccttagagagaaagtttaacctaattctgcagtttcaatactaatcatgggttagatttttttcattgtagatctcacttgtccttgctttcttgagtagtcttagagcgtatttgtttgctgcaattaaagcagccgtagtctgattattttcttaacttgattgtaactgggtacacttggctgatcatgtgactctctaaattagctgttataagttaattcccaagcctttgaggtgtcaactctgtcctcagccacttagagctaatatttgaaggacctccagggtacttggagggggaggtggtggtgcttcaagaatcccatttgcccacagcacagtggaggagtacgatctgggctgtgtaggaggtgctgatttttggactgaaaaagcactgaccccctgcagaccacgatgtcctgctgtgattcttcccttgtttgaggcagggctacagatacaccccatggagccagagaacagaattccatgtgtcccccaaacccaaatcatatacccaaagccctcagccctcagatttaagaattcctagcctagtagctttttcgggtggtttctctgctcccaagaaggatgtccaggaggtccatgggcccccagtccccctacttcttgcagggtgctgccctgtggcagagccacctctaccttcatgcctgctgcagggattcacccatccttaagtcctccagcccgttgctggtttgctccattctagaatttgcttcctactgcgcgcaaatgtttcatgttagagaatggtaactgccatctctataatggttaatgccgaacatgactgcagatgaaagtaacagtgtgatcacatcctttctcttcctgttctgtggcatgagtcagtctctttgccttaatgtttatacagatccttaataacaaataacagctgatggcgacttgctgagacatgtacaataaggaaagaaattacatcgtaaaagatttgggctttgtcccaattttttttttaagagaaaaaaaaaaaagcagggagagagaaccttgttctaataaccagtttgtgcaacaatgttccttttttcaaatctaatgagatctgatccccacaagtattatgatttattacctgcccctactggactgtttgcgttgggtgtttattatttggatattcggttaacataacacttgaaataatttcgctttctgaatctgctcttctctctttttcttgggtggttttgtggtaggtcggacatcctcagatgaaaataactcacaagagagccctttttctgttatcagtgttctgtcttcatgtccaggaaaatagactcgtgggtttcctcaaatgtaggggaaaaacaaaagttgtttgctttgtgtctaaaagttccatggtgtcacacctagaaaccctcggtgttggagactggtgcttcatactccattgtcagcaactttgcagaaagtgttgtactaaagctactacagtgagcaagcttatgcccttcagcgttgtctcaaattttgtttttaagtccaggcgtaaagataacatgtgataatgacctctccatttatttggagtcacagatttgatactggaggatctcaaagcattaggtcaaaataattagctctgtctgtagaataatcaactccctctctgcctggatgcaacagatttgtaaccttgttttaaaagctaggcgtttccattggtacaagtcagcgtgtttaggtgtggagagagttggcagcctgcagggaggggtggctgtttcccagaagtcacaattcctggtggagagaggaagctgtctactcagtttccctcctgtgctttgtgaatggtgaccgccccttctcccagcctctccagccttcctcaaggtggggcaaaatcagccccctgcagcaaagtccctttccttccttcctgtggagac

SEQ ID NO: 98844 - DNA, 2751 bp, Homo sapiens
atgaagttaatcccagacagctagaaattagccagtatagcacatatgcttagattggatgctgtgaatatatgctttctggtcaacaaaaaagttaaatcatgtagatgctcaagtgaagagcacctctgtcgactggaaagagttgagttatttaccttttttcccccagaaactgtttcttgaggtggaaaagcaactggaagtacaactacacagaactgaaaggctattgagtttgattatgggcataaaattaaattttcagctaaatgtgacagccctagtagaacaaagaagaaccaatcaaaaagttattgactattgagacttttagacagagctaacaaattgaccatgggttccagggatagtcacagcctggaagttgcttattctctttcttctaaaaggtagggaagttcacacaaccacagccactgtagccaggccagggaagaaggccaatttaggcatttaccagcatgtgcaagatgcagtttttcatctgagggggtgagaccttttctaggtgcctgtgttagaacttggagcacttgcaggtaatgagaacgcattccaatacaagaaaaacctatttagggcagtactggatatggattagccaagaagatccacagatcaaaatagaatccagggcagaaacagagcagagaaatttcccagagccacttatgggtaagtggaacaccaatgatttactaattacaggcatgtttttgcacaaattcattttttagtaaacaagatatgctttatgctacttgcaggccattcttaaatcattcttttgggaatccttataaagacatcagttaaaaatctcatctgttatccttcaagagaagtagttggcatgatttttgaaattgagtccctgcctacctagattcaacagattaaatatgaattatcagtggataattacctagggctgttcttatatgtatattttatttccttaagtgtgaagcacatggagtgtcacgcagatgtgggaaaaggtaactcacaaggatcttttgcccagaactcttctggtagggcgctgctggctcttccagtatgcacccaaggtggcaaagagtctgcctgtcaatggtatccagaagtgacagtggggatagccctggagaaggttgtttggattttcataagggagagattctctctctgatctttataatctgaatcctaccctcacaggctttttttttttttttttttttttttttgacactagtcacaaaattaacagtcaggatgcttttgaaatcagaacaatttccctggaggaggcacagcccccggtaccatcattattatatatgttttgaaactccatagactggaactcgttcagcgtgctgtaatctgtgtgtttagaagctgtattgactttaggagtcacacagatgggtgtagacccatgtttcaacatttttctttcagggacacacctttgaaattctgcttggaacatatcagcttcctcctccctccgagtcatcagccatctcagtgaatagcgcatctgcatcctttattgatacatacgggggcaggggtgagggcagttactgcctctgcctctgttttctcattcaaatattagcaaaggtccacaaacagaaatagagaaaccagattaaagaggacagattgtatttatggtaggctgtaacacattttgatcaacaacaacaaaaaagtttttggagctatggggctgcctgatggtaggatacatactgggtttattataatgcatgtacattgttcaatgtaactttcccatcatttttatgccaaggccatatgtatggctcagatgaaatgtaactggcaatttttcattgttgttgttctttatttacctttctcttttaatcatctccctgttccaactaaacaaatcacccccaaaagccagtgattaaacacaagtgagttcaaagagccaaggcaagtctgcccaagagtggccgactccccctacagaaggccaagtctgccaattgcagtcttcactcagagcctggtagtaaaactgctgagaataaggtggtttcagaggcaaacagtcacctggcccagagggcttctgcaatggagccccctcagaagggctaggctatgtgagaagtggtgggtgttggccgtgtcaaacagctccttccagtaggcatccaggaactgagtggtgtgcaccccttaggaggccaagcctaaggcaccagctacagacaaggtgcccaggtggcagaatgcagcccctggcccggccaaggctgtgtggatctataacagacaattttggcatgactgcattgactttcactctggtcttctgggttctaaaatgttggttccttaagtaggaactaaaagttaatatctgcccttgtgatgactaggaatttggttaattcatgtgcctgcttagcaaattaaaatggccagtaatcagaactagaatgttaaatctcaactgatctgagtttttctcatcttttgatagaataaattgaactatctggctgggcacagtggctcacacctgtcatcccagcagtttgggaggctaaggcagtcagattacctgagttcaggagttttagaccagtctggccattatggtgaaaccccgtctctactaaaaatacaaaaattagccacgcatggcagcacgtgcctataatcccagctactctggaggctgaggcagga

SEQ ID NO: 98845 - DNA, 1037 bp, Homo sapiens
agttccttaggctgccacattagtttcctcatctagaaaatagctaactggacaaggtcatccacagggtgcccggtagctcttaagtgtcaaaatgagtgataagataaagtgctcttttgccaaagataagaaggactatctttgttgacagttatctagaaaggcttccaagaataggaacttggtaaactgtagttaaataaagctggtaaaagaggaatgaatatcccttgagccaagaacaggagttagctgccacaccctggggttgaagagactgggtaggtaggtggagctgagttttgaaagatttttgaagagcagaggaagagtttggtctctacccctggctcgttcatcagatatttcttgattgccatctatcttccagccattgagagccattgatcatgtaagattctttccctactggagttgggaaagatatttcatccaaccaaagggaatgtgcccttgatatgaagatttgtaatgtttaccaaaaaatctttgttctaccactttaggcatagaagaagaagataagaaaagcctcacagtaaagttgacttgcaggttatatttaaaggatgattgtctttatttgaacaaaaggagaaaataacaaatccgttgtttgaagaggaaaaaaaacagaaaaaaagaagtgcctttgatttggcataattgatgctttattgctttgtagataggtggtttagggcattggacaaaagacgataatgtttatttagatttgggatttgggactgttctagaaagtcaatatatggttgttacttttagtagctgtaagaatggcataagataacttagtggaaggtaagtgctttctgagcttttctgtctgatgatgaaccctagtggttgcaaaaatgagtttataccttagaatcatttgaggtactgattacaaatgtacacttttaacatcaatcctcaagactttagagtttggagtctgtgatctgaatttttcacaagctcctaggtggttctgattaatttaggtt

SEQ ID NO: 98846 - DNA, 1914 bp, Homo sapiens
gctgtgcctttttctacacaatttaccctgccccaaaggccctcctgctggtcacaattttgcacattccacaaggttctacagaagcatcatttttttcttctctctcctaactcccaccagcattttgattgcgttccttcatgtcacttatgctgtgtaatgccatcttatcggacttgttagggcacagagtacagtattactcagtgagtaattgttctgccatttattagctatttgacttcaggcaaattaataatttttctctgtacttggttttctcatatataaaatgcaagtagtaatagttcctacaacatcagcttgtcgtcataagtaaatacgtgaaacacacatgaaccgtggctgggacgcagaaatcctgcaatcaatattagcgcttactcctactcctgctactgctgctactactcctggattgtcatggccctgtgtcaggaccttgaacttggtaaaaggagtgtaggctgggctctagaccccactttccccttcagttggatactctttttcagtgaacaacctgtacaactatatatggcagttctgtaccagaatctatgcacttcccaggctaagtctgtatttatctttgcattcactatagcacctaaaacaatacagtacatagagtcctattcagtcattgcacgccacgtgtgatcattgaaatgaacgaagaaacaaatgtaaaaaggaaaatgtaaaaatgtcaatatggttttatttgtaagcagcccattgatttttgaagcatactcaccgaatacatcatgtattttcagtgagaaagcagtatttgtcacaatactagaaatgtcataaatttaaagagtaattgagtctgaattttctgcaggtttatttactagatcaaagagtgacttcaactttcagtgcttattttatttgccagcataaacttacaggttcagtcaaatgccaagaaaataagttaataatctaaattatgcagattctggcaaattctctttcttttgggggagaaaaaaagagagagctttgagtttttatctcacttcagcaaatccaactgactataatagtaagaataaaactctagcaattaatctaatagctctaggctgctagtcattccagaaaagtgacattacacagaatatactagttactctcattgcatgtcattgatatataattcaattgattttcacattttttacactccaaaatgaaatacaacttttgtcatgtcaccagattggaattcattgacaatacattaacatgccaaaaataatattacacacaagaataatgtagaaataaattacaggtagagcagtatccctaaggagattttcatttgtgtcctataacagaagacttataaccctactcatacatctgtttcatcccactacgttttagactcttcgttcaattcaataaattactcattttgccacacactcagcactctgtcagttttgctgggcagtatacttacacaaaagagtctgtataattctaaagtataaccccccctttttttttagcaaacaaatacagagactttcatgcaaatgaatccttgaaaaagatagtctggataactgtaaggctgccacaacttttgtggaaatgttttggaactgtcttcttcaaaatgtctgggaccttctttttattgataatctcctcctcctccttcttcgtcatcgtcatctttgtctttcttcttccttctttcttcttcttcttttcgatggaatctcactctattgcctaggctagagtgcaatggcaccatcatagctcattgcagcctccaactcttaggttcaaatgatcctccggcctcagcctcctgagtagctagggctacaggtgtgcaccactgcacct

SEQ ID NO: 98847 - DNA, 1762 bp, Homo sapiens
agcaataagagtataaaatcatatttttttgatttttttctatttattttatttatgaaacaaatactgtttattgtagaacatttggaaaatgcagagaaagaaatgctgctgcatgcaaagtaaacctgaaatcacatttggtaacgtctgggtgcctatcccctgtctcattgctgtacttgtaatgtacaaagtataaatgcaatgtacaaaatataaagagtattactctgtttgggtggtggtgctccccttttcctctctactgctggtccagaccaaggaaagtggtttgttggtaacgtcagaatcacctaccttgctgggtaaagcattcatttgctgttttagattgcatttctgttttgcttgggttgagtactgtcatctgtatgcctgtggagttacagcttcccacacactttattggcccacaaactacagctacttctgtccgcctccccggctcaacattccagttccccattaggactggcaccttcggctgtaactctgaaatcctctatgaatgagctcttgccattcccttcccttagggtgctgcaccctgtttctcaatcccacagaatcttgttctgaatcaccaggagcttgaatttggcttactgatctgactctaatatggtaccttcttaggggatcccctcgctgcttcggttctctgccctctgcctagatgtcctgagagcttgatgtcatcccacagcaagacttagttctcagtccaggcaaagtggcatatgcctgtaatcccagcactttgagaggctgagatgtgatgattgcttaaatccaggagttcaaggccaccctaagcaacatagcaagactttgtctctacagcaaataaaaaagtaattagtgatgcgtggtagtgcatacctgtggtcccagctactcaggaggctgaggcgggaggctcacctgaacccaggagtttgaggtggcagtgagctatgattgtgtcactgcactccagcctggaagacagagtaagactctctccccgccataccctcaaaaaaaaaaaaaaaaaaaagacagttttccacaacattttggacactgaattggccctacatcagtttcttttaatgtaatcccccgaattccagcttcttcccatctccctctgttgcctatgtcagtgaggtttcgacaagcctgtacagctctcccgtcaaagataaacagtaaggtctatgtcatggaaagatgagtccttaataaaagggagtccttagtagagggaatccttaataaaagaagcttcagctgttacccctggctggttatccagttgcagggactggaataactcctggtcccttataattctgaggttattgcaattcaacagtgattgcctttcctacttcacaggcaatgaaaagtttcttactatgttcccagtcccgtgcagagcatgacttggtacaggttttgtggtgtattcatctcttgaaaaaggttgtatcagtacagaaagaggggaaaaaatgagttgatcaaaactggcgtatttgatcatttaagttgtattggccaaattatttgttacatagtaatcctgtttccttctgtgagatgttatgacaactgaggacatgctttgattcactggctgcagtgcagactagttgggtgttcatttgttttgttttgcacgtggaaatttaagtaaccacaacagcagcaactggatattgttctttgaatagagagaattcattgaatt

SEQ ID NO: 98848 - DNA, 1057 bp, Homo sapiens
ggatgtgtgaatcttgtagaagtcactttatccttctaagccctgtattccttgtttgtgaaatggagatcatattatatctatcaatcatctatgtgttttagctgattaatatttcactagactttaacataatcagatttattattaattgtactgtggttttattgtgtgcgtagctgctaagtacagcatagaaagcctttcttagtaaggtaactaaatatggcttagagccatgttgaagcgaacttatttatcataaggttatcaggtttagtaaaaaatcgcaaattaattttgtatgtataaaaatgcggaatacaggcaagtataaagataggcaaaatcatctataagcttaccacataatgagagccacacttattttgctttttatgcttccagactttctttgatgtacacatatacaccacaaaatgagttaatgatcatggagcatgatcataaaatcttttcagatcaataaatataacttcataacattatttttaatggctacagagttttctgttgcctgaatgtaccacagtttcttcaactatcctctattgttggacatttaagatgctttcagtttgatgctttcaataatgttgcccttaatatccttggccaaagttttaaaatgtagccttaattattttcaaataattgccaagttgaaaaatatgcattttttagaaaagcttcagtacatactgaaaaaggctcagttttgagacacatgcttcctgagcttgaaacaaacataacgagaaagagcatacatataggatcattatatgttaatttccatgcaatactcattaatgaaatgaactccaaagtggaggtagttttactcattagcacttgcatgtgagaaaacttcttttaaagttttactttctcaaggttttttgccatcaaagcctttcttttcattctaaaaaatcaattaattttaacacttgttttaaacaaatgtaggattctttggctacatctgttggcagctaccctttaacataaagggttatgtattttagtctcc

SEQ ID NO: 98849 - DNA, 2587 bp, Homo sapiens
aattccccaacccctcctttttcttgtctagcctcatgatgtgttgccagttagaggtgcaattaaatgaacaatcagttttattttccattttcatcacttatggagaggcccaagtattcatcaatatcaatgttattaatgttttacatcagtttaattatatcagccttaatttttcttccatagactaatgttactaaataggttgcatcttaattggttatgatgcattcacaggctttagacatttaaaatactcgatcaaatttctcgatcaaaattcatcaattaattttaggacatctttctacatattagctatcctgtttgtgtttggccaacctctcttgctttgcactgtgaacttgaggcttggattcatttgttttcagatttaagtgtttaaaaaagacatctccactttgaaaaacagtttccttttgaagtgcccagcctggcaatggctgaagcagccccaggcaaattaacatgttaaaagaatggatcaatacctttctggctcctttaccctcctcgcactcttccaagggagaagagttttgaagaaccctaggaggcccttgacagaggtgccaggaggcttcaagaggactgtcagtagcccaagtggggaacattgacagcttgatctagtgcccagatcgcttctccgctggccatttgaaaatggatgcaagaggaattgacagcttcaggaaagctttagccgttcatgtaattatggagaggattagaagaaaagtgttgggtgacataagagatcaatacaagggcactagttgactgaattcacctttagctgttagggcactccattttgtaatatttagcctgtgcttagagaagaatgtttgataggcttgtttatttttttaggggttgtgtagacctatgcataagaaaaagaagacataagcagcctctggtttttgagcgtggacttgtagataattaacaatgtaatgcttccagtccttagggtgcaaaggtactaattaactaatgggagagattgagatttcattactgtgttctttaaggaggtgccagcaaagaagtgcagttgaaagtaatatatgaatattcaggtttctttttcaaaccctttcttttagaattgcctctctgcttgtatcctagagtttaaaattagcactgatacactaaaccaaggtaagagtgtggttgtttttgtaagaaaaaaaaactcatgttgatggagaagtgaaaacattatctttgcatgaatgaaaagcgtctttaaaagatttggaatcaaccactgaatggtctcaaatgatctgacttttggaagttttcctccataggataaagaatggctagtgtacttaactaaaataagcccaagtacctaatttattctagccttcatacatgattctgggattctcttgtacaacatgttggagctacaactttttcaataattttaaatggttactgaatatgacaagaatcctacactataatttcagcaattgtactaaaactttttaaaaagcattgttagatctttcttctagagaaccataaaatcttttactgaagagaagtaatgttttaccgtatgaaaatcataacttttattgcaactttgaaaactagatacactaaaaagaacccctccccaaaaaggattgttgacttctacaagagatagtgattagaaaacacaacccattgagtttttccaatattttcaattatatcttctagctggttatcactgatctacaggaaagctattgatttttgtatgtttatcttacatccaatcttcttattgaactatcttgtgaatactaataagttttcagttaattctccggagttttctagagagcaaatagtttccattgcaaacaatcatatatgtatttttctcttatttaaaaaattaagcctcttatttcaaacttttatattacaacattggtcagaattttcagaccaataataaataatagggtagattgtgaacatccttatgaccaattttaatggatataacttaactataatatcagatctattttcttaatatcatattaattttaaacacttctcagaggagtgaatgttgaattttgttaaatttacatatttatcttggttatgttgcttttttggtttgttgtattttgtatttatgagatctaatatattagtagattttttctcgtgataaaccataaactctctttgcatttgtagaaaaaaaaaagccttattagatagcagtgaattttgacaaattcttttgaattcagtttgttaattgaaaacagtgattaggagccagaactttggaataccaactgaattttaatctcagctctgccactcactatgtgactatgggctagttagtaaactttagtaatttggctttctcttctataaaatgggaataatgatacctattgcatgggtatacttagtgttaaataagataatatatctaagtctcaacaaggaaatggtgtctattaagtgttcagtaagtgtcacaatttttattgtttattttgaatttctaata

SEQ ID NO: 98850 - DNA, 1054 bp, Homo sapiens
atatttgtggattcactttttgttgaatattgtcttttgtttctgtctccctcctccccactccccccagtgtctccaaatttacttattttttaaccttacctttattccttctagaatgggaaggcaagcgtactgcatattttacccaacaaacttaactctggttgaaaccagcactatcttctgaaaggccacgatcatatatgcattctataaactagaagaagaggactttgcatgaaatgtttttgaagttcaattagacttgagttcaaactaatttcacagagcagaaaatgggcatagctagacgttgcagtctaattaagtaaaagcaaagtcagttaaaacaacatctaaatgtggaagagctttggttttgctccacatggtctgacaaagtttgatgatgctgttcaaagtccatttgggatggattattaggattaaagagcagcagaatgctctctgtacatggtgtgttccctggtgtcattagcggatgagaaaattcagctgcttatctggctcttgtttctcaggatggatttaaacagacccacacttctcaaaggtgatcttactaacctcttcttaataagttacagatctcaaattgctcaaaatccttaaaataccatttgaagtaagttgattgataattatcatttcccttccgtttacagatattttctgcaccagtacaaagctgtggtacagtttcttaattacccagataatcctgtttgcttgtatttttaaactatgaagtgctgggtaattattcaattcttaatagaaggcaaatggcaatgtaaacaataattaggatgttagacagactaatgcgcttcaaagcaaattggatttttttcatactgttcagcttgaagtcccataaagctaacaatttagaagcaaggcgaaaaaggttccatgttgttcatattttatggcgttatctcttcatggcttgtttctgtgaatagcagtttgccccaatgaagctgcctgtgcccaagccaaatgtttctgtaacaatcgcttccct

SEQ ID NO: 98851 - DNA, 1007 bp, Homo sapiens
gaagtatacaattttgttgtatattgaggtcatcagtattaaaatgtactcatatcaacaaaaggtatcgtattaaaagctttttaaagaaagaacaagatagaaatgttccaatggttttaaaataaacagacttgtgctctgaaaagaggaagagagctatgtcaaaaaaaatgatttcttttttcaactatactatagaaggagcttaggagaaagaagtaatggaaaggaaatatttaaaatctacttcacagagatgctgcttccatatcctttgcactgttgaaatttttcctctacctttgaatcgtatcattaagaatcaattgcttgaatcacatggctgcttttatctccggctttgaagcatggctgtgatcattgaaaaaatgtaattctttatctataagagagcagcgtttaattattgtcctttttctgatatacttttttttttcctctttgtgtgaccaggctgcctttgtgagtgtgaatcatgcaatagtctctatttggggttcaccaaaacatcgcatagaaatcatctcagggatttttgaatatggtattcaagatttgatgacttattttagtctaactgagcttccttgtatctttcagaaatgaattaacacataattattctgttaagatctgagcctctaggaaaaagccttcttaagtggtttttcagttactgctgtgcaaagcaggggtggtcatgatataagtttgactttcacataactgaactttactagttaatggcggggggtgggggaacgggtaattggtaaatttaacattagcaaaggactgcatgcttgtcagataaatttctcatatagaattacataaagtaaaaattgtaagtctaccattccctgcccacacacacacacacccacatccacccatacatacacacacacagttttcaaaagcttactccaacattttacaagttaccatttttcacaatttggcaggcaactcaaatatag

SEQ ID NO: 98852 - DNA, 1247 bp, Homo sapiens
tattttgcttttttttctgctaataaaatgattaactctttcaagacactttttgcacaagaccttgcactttggttgtttgtttctgttattgccatgtaaaaatttctgatgtagttaggtaagaaaaaacttgaatgacaaaggattccaagcttgagtgagactttatttatttatttatttatttatttattttgagatggagtctagctccatcgcccaggctggagtgcagtggcgcgatcttggctcactgcaagctctgcctcccgggttcactccattctcctgcctcagcctcccaagtagctgggactacaggcgcccgccaccacgcctggctaattttttgtatttttagtagagacggggtttcaccgtgttagccaggatggtctccatctcctgacctcgtgatccacccgccttggcctcccaaagtgctgggattacaggcgtgagccaccgcgcccagccagagtgagacttttaaaagatgacttgagactctaaaagtcttaggaataataaaaacagttggccctatccttgatatcatgataggcatcaagagtagcacccaggcacagtggaaataatatagagacgaggaaagatgtatgaatttggtcacttagctagatgaccttgagcatgtttcttaagccctgtgagccttggtttgttcatccataaaatgggatgataatagttatatttagtttacagacttgcaatgaggacttggggttgtaagattggtaaaagtcacctcagagatcatgcaacaacttgatactagcatttctgttgtcattgtgctcttcccaaggtcatagctattgacttttaagagcgttgagttgaaatagtagaaggaaaatccatcccctgaccactccttgatatcaaggctaaagataggaagcatctctctcctttgccctaacaaataataatatacgttttcacactttgtattgaaaatattatatggagtatgtcatttttttttcctcctcgataggaaagagaaacttcctttgaacgagcaaaaagtgacttgtgggtaggacaagaaagagggtgtaaagaaagcttaagaaggaatataaaggaaaactggccaagtcttcagaactctggcagcagtttcctccccaattgtcttttcaatggttctactgtggcaggacaaatagaagaacaggtgaaaggtcacctacttcctcatccatcttcct

SEQ ID NO: 98853 - DNA, 1831 bp, Homo sapiens
tttcctgtctatggacttggtaaaatgacaaagattgttaaatatctcccgtcttctgcataagtgcgtgaatgatctaaatgtgaaattaggattaagttgttccagttccctcccactgactaaaatcgagtgaagaaagtccattttttctttctgccttgtggaccggtggagatatgacccaacaaagtggagggacattgcttcaagtacattctgttccctgaacacccaccgatgggttctctaaatgaaattaatcttgatgaaagacctctttatttctcttaggaggtggtaattaagcaagcaagagtcttcttatttgatctgtggtcagaagcaatagcaaattgtgacccaatttggtattgatttcagttattgagtttttgaagaaatctatgtatttttatcacattaattactacttaccatattactaagtggatttttttttctcacctcaggttcagtgtatgcagttgattcttgcttttttaccccttcctgtcagaatactggggagtgtataaagtcctttgctttacagaaagtttatatctgagtaagagatgagagtaattcctatttatacagattgtttgtcatgtgtgaaataaggctcaaaaatatcttttattccaagtttttgtcttgcttgatacttgtttttataatgtagttatcaacagtctgcggctgccaatccattatggttactacaaaatagttagaatgtaattctggtctcatctatggaacaatcagattaatcttttctctgggtaattgttgagctgtagatggcattgccacatggttcatctgatttggtggttaaagggcctgaattaactgactgccaaacaatttgtctggcatttcaaccattctaatgacagggtgggattaactatggggcaatccacttgattgactgaaaatccagttagaacatgaagaaaattgcattttttggtgatttggtgtcataaagttacacgttactccattcatagtttacacttgtctgaagtggcattcctgcttagctatagttatttctaggagtaactaacagtgaatgttctttcattttgtggtaaatagaaaaaagagtggctatcttttctgttgactcagtgttaaaaattcaaaaaaaaaaaaaggaaatgtgtaaatttaaaagtttacaagttggaatttaaggatttttaaaataaagattaaggcctcgatttttggtttgctcttgacttagcaactactagataagctgtactgaattggtaacccaaagtatattctggtattaatataagaaaatatgtgagtgcattgttactggcaactaaattactatgatcatagcaggaacagtgaaatgagcagggcaatgacatgccatcacattttagagtaaattattctgccttttccgttttgtaagacaggagccgcacatcttcacatgtcaagattcttatatatatttttaaaaaaacaacattggcttccatttcctgctaaaatgttcactctcagcattagcacatcttcgtgtatctaatgtcattgattttcaattgtcacagagcctagtaactcatacattgctacattgtgaaactccttgacatttttacaaccaaaattagaaagaaaagagaaaaagatggtgggcaaagtgaatataaaagcaatcgaacatttttctggtttgctttatggaaatagtcttgggggatccagttaatcacgtgcgtcctcgaaggggaggaatttagggtttcaaatctagtccacttccgagcaagctgttcct

SEQ ID NO: 98854 - DNA, 1333 bp, Homo sapiens
gtcttcctttggcaagctctgctcttcctgcccttaatttgcaggtctctgctcagtggttgaaacaatacccatactagtttttcctttatgagtaaatttgaactgttgccacttgaaattgtagctgttgtaataggtgaatttgaggttgttggaccaccacaaggaactgccgagaactcacaagcagtaaatccaccattgcctctggatttcaggcaaaagattgaaacaattaaacaaacaaaaaaaaaacttcctcaataaaatattgtcttatctcccataagatcctttattagtgatgattggtgctcagtagtttgcttcattattgaaagaaaaataatcaggtgtcctatgagaataaaatgggattgacaaatcactgcatgatgaaactttgtagttgatacatctgctttggatctttgcagtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaaggtaagagggtccatattgcagttttttcactggggcttagtgcgagtaattaaatcagagatgagactaaatggagtaaagccagtaattagtagcccctgtgggatgtggtgggacacaggggtctaatgagtaagtgctatagctccaggtggcaaagctaagacgtttctaatactgacaaaataaatgatgctgctgtaatcagcagaaagccaaacacatttgc

SEQ ID NO: 98855 - DNA, 1049 bp, Homo sapiens
aagggaaaatgttagggagagccttttcctgaccctttggataggatactctctgatagaagagagaattcacttgtggctctgtcaccctgatgagttatgtggtcatctgaaacttgcaaaaacaaataattctagtagataccagacagagatgaatgcagattttgctctggagtgtaactgctctacatagatgtatttatctttttgaattgtacttcagattctctattcatcctttttagaaaaatgaatcaagtgagtcctaggatggaattttaaatgttaagcaagttgaataaataagaacctgcagatttaaagagggggagaagatcaaatgagtaatgattatttacataagtgagcccaagtttaggttttgatcagtgttggatatgcacagcctcagcacatatggaaacgctcaggcaaatggtttttgtgttattggctttttgcaattggaaattcatctatttttcttttgttttttgcagttaccttattggattccagatctgttcagggagaacttgggtggatagcaagccctctggaaggaggggtaagtcctgagttgctctctgatccaaagggtaaaaaaggagtgattagcaactttctgagagtcctaatggcttgattcttgttgattgtggtgagggggtcagatttccgctgtggcctatgaagtgaattacgctttgttggagaaatcctatactccctttggataactctgtcatggaagaactagaaaccaaaagggcagaaaggggtttcaaaattaggagactggtggaggcacagacttagatgcctatttaaaactaaaataccaacaggaaatatgatccggggaccaaattagaatttatgcctattactgtgatggccatgaagtcctgacaaggttaatttaagagcaattgtcctgcttccagatgaaaaaaaaagaataaataaagatatgagagagaagacatttctaattgtacctgcatgaactgcaggaaggctctgtaccttgctctcactcttaa

SEQ ID NO: 98856 - DNA, 1031 bp, Homo sapiens
ctagcgaaagcctttcgagctctggtttctgcaaagtttcccgagccctgcgcttctcgggaccgggctgcggggcctgctccgcagcgcagcggtcgtggcgccgctcgtcaggcgccagtgacctgatttctagcacccggagtcagacacctttctcctcgccaagcccagcgccccgagggtgcgattgcgggcctgaggggcccgagctcttcgccccgcagacttggggaacccgccggcaagttgaacgcagtcgagttttagcttttcgccccagaattgcacacagtttagagctaacgtgcggggtcgacgggacccgtctgggtgctcagttttctgtgcatccgttcggacgtgctgggaggattgtatgtgcctgtgtgtctgtgtcgggaggtggggcggggcgggggggcggtgatcatttagtttctgagaaacccagggagaggcgaactgtgtgtgtgtgtgtgtgtatgtgtggtgtgtgtgtgcatgtctgcgtgtgtgtgcatgtctgcatgtgtggtgtgtgtgcatgtctgcgtgtgtgtgcatgtctgcgtgtgtgtgcctgtgtgtgtgcgcgcgcgtgcaactgcgtgtatgtaggtgcgcgaatgcctgcgtggaagcggacgcggaggattgtatgtctgtgcgcagatgtcctgagtgtgtgcgcgtgtgttcgagtgtatgctcgtgctctgttccagcgtatgctggtgctctggcctgcgtgcatctagtctcacatccgtctctcattcttctcctttccggcatccatctatctatccgtccgtccatccgtctatctatccatccatgcatccatccatctctccgtgcatccgtccgtccgtccatgcatccatccataatgcatccatccatatatctgtccgtccgtccgtccatccatccctccatccatccacccattcatctatccatccatccacccatccatccatccattcatctttccatctctccagacatccgtccatccatcc

SEQ ID NO: 98857 - DNA, 2313 bp, Homo sapiens
cagccgagctgcagcagcccgtctcaggggcaccgcagcctccccgggccctacggccgcccgccagcaggatggctggaatggccttagtcatgaggcttttagaattgtttcaaggcaggattatgcgtcagaagcaatcaatggagcagctggtggtgtttatttgggtactaccaactcctgtgtggcagttatggaaggtaaacaagcaaaggtgctggagaatgccgaaggtgccagaactaccccttcagttgtggcctttacagcagatggtgagcgacttgttggcatgccagtcaagcaacaggctgtcaccaacccaaacaatgcattctatgctaccaaatgtctcattgtccagctatcctgaagtacagaaagacattaaaaatattccctttaaaattgtctgtgcctccaatggtgatgcctgggttgaggctcatgggaaactgtattctccaagtcagatcggagcatttgtgtcgatgaagatgaaagagactgcagaaaattacttggggcacacagcaaaaaatgctgtgatcgcagtcccagcttatttcaatgacttgcagaggcaggccactaaagatgctggccagatatctggactgaatgtgcttcgggtgattaatgaacccacagctgctgctcttgcctatggtctagacaaatcaaaagacaaagtcattgctgtatatgatttaggtggtggaacttttgatatttctatcctggaatttcagaaaggagtattcgaggtgaaatccacaaatggggacactttcttaggtggggaagactttgaccaggccttgctacagcacattgtgaaggagttcaagagagagacgggggttgatttgaccaaagacaacgtggcatttcagagggtgtgggaagctgctgaaaaggctaaatgtgaactctcctcatctgtgcagactgacatcaatttgccctatcttacaatggattcttctggacccaagcatttgaatacaaagttgacccatgctcaatttgaagggattgtcactgatctaatcaggaggactatcgctccatgccaaaaagctatgcaagatgcagaagtcagcaagagtgatataggagaagtgattcttgtgggtggcatgactaggatgcccaagttcaacagactgtgcaggactttttttggcagagcccccaagtaaagctgtcaatcctgatgaggctgtggccattggagctgccattcagggagatgtgttggccggcgatgtcacagatgtgctgctccttgatgtcattcccctgtctctgggtattgaaactctgcgaggtgtctttaccaaacttattaataggaataccactattccaaccaagaagagccaggtattctcaactgctgctgatgggcagacacaagtggaaattaaagtgtgtcagggtgagagagagatggctggagacaacaaactccttggacagtttactttgattggaattccaccagcccctcgtggagttcctcagatcaaagttacatttgacattgatgccaatgggatcatacatgtttcagctaaagataaaggcacaggacatgagcagcagattgtaatccagtcttctggtgggttaagcaaagatgatgttgaaaatatggttaaaaatgcagagaaatatgctaaggaagaccagcgaaggaaggaatgagttgaagcagttaatatggctgaaggcatcattcatgacacagaaaccaagatggaagaattcaaggaccaattacctgctgatagtgcaacaagctgaaagaagagatttccaaagtgagggagctcctagctaaaaagacagtgaaacaggagaaaacattagacaggcagcatcctctcttcagcaggcatcattgaagctcttcaaaatggcatacaaaaagatggcaactgaacgagaaggctctggaagttctggcactggggaacaaaaggaagatcaaaaggaggaaaaacagtaataatagcagaaattttgaagccagaaggaccacatatgaagcttaggagtaaagagacttcctgagcagaaacgggcaaacttcagtctttttactgtgtttttgcagtattctatatataatttccttaatttgtaaatttagttactattagctagtgatcatttaatggatggtgattctaacagtataaagttcacaatgttcgatgtccctagcttatcatttttcagctgcatgtaaaaggaagtaggatgaattgatcattataaagatttaactattttatgctg

SEQ ID NO: 98858 - DNA, 1036 bp, Homo sapiens
aatttaagaggaaaggaagttaatctttacagcacatttacttttattgtcttgtttaatcctcacaatgtcccgtaaggtgggtgttattcacccaaacttatagatgaatggactgaggccaaagctgttaagcagttgggccaacattacatatagccagaaatggcaaaagaaggctttgacttctatgcaaccatgtggcagaacctgtttgttttacccacttaattatatcagtctatcctcatgccaaactcaagttgcaaacaggcatttaaaaaaatcattcactcccaatacatgagaggaatgctgccaggattcagattacacaagagaaactcattttacatgatcagttttcctttctgtctcctgatatcagaacttgtcatgaatggcttatatcttattttgatatacttctttgtgtccttttcttatttctgcatgtctttgaaatctacttctctgctgttacttctcatgttgaaagtccctgtagatcttttttctccagactcttaaaatatctaatcaatttctggggaaatgtgacctgatttctttcagtcagagttcctaccctcatttgctgggacaagcagccctaagaactttgaccctttgacattcaacagaacttgaacctgattgtatgtggggggttcccccttgcccatgtagttatttgatttcatttgaaaaattaaaagtaagagctgaaaattaaaactcaaattattaaattgtggatgtaccattgtcagctgctgagccattccttggcagcaatttttctaggaatagatatcatacatttcacatctgtgacagaaacaagcatattgttttatgcttttgatttagcccagtctggaaatgtgttttcatacacacttggatgcttgggaaacatcctaggttagaagggatcttcattagtgctggcatatagaaccagagtaagagacaagatcactggctcatggctataagtttaggaagtcttaaatggagaaggagatggatt

SEQ ID NO: 98859 - DNA, 1044 bp, Homo sapiens
gcagaggcaagaagcctgggaaattcgtgtagggggaggaattgacaagaaaaatacccagtccccttaggtcaaatccctagctcctaacagggacaaagggcctgctctttccctcactccttcttttccacttggctgctttacagaataggataaggaagtagaacatgggcccaggaatgacaagcccacaggatctgcaggcagccctctgcaggcctccagctccgaaacaaaagtaccaaagcccttctccgccctgctaggtccctgtgatgctctggcctttcgagttcgtgtgaaaaatctgggacactcagtctgtcaaatgcgggggtgggaaggggacgcaccagtaccaaggcatggagaactggaaggaaaatatctagaaaatctgtgacatatggctgctgtagatataggcacttgcaaatgagactgtaatgctaaacagagcctttccaaccaaataggcaaagcacatttctgaataattggactggggagaagagtaaagtttcgccatctgaggcaacatggcgcagtggaaaagaatggatggggtttagagagcgcgccagggatgaacactacctattctatttactggttgtgtccctttgagcaagccacttcatctctttggacttcagttgtactcatctgtaaaatgggttcttgagtgtaaagtacttgtacatgtagcggaggggcagtgaacagcttccatgagaaccataacaattcaagacggcagctttgccagtggaattgattggtttaaaaaagagagagagaaaattaagattttgtttgaaaattttatctgaaagtcctccatggtctacaaattggctcattatctttcctcttgttttacaaatgagtaggagagaacctggaacaaaatctagtctggaacagtgcctttgtaaagaagcctctatggggaccaatccgcctgcaggcagtagaggaggaatcaggtttagccacagcaagagagaaactgagttccttaccctctgccatatcagg

SEQ ID NO: 98860 - DNA, 1036 bp, Homo sapiens
ttgctgtgtatatttggctcccccagaagcgagcttcctcctttagccagcctgcagcccaacccccaggtggatgaaaggatggtgacacctcggtgaagacggtgacagtatttgtgatataagtgtcgaaatactagatttatataagtttgaaggacaatgagattacagttattcattaagaaaacaaatacagaatttattccaaaaggtaaaaaaggtgaaagaagatacgtaacatgagtagtatggttgttggaagcattttttcgtattttcacttcaaagttttagaactttacactttctttgaacatgtactgtaaaataaaacaatgcaaaaattgtgttttaaatatcaaattagccatacttgattcaaattatacctgtatacaaggaaacactcattggttcacactgttcttttctctccttcccaaaggatgtgctgggtggcgtcctgatcaccgcactcctcatcgtcctcacctaccctgcctggaccttcatcgactgcctggactcggccagccccctcttccccgtgtgtgtcatagttgtgccattcttcctgtgttacaattaccctgtttctgattactacagcccaacccgggcggacaccaccaccattctggctgccggggctggagtgaccataggattctggatcaaccatttcttccagcttgtatccaagcccgctgaatctctccctgttattcagaacatcccaccactcaccacctacatgttagttttgggtctgaccaaatttgcagtgggaattgtgttgatcctcttggttcgtcagcttgtacaaaatctctcactgcaagtattatactcatggttcaaggtggtcaccaggaacaaggaggccaggcggagactggagattgaagtgccttacaagtttgttacctacacatctgttggcatctgcgctacaacctttgtgccgatgcttcacaggtttctgggattaccctgagtctcaaacagttggaaactagcccactggacatga

SEQ ID NO: 98861 - DNA, 1114 bp, Homo sapiens
gtagagacagggtttctccatgttgcccaggtacgtctgaaactcctgggcttaagtgatccacccacctcagcctcccaaagtgctgggattataggcatgagccactgtgcccggcctcctccttgttatgatcaaattagactgtgcctggttgggtggtaagatcactctgaaagaaagctcactgtgaagagatgaaaggtggaggcagagctgtgaggtcatggggaaaagcctgctttccttataagtcctgctgttcatgttggaataaggatctgctcttccttgtttccatgcattttgcaggattccaggtaccattaccacactcttctgacccatgaaaccaactggctgctcacacatcaccaaacaggttgggggttagccttcagcacaggtggatacatctgggattcactgagattcctgccctctcctgcttcctagtggtttgggacaggccctctgcccatcgtcagcagttttttgctttcatacaaacctggaaggcactggcatctgcctaggaaagtggatctgtgaagaacagatgaactcaatcctttctggagtctgacaaagaagggataggcttccttgacattgcctgtcctgacaaggcctccctgacattactcctccaatttcacagttaccttctgtaaatctattttctcatctactgaatagaatcaggcgccctttttgtcttcccacctcttatctcttggcaattttaaggggaattaatgcaagaacaactttagtgtctcttgggaaaacaagccaaccaaatacaaaacccattaagcctactagggtgagtcctcttaacatgggaaggcgatgattatgcaaacaccggagttccctcctcttcagttcctaagaataaagaacaggtatcaagaactttctttaaagttagtgtaactatagttaacaaagtatccattgaagtttagtgcctgtaggactgagccagtgctttatcaacccaacacatcatcaccatgtgcatactctagaaaaaaaaatagcttccttaaaagttacagaggctcttaacgtgttaaaaccgaaaaatcacatttttcttgatttc

SEQ ID NO: 98862 - DNA, 1720 bp, Homo sapiens
attcaagtctagctctgtataggggtgctggggtgctgggataaataattcccagcagtccttccagttctgcagttcttgattatattgcttaccatcaacaccttatataatcttcacttacatgtcatttgaagatttttcttctcctttggggagtcgaggggaggagagttttgtcttttaagttagacatttattttgatagaattaaaatgtgccatctttatcagatttagtaatattcatatgaatgtgaatattcatattaatatgaaactaaggctctataatattagttgggtttggtttctgcattgttttatttggtttccctccctatccctcaccccaagtgtggattagtgtgcagagccagatagttaaatgcagtcactgaaattcttgctttaaaagacagtgaggcagaattgtttagtttggagagatgtgaaaaagaggccaccttaatatttcacctctgttgctttgggtttacttaagaatgacaatttagaatattttccagctctttccccagaaatataaacaaagatccttctctgctggtcaagaaatatatgtaattgtcctttgtctctgtggtactaacttgacagtagccggttcccctcccctccaacctgattctgtatttcctaagcatgctgaccttggaaccattagtagagactcagcagtttactctttcatcaataatgcactcactctgaagtggcaggctggacactgtggcccagctctgcatgggtgtttatagtttatgccagtaaatgtttctgttgaatctgtcaggagctgcaggcctgatcccttttcaagttggtggtgagagcagtgagtcagcatatttgtaaacttcagaagagtacagaacactgataatttactgtggcactggtaatttcatgaatatggagtgggcccatatgttcatttttagctctgtaaatctcaagaactgttactgccttggtaagctgtatcagtgcattggcacccagataaagagaactttctgcctgtcttgaagtaaatgaggcatcaacccagacttgtgttaggctggcctttgctgtggttttacagtagatgcttcagaactgcttagaaagctcttttcagatgggaatgtgggttgccttctggtagcatggcctgtcatcagaggtgtggttcccccagtagccggcctatgacacggcggctccagtttctttatgtaataaggtgagaaagagtgaggaagagttgtacagagcaaatgaattcagtgtcgatgtcttatccagtgagcgttgctatggaaaaacctgtttgaaaacaggttcttcccattaagttcatcagttttatgtttcatttttttccttttggcctttttaggaccagttccaagtgcaggcagagttcccctaggacttctgactgtggaccttcagcagcctccatgatttcatccttcctgctcgggtccctgttaccaaaaatacagggcccttattttcatatttgccccggattttttccttgcaagagtttcttgatagcaaatccttcttttaaatactagaaagtatgaggaagcgttctcttttcatagccagtgatttaaagaatagttatttttaaagtagactagtgggcttttagtgttaaatgtctattgatgttttgccagaagaaacattgatttttc

SEQ ID NO: 98863 - DNA, 1759 bp, Homo sapiens
caggagtttaaattcagaaggagtttctgccacaagttctaacatttcagctctttttctttgcctttgtagatggtgtccctgtggtacttgtctgctgaaataattccagctttgtttcaagaatctgaaatttattcatacaagtacctgtgttatatgggatttaaaaaataaatagttctgttttccatggaaggctctaggttttgtcagtattgtgctgtattaatattacagaccctacttgggtatgtcctaaggtggaagatgatgaactgtcagtctttcttattttctcttaagttttgtttgtttatttaattgtaaaccagaagaagtttgtaaacacgaaatggacagcttgaccaaaagcttaaaaacattctgctttaggccttatgtgcctgtgggccacacacagaagagctgattccacggcccttattcaccttttgcttactctccagcctctactattgcttgcctagggcaagcctcctaatctccttgtgcttcactttttcccatctgtaacttgtctgtcccacaaagggcttggccagggctgcactgggaatgagtgaatagaaggcgaggtgccatgtttttgcaatttcattattctttcatttttcttttctttgtttttgagatggagtctcactctatcacccaggctggagtgcagtggtgagatctcagcttactgcaacctccccctcccgagttcaagcaattctcttgtcttagcctcctgagtagctgggactacaggcgcccaccgtcacgcctggctaattttttttgtattttttagtagagatggggtttcaccatgttagccaggatggtctcgatctcctgacctcatgatccacctgccttggcctcccaaagtgctgggattacaggcatgagctactgtgcccggccccagctaatttttttgtatttttagtagagatggggtttcaccatgttggccaggatggtctcgatctcctgacctcgtgatcttcccgcgttggcccccaaagtgctgggattacaggcgtgagccaccgtgcccggcctcctttttcttttacatgccctacttgtcacctgaaatcttactctgaaactaaaacagctatcaaaattacatgtttaaagttatgtttgcactaagttagctaaaggtctcaattgaataagttaactaattgtgaaatttggatacaatctcatatagtcgacatttccattctttccttaattagccctaccacagtctctttttaattatttcactgtacttgtggaggaagtaataaattattccttttggtttgagaaataatccccttaaagatttttgtcaggtgaaagactgggtaaagaaccatttgttggcccaagaaggcagagtgatttcttttatttttgaagttgttattctaaatatattctatacatattgaagaaatgtgaaaattttgggggaaaatgatatgggtgtcagacaaatataggatgatggcattatttaagaacagaagttttcaaaacagactgacagtgagggtactttttaacctagaggtaaaaatcctttggttttacacagtttgagagtgatttaaagttacaattagctgggtcatcttgaagctcttccaacattcctgacctcctttaggttttaaaatatgagtgtgcatgtgtgcatgagagacacatagttaagattagactttaaaatagatctcaacgt

SEQ ID NO: 98864 - DNA, 2043 bp, Homo sapiens
tgtcaaaataagtcagtaataaagttggtattaagtttttcatctaatatatatgtatgtgtttgtgtgtgtgtatataaaatacacacacacgtacacacatacataccacaactaaggaacaaaattgtttttcagactcctaagcaaatcagtaaacacaggaattttgttactggggcatgtttagctgcatcatttcctccagtttattgttattttacatacagctttttcaactaagaaaaggtcttcagagtattaaaaagtagagtggaagcagattaagaactactgttccctgccattcttgattactgagttgtctgatattactctggcatatggcttactttttaataattaaaaatctctagtggctttgcagttataattgagctaagtctgttctccagagattcctgcatatgtcagttacgtcggcacttatacctatttcttcctgtccttttaatgtacactactaagctttcttttgtactgctttgtttggtggtagggatgaatggaacagaactcgattcacctttgagaaacctggctccgtgcgttataagaaatctggaaattcatctgattgatcttcgcattaacctatggagttttgttgacattggagcgtaaccttgcttgttatgcagggggcagtcctctgcagcatgtggagtatctgcaaaagcacccagaaagcccgtagttgtagctagagtgaaaagccgtggtcccctggtcttacatatttcttatttgctgagcatccttgcagttaacaacttgagatagaatgtcaagttgatgacagaataagatcaatgttgagtgggaaaaaaagaagaacctttaactttttagcagactgcagagcattttaagagtttcaaaagggttcaactccaaatattttagtggctttggatcagattattatggcatatatatatatatatgctttttctttttttcaggcttcttccccttcattttttgtggtttgttgcaaacttaattatgtatgttaagaggcatctatccttttcaaaaaccacttctgggcaaggaaaattctccacatttttgtatttggaacagttatgtggttgccgggcagatcagtggcaaaaattatttcttgtagaatgtatgggctttgtgtgtgattggctgcgttgacttgagcctgtgattttttttcccctttagcttgttacctatttcagttttgattatttacagttctacagaaaacttgaatttaacttgtgacaagatccctgttggagagacaaaaggtttagaactttagttttgacaattctagttttcatgctgctcagaatacattttgtgaaatgaaaaataaccttgtaagtaatatgcacatttaatcctgtaccatctgtatacacagtgggtagtaccttctgctacagtaatacctaatgacctggagttcatgacctttttcccctttcaggacacctgtgaaagatttcagatgctaaaaaatatgggtgaaattgtgatgtttccctggtcatcacactggtttttagtgtaacatgagcttggaaatatatgagaaaaatatctattgaacaacttgttgaagtaaaagtgttcaatttatggtttgatttatacaaaacattctggactataataaagggagatctttctagcatgcccacatttagttaccatcaacaaataaattgtgaagacaacaggttgaaaaaaattggaagtttttaagcttctgacctttggttagtctgtatggaaacagttttgattcctctggatgtctgcttttttgtgtttgaggcaagctttcaaatactatcatttttcttagcttctttgaaggaattaaaagacaaagcaatattaaacaaataagcagtgattcctacacagttggaatagtggtataacacaggcactgtttttatagaagcttcagcaatcatcacatgagtcacttagccctgccttgtttttactgctcttgcctcactctct

SEQ ID NO: 98865 - DNA, 1005 bp, Homo sapiens
ttaggattatttcctttgggtagtattaatattatgaataagagagtatgaagctttaaggctctgatatattggtaaattgtttacaaagaattttaccaacttatacctcagtgaagccttattttccctggtcagcattgagggtttttcactctttcccccaaataaaacaccttagggaatttgatgagctgaaaaaagactattttatcttattttgcatttgtgaggttgaatccttctctgaatgtttaatatttggttttcttttttgttgactttttctaagtttgtactggggtaaatcagtttcttaagcaatggttaatacagcgttgtgaccagttcctttatttttctagatgtaggtgcaaaaaactacagacatctctgtgctgtttattacaacaagaatcctgggtttgagatcattcatgggctgctggacagaattatgcagttgctcgatgtgcctcctggtgaagacaaggggggatatgtgatcaaagcatcagaaggtaagacagatgagccgaatccagagttagtgacagtgtcaggaagaggctacaccttgtttttgatgaagttggtagttttgatttgggattttagaaagaaagggagagttttatttcaattaattgtcaatattatccagaaaatatcccctttccctccagcattttaagaaaacacttttcagaactctcgtaagtgctgcacagtatactttcgttccaactgagctgtaacccctagttactggcacctttaagccatcaaaatggctaaatcactggcacctttaagccatcagcacatggtgaacccagaagttttaactggaagctggtaagacctaaagtgatggtttgcactcaaaagctgcctgtctgatggctttaagacaaaagaaaaaagaaaacaaaaacaaaaacctcagaagttattctgaaagatttcacacatgttaatcaagtcataaagtttgcagagcaa

SEQ ID NO: 98866 - DNA, 2128 bp, Homo sapiens
acagtggtatgctcctcgcttatctcagctggcatagatatggcccactgtctgctcctggccctgtttaatagctatttgtgtgtgcttatcttctttttaggctgtaggcatttactcagaaaataattattgaggtctggcatggtggctcatgcctgtagccttagcactttgggaggctgaggcaggcagattgcctgagcccaggagttcgagaccagcctgggcaacatggtaaaaccctgtctctactgaaaatacaaaaaaaaaaaaaaaaaaaaaattcagtgggcatggtgatgtgtgcttgtactcccagctactcaggaggctgagttgggaggatcgcctgagcctgggaagtcaaggctgcaatgagccaagatcatgctgctgcactccagcctgggctactggagtgagaccctgtctcaaagaaacaaagaagaattactgacggtttaggttgtagatgtcttgtactggctttgacctctatcatcaaagaatatctagaatagagcgccttgaatatagtgtgtactgagaaatgttaaatggcaagggcagttatttctttgtatctgttcagtccgaagttcaactcagaatatactttccataagtaacaatactttcatggctagaaacttcactgactcttaaaaataatttatttcagttgcttaaatggaattcttaagtttcacaaaaacttttgaaaataaaacatctgtttatcatataaaaaacatttcaacaatgcatatctttttttttttttttttaagacggagtctcgctctgttgctcaggctggagtgcagtggcgtgatctcggttcactgcaaactctgcctcccgggttcacgccattctcctgcctcagcctcctgagtagctgggactacaggtgcctgccaccatgcctggccaattttttttgtatttttagtagagacggagtttcaccatgttagccaggatggtctcgatctcctgaccttgtgatccgcctgccttggcctcccaaagtgcggggattacaggcgtgagccaccgcgcctggcctcaacaatgcacatctttgaccatattaagtggatatatagccatacataagcttgcccttatattgtttgttttcatttaaatgtttttgggtgtaccctatagtggaaagagcatgggttttacagtcagttaattctggtcaaatcctggttttgaccagataattaatcgtattagcaatataattaattaatatatataattaatattatatttattattattatctaatatatataataatatataatataatattaattatattaataataatataattaatcgtattagctccagccaattagtttgactttggccaagttacttaatcattctgagctttgtttctccatctgttttataggaataataatacttactttgcatggttgtcttgagaattaaataagattatagataaattgacagatagttaatacctagcatgtgccagataatcgataccacagattaacagttaatgttagttttcgttttcctccatttatgtgcttacttttatattattttaatattagagtacagtgtcttaaaatattcatgttttacttggatatctagaagataaaaggcattctgtattttatgtcaactattgctagtagcttttacctatgggagtaaatccgtggaagaagttttgctcaatgtatgctaacatgaagcagctttctgttttcagtttattccctcagatattagtttgttttttctctttttaatttggaaagcaaaatgaggccagcattcgttctatgtttgtgttagagcagcggtctccagaatgtattgaagggccacaagtgttataaagttaaatgatgactgctgactttcagtcttcctctctatacttaggtacttctttttaaaaatgagttttgttacaggtttagatgatttttttttttacaaaataaaaatttaataaattaattttcagaaatcaatagcttttatagatacaatatgtctaatttcaagctctaagggaagaaaagacccatgttataatagcacaaaacat

SEQ ID NO: 98867 - DNA, 1125 bp, Homo sapiens
cataaccaaacaccttagtttttaatcattggtactttggtggaagaggatctataccaaacaggagcctatttgaaaaatttgagttatatgtaatagtcatttacaaggggacatcatgtaccactcctttttcttttctgttaaaaaatcatttggcgtgttctttcatcttatagaattgtagctagccgcccctcctttgcgcagcttagatcagccctctccaggcagtactttgaagtctgtgaaatacatagataatttaggctgacatacttgccaggcccatttaaaaagcagaattgtttgatggcatgacacaagcagtctgttaactgagttataaaagaactgaggcatttccaacaaaccccagctttggcatgacttttaaatagttcttattttgtggtgtgtagtcagtggactttctatgatgtagtatggtctcttagtgcaacatactaggaaatgggaatgttactatacccagcaatttcaaggaggaatgggtggaaataagtttgtggttattttctcctttgattcagttcagctacagtagagggagtatcttagcaagatataaggaagtaagtccggagagagcaataacccttgggaaacgtaaaaagccagccaatcagtgtggagttgggagggggcgcctaaataatgaggttaatctaattattacggtgggcttaatacaaagccctagaaatcaggcttttcttaaaaatattgcaaaattaaatctaaaaatatatagttcattattgtatgtgtatgctataaacatcctgaaacctttcttgaatgaaatagagtataaattttttaagttctcttttgtttttgtttttgttttgaggcagggtctcactctgtcactcaggcatgatcatagctcactgcaatctcgaactcctgtgctcaagggatcctcccacttcagcctcccaaggagctgggactacaggcatatgacaccaccagtgtgcctggctaatctttacatttttttaaataatttattgtagagatggagtctcactttgttgcccaggctggtctgaaactcctgggctcaagtgatccttctgcctcggccttctaaag

SEQ ID NO: 98868 - DNA, 2690 bp, Homo sapiens
ttctaaataatgaaacttttttgaagaaaaaagtctaaaccatagttttccagttgatgtgaaaattcctcagattttcattggtgggagcagtacctaaactactggttcaaaagagtagagatagagtggcaagaatgagcaaggcagtctcattcagcacagcacattggtggaaaagatttttaagttctttttcattgctagagactgctttagaatatcagagaaagagttgccagtcttaagggagacaaacctgtgagcagattcttacagataatgctgagagaatgtaccagttgccccttggtagctcagaagggagcaacagttgccattaacttgttttctaatattaaggaaaaacccaaccttcccagccttgtatcaatttggggtgggcaagcatgtcttccaaaatgaaaatagaatccatactggatttcgatatgcctcccacacattttatgtgaccagtattcctgtaagagtagatgaaagactcctagccctattttcatgcttgacctcgttggacagtttcttattctaatgtagacttttttgactgaccatccgtgttgtatgaggccgtcaggctgccagtttagagactgcatcaggcacactttttgagcattaagacttccactctaaatcagacacattcaggttctttgaggctgagccaaccactgcatttattgagactctagatatgaagttgctgcaacattttaaaaaattagtcatgactcaagggactcagctgatttatgcattttgttgggcagagtggcatatgcttttggaatgagaagttgaatgcagactctgctgtggggtaaatttttcagttgataacaaggaagtcagcagacgcagcattgaagctgccatatcaggctgctgtgtgagctattggttggtgattggtttaaatccttaacattttaattttttctgttaaatgtcaggaacaactaaactataaacaaaatagtttaaaagaaaaatgacttctggggaacaaaggacctaattgtgaattcttaatccttatgcccagaaaagcaactgtattttgcaaaatccaatattcaggctttttcttaaacacagattgacttctgtgattgcagtttattcctttatggtcactgaagctgccaatgtatatagatagaatctctctgaaatggcaagagaaaacatatcactgggttgagtgagtttaagtgtaaaaggaacaagagccaaagaaagattggtttggctttgcaatgtaagagggtgatttagatttagtaagatacaatcctccaattgtcaatttgacatatatctgtggagaaccctgaaaatcaaattgccatgcattttgtttataactactacatttacaaaatgttggattttaataaacatagatggaataggataggttaaagcctcttgaccgttcatagggctccagttagtgtcactttcttcatgaagcaggctaagccttcactttttgctcagagcattattaactttctctaaagcattgctgtagtcctggtgcaagctacatttcctctacccctcaaatcactgacaaaatagtttttaaaatttcacattttccctgaaacttttctaaatgagcgaatgatctacttcttcttacctgcttagtttggatgtagaaatacagaatttttttttaaactttagtcacaatatatgtttaagattcttgttcctttctcctcccttgaccaccaaggccatcacagaacaaacctaattcactgttcttttatgatttggtttgttctttcaatttgctattggtttgtatcatatatgtatgttggtgtttgtgtatctgtcttataagttacgaaaatatagcggtcagatctttaaaggtttttgtgtaactctatgcttaaaaataactcaataaaagcattttcattgtgggcttgtgaaatacttcagttctgagaaattatccagtaattctggagccctcaaataatggaggattatctagcgtccacatgtggaatgtggttttccaaagagagcttatgtcatcagtctggattaatttaatttcaccatttcatatttttggcatgtagaatttccaattattaattcaaaaaatatgggtgtaaggagcatcgacattaacaatttttgaagtaacacatttgcatacatgatggcatcttaactgtgtaaatacatcatttttaatatagaaagttattttagtacatttggttccacatagttaagatctgctaacgtgagtataatgtgtcctgtcatgcattgaatattgtgttttttttttaataggtaaaaaatccattccaggtttacattaactaaataaaagccaacccacaaggacgtactttttccttcatgcgttgagaaggtcatagatttttcctcatatttgtttcttggcttttcagcactattttaaaaaggaagttctgtactttggtgctataatataggagggcattttaaggaaaattgttcttaagctttatttctttttaaaaaaattgaaaatatatttgtgatgttttaagacctttcatgaatatgtatttttaatttaaaagcaattctaatcttttcttatttttttttttttaatatccaacttctcc

SEQ ID NO: 98869 - DNA, 1654 bp, Homo sapiens
gcagctgtatatattttttagcacctacatatttgtattctgttttcctcattgtgatattttaattgcatttacatttttcctggtcctaattctgattaattcatatttaatttatttatggttttatttatttatttgtttagagacaggttctctgttgcctaggctggagagcagtggtatgattatagcttattgtaaccttgaactcctgggctcaggcaattctccacctcagcctcccgagtagctgaaactaaaggcatgtatccatacctagctaatttttaaatctgtggaggtggtgttttgctatgttgcccgtgctggtcttgaactactagcctcaagtgttcctcctacctcggcttcccaaagctttgggattacaggcatgagccactgtgcctgacctatatttaatctatttaaacatttgtatttcttgtagtctatttcaattactttgtgaaatgaggcaggatatgaaaacttgcaaacatgcatttgaaatcttgaaagcaaactttagtttttaaaatgataatcaattagctgggtgcagtggtgtgtacctgtagttccagctacttgggaggctgaggcaggagatcactagagccatttgaggcatttgaggctgcagtgagctatgattgtgcccattgcactccatcctgtgcaaaacagtgagactgtgtctctaaaaaaagaaaaaataaaataatgaatgataatgaataaaataaccaaggcttagatataagcaaacatatttaggttgtatttgtttctcgtttattttttaatcaaatttatgatttttcattttgtaaatttggaagccagaatgttttcagttcttttcagttcaatttcagtgtcctggaattgaaaattgaaagtgacttggatattttagggcaatgcattttccagaagtgtcttcctatgaagccatagtctttctgccatggtctttgtctttaaccaagtgtctttgtttgggtcctatttggtcagtgcaatttcatgtcttttcctgtaggtggcacgcactacccttcttcctggcctcctgaagaccatagcagcaaatcgtaagatgccccttccactgaaactgtttgaaatctctgacattgtaataaaagattctaatacaggtaagaataagtcacctttgatttgatttgtgtatttaaaacatttttttcattatgaaaaccttaactatacataaaagcagaaaaaatagtataattagcccctatgtacccagcacccaccttcaacagttaccaacacatggacaggcttctttcatctataccactatcaacttcccatattattttaatatgaatcatagacattgtatcatttcatcagcaaacactttagtatgtatttatttatttatttttttcctggaggcagagtttcactcttcacccaggctggagtgcagtggcctgatatcagctcactgcaacctctgcctcctgggttcaagtgatacttgtgcctcagcctcctaagcagcagggattaaaggcatgtgccaccacacccggctaatttttgtgtttttagtagagacggtgtttcaccatgttggccaggctggactcgaacttctgaccacccg

SEQ ID NO: 98870 - DNA, 2207 bp, Homo sapiens
gcctcagcctcccaagtagctgggactacaggcgcccgccactacgcccggctaattttttgtatttttagtagagacggggtttcaccatgttggcgaggctggttctgaactcctgatctcaagtgatccgcaaagtgacctcagcctcccaaagtgctgggattacaggcatgagcacctagccaggtttcatctcttttccattcatttgtaataaatgaatcaaaacctgttcccagttccttcgtaagtcattcactttgaaattgcccattatatcagttcttgactgtgctgcttatgtcttttattgtaattgtctaagtttattggcagtttcatttagaggttaggaatatttaaatgagaatgatactgctttaatattgagtattaagtgatttgtgttatagactaggatattaactataaagggagggcattttaagattataacatctttgcttattaataactttaaatagttctcttttatactgataagctcttgtgctgtttctcttgcatatgcaagtctgtatgttttttaacctagattttagagaaaatcatgtcttcttctagaatcaaggggaatcttagaactggaaggttatattttaaagaaggttaatgctattataaataatatctgaattctgatttgaaatagtttctttggattttggtttttacttctacaaaaataagggactgggttagttctaaaaagaattctaaaagttctaaaagtgtttaaaactaaatttaaaaattctaaagtttatctatagaaccacctgctaatgttgtagattagagctagactaattaaagaactaattggtaatatatatcaagtatatgaattctttatctatacttagggtcagaactttgaagaatccttatactaattttggaaggattgtagtaatgagttgttatattttattttctgaggtctagtttcctattgcttttaaagtttgcccatggtgttccttttaataagaggtattcaaattcatttgcatagaatgatttttcagtaaatcttaatggatttttgcttattcgaaatgtacctttttctcccagttttacttatctagcttgattacttttttaaaaaactttattttatttttatttattttttgagacagagcttcgctctcttgcccaggctgaagtgcagtgtcctgatcttggctcactgcaacctccgcctcttgggttcaagcgattcttgtgccccagcctcccgagtagctgggattacaggtgtgtgctaccataccttgctaatttttgtactttaatagagatggggttttaccatgttggacaggctggtctcgaactcccggcctcaagtgatccacccaccatggcctcccagagtgctgggatgacaagtgtgagccacctcgcttggccttttgtcaacttttattttagattcagttagtacatgcgtgggtctaattacaaaggtatattgcatgatgttgaggtttggagtgtgactgaacccgtcacccagtagtgagcatagtacccaataggtagtttttcagctcttgctccccacctctctcttcgccttgtattcccctagtgaagcttgatagatttcttaagatgtggtaactgttatgttcttcaggatttacatcctgtcttttctattttatataagtggaaggaaaataatcagaaatgcattaaatgtcactataaatagctgtggcttagcacacttaagaatcaatctttcttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaagaatcaatctttctgcataaagtaccttaaagatcaaagagagtgcctgtcttttgacctaacagattctatattttaccttgctttaccaacaggtgagtcctaccatcattaatttggctaagaggtttatatttatggttaa

SEQ ID NO: 98871 - DNA, 1986 bp, Homo sapiens
cctagtctctgactttctaagtgtaaataattcacacttcatcatattgatttttgctatatctgcatagtagttgtaatattttcttttaaattggctcacttttaagttggcttatgtacttcagccttgttataggaataatatctgtaaaaactataaggttcatttacttgttgtatttttctaacacattaaaataaacacataaatattaacattaaaaaagttcctggcaggcatggtggctcatgcctgtaatcccagcactttgggaggccgaggcgggcggatcacttgaggctacaagttcgagaccagtgtggccaacatggcaaaaccccatctctactaaaaatacaaaaattagtcgggtgtggtggaggttgcagcaagccgagattgcaccactgaactccagtgtgggcgacagggtgagactctgtctcaaacaaaaaaaagtttcttactgtgtactaactactgccacttcagggtagcttaatttaaattgcctcttgtcactatcccttattatccattgccatgataaaatacaagttcactcagatacacagctgcgttgccatgtgtctgcagagtgtttttcttttacacagagaggactagtttcatttgagaatagattgcttcatgtcagttgcatttcataattaatcagtcacattatacctaagtcttgctgtaaaacttctttatgctgtggggaaaacgcttatccccagtgtgcatgtcaccattctccatctcagcagctgtagcagatccgggagctgttttctgctatggctggatgtggcttcaggatctttctcaagaaagcatggcaagaatcactagaactgacattgacatgaaatgaattctttttaccatttcagttgatgtgtatcattttgttttaataagtgaaatacaggccaactagcctttgaaaactagttgtagaacagcataatgaacaatattgcctaacattggacaatagtacaataatctgatggtacatcagtttttgtgttacgttttaaatgctttttcaaaaagctagcattaatatacatgataataatttatccttagtaatgatttgtcagttatcatcattgttggtattttttgagtgcttactctgtgccaggcaccatacttgcattatctcattatatcatttattattagacttgatgtatctaatcgtcagtgagtttttaatttcataacttctgcctacaatgctggtttctgagggtggcaagcatctttctcttcgattggtgggtactcagcagtttatttgttatgagtttcaggcatgtgcacagaagttaagtgatacagtaaagaacactgggcagagttccagtcacttgaattctgttgtcagtcctactgttctgccacaagtcagtatggatttagcaagggttataatggtagtcaaaatggaaagtcatgaaataccaaggagggagagaaagtttctgactagagtcattaggaatattatggaagagaggtcatttaagtcagccttagggaatggtagcaggtgaggctgggaggacatttcaggtaaggtagggaaacataaggtttagggaatggctagggcatcatgggagattagattggaaaggtaaatgggaaactagcttaggaagggcccgagtacagtttataccatctccatgtgaaaaatttactttagctctgtatgatggctaggactcattgtgaaagaagtattaatgttaaattccatctgctatgggcctgagattgatgtgtatttattgttagcttattctttttttgtttgttttttattattattattattacatttacttcagctcacaccaggcctattcttaacttgctgatatgtgtagagaatataaattgctcttagaagttgacttacagcattactttttattttaaacttaagtaattgctttt

SEQ ID NO: 98872 - DNA, 2170 bp, Homo sapiens
cattcctttttcagagaaactccagaaaatcttgccaaacttctgaccaggatgtatttaaaatcagaagtcataggtgatgggaatcagattgagattgaaatccctccaaccagagctgacattatccatgcatgtgatattgtagaagatgcagctattgcttatggatataacaacattcagatgactctcccgaaaacttacaccatagctaatcaagtaagattgcacccttaaataaacactccttattgttagaaactgattatttaatgccaggaaggcttcgagaaaacagaacgtaggaatcaagcagtatttggacatgctctgcaatgagaggcatttgctgtggagaggatacaaaacagatgcccaaatgattagagtaagttgaaaacctgtgatgactagttctttgaagaaagacaagttttgagtttggagcccttgttgaatctctcagagattcattttctcaacttgggcctgaaggcagaagctgtgtgtgggagagatggaagtgggggtggtttgtacatctgtgtaggagcagaggggtggcagagcggtggggagggaggaggtaatattgatagggaaatagtggcattagcagtacgttagtaagggtgaaaaggtttttaatcttttaaacatttttatttaaaaaagttttaatggcatgttctgtataaatctcccttttaaaaaacaagaaataattgcggtgaaatcaagtggatgctttttttttcagtttcctcttaataagctcactgaacttctccgacatgacatggcagccgctggcttcactgaagcacttacctttgccctggtatgtcttacatgctttttctgcccagatgattatttacttagactctctgaattatttattctatgatgctttataagaatttataaaatctagactgttagaacttccagattctggaagaataactttgttacttgagattatacaattcctggtaaagtaatgttgaagcttttgtttttacagccacaaaagaaaatgaaggcctagaaaaaaatacctcaaatgagagatgacaaagtattttatagtttcatgtgagtgttgagagttcacaatgtatttcataaccaaatttattaagttagaatatttggtcttaatttggttatggctgtgcccactagatgccgtcctgggtaaaggcttgtggactgttccacattaaattaatttctttgtctttgaacatgttcacaaacatttgctttgagttgaaaagctgacataaaaggcctaaatcaggaaatgacttttattacaaaatcagaaggaaatttccctcccccaccagattgaccatttgaaagaataaaatgtgtatgcaatttgtagttccgtttttccctcttgctgagcatttctgtggtgcctgcaatgtagttcttgagcattcaagtatgtttaatctatgaggggaaaggaagcttcttctttttctcccctgcaacttagccctacctctgaaattctcaatattttagagtatttaagggactctacttctagtttgcttaataaatattaagcattaagatttttctgattcaggagtcattcattcaacatttgttgagcatttattatatgtcaggcactgcaccaatgaggaagcctgaggctgagagaggataagtacgtagcacattttacacggacagcaggagaactgctgtgttccaggccaccatacctgcatgatctcattatatcatgagcagggtcctgacctttagcctcctagaacagtgcttttccatggtctcataccgtgtacactaggtctgtaatgccatgtcattcatctttgcacatatatatacacacatttgtagttgtgagcatccaggatttcatataaaatgaagtaccaaaaataacattgaaaaatatatttttattttttaaaacatatgagtgtcacaggaatacatcttattttaaaggactcatactttaaccatgtagattaaaccataacagttcttttccccacttcgaatcctcttttcctccccagaaacaactgctgttaaaacttgggtatgcatttttccctgcccttttatattagtggtgccagtttgaaaaaagttacttatt

SEQ ID NO: 98873 - DNA, 1041 bp, Homo sapiens
taaggtatttcctttataacttttaggtactccttgccttcagaaatattgtcagggtagtacagcttttaatattaattttttaaaaaatttaattcgtgcatttacagaccttgaatgtctttcctgaagcctgtatatataggagtgaaatatttatataagagtaaagcatatattccaataaggtcacggtattttttttctaagaattttttttgaaatagaaaaattatttaacaaatctatatggtgtttactacatgccaattatttaatctttgtaagtaccagacaagataggaattttcattatctccttaacaggtaagaaaagtggtttgcctagtgtcatactgttaataagtgcttgagccaggattcaagcagcctggcctcagagacttaggagattgttaagatttattccagtaattagccatttgtctctgttgaagcccagtgaacctgaggttgggggttggggaacgaaacgatttgtctcagtcatggattataactgtcagagaactgcgtaaatgcagaacacctgaagataaggctaggcctactcatgtttttattccacttcctttcttaaaatgtatacgtaaaggtccattagatgtgaggacacaattatattaaatattaattcatttccatctgagtgaagagaatatatttatagattactatatttgtttttcttttctttgcaggcaaaaatagttcttgatattattgtcaccatgttcagtgaatattgtgagaatcaatttacgtaagttcatccagcacctttattgatggcccattgttctgaaggcgaggctttgtgctaaatgtaaagataggccaggtgcggtggctcacacctataatcccagcactttgggaggctgaggcgggaggattgcttgagcccaggagttcaagaccagcctgggcaacacaagaagatgccatatctacaaaaaattaaaaaattacttgggtttggtggcctgcgcctgtagtcctagctattggggagactga

SEQ ID NO: 98874 - DNA, 1114 bp, Homo sapiens
ttttctaacttttcccctcctttttttttttttttttttttgagacggagtttcgctcttgttgcccaggctggagtgcaatggcacaatctcagctcaccgcaacctctgcctcccgggttcaagtgatcctcctgcctcagcctcccgagtagctgggattacaggcatgtgccaccacgcctggctaattttgtatttttagttgagatggggtttctccatgttggtcaggctggtcttgaactcccaacctcaggtgatccaccggcctcagcctcccaaagtgctgggattacaggcatgagccaccacacctggcgttctcttcttttttaatattaggtcagtatgtgaactatagtgatagaaattaaaaaaaaaaactaattttatttgacttaatttgttttcagactgacaatcacctgaaacattatttacatatcattgaaaacaaacccctgtatccagttatctatgatagcaatggtgtcgtcctttcaatgcctcccatcatcaatggtgagttattttataagcatcacagatctttgctgtttccttttaatcttcagcatttctgtagaattctcaatagacttggctgaatcaaattcaaataactcataatctgagtatctcaggtcttttgtagattctaatcattcttttcattcatttattcaacaacattttattggtgattcttatgtaacttatgctcatacatttataaatattttctgatgctaggttttgggttctattatgtttcttcaaaggttattgatgttttggttttagcaagtaattcacttggttaaactcaaagtcaaactctgtcatgtctgtagttttttttcttttgttttttttttttgttgttgttgttttttgttttgtttttgagacaggctcttgctctgtcgcccaggctggagtgcagtggtgcagtcatggcttactgcaaccttaaactcctgggctcaagcgattctcccaccttggcctcccaaagccctgggattatagatgtgagctgccgtgcctggccttgcctagttatatagttaaacaaaaacttttaatttaaattttgccctcttaattc

SEQ ID NO: 98875 - DNA, 1202 bp, Homo sapiens
acatccctacttctatttctttctctcctattttgttgcttgctgtaatttcctaaaattaccttaaatcctttgtggataaactgtagaacaagtgaaatgaataccttttgaactttccttatacattaaagtaaacttgaactgtaattcagagctgttgaaattaaaattaaattttttccatgactaaggtaatgcagctatgtgataaaatttaggaaaacatagaaaagccaaaaaacccacaattcgatagttcgttctaatttattaaaacatgtttacttgagtatatcaagaagaaataggttaaaagaggtaaaggaaatgctaactttgaagatatcctagaaacaatatttgggaaaagataatggcaaggaattttcttcagctcctgaaatcatgtatttcaggtagttttgtgatttctcagtactcttaatggttgtgagaatttgttcattatatgccactaatgatgccatgtagtagcaatatgctgtttcagggaagtatctgaaataattaaaaaaaatatgtagtctatatttatgttatctttagaatttcggctttagaatattcaaatctgtctcattctcctcctttcctttcctccctccttctccctcaacctctcaacaattaggaaaagagcactggttgccattggtacccatgatttggacactttgtcgggcccatttacttatactgcaaagcgtccttcagatatcaaattcaagcctctaaataagaccaaggagtatacagcctgtgaactgatgaacatatacaaggtaaatattctttttgattatgcagcagctttgcaaaaatcatgaaattccatcaaagtcaagccttgcaactagggaaatgtaatcaatacttttaaaaaatagcagtgtctggactccaacctagagacagtgattcatctgatctagagtgggacctgaacatagttttattttatttattattaaatttttaacctctgatatgatttcagtgtactgctaggattgagaaccactgaagtagaccataccacattgtaatcttcaattgaaactcatgcaagtataaagaacagtaaaacttagctagtgttttttgtgggaaatactgttacaagctgtctatctcccattatttaaaagtccagcagcgaaaatgaattcagtagtcac

SEQ ID NO: 98876 - DNA, 1098 bp, Homo sapiens
ctttgatcatttgctaaaatgattatatacttagcccctagcccttaaaaaaacatttttttttaacctaggaatgaaaaagaacaaagcctttgctttccataaataattttggataataatatccaatgcatgtttaaaacacatttgagatataattgtttaaattgtggaacattaatgaaattttaaaagattttaaacttttcagaggggttgtttggtaaatatatgaattatgagcaaactttttctcaattatttaatacattttcagaaatcttactgaaatataaattctgtgaaggtagtgactttttctcttgtttaccactttattacttgttgactgaataaattaatatatacttgtttgaatgaaaatgtatgccagtggcaagaatgcagctaccttcctattacaagatattacaaagaaaagccttactgtttgctatctctaatgatattatgaatttcagacagctaagatacgtccttttgcggtagcagcagttctccgtaatataaagtttactaaagatcgatatgacagcttcattgaacttcaggagaaattacatcagaatatttgcaggtttgtggttgcattttctttcttccttgccttcccctttccctttgtctccctatctcctttccatcctgatccctctccctcttctctcttgccacttctgccttctttctctctctctccttcctttcttcctctgcagattttttacaaatcatttctaaattaatagtatgtgacagaatatgagaatttcactttgctttaccagataccttttactgcttgtaaatgccatatgcatggagaaacaggaggtatattttgaatactgtatagagaagaattatctagtcctagagacttccctgctttttgttgttgttgttttggttcagatcagtcgtggattatgctactaagtataaaccgtgttaatgaagtatgatatatcatttttaaaatggaaataacattttggcttattctcactttttgagtgagagtaattataaattgacagaacttgagtttaaatgactaaattttacttattcagt

SEQ ID NO: 98877 - DNA, 1153 bp, Homo sapiens
ggctcatgcccataatcccagcacttcgggaggccgaggctggtggatcacttgaggtcaggagttcaagaccagcctggccaacatggtgaaaccccgtctctactaaaaatatgaaaattagccaggcatagtggcgtgcacctgtaatcccagctactcaggaggctgaggcacagaatcgtttgaacctgggaggtggaggttgcagtgagtcgagatttgcaccactgcactccagcctgggcagcagagggagactctgtttcaaaaaaaaaaaaaaagatagaggataacaaatatatacagtgaaaaaaatgaacagctattaaaaattgtttttatttttgattacttcttcattatctggtcagctgcaaaagaataagagttctaactgatgggctagattctgaaattgtgagggtttaggtgagtgatgggtattggtgaaatggtgataattaggcattaggttaaggatggttaaaattttagagttgactcagttggtttcctatgggacaatcagatgcttttattttaggatcaaggataactcctgagagttcgtttcccaaacctgcccagtgagaatctgtatttttaccagtcaccttgtgatttttatgatcagacagaattaggaaagcaacttaaaatgttttctacttaaagtgagtccatggaccagcagcatctgaatcacatgagaacttactagaaatgcagtcttagtcgccacccaacacctattaatcagaatctgtggtttaacaaactccccaattgattgtaagcacattgaaatttgagaagcactgccttaaaacagtagttcccaacttctccctatgataagagttccctagagatgccttcaaaatgcaccatttaccaaatctttgtcttcacttattttattcagtagggccagatggaaccagggaatctgtattttccataagctctgtttcttcctagaagctcagaatctcatggttagaataactatcataacttaaaggttatctaatccagtccctcagctgatgttgaaatgctccttaaacggttgctcagttaatggtttgtagcctctgctgggatgctagtgataggaaatacattactatgaggcatcttatgtcat

SEQ ID NO: 98878 - DNA, 1301 bp, Homo sapiens
tgtaacttctctgcagtggttatgtttaagaaaatctgttactctgctgtagtgtggtgcttgagatattctaaactctttgccactgcattaaacgtgattctagtggtgtttcttctgtcatctccctcttggctgccttcattctgctgcactatccctttgctatcactagtttgcttcccattgtacctattatcccttctaatttttaccagtgtctgatggtctctgactgtttttagtttttatactacccctctcattctcatgtggacttgggtgcccacaggatttaggttttagagtcatcctataagaagttgtgtttcttttatttagtgaatcatctttcttttacccctttgacacttttgttgttgttactttatgttcttggtgatgttttaattttcttttagcttgagatgggaaaactttttctgtaaagggccagatagtaaatatttaggctttttggctctatagtctctgttacaactcagctattgcagtgtgtaagtagcagtagataatatgtaaatgaatgggtctgtctgtgttccaataaatctttatttacaaaaacaagtatcaggtatgatttggccagggggctattgcttgctgacccttgtttagatggatttgtgcttttctggggtgattgaggttgccagatatctgaactcagttaaagctgaagtatttttctgtctgctatgattataacacttaatattttcatgttgtttttgtcgtggatataataatcccatgttcttgttatagaaaatatgtataatgtagttactgccttatagggctgacaacttttactttttaaagagagtttaaattatttaatttttatcattactttttggcttgttttagacatctgagaaggaaataataagtaaagaacaaggtaatgtaaaggcagcaggagcctctgatgttgttctttacaaaattgacgtccctgccaatagatatgatctcctgtgtctggaaggattggttcgaggacttcaggtcttcaaagaaaggtaaggaaatatgttccttaaagactttgctaagttgggttttcttttctttccttgtcattatcagcagccatgtttaaatttctaggaaaaagcttgtagaggaacgtagctttagctctcaatagagggttgatttgaggaattagattcatgcagattgtagccatttgaaaatttccatgaaaattttagtcatagccattcatctttgagaacatattttaaaactggtgtttaatgctttta

SEQ ID NO: 98879 - DNA, 1128 bp, Homo sapiens
aaattcagtctttacatatggtcattgtatgagctgagatgctgaaactgaaagaagatgtaagcttctgtgtctttttttttttttgcaaaggaattagatctttttttacagtagttcctccttatccacagttttttgcctccacagttttggttacctgcagcaaactgtggtttgaaaataggtgagtatagtacaataagaaattctgagacagaaagagactacattcacattactcttattatagtatattattttaattgttctattttattattagttgttaatctcttactgtgcctaatttataaattaaactttttcataggtatgtatgtataggaagaaacatggtatatgtaacatttagtcctatccaatgtttcaggcatccactggggagcttgaaacatatcccctgtggataagggggtgctgctgaaaaatgaatgcagatgccttcatttctccggttattatattatcttctctgtatataggtccctcctgagatctgccatctcctgggaggtgactcagctttcttcactattgaaacagtaattttattaacccctttgattgaacattgtttaaactcgaattcttcctcttctctttttgcctctccccattccccttcttttcttttccccctttttactccttcctcctcctcttcattctcttgtttttcatttttcattttccctaattataaaaatttgcctcctaagtttgagatgcccaaggtagaggttttttggagcccagcaccaccttgtacagccccagcattgcatagactcctgtggttcctcaggtgggactttggcacataatactcgtggccagaagtgaatttctctgcatattgtgcaaatgtggatataattcttaatttggacaaaaatttgaactacttatattgtggcagtgggagggcatcatgtaaaacaaaaatcattacatattttgatagaaatccatcagttattttagcaggttgttggtggtggaaatagtaggaattctggttaagtggagtttccacataattaaagcgtaacattaacagttggaatacaacttgtaatcatttcaagtgaaaatttcttaaat

SEQ ID NO: 98880 - DNA, 1062 bp, Homo sapiens
ttttcttttttttatcttaaatttttttggcccagctttttttttttttttttttttttttaattttttgagacggagtctcgctcttgtcagccaggctggagtgcaatgtcatgatctcggctcactgcaacctctgcctcccaggttcaagcaattctcctgcctcagcctcccaagtagctgggattacaggcatgcgccaccatgcctggctaattttgtatttttagtagagacagggtttcaccgtgttggccaggctggtttcaaactcctgacctcagatgatccacacacattggcctcccaaagtgctgggattacaggcatgagccaccatgcctggcctgtttgtttttaaatgataatatgtgatgcctgatatttagtagtatgattggtgtaaggcaattagtaataagaaaatgcagtttgtatgtagttttcacttatactgaacagagtgaaattaaccatctccttttttattttcctagctgacgaagaatttgatgaactatgttttgaatttggtctggagcttgatgaaattgtatgtattggatatttgtctatttttcaaagattgtgtgcataagcttatttttcagggttatactgtatttcatctttgttaccttatagttagactaaggtgataatgtttgtgggccatgatttctgtgttcagagggctaagctccatgtctgtctgttgccttgactaaaatctcaaaaggagttcatgccttattccatctacaatcaccttgttaccaggctcatgctgtggaaatggatagaatgtgttagataaccccagtatgaaagtaagctccctcctttggcaaattaatcacagaaagggaccaagaagcagtagaaatgttgcttcaaccagagttaccctgcctccttcacttccagcgcctcctccttcagctcctctgcccccataaccttcctccgtgcctcttcaaccagtactaatgcattactatattcattggtcttgtaaaatgaactaatattttttaaggacttgcttataaaaatgag

SEQ ID NO: 98881 - DNA, 2541 bp, Homo sapiens
gattgcttgagctcaggagttggagaccagactgggcaacacagcaaaaccctgtctctacaaaaagtagctgggtgtggtggtgtatacgtgtagtcccagctacttgggaggctgtggccggaggatcgcttaaaccaaggcggtcaaggctgtagtgagcggtgatcaagccactgcactccagccctggccacaaagtgagaccctgtctcagaaaaaaaaaaaaaaaattcagtcagaaggattgatgttatttattgagatgtactttcaagaggtcagaaatgattctcctcattagtttacctttattgtgttcttgcttgaaactgttaactgggttgaggtcagaattgaaaaagcatgttcagcaaacatgtggtttccaagtagtatggatacatcttgtttcttaccttttttttttttccccagtcttcctctttttttcttgttttcagataatgtctcattcacacttttaaaatccacattctctctctttagtccctccaagggttgctttctatttgaaattccattgtttctaccagtccccaccttcctttttaccacctctttgcttagcaaggatatttctctttcaagctgtttgccattttggttattttgctcttctgactcctttggagcagttttgtctccttagtctaccttttcaacggactttctgtgcagatggtttcctcttgccactccttttcttgttaactgatttattatcactgctcttcaattatagtcctgttctggcgtggtgtaatagctggcagtagtggcagaaccttctgtgtatatcatatacacccctaaggtgtggttacttgatgtgtcatttcgttagaggaaattagtaatcacgattttattgttgatttttctttgtatagaaacccatgaaataacagctgaaaggaataaaacatatgataattaggattcagcgtattttaatagttctgtaccacttagttatctattactgcatactaaattatcccaaagtttagcatcttaaagcagctatcatttgttatatagtttctgagggtcaggaattggggactggcttagctgggtggtttttgctctggatctgttaccagattgcagtcaaggtgtttgccagatccgtagtcatctcaaggcctaactgggtctggagaaactgctttcaggttcattcaagtggttgttggcaaacctcagttccttgctgatttttggccataggctttagttcctcccaccttatcctctccataggactacttagcacatgttagcttgtttgccccagatggagaggtccgagagagtaggtaagtaagagagtgccgaggatagacgcctgttttcaataacagctcagaagtgatacactagcccttctcatattctcttgatcacagaccaatcctagcacaatgtggaagggaacagtacaagggtgtgaataccaggaggccggtattattggagcccatcttggaggctgactaccaccgtttcccctctaacctccactgattcagttcctcccatatgcaaaatatactcaccccctcccaaggccctcagaagtgtcatcccattacagcagcagctcagaatctagaatctcatcatctaaatcaggaccagatgtggatgtggctccttgggtgtagttccttcagtatagcttctttagtacactgttggcctgagagactcgagagaccatttatctgccccacatatacctaacatacagtggtgggatgggcataggataactcctgtagcccttccacttcaaaggggcggaaatgggagacacaaaggagtcattggtccatggcaattctggaatcaagtggcaaatgttggatgttcttgattaggtctgaaggcctggaataattctccatggctgtctgccctgccctctaggctcttggtttccacccctctgagtgatccctagaaagcatgtgctttacagctggttggttttctcagtctacttactgctaatagaattttgagagttcaaagactttattttatcctatttctatccctttcaattctagctggcaatgcttctgcatatgtatttcttctaaaaacttggaaggtctttggtgcatgttactggcttccattttattagtcaaaagccacaccacctacacatctctgaaatatattgagtttctgctgataacagtgctcttaattaagccctattgtgtgattaattggatttatgaggtgcattctttataatttttaatagcaccctttgttggaatgattagtgcctttgatctttctgggtcttaagattttatggtcatatccttgattttatctttggaccatgttttcctggcagtgccttggatttggtctttgctcagaagttatttcttaattttagcattgtttcacatctggagaagatgagaattttttaaatccccaacatcctggctcatttttgtttaacagcctttcctttagcttatc

SEQ ID NO: 98882 - DNA, 1055 bp, Homo sapiens
aatgaagtaaaaactgaggtctgttaacagcccctctcccgccgccaggatttgcacacctttctctgcaggaagccttgaaccctctccactcgcatttccaccacctccaggcaagatctcccacgtggaggccccaccccctccctgacgcgccccactctcgccccgcccacctggtgggcgtccccggccgttagcgccctggaagcatccgggacttcagggtcagtacattacaatgcctgacaaatcctagccagttctatcaaattatatctttcttacaggcttttaagctattagtctcataaagatacatttaatcagcgaggtaatggcatgatgagtgtttttaggttaaaaagagaacaggaactgttgccagcagaatggcgatattcaagacaacacgcacaagaagaggcgggtcctacgcgcttcgctagggaagcccgggtcagctcgctgcgcaggcgcagtgagttcgacacaccatgccgactgtcagcgtgaagcgtgatctgctcttccaagccctgggccgcacctacagtgagtggcggccctatacgttgggccctacgcctcttctcggaggcagggcctccctccaaaagggcaatgtggcgacattcatgccttcctgaaggttttggctccgggaggccggggtttacgcgggaaggccgatgatggtggcggtccggctgggctgtggtagcctcggaaccggcatcgcagcggtgccactgcttgtgcccggcttgccgtgtcattcattcagcgatctgccatcgagtgcctacagcgtgcctggcaccgacatccaagccaggggatagaacaggaaggaaacccggggttgcatcccgagcgtagccagttaattgcaatagcagcgctgtgggaactcagtttataagggggtaggaggagagatttgtgcagcggggtggagaacggcattccacctgtcttcgttttattaatgtttcctgagcgcctgttatgtgtcaggcactgttctaagagcttaggactagagctgtgca

SEQ ID NO: 98883 - DNA, 1045 bp, Homo sapiens
ctacgtgacagaatgagaccctgtctcaaaaataaataaataaagtaggaaactttaacctagatgtgatatctggaactgtggtgacaattttgccaccataatgaaacaagcatgaggctgacagcactcctatccaggatattcctgggtatgttggtcaaagatccagtgtttcttgtctctagagctggagttgatttgaagccatgtttagtttgtctaaacctagtctcgacaatggtcactggggagagaataatttagacagatacttctagtgggaatctccatttctttaggaatttaattgtggttagtaaccacagattccaactgaggggagttcaatctcagcccaaattaaatctgccagggtacttggagtaggagggacataaacacaagtttaaaaagctgtgtttcaagataaaatgtgctcattaactgtggcaaagatgtaaacatatcaatcattgctaattcccactactcagtgaatcttttttttttttttgctattttataactttatttgatgtatttgatgatcagagattagttcttgtccacattgactgtctgtagatttttgaaagtggtaacaggtacataggtaaccaaagtatagagcttatttggtgaatcttcaccctcattacgttttctggacaaccgcacatggattccctataggacattccttattcctttggcccagacagctttgttgagcctggtatcaatgcgtacatctggagttcccatctccttcatggcaaatttccgaatctctttgagtgcccgaggagcacgcttcttgaagccctctccatggatgcgcttgtgaatgttgatggtatgttcttgggtcaccacctcgttgatggcagaagggccctttttcttctcgccacccttctttgcgggagacattctgccgggtctaagttggaaaggaagttttgttttttgtttttttgagatggagtctcgctctgtcgctctgtcgcccaggctggagtgcaatggtgcaatctcagct

SEQ ID NO: 98884 - DNA, 1052 bp, Homo sapiens
tgattgttagttttctgaggctcccccagccataaggaactgtgagtcaatcaaactccttttgttcataaattacccagtctcgggaagtatctttatagcagtgtaagaatggactgatacaattgccttgaaccacattaagtagcaatttaagatgaattacatatacgataaaacacaatgaaatgttttatgtaatcagtctttcctttaaaatgttatgtaatcagtctttcctttaaaatgttgactatggataaatttgttttttggggctaccataacaaagtaacaaaaacagaatggcttaaaaaaaggaaattgttgtctcatatttctggaggctagaagtctgaaatcagggtgttgcccaagccatgctctttctgatggctccaggggagaatccttccttgcctcttttagctcctggtgtttgcccataacccttgacattgctaggcttatagaggcatcactctagtcccatggttgtcttctgcctgtgtgtcttcacatcatcttccctttgtgtgtatctgtctctgtatccaaatttcccctctttaaaaggataccagtcatgctggattaggacccaactccgacgacttcattttaagttgacttgaccctacttccaaataaggtcacattctgaagtagtgggggttatgacttcaataggtcttttggaggtgatataattcaactcataataccagggttgtgcaatgtttcaggatagttaatggacgtagaagctaacctcagggcggtaggggttgggcagaaggggaaggtggaaaggaaggattttccacacccacttctgttaacactgcatttgtagaggccagattcacatgaagggtgaaaagtggaagcttctttaaggccttaaaatttcaccatttttaactaagagtaaagaaagtttcaaatatctattgcttttcactatgaatcttagagttcagaataacaagataaagactttacttcctcctagccaaagtcatagcggaacttaacacggacttatagca

SEQ ID NO: 98885 - DNA, 1108 bp, Homo sapiens
ctctttggatacgtgctaatgcaatcctaaaacagggggaaaagaaaaaggaaaagaagaaaagggggaatgtggaagcaagaaaaaataaaattagctgggcgtggtggcgtgtgcctgtaatcccagctacttgggagactgaggcaggagaatctcttgaacctgggaggcagaggttgcagtgagatgagattgcaccactgcactccagcctgggtgaaaaagtgagactctgtctcaaaaaacaaaaacagacaaaaataaaaaacataagaaagagaaagaatgaggagcacttagaaaaggaagcggagttcattagttcattggggaggggaataaaggcttatggaggaaagtgtcagcagctgaggtccaaatagcacaaaaaaagaatttggcagggaaagggggcactcagacagcattgtgtttggtgtttgggtactttgtaatggaaaagcaggctgtagcctgaggcccaagatcaggtcaggctagggaacaaaggcagcatgtaatgggtatggtgagtcagcatgaacccaaatctagattgacagtagaggtcaaattcagggaagaaggcaaatgaccccaaagacccagatatgtcttctggaaaaagacagcttggtccaatgcaaagacccagatgcagaaacattgcaatagtgtcaaacgtgagccagcatggacagcaaagacgatcccctgctaccgcagtctgagtctgttcagagaggagacagtggccaaactgacttgatcccaaaccagcctctgtcgtggcaggcacagtcattgagttgtgaatatgatggaaaacactcaaagactcaccaaagtagagaaatatggggatctccagcagataactcctggcaaggtagaagagaggcaaaataatgttgagtaagacagacgtgtccctgctccaccatatgccagctgcgtgggcttgtccagttcccttctcctctccaatcctctccttctttacctgaaaaacgtgatcatttgggggctcatctttggccagcatgcactggaacaacagccaccgtgcttgtttatagctggtgttcaatctgactagtcagtg

SEQ ID NO: 98886 - DNA, 1029 bp, Homo sapiens
tatccacaactctcaccatgaaaacagtgcagaggcgaatttccagactggacgcttccaagccagcttacctgtacccttaacagatgtgccagttgggaaactatttcgtgtttctccttaaacaaactccttaatccttccttaagcaatgaaaacaactgatttctcttagtcaacacaataaaaaccttcagaaagtaattacaaaattgcttgcaggtaacaacctataagacctataagaaatgtcctctttgtgttaagaacgcaatctctttggtatagtgatatgatctccaaaattacatttgcaacatcaggcaatgaaacaaaggaacatcttaataaattaatcctaaaataacttcgttatagcagaatgttatctgaatttggaaatgggaaatcctgaagtatatggcagaaaagaatttgtctatgaacagcaatttgccaacaagatcaggagggaactaaactcaaagatatgttgtcaatgtgcacagtgtccatgcctagaacttggtaaaattgctccctttaaggtactggctacaattgaatgtgaacctagaatgaatgtcagtaggtttcgttaggccatggggcccatcctgcctgacacccaaatctcacctcacgctgaggttcctgggattgggattgagtccagaaacaattgtgcatctctaagagattcccactgtacaaccaagtggcttcctgctgaagtattctccaatcaagtggtgggtcagttctgaaaggagctgacctgtcatgttaaggggaatgctggttcaaagagctacacctgggctgcacctccaccttcagagctgcagacacctgggccacacctacacctttacagcctcatacttatctcaaggctccccataacccaggaaaagtaagcagaggtagctaaaagactggatcacctgtcaacacagttgggtcatctctcagtgcatcaactaaagggtattttctgggcagtatataaacttggattttagaata

SEQ ID NO: 98887 - DNA, 3012 bp, Homo sapiens
aggtgggtcgaccttggtgattggttctgggcactatcgtggtggtgggactgggattaagactgtcgtttggggtttgagagttgcagctttgcttttccccaagtgcgttttaatcatatactgttgataggttgggtaactcggggactgcttactaccagcagtcctgtggggtaggtgttatcaggctcgtttcacagatgaggagcccgaggcacaggttttcaaatggttttcgcaggaagtctgatactagaaagtgtgctctaagctgctgtataaaagatccctcgaaaatgaaaaggctggaggaatgtctttaaaattatatggaagctagaaaggcagtaggctttgtgaacgaaattatagctgaaaagaatgacaaatagctgacatttattgagcttttattacatgccacgcactgtttggagagctttatgtacagtgtcttcacactgttaacagtcctctggggtgggggttattcccattttacagcgggagaaactgcagattggacgacttagcttgcctcagatctcagctagtaagaagctgggattcagacaggcctgtgtaaatccagagctctgaaatctaagcactatattttgctgcctctccttggtggctggctgaatagtttccacagtggattttagtctgggtggccaggagagttgtagtttgatgataccttctttcatgtttatcaacctattttgtttccccaaattagttctgagagttaagggtgctgatgagttgctcctgaaagtgtattagaagggtattataggggacaggtggtgtgacatgggaatcttttgcacagacttgattttgttttctggcatttttctgggcagttcctcacacttggggatgagtaagccttctaattgtcgcatgcgttttctctctagacttttcctggtttctcttttgtataaaaatattggttttgtaggatgacattgggtgtggggcagagtggtccattggacctaagggtcaaggtgacaagtcacctcgtatctttggatctcagttactgaatttgtaaggctttagactcagtgacttaaagcttaaatattctgagggtctaaaatgttctccttgaaggaagaaaggaagaatgggagaaatgaagaacgcacaaattataaggggaaaatcatcctctgtctggtttggggtgagaatcagatcttaaagcctcgaggtctgtttcatttgcttttgtgtttccctgctgtttggttccagttaagtgactgtttcattcctcatttgattaattgactcacctagagccatttaatttttgtgatatgtcaggcaccttattaggtgctgggaatacagctgtgaatagagggaaaaatagacaagaagcaaatggtcatacaaacggataggtggttgcaagtttgataggtacgatgaaggaaaagtattgtgtgaatgaggattatgagcaagattgtgatgtagatggaaatctagtctagggagctgttttttgaattgatgtggtgagattttgctagaggacagtcttgaaatctgagcctgcaattatgtacataatgcaagagtttgggaagttgtcagcaacaataattcttttcattgcacagtgtatttcatactcagaatgtcatcccggctctcattgcaagatacgaaaatgagataggcaactttacaagttgtcattctgtctgccttcagggtacttaaagcttaaatagtcctctaatactttctcccactcaaaatgaactgtaagggggagtaagactcttttatgtgagatttgggcttgaatattggatttagattttttttaggaaagctaggccaagggtgataggcttttaaaacaacgagcatcataatgactcaaaagtatccattgtagcatacgcttcacagggtcatttaacttaaaagtctcatcatcttaggagatcattttttgatggctggattgggaaatatagattgttaaaaatatataaatgtctcagttgaacatgtatgaagccaattcaaataatacattgcaatatatttacttaatggccatctgcatgcaaaacaccgtcctaggggtaccatgtggcataaataaaaaagatgaacttgccaaagttactgctttcaaagagatttcagttaatgtatactaatactcaaatttaaggtttttttttttcaaagtgctagcatatctcatctgatccttttaagagccatatatgataaacagaaatactgagaaaatggagataaaaaattgtcaggatatggtgataaatagtaaatggagtgggagaaagaggtgctaagtgattactaggtttcagacctatgcaactaaagaggtatgtgtgctattcactgagctggggcttaactggtagagaactaggttctggatatgggaagggcatgactttagttttggaagtgttcagctggagctgcctttgaggcctttattgaggtactggttttgtgctgagaattggggtggccatttaccgttttgaagacctccatgtagaggcaagagctcaaaccatgggtatgggtgagattgcctgtggggaggctatagaataagaagagaaggaggcctgggatggagctgggcagaggaggttgagcttgtcaaggagacaagagtggccaggaaggtcagaggacagccagaaacagatgttcctgcaaggcgatgagtcagtactgtggaatgctcctatgagagaagaattgagaaccatcattgaatttagcaacatggaggtcactggtgacctttgaaagagatgctgatctgcaggtaggggtgggatggggagcagtgggaggtgaggaaaacggagacagaaactgtttccaataggtttgatttcagcatgtttaaatgctgatgggaaggctcagtggagagggagtggttgaatatagactagaaaagggtttgtg

SEQ ID NO: 98888 - DNA, 3130 bp, Homo sapiens
ttttatccccactcaaaatcacttagcagtgtggtttcatgaattgagtttcaactcaattcatcagtgtgggttcatgtagatttaggtcatttatttttactgtgacaagttagtacattttaggtctataccatatttatttcccctttgctctcttgatagacttttaggctgtttccattttttttgttattacaaacattattaccgttaagtattattgaacacaagtctttgttttaatttttgacactgtagttaacctgtgctcctttttctctgttcttcacatttttgtctcggccttcctctaatcgtttcattatttgagctaaggtaccattctttgtccattatacttaacagtacaaaactgtaatgggcacttttcctcgaaggctctttttagtaatctttactttagttaactttctttgctttttttttttttaaataaaaatatcttaaaatatagaaatatcttgaacatattttacagatatatattattttacttgtaattccatgcatgactgcagggataattcacgtgtaccctttctcttgggaaacgtttctgtgttgatgtacatttgatttagctaattctgtattttagtgtttgtttcctttaaatattttcctctaaatgtagtgcacttttttcattgcagtttggtgggtaggaacatgagctcagagttaagattgcttggattggaatccgggctctactttttagctgtgtgtctttgggcagcgtatttaatttctatgtctcaatttcttcatctgtaaaatggagataatagaaatctacccgtagattgttgtgagattcaaatgaggtgtctggcatagtcattactcaatacatattagctatttttattagttttattttttgttagagtatgcagtattttctaagcctactcagtttgtggtgttgccttcttttttgaagcagcattttaacacagacatctatgcctcaaggaaatgtgtgatgttttataactgttagtggagattgggaagagatactgtaaactgtagcaaaccataagttgaggtacattaactagattgttatattttaatatcaataatttaggatttggttgggcatggtggcttatgcctttaatcccagcactttgggaggccgaggagggcggatcacctgaggtcaggagtttgagtccagcctggccaatgtggcatgagtccagcctggccaatgtggtgaaatcccgtctctactaaaaatacaaattagctgggtgtggtagcgggtgcctgtaatcccagctacttgggaggctgagacaggagaattgcttgaacctgggaagtggaggttgcagtgagccaagatcatgccattgcactccagcctgggcaacagagggagacgctgtctcaaaaaaaaaaaaaaaattaggatttatcgtgtttcaatttttttgaaatacgtataaagcactttgaaagtgagttgacatggtgaaattctcagataattaccaagggtctactcttgttagttttaaataccttttgtaatatgaccctgataatgattcagatggtgtttctaagtatattatcctatgtcatcaaccttgtgttgttcagtggagaaggaaccattgccatccatgtatgtaaagcttcataggtaaatttgagcgagtgacttaacctttctcagccttccatttcaatttctgtaacataaagatttcaattcttacctcacaaggttatcatgacttatgttagttgcttccttcatctctctggctcccctgtcttctcttgtaacttcctttttttctgttttccctatgtatattctttcttcctctttatcccttctctgcccttcacaagtagttttttggtaaatggtaacaagacattctgaaccagtgtgtgagtgaacccattatattaataaaaatacacattatttaaaggggactaggaaatgttaattctgtaaggacaagaggatttaggccatatgaagttacagaggagatgctgtaaatgttaaatgagcagtataaaggacagagaggtcatgttttgccacagtagccagggaatggtcagctgagcaaaatgagactaatgttagatttgaagaaagatttgtgaggaaggtattcacataggatgtccagtgggcagtggagtttggaagattggcaaataaaactgagccatcaactgcttgggaggactcaggaagctgtgaggataaatcacatcccatggggaagaaaggcacatggacttggaggacaaaagcaattaagacctagcgtaacctctttatttattgattaaactctgaaagtagttgttgaatgaattaaaccttctaggaatagaaagggagaactagcagctagcaaatggagagaattgagtggctctgagttgttgcaggaggagctttgaaggtctggcccgagttgtttgtaaccctgccgttgagactggtggtgtggcattgtctgtgccatttagtctgactggacttctggtttttttttttttttggtctgtaatcctttcttgcttttgggggatggagagggatctgcttcatcactgttctttttacctccttttccccctcctttacttgactcaggatttttgttacctgtgccatatttatttcttaggtgtctttgactttatcagttagctttgtgcatttccccatgtattcattgatgtgtttactacctggaatttaatggggtgtttgcatgagtctcttcctcttttgacatctcaataagcaagattctcatggaaaccatctcagaggcagtgggcagtaaatagatggagtgaaagatgaggcagaactgtttctctgcattctatattgagatgtacaattgtttaacaaataattacaaaagaaaatgagtgccatgagagagtgccctaaggggtcagcggatgggtagagaagttcaggctggggctagggccagtggaggtttgggtatcagagaatgcctaatcaatttagatgctaagagataactaggctttgaatgtatgcagaagaataaaggacattccaggtagagct

SEQ ID NO: 98889 - DNA, 1152 bp, Homo sapiens
tggacaatgaggagggaattgagattcttgaagagaggattgatgtgaaatacgggttataagggagtggcaacgtcacactggcaacatgaatgaaggatgcattgatggaggagggggagaggggactagagacagaggaatagttaaggatacagttgaattctgccaggtgacaggagtaaggacctgaactgataaagtaacacgtgagaaagggcaggaggcaggggatgacagaggaagcagaaccatcgggacttggcaactgactggatctttgcagggcaagggaagggaacattaccaaatgctttttaagttttgagtaagttctagaaatgggaagagtcagctttccatttgagttgggaaaggtgaaagcagagtgacagtagaagatgtggaaaggagaattcagttaaaaaaatttatttttaaaaatgcgaagtgggatagctgggatctcctcaaagaaagccagatgaggggtcatctgggtaggcgatggtgagatcagggagtggcggaaagtgaacaaagttctgggcttagatgtttatagaatgaggtgagaagtcagtgaaagatgtgtaaagtgcttatcactaggggcccagtaggcattgtctagggaggcctcagctaaggctgggtctcacaaacatgtggcattggtcctggctgtataactctccagctggcagccttgtgagtaggagtgaagaaaatgcagtgaatctgcagggagcggttgtgttttagagctctaggatagcaagtgctcgggagtcctccaggaaggacatggttgtcacagaaacattggttcctgggactaggctttcaggggacaagagaagacacaagggagttggtggccaagatggagtgggagagcaggtctagtgggtgaggggttgtggggttactaacagcctattctcattctgttaatttttaaggcttgaattagttttctaatgataggagtcttgttgctttgggaccacagatgtgaatgttattattattatttttgcttctctgctttatctgtggcattactgctcttgtggcattcccccccacccccgactcccttgtttttggtgaacataatagtcaccgtaaaaaagatgtataattcta

SEQ ID NO: 98890 - DNA, 1927 bp, Homo sapiens
cttaggaaaatttaaataaattattattcttaacatctgtcatccatccatctgtttgtctatcggtgtgatggatgctcccaccaggtactttgctagtggacaccaaggatagaatgatgaataagacaaatacggcccttccctggtgcatagagtgggaaggtgaacattaagcagttccacagtaattatttaattacagttgcagtaggtcctgtgaaggcaaagttgtggggtgccgagggtggggaaccagagtaggctgtcttgagaggcttctctgaggaagtggcatccaactgatctaggagaagggggatggtagtggggcggtgtggtggtggggcaactgggccgctttctaggcagaggcttgaagcaatgtggggtggggtgggatggtgacttggctttggggaaaatccacaagaagggcaggagtttgtgcagaggtcttctgagatgaagctggatgcaaaaataaatgggccacagcatgcatgagacagaaataaaaataaagccgtctcttagaagcaatccattgagagtagactgggaagatgagggaacttggaggcttgactgtgccaactagttagcaatatctgtatcaagtcagtatgcttctttggtcctcagttactacaaaaagtttaaattttattattacaaaatttgcaaacagttaactttttatgatttgaattttatgattagcaatgttacagtttaccaaaattatcttcagcagtattaaaacatctataaatatatataacaatatacctgaccatatattatgttgattttggtattgttcgcctattaaggccaatgggaaacttttcagctagattggatattatttcataattccatagagttgtatgttttgaacagaaatatttttagtgtcttctctaagtttactattcaatttcttgtttaaaagatcataaattgacctagtgtttcaggcatgtcaatactgttgctatataaatttgtagaaattataatgaatttatatatttgctttaagtttttcttctaagaatgtgtgtttgatgagaaagtttggaaaatacgtaaaagcataaattctacattctagatatagccagtgctgaggtgctttcggtcctgatacctgtttgtgtgtatgttaacaaaagtggaaatatattgtgtgtaaatatttaacctacttctcatttatcatatcatgagcaattcccatgttattgaatgtttttgaaaatatttttagtggttgtataataatctactatatgtacataatgtactttaccatttcccaattattagatttgcatattttcattacccattattataaatagcaaatggaagttctcaagtaaatttgtttttcttcattaaatattcacagaagtggaattgtttggtcaaaaggtatgaaaaatttaaaggctcttaataaaaattacaattgcttcccagagaggttgtacttatatatctgtgccctttagtttgagtgtgtctttccattgcacctgtacttggatttatttttttatttttatttttttttgagacggagtctcactctgtcacccaggctggagtgcagtgacgtgatcttggctcactgcaacctccatctcccggattcaggtgattctcaatgcctcagcctcccgagtagctgggattacaggtgcgcaccaccacacccggctcatttttttgtatttttagtagagaccaggcttcactatgttggccagactggtcttgaactcctgacctcaggtgatccgtctgcctcggtctcccaaggtgctgggattacaggcgtgggccactgtgcccggccttgtacttccatttatatattgaaaaccagaagagagatgttgtttcatatgaataa

SEQ ID NO: 98891 - DNA, 1065 bp, Homo sapiens
ggcaattttagaaagaagtgcctatggaagatgacttattggtgaggcttctttcctctttaattgcatgacgttatagcgcagaaatgatcacatctatgaacctagatggccttactgattgctgcttgacgggttgttgaatgagctgatattgaccagagtttctacccctcctcccctccccttttgggttgtccagttcagtgtcataagcacagacataattccttagcttattgctgggttttttttgatgatgtttctttttgtttttccctgttttaaaattttattcataaaatcagccaacatttattgaacatatactaggtaatactttgtaggtttcttgggattcatatttcaaagatgcatcattagagtgtttacctcgttgaagtagatagaaagtaaaacagtaaacatacaatccatagttaaaagtgctaatgtagatgtatgtgcaaagtgttttgggttcttagaggactgcaagtagatattagaagacttcataaaagaggtgacatttgagctagagtttggactgtttcaccagtataaaagtattgggattaataagcaggggaaggagcaatagtgtgtgatttgtaaatcataggagcagctttgattctggtacccattccctaccctcatgtgggatagcttttctcaacagatgtttgagcaagagctagttattgctttatggttttttttgttgttgttgtttgtttgtttttttgtttttttttgagacagaatctcagtcctaggctgaagtgccatggcacaatcatggctcactgcagcctcaacttccccagctcaagtgatcctcctacctcagcctcccaagtagctgggactacaggcgtgtgccaccatggccagccaattaaaaacatttttttttgtagacactagatctattttgtccaggctggtcttgaacgcctggactcaggcattcctcctgcctcagttacccaaactgttgggattacaggcatgagcaaccatacctggtcctactttatgactttaaaatattttctt

SEQ ID NO: 98892 - DNA, 1461 bp, Homo sapiens
gtttgcaaactccagttgcttgttgctgactagagtgagaatggggctcacagggaaggaatgtggtgattatttggcagtggctgctggggctgtgagagaggatggatgtgttgtatttgtaaagtacttgccatccctaatgcagtgagatgctaaagcacaggaaatgggtaaatttttggtcttcccccaaccctctttctgacttgctccctttttactactgggaaatgtttgtggatacttaaggttttggttggaacagccgcctgtttacagtatgatgtggaaacttttcttgtaattccgttgttaatagatattgtacaaatgagtctcttagaaatatcaagacattgtaggggaccagtgtggtagctgctgcctgatagaaaaaaaaaaatcttcatttgccgatgtaacttttctttaaattattttaaaatgattttgaactaacgcctttctttttcttcctcctagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggtaagatgatctttcattgcctttgaattctttcgaataaaatatcctgttagaaatgaagtaaagggcaagcacagcctgcctccattagaattcgctgttgaaggagaagcagtgtaggaagggggctagactaccttctaatttcttcctgtacttaccagcactgatatgttctgagttttcagaaggacatcgcaacccagtggtgtggagctcttccccagtgtctaccagggtttggaatgtctagggcagttttgagtatgaaaccatactccctgtctctagagcagctgggtgctggaaatggctccaggttttggggtgggacctgctgtgttaaatgtggcttagatgtgggttgcagtgagtgcttcatgtctttgtactttggctgtggcagttgcatggttcttaaaacatttcttttcagaaatatggagaaacctgccattgttgatttgaaacaacgggcaagatgttctcagaggcagtgtaacagcgattaagagcctggactccagacccagactataggtctgaatcttggcttt

SEQ ID NO: 98893 - DNA, 1107 bp, Homo sapiens
ccgtctgatactgacatttaggaattcctaaatagagagaaattaaaattttggcatctgcggtacttggtactaggctaaatattaagttaacacctacatcatttaaataggtgaaatttataagtagattattagtgtatgaccatttggccaggcagttgacctttacgagcctatcaaactctcaatatttttgaaaaccaaaaataaagccaaaaaaccccccagttacaatataagatttgagttgttatagaagatgtcacaaaatagctaatttttaaaatagatttttcactcaaactcagtttctggctttttattaaaaagataattctatgcaaacgtaactttctggttcatcataacatttggacgatattctggtttcttctgtaaattattattttgattacattaaaaaaatttttttttgttttatcaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcgtatgtagactttcttatcttctggaagaatgaacttaactgatatttattgaaatactttactctgaagaggttaaaattctgatgttaattttcacccagtgtccagttagtggagaactctgttgtgacttggaatttttggtttattttggaaaataaatcaattatatgacaaattgtaccaatcagtgttgcagtgaggcttgaacctcttcatgggagactttcaggtcttgagaactagacctacacttaggggccgttgttccaataccatttctcaggaatcctctttagaagttactgtcaattttgttctgtcacctctatcagtaacaacagttgacctccgaaacacttccatactgaaacctggtgaacttcaaggtgcaggttaaacaatagagttttcatattgtaattatctgaatggtaattgtggtggctcagtctgtgagatagttctggaagcataagt

SEQ ID NO: 98894 - DNA, 1083 bp, Homo sapiens
catttcagagaatgtttgtctttagatatttttgcttgagaataaacggtactgccacttgtttgtgctcttttcttgacatacaccgtaaatctgacattcagtgtgtcatcctatttgtatatgttctttttcacattgtaaagccaagtggccaacaattaagaatttgaagtcttagaaatcagttataattccttcacaatgtggtagtcccagagtaacatctgtaagtgaaacaaaataaaaatttaaatatcttcatctttaaaaattggaaatcttggggcatttaggggaggatgagtaggtgtaatgttgattagtatgataagataactttaaaaaacataacacttatagactgtggatttaacagtttagggctcctaatgcgttattatgattcatctccacattcagagactttacatttgtagttaaatgtttgaatatttgactggctgctgcttttccttttagttgttacattatatgccactctaggaggtccagccattgttcatgcattaaatgaaacagaggtgaccaacatcattactagtaaagaactcttacaaacaaagttgaaggtgaggactctagttactttctaactgtctgatactttagaattttcagtgtcatgagccctattattgatacttagttcttttatgacttttaagtccttaatctttgtggacttttatgaatatcatactttattttttcctttagaaaataaaaagtagattttgtatatattcatgtataagtaatccagagttataaattgttaagatgcctatgtttaaattgaagaaattacgactactttttctcttattgtgctcatctattttctagtttacttttagtaaatttgtaattttgaagggttatattttaaactagtaatttttattttacttctgaagcattaagtaattacaagttttcagaattgtttggaagttaaaaagggagacttttaattatattacagtaaaaagagtttctttggtctctagacaactcccagaaatatctgggctattctatatgggggaaggaggagaa

SEQ ID NO: 98895 - DNA, 1034 bp, Homo sapiens
aatatcgaaagtcaaatagccaaacaaaaactcccaaacgttgcatggtctttttgtgagcaaagaatgtggtactgtatatttttataagataaagttaggacattttgaaaaaccatttcagacggttgttcgtttattttgtgagtaggttttagttcagaattagtaagataagcaaagcaatataaagaatatcttacaatttatatgagtatctagatatatttctgcttttaaaaattatttttgtggaaactttatttttaaactaattgtggttcgattttaaaagtttgatcttgataggatacatctttttgaaaaattcacaaaaggttttttccttcttgctgaatcacatccacagttgaagagtacttcttttaaaatgccttaatattgctagaaatgttaatctaatgctaagtgaatatgtaaggcagctgttattattaactatgttaaactcatttttatacatttaggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacaggtaagtaaagactctctacctccttctttctcctcttgataatttaatcatttagttcacattaatagcccaattaattgagatagttataagaaagaaatatatttcataaagtcaagagaactctttaaaaaaaatccatcccaggccaggcgcggtggctcatgcctgtaatcccagcactttgggaggccgaggcaggtggatcatgaggtcaggagatcgagaccatcctggctaacacagtgaaaccccgtctctactaaaaacacaaaaagaaattagcggggcttggtggcgggcgcctgtaatcccagctactcaggaggctgaggcaggagaatggtgcgaacccaggaggcggagcttgcagtgagccaagattgcgccactgcacgatctgtct

SEQ ID NO: 98896 - DNA, 1082 bp, Homo sapiens
tttaacaaacaattcaaagcttgaattagtgaaacttcaaaaacagattgtggtatacaaattatacacatttctaataaagtacattaaagcaaaaattaatttgattttaatacatttcataaagatgatagaattgttcagtattaatatatgataaatattttatgtaaataatgatataaaagtggccataagcaagggttttcctgtcactatacaaaactaaacctgacaattcaaattcgaatatcacttgaaaagctcttaagaggaaataataaattctttaccttgttgaacttcaaaaaattaacatttggggctcaagagactctccaaattggctgtgtgaccttggataagtaacttaatctcaaaatctctcatatcaaaactgggggattagtttaagtgatttggaaaatcccattcagttttaaaatcctgtggttctctaatttttttctttagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaaggtagtgttctccatggtcagaggctggagtgtgatgccagacgtttttttggggtatgggatattttctgcaaatatataggagaagagtagtaaggtgtttgtgaggcagaataatggtggattccaagtactatgatcattgatatcaatttttagaatgtattagatgcatctggagtcaataatttatctggagaagtttttatatcaaactgataggtaatattaaaaaccacttagcattttggaagagaaactttagtaacaaacactgactgttttgtgtacatttattttctcacatcagtgattaaatttctttttatgtagaaaacttaaggtgcttttgtttatttgtgtaggtgagtatattaaggctcaggttcagaaatgtttatgaggatttctgtaagtgttagagaaggaactaagt

SEQ ID NO: 98897 - DNA, 1016 bp, Homo sapiens
taagaaagtagaatagacgtaaaccattgttttcatcatcctttaagacagggatttcaaactcaagaaccaggcagctacctatttaaatgagtcaagtgggccctaatgtaagacaatgtgatgggtaaggattgattctgagggaacaggagcaggcatgccctctctaacagaggccgtcagttctgctgtacctgaaatgtgggcccattgttgctggcgattccacacttacatctaaaatttcctgattttttaagaatgacaataactaatttaaaaaaaaaaaaaaaacctcaatgtaggccaaaaaatacgactctacaggcctcacggcctgtgcttcaccaatatgtgacttctgcttttaaggaatagctggggatacctcagccttaggataaataatcatttttggtaatttagaaaaatgaagcagtgtattagctactgttctcaaatatcctttttttcatttaattcctagtgtgggactacaatactggcagagtgggagcaccattagtttgctgtgaaatcaaattaaaaaactgggaggaaggtaataaactattttaaccacagagcattaatttttaaagtattaaacttgaaaattagtgcttcactttcttgctttagaatgtaaacacccataagtgctcatttttgtcctttgtgatagacgtgttttatctcgaactatatgaatgcatttatttttcttgtttcaaagatgtttctgaagaactattattgttttcattttacttattacgtagatgcaagtaagaattatggcaaaaacttgagaaatgtactaataagtgaataatgtcaataaattaggagtgatcataactttattttgcagaagtaaaattataaaatttattttatgaaattgtggatttttaaatgatttttttctttttttttctgagggcttcaaccttgtattattagaaggaaattttcactgcaattccatagaagtctgtttattctcatgc

SEQ ID NO: 98898 - DNA, 1092 bp, Homo sapiens
tggcctcccaaagtgttgtgattacagacatgagccactggcccagcagtaactcattcttatatagggatttgttctattaattgcatgacttaatacttctgtcagtttatcaatatgatatttaagatgttgcagaatctttcaaataatttgtctcttgtatttataattttatacaacaaatggaagatgttgggttttagagtttaatttttttctcagaatagaagtttgaaaacataaatacttatggtttagcaactgagattttgtgcctactgttaaattgataaactttgttcattcatagtgtctgccttttttcctttgggaagttctaattggattaaaataagatgactgtttagaaactagtagtttcaaattttcatgtgttgtatttaactcaactattaactcaattattattttattaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattggtaagtcatctaatatttttttgaaaatgaatgtttctgaaatagtttacacaagaagcacaatatatttagaggaggcgctgaataatataaatctttatgtaatcttagtttgggttgttgcatcactcctggaatataaaatattacggactgtggaatttatgaggcctgacatgttatgagttctcaaagatggttcagcagcagtggtattttaaattactcttagataaccttcagtcattgtttcctgcctgtgtttctgacatctagagattagtggatggagctctcacagtctgaactgcacccttgccttgccctgcccaggagaatagaggaaagccaggcagctcaagtactatgactcatatgggttgaaaaataccttattctgcttctccttttaggttctttttttttaaaagttaatggcatttcagttagccgtgtgtgg

SEQ ID NO: 98899 - DNA, 1085 bp, Homo sapiens
ttgggcatagtcagagttcctctatcaatacaaattctgatgataacaaaagaaaaaaaagaatatattcacatcattttgattcgttgctgaatttttaagatagtttttaatttatgttaaattttagttttttaaaacacatgctatgaaatactgatagggtttaaaggtgaatattctaatatttgtaactttcttttaaaatgtgtacatggcagtattcataacagtttttcatagttgaaattcatcatgaaatgtcagattgaagtttatttagcaacgaactctgccaaagcattggaaaatattatgaatcaaacagtaaaactggcggttgcatgaaatggatatgccagtgccaagtatggcacatgcattttaaaaaaaatgaggagttatttactacttgtcactgtaataataactgcagtcaacacagttcaccattttgttccttatctgttatcctttctatatttcagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcaggtgagtattcggttaaactgatactaaaaactgagatgggaagagagtacttacatgcattcaacctgttttaaggtttagggttcattactttctgctcagaaaccatttctaccgttagtatatggaagagtaaacttatcagtcccccattcaagccttgctacacaaattaaccactcccaccaaactgatgtacatgtatcttgaatgttcttgtctctgcaacctttgctttctgggttaccctttctcttatgtcagctgttcttcaaggccttgctcagttttctggccacactagcccatagtgatcaggccaaaactccttttgaaactttatacaatgttagagtactggtagttggttgtactaatagtttcataaccatttttggtggggtgaggagtgcccaagactagtttaatattgttggtc

SEQ ID NO: 98900 - DNA, 1393 bp, Homo sapiens
gctttcagagttactgggattacaggcatgagccatcatgcctggctctaactcgttttcaatgacagaatatatattctattttgttcctatatcatattttatttaactcattttcctcttgatggggacttgttaaatagtttattgttttacttatgtttgtattttgaggaatagattctttagaagtgacattcatggttcacttgttggttgtgcattttgatggatacgcaaaaagtggggaagttacaccatttgctaagaacttaaataccttttcttcttttctttttttttaatcatcttagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaa

SEQ ID NO: 98901 - DNA, 1613 bp, Homo sapiens
tttctttcttttccttcctttcttccttccttcttctctctctctccttccctcccttccttccttcccttcctccctccctcctttctttctttctttttctcttttcttttcttttctttcttttctttcctcgcttcttgtcacccaggccagagtgcaatggtgtgatctcaggtcactgcagcctccgtctcctgggttcaaacgattctcctgcctcagcctcccgagtagctgggattataggcatgcgccaccacgcctggctaattttgtatttttggtagagttgggatttctccatgttggtcaggctggtcttgaacgccgacctcaggtgatccgcccgccttggccttccaaagtgctggaattacaggcatgagccgctgcacccggccaaattctttatttttcaatacaattttgtaaagatggacctcatgtaaatccatcatagtttttccggttcttttgaaatttgtcaccatatttggataaaggtatctcttgaacctcattcaaatatactacacatgttctggataattccatattagacactttagttatggacagggcttctcagacttcaatcagtgtcacacatagaaagtaaatatatctcttctgggcaaggtggctcacgcctgtaatcccagcactttgggaggtcaaggcggcagatcacctgaggtcaggagttcgagaccagcctggccaacatggtgaaaccctgtctctactaaaaattcaaaaattagccaagtgtggtggcacatgcttgtagtgccagctactcaggaggctgaggcaggagaatcgcttgaacccgggaggcagaggttgcagtgagctgagatcacgccactgtactccagcccgggtgacagagtgagaccctgtctcaaaaaaaaaaaaaaaaaaatgaaagtaagtaaacatatctatatggcacagtggggtaaatttgagggattttagggacatcttccatgggcctaggctaaaatagtcattgtgttttctttatattatataattactataaaactaccaagagaaagacagtaaatgttaaatttctataaaacttccaaaataaaatgttttaacatgttttaatgaggaacttggtgtgttttcatgaatacacttttttttaagtcagattttatgtttgaaattgctactcataattcctggtgatgtctctttaatatgacctctttattttcttggtacctaccaacaagaagcaacttcaaaagtaagtggtagcaaatgggagaagagtatttattgcttttgctcctactgacttttctcatcattcacctacattttggtaatctgatctctttacacgtaattaatgatgtgatcattttttaaatctagtgacagctccttttctttcattaacaaatgtaaagttgacaatttttgtgataaagcaaatggatttttgattcaaacttttttttccatatcaaacctcctaaaataatgataaagctttagtcaaatgtattgttctaatcttttttgagacagagtctcactctgttgcccaggctggagtacagtggtgtgatctcagctcactg

SEQ ID NO: 98902 - DNA, 1048 bp, Homo sapiens
aagtgttaggataatttgcttccagcagagtttttttttgttcttgttgttattctctttaatggaatgagcagtatttgcaatattgaacacgttttatcagatttgttgcaacacttttcataaggatgaacactggaaagatttctgaaagaatttttcctccctcccttttttcccccttgtaaatgatgttgttaagacctaaaatgttgcttcagggatttcaggttgttggtcagtatataacagcaataagacaactagaccatcttttctttctcctcttggtataccaagtttattttcatttttttaaggagaaatttgcaaatgtataataacatgttttcaaacatattatttaatactttctactattcaaatgaattctcacatttttgtactttcctttgaaataaactacagacttggccttttgcaagagcctgaagaagtttccttgaggtctgggcattcccgtaacctgccttctctttctcatttctgaactccggcttgacctgttgtattttcctagattaaaccaactgtgataatgtgaattggggctgaattttgatctcaatctatctgaccaaatttcagccagatatctcagggcattatgcttctcaagagaacttgagtgaccttcaccaatgctaaacccagttaaagtacaaagagagtcagaatgaattcccatttctctaacattaatttcccattctattttggtatacctttggaagctctgtctttgtcatgtaccaaaatttaatttattaaaaaattcaatgaatctttcattaagctaagagcagctaagagcaattcaaggctatatgcccagtagaagttcggttcttgttaattaacagtgatgagcaaagacttccagtactgattctcattgacataatctcagcaataaaatatttctctttgattttcttttcctcccatattaatactaaagctttccttgaattctgcccttatataatgttatctaggggaaaacttggtactgagcttctcttat

SEQ ID NO: 98903 - DNA, 1058 bp, Homo sapiens
tggtcagggctttctattttacaaaaaacaattgacaagctggagaggggtgtgaagacaccctgattaccaagagcgaaaggatactgtcctcctgataatagctcttcaaggtaaaattttgttgagagtctttcatgcgtaattaatggaagtaatccaacccccacagaattttcatatattctgatttatatttcaggaggctattgggggtgatgaataatgatttcattcttggatgaggagaggctcggcgggggaggaggtgactgcatattcgtgggaaaaactgtctccaggttgcttaatgtattgtcatattttgcttttgttatttttcatttcaaggtatgctagtttatatttttgctgtgcaatagaaaatcaggacaatgagctcttgacgctagagattgtgcatcgttacgtggagctgctggacaaatattttggaaatgtaagtgttgtccttgtcggttaggattagctacagtccccatctcagctcttacttcagttctgtctctggtcacatcccttctctctgtcacatctaaaatatgaattgaacttgaaccgaagatcaccttagtccccctaagattagaatacaagatttttctccctacctataattcttagtaaatgaaagacccaaagctttccttttttctttttaaatagatatggagtcctgctatgttgcccaggtgggtcttgaactcttggcctcaagcaattctcccacctcagcttcccaaagagctaggattataggcatgagctaccgtgcccagccacccaaagctttcaagaggtggatgtatctttatcttcataccacaaatacaccagagaccttatttcagtgaaccagaatttaactgtgaaggatttcttgatattctgttctttattcttcattggctttgtcgtctcttttctgttttgactttttatcctttctctggctttttttctaagctataagtattcttaattatttatgcataagaaaaatagcaacaaacaaaaaacccaaatccttttccttc

SEQ ID NO: 98904 - DNA, 1051 bp, Homo sapiens
gctggtaagaattttttcatccgttcagaattatctttctgtgtaaatccatcattgaatttcagtgtctttgcagaacggcagagtgacttggttgatcaggttctgttttttgtgtcctttgttctagatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtgtgagtaactttttgagagctcaatttctcagtcttactttggtttgttctaatcctgaacattttagattgctataccaattccatcatttactgaaatctttgaaggctggggcccagatatttgtaccaatagactaactagaaaagaactctcattttattgaaagaaattctaggtgccaggatggattctaggtaaataaactacaccttgatagtgcacgcatgcattcaagaaaagtggtatgaacacctgttacattcctggcattgttcttttttaatttgttggaggcggaatcttgctctgtcacccaggctggagtgcagtggcgtgatcttggctcactgcaacttccacctcctgggttcaagcgattctcttgcctcagcctcctgagtagctaggattgcaggcatctgccactatgcctgactaatttttgtattttaagagagacggggtttcaccatgttggccaggctggtctcaaactcctgtgctcaggtgatccacctgccttggcctcccaaagtgctgggattacaggcgtgagccatcatgtccggccattcctggcattgttctaatggctgtgatacatcattgaacaagacagatgacattcctgctgtcatgtagtatacatatttattaagtaaccaaatacaatattttcacttagtaacaagtgctttggaaaaactggaggttagtatgacagagagatggggat

SEQ ID NO: 98905 - DNA, 1010 bp, Homo sapiens
gcgctccggggaggcacctggggcgtccgggccgggcgcgcggccgggtgggggtgcgggccgagtcccgcctggccacccgaaccgtgcgtccctgtggccccgctgccccagacggtgcggacgcgccaggatcgcttgcccgggattcctgcggcaacgcggcgccgcggcgccgcggctccattcattcattcgatccgccttagccgagtgcttagtctgtgccgggctcggtgctgggcgctggggatgtcgcgggggaccaggaggagcccctgttctccaggaagcttaccttccaggagggggatgcggagggagggacacgtccaatatacaagtaaaatgaagagaacttctaaagtaagaagcgctgtaaagtctcaaatacaaccgggtggagtggcaacttttgatttggcaaagcctcttcaaggacatgacattctagctgctggaggtcctggaggggcgctacaggtggattagagagagcaaagcggaggggagaaggccttgtttgtggcaggagaggtgggcttctgccaggtgaggcgggtttttataggccaaaataaggagtttggttttggttccaactgagtaggggaaacctcggggacgttttagcaagaaaactgaccttacccgttgtgcacttttgtttttttgagactgatctcgctctgtcgcccaggctgaagtgcagtggtgtggtctcggctctgcctcccgggttcaagcgattctcctgcctcagcctcccgagtaacggggattacaggcgtgtgccaccacacccagctaatttttgtatttttagtagagacggggtttcaccatgttggccaggctggtctcgaactcctgacctcaggtgatccgcctgcctcggcctcccaaagtgtagggattacaggggtgagccactgcacccggcatggtgtgcagtttggctgtggttggagaatggactggggtgtgtaagggcaggggatagggggtca

SEQ ID NO: 98906 - DNA, 1090 bp, Homo sapiens
agcctggccaagatggtgaaaccctgtctctactaaaaatacaaaaaattagccaggcatggtagcaggcgcctgtaatcccagctactcaggaggcgaggcaggagaatcgcttgaactcgggaggcggaggttgcagtgagctgagatcgtgccactgcactctagcctgggcaacaagagcgtgactccatctcaataaaataataataataaaaaaggaaaagaaaaagatagaaccaaaaagtataaaacaagttgtttttaaaatcatctcatcccaccacctggagaaaacaccattaaacttatcctgtatatctttccaatgtttttataaatgtctccttacatatgtaacacacacttagagatacattgttttaatgggaccatacttgttttcccacttgatacattatggatagtttgcccgtgtcaaaaagtagaactccatgttagtattttttatggctgtgtagttgcagtagacatttgctcctgccatcatctggacacatgttgggatcccacgtctccatttgaggtcaagaaaggcccttgtaacttgctttagcaaatgaaacgtgggcagaagctctttactgcaggtgagcctctggtaccatgacactttcttccatgcccctcatgaagcatgtgttggtgaagtgtgacgctaagccattctacagatcacaaccgctctaggactgcagtggactttgcatgatcgagaaataaatcattgttttagcccactgtggtaggggtgtgtggtgtgtgtgtcagggatgggagagtggctagggatttgtgtgtgtgtgtcttacagcataatactagcatgtatagcagtatcccattgtcctatgtggctaagccatcatgcattttaccaatctcataaaattagattatatatgtttagattatcattgtaattaaaacactaaatatttttcaaatttttacatttaaaaatatacaagctcagcatgcttatatgtttatcttgcccacttttccaattattttctgaggataaagtcttaaaaagtgggaattgctaggtcagaatatgcatgtt

SEQ ID NO: 98907 - DNA, 1037 bp, Homo sapiens
tatgataaaactaaaggactaaatttgttttataatgatgtcttagagggactgaaaggtttaaggaggcgatcaaactaaaatgtcttaatggctgtgtgacacacgtaaggaaaggaaagggggtcacgcacatcatgtactggaatgatctgcattaaacatagacttgtcttcagaaataagactgaagggttttgttgttccttagagttttcgtgttacatcacctaaagagatttcttttaaaaactttctagactctttgcaaaatgtatattactaacatagtttggaagaaaaattgagtagtggtaagttttgttcaagcacaatgttgaatgttaagcttcctgtattaattttagttcagttaatggttcagcccatacaaaggtgctatcctagggattttatgaattcctgaaaggaaaatagaatatgatcaattccttgccctgtggaagagtgcagaactgtggttttgttttcctttgacttctgtaaaatgtgaccgtttgacatctgtggtagattgaacggaatatcacagctgctgagtttactccatagctttcaaaccttttttattttaagaaattcttgaaaaaccctatgttccatgggaacataaagttattatagtgcctcctaaggggttaatataaatcaaggaggaagtttatatttaaggaagaattggagtgacgtatcttagaaaaggaaaggctgatgtttccatatagcttgctctccaccaggcctatcatttttctttttagagacaaacgtgacaggctagtcttgtctctctcatatgctaggtagcaaatggggtgatatttttatagaagtgggcaaaaattattttctcaattttactgagtaggcacagaagaaaagtacagataggctgatggttattgccttattttgactgcatttctcttaaatggatcatttaaattagttcttcaagtaacagtttactggttgttccattcctgaatatgcaggctaatttgtacagataggga

SEQ ID NO: 98908 - DNA, 1024 bp, Homo sapiens
ccttttcaggtttaacagtcgtttgtttgtctgtgttgactcttgccgttagacctggttatcactgctgccttttctgcgtttcttccttccttgtagatctgggacatgacacctgtggtgggctgcagtctggcgactgggttttctccgcactgatctgagagctgggcggcgtccacacctaagaacagcagctccaccaaatgaagtccctctcacgcagctccacagcgctgtctcgtgaatggacagtagccacttacaaacaaatcaacatttttaaaaagaaaatgtaaaggtgtgttttggggcatttgtggaacttacccatggggactaatatggaaaaggtctgtccatagtggttccctgaagactggaattacttcagcaaaacttccccatgaacagctaatgtgtagtgaaagaatgagctagcaaatgagttttagcggggacaaaaaatcaaacaaaaaagtgaatgcttagaaccttctcaaagcagtcacaagtacagacacttcacttagcctagggggccttccagggttcttgtggctgttgtcagagcaggagctgggggagggaagacttgttctctctttcttgaggggtggcattaggaacttacgaaaccagagacctttccctatgacttggcagtatgtgaatatcctctacacttagttattgataaacttcttaaagagatctgttattttcaggtagtgccataatctgcacttagcattggcttgcttcagttgtttctcttcccagccagtatgccacaggtgaactttcggggttgtcattaagtaagttgtgaaatttctgtaataacaaaggcagtccgcattcttccctttcccccaaattcctagggcaaaacttttttatggtgctgttaacatgggagtcacacaagccgcctgactttttctcattgccattagtaatgactgatggaaaacccagccaccactgtgatgcgaaatgatcagtctgttgcctgaaacag

SEQ ID NO: 98909 - DNA, 1074 bp, Homo sapiens
ggaattttataaaacaatcttgtgatttaacatgctttctgtcatcattaaattataaggttagttttcaaaaccatagccacaattttaggagcaaattttaacactattatcataagcatttactttttttttttttttttttttgagactgagtcttggttgatcacctgggctggagtgcagtggtacaatctcggctcactgcagcccccacctcccaggttcaagcgattctcctgcctcagcctcccgagtagctgggattacaggcgtgtgccaccacacagagctaatttttatatttttagtagagacggggtttcaccatgttgaccaggctggtcttgaacccctgacctcaagtgatccacccgtctcggcctcccaaagtgctgggggtacagacatgagccactgcacctggccatatttgcttattttatgttgctaaaaaagcttaccccactagctctaggtacagtcaagtaaattttcagtgatctcttttctcttgttagtcggacttctctagcgacctttcatgaaggaaaacataacatttcccacatgtccatggacattgccaggggactgatggtgacctgtgggaccgaccgcattgtaaaggtaagctggctaattgtctgtcagcatctcagttgagattgcctattaccatgctgtgaatgtgcaggagacagtcactctttctgactggcaagctttataagcaaatgattgccagtttaaaaccttgagtaacaaattgcttgcctctgagtttccatgcattcattggtggtcagtcccagtggcacctccctctgcagtgtctgtctggcagagtgagtctggcaccctgtatatccctatgggtggagttgacctctgggttctcccttgctggcctgggtcctcacccctgacccatctcaagacattcctacgcttgccaatgttccttttcatcctgggcagaatgcgtcctcagtataaggaataaccacacattttaacaattaaatccctgggtcactaacacataaattgaaatgaagtgttttatactta

SEQ ID NO: 98910 - DNA, 1049 bp, Homo sapiens
tgagagatcaagcttgcagtgagccatgttcacgacactgcactcgagcctgagtgacagagtgagaccctgtctcaaaaaagacccccccccacacacaattaaacataatattgaatatgacaactagctagaatatttcgtggaattaaaaagaaatgctaactggccgggcatggttgctcatgcttataatcccagcactttgggaggtcaggagtttgagaccagcctggccaacatggcaaaaccccatgtctactaaaaatacagaaattagcctggagtggtagtgcatgcctgtagtcccagccacttgggagcctgaggcaggagagtcacttgaatccaggaggcagaggttgcagtgagccaagatcacacatactgcactccagcctgggagaccaaaaaaaaaaaaaaaagaagaaaagaaatactaaccttggcaaggtctagaactgttgtattaattttgaaacatgggagtaaatatagacacactgatggtggctttgactttctgctcccccaggctcctcagtggttggaaagtgattcttgtcagaaatgtgagcagccatttttctggaacataaagcagatgtgggacaccaagacgctggggctaagacaagtgagtagccactgtcgagtcatctctggcttgattgtgtatttcactatttgcatacttaatctggggtttttttgaaacacactttgtttttgcaaatgctattaattcctacattttctatgtctttatcattgtgtgactaacaatgaggaagacctttcccagggccagtgagactgttacctcacttttccattgcttgtcctgtattggaaaggcaggggtgcgtagaaaatcctgagagcctatttttaaacagataaaagatctttcagtttaagactattacttattaaagtcagtgttttatgctagccaagaacaaaattagaataaagtcatacagttatataccttatgctgtcacaaacagataaaaagtaataatttagtcctcacttgaatgcct

SEQ ID NO: 98911 - DNA, 1196 bp, Homo sapiens
ttattaaacacagatacattggctcaatagtataggatgtggccagcgcagtggctcatgcctgtaatcccagcgctttgggaggctgaggtgggtggatcacctgaggtcaggagttggagtccagcctggccaacatggtgaaacccagtctctactaaaaaatataaaaattagccaggcatggtggcaggtgcctataatcccagctacttgggaggctgaggcaggagaatcacttgaacccaggaggcagaggttgcagtgagccaagcttgcaccactgcgctccaacctgggcgacgagcaaaactccatctaaaaaatatgtatatatatatataaattataggatgcataatactatatttgcaaagatttattcgaactgtgttttacgtttatcagctactagttatatgcagcaagaaaagctagtaaactgttcttggctcttggcctattatttttcagtcttattctgagagagcggaaaactcagagaaaggctgtattccctggatgatgaggggaggagactgttggtgcccagcactgctggtggctttcccgagggtttcacaacttagattttaacctgctctttttatcgttggtaaattcttttagaaaaagtacttagaaagtagaagtgggattcctaccgtcaaagtgcatcactgtggagtgtatttctctatctagggaaagaaaaaatagtcccatcaatcaaggcatttcctgtgtgcacaattcactgcgtctgtagaagagacaggaaggcaaattgtgtcaaaaagatgcattatttttagtgggtttttttgtttgtttgttttttaataactgagaaaatgtattgcaaggataaacaggctataatctataaggttctgaccctgccttaggatttttgggctttttttttttttgagacggagtctagctctgtcactcaggctggagtgcagtggtgcgatctcggctcactgcaaccttcgcatcctagtttcaagtgattctcccacctcagcctcccaggtatctggggtgacaggcttatgccaccatacctgtacctggctaatattttatatttttagtagagacagggtttcaccatgttgaccaggctggtcacgagcccctgacctcaagtgatccgcccgcctcagcttcccaaagtgctgggatta

SEQ ID NO: 98912 - DNA, 1030 bp, Homo sapiens
gtttgtgtgtgcacactagtgatctttgtggtgtttgactccttgttcatatgaattgtggtcagtaggggagttatacctccttcgttcttgtttctgaacaagtaggtaaatcttatgcatctgaaagggaaatcatgttgattggtcccaaaaaccatagccctcatcaaatctctggcctacaattcttaatgaccgatttgaaagtagtcatatattttatagaaagtatcattctgtattatgagttataaaatgccaagtaaagtttatactagaattcattttaccatgctaaatagtcagtggtaaaataccacttgctgattttaatgaggagagcaatttgagcctaaatgaagacagttcctgtgtttttccgcatggagacaagtgactgttgtgtgtgctgtttgcagtgacaaggtgcagtcgctgtgctaccttcagctcaccaggcagctcgtctcctgttcctcggacggcggaattgcagtgtggaacatggatgttagcagagaagaggtaagagacaagggcaagtccaggctgatcgggggagacccccaggaacctggcttcttcttggcttttcaccccgcaagctgtaaatgctggtccaggtgcagacagtcccagcttccccttctgctaatgggttatttctgacaaggtcctttgtgtcattttgcattgcttcctctgctcatttgagagtttctaccaatgacatgcagtatatacaatcagcgtttaggctggttctcagccttgagcaatacactgagataacactttgagacagatttctggcatatccagtgatttggactgcatagaggtcctccgaagcaccattgtggtcccgtagcattcctgtaggaaaccctgagagatgcatcagtgactgctgtcagggacatagctaaacacttgacaggtttctgggaaaatatatttccatttctctgcttttacttcccattgagttctagttcactgaggccatgtcgacatagtattcttt

SEQ ID NO: 98913 - DNA, 1050 bp, Homo sapiens
tagccaacatggtgaaaccccatctctattaaaaatacaaaatttagctgggtgtggtggtgcacttctgtaatcccagctacttgggaggctgaggcaggagaatcacttgaacccaggaggcagaggttgcagtgagccgaggaagcaacaagagcgaaactctgtctctaaataaataaataaataaataaaatttggaaaatatgggatcataaaaagacaaaaaccacccacaatctcaaaatttctcttttgttgttgttgtgtttgtatattaaataggtgtactttcccccactaaattgctgagctacccagtgccctgtttttactgtagctgagagctctgttagtgaggggtctttgcagttttgctttaatatgcagtgtcttgagggattttttgtgtcactaagagaataaagttttgtagtaggagggagaaggaatatggagtgctgatctgggcaggaagaagtggacacaaatcccatgctgatcagcagcacttactttattcaattcggtctgttctcccaaacaatgttggcctgaggacaggtctggtgaaagaagcaattcatatcattcctaaataactcgccttaagtcctaggtcttgtgataatcatttttggattttacttcatttttgaaagtcaagtttctgttgttttttaaaaccataactcttttaattttttattttgtgcatttgcttttaggaatttcacgtttctgaagattttaataaaatgaactttatcaagacctacccaggtaattataatacacattatcttgcgtacacatacatgtagacatacacaaaactagaacatcatctcttatgatgaaaattagattttcacattaactttttagttttgttacccccactatgcaagagacttgtcttttagtgatatttcagctttttcttgctcattaacatttaaaattttgtatatcaggcacatgtatcagatttaattaaccattcttttattattggatatgtgtactgcttccattttttttttgata

SEQ ID NO: 98914 - DNA, 1073 bp, Homo sapiens
gctcacatctgtaatcccagcactttaggaggctgaggcgggcggatcgcttgagcccaggagtttgagaccagcctgggtaacatagtgagacctcatctcaacgaaaaatcaaaaaaattaattggtagtggtgcatgcctgtggtcccagctgcttaggagactgaggtgggaggatggcttgagcccaggaggtcaaggctgacagctagctgagattgcaccactgcactttcgcctgggcagcagagggaaaccatgtctcaaaaaaaaaaaaaaagtttaattcagtatagatattaggtcaaaaatggattaaattattgcttaattttaaactagttccttggagctcagaatgctgtcgtaattgatagctgggtgctcgggctgacccacagatcatagccttcatagagtgaatacgtcacctatagcagcccccatcccttagccgtgatggtggagagcctctgtcactctgtgtgtgtgtgtgtgtgtgtgtgtgtgtgtgtgtgtgtgtgtgtgtgtggtcattcagctagcaactcacagaactctttaaggcaatacttctcaaactatctttggcaaaggacctgatattcaagtttctagtctgttatagactggcatttttgtgcgtcaaattgtatgcatacatttgttttttcttaattgaaatataacttaaataacataattatatttaccattttaaagtatataattgtgtggtcttgtagcatattcataagattgtgcaaccattaccaccattctctaattccagaatattttcatcacccctccctgcaaaaaaatcccatacccattagcagtcactctccattgccccttcccccagctcctggaaatcactaatttactgaatccaaggatttgcctattttagacactttatataaatagactcatacaatatgtgtggccttttatgtctgtctttcacttaacataatgttttcaaggttcatgcctgtttgaattaattaattatttttgcagtggaatagcattctatactgcatttggttgatccgtttatta

SEQ ID NO: 98915 - DNA, 1035 bp, Homo sapiens
aaagtgttgcctagatcctccatggactccagcctgtctagattattcctgctcttcagtgattagagtggtttctaggcttcttgatggcacaaggatcacaaaaaattatttttatgctaacagtgaaaagattacagcaagaatggtttggagtaaaaaaaaaaaaaaaaaatctgcaggttttcagccaatctggcttctggaagggtgatatttgtttaaagggggtgcaaatgctggggccacccagtggcttcttccctggataaaatctgcctgtggtgacatcagcagtctaattcttggtcacagacccttgaagctgtcctgtgggaggggatggaaatttctgtttttctcagccaatctaattctcctctacaaaatgaggctggtttctctgccttttaatttagagaataaattcaataacaatctaacattttctctccctgttaccaaaggagaaagacttctttttgcagcaagaatgaacagggcagaattccagagactcgttggaaggaaattgctatttattcgataaaaacagatggcaatgatagctatgttgttcgttccccctttcaggcaaacgtcttaatgttatagaaaccatctagcatgccagaagtacactttttttttttcctgtatcccctggaggtactgtcagactaggaaaaaatatcctttgctataggtgacagaaatgttcacagatttaccaagatttgaaatagtatcagcatccctaagaatgaccagaaaatcagattttctcagaattactgtttgcccagagtttaaaagaaatcaggaccttggacttaatttgtaacatatagtatgcccttttaaaatgattaattgaatgatctctttttatcagtttagaatttaaggatggttaaattgctttaatttagctgtttttggagtgattagggtgtgtttttgagaaagtttaaaaaagatattcagtttcagagatattgctgtttcaggccaggtagaacttggtgtgatttt

SEQ ID NO: 98916 - DNA, 1045 bp, Homo sapiens
ttaaacctcatttttcaaagcctattaactggcttccctgagttccagcatactgtacttggatctgtcccactaatctcctatctttaactaggcttttattgtgtctttttcctgctcatgacctttcattagctccttatttaatcatgtctgtaaaaggactttgggggccgggcgcagtggctcatgcctgtaatcacagaacatggggaagctgaggcaggcagattgcttgaggccaggagttagagaccagcctggccaacatagtcaaactctgtctctactaaaaatacaaaaattagccaggtgtaggggctcatgcctgtaatcctcccaagaagctgggctgaggcacgagaattgcttgaacccaaggggcataggttgcagtgagccaagatcatgctgctgccctccagcttgggcaataaagcaagactctgtccccaaaaaaaaaaaaaaaaaaaaggactttgggaaccccataactgctccctgctaagctttatttccaccttctatctctcatttattatggttcttttgtgtccagtgaagtcagtgtgtgttctgtcccactcacacctggtacatttcccacctgggtgcctttgcctccctcaccaggaacctcacttgccctctctcctgtattcagaccctccttcatctcctagatccacttcaagttccacctcctccattgaataattcttcccagcccatcattctctgtcctttctgagcttccttcaacactcctagtatattactgatgatgcctagttaattacaatcaggtattagttcctgttgctttgtgtttattcatcttatcttcccacatagtctgtactccaccaggtactgcataactagctactggttgaatgatacagacttaaccatttctgcacagtagacatttcctctgctgtgtttagctttaataatctgctagttctttcctaagaagcagatggtaatataatgaatgatacttgtttctagaatttaggtattcatcttccctctctac

SEQ ID NO: 98917 - DNA, 1035 bp, Homo sapiens
cctttggccaggcgcagtggctcatgcctgtaatcccagcactttgggaggccgaggcgggtggataacaaggtcaggaggtcgagaccatcctggctaacacggcgaaacccagtctctactaaaaattcaaaaattagccaggtgtggtggcaggcgcctgtagtcccagctactcgggaagctgaggcaggagaatggcgtgaacctgggaggcagagcttgcagtgagccaagattgtgccactgcactccagcctgggcgatagagccagactccgtatcaaaaaaaaaaaaaagttagcagcctttattcggtcaaatattttattcatgaatcatgcgttttgggtaagttgctaaatatttgagattgctggtcaggagcagtgctgataaatgtttttggaaagtgattactaagctgctctgggactgaaacgttctgggggagcttgcatctgctcactttttcactcgtgcaccactgttattgcagagcccaggtagatgactggaccaggatggggttggcgtttgaggtttctgttgtgttcaggctcttgcaacttccttgaagggagaacaacctttttagtaggtgctacacttcatgagatgtaatgaaagcacatgggcgtgggttttttcttggtgttagccatggtggtttgttttcacattgtcataaatacgtgtcacgttcttcactcatttactcattcatttagaaaaagcttttttattgagtgtcaggccctgaggacacaacaggggtcaaaagccacactaccttggccaggcaaggtggctcacgcctgtaatcccagcacgtgtgtggggcccatgctagacctgtgggggagagacagctgacagctaagttgctctttcccaagggctgaacagtctagtgaagagatggcccctatgtattcagcatccagtgctgggaagacacaggaagaggaggctctttgggctggggccggggtttggggacagcctcctagagaaggtcgttgagctggtctt

SEQ ID NO: 98918 - DNA, 1055 bp, Homo sapiens
taatttaaaatactttattgctaaaaaatggtaacacagagacacaaagtgagcacatgcagaattgctacagaccttcagtttgtaaaaataaaatgcaataaatctgtgaagcacaatagaccgaagtacagtgaaacgaagtgtgcctgtactacaccatttatatgagagacttgagcatccatgaatttcagtatccaggagagtccttggaaccaatcccctacagatattgagggatgactgcaaatataacatactagtgtttatggcttgaatctgtgaaattaacatttatgcttcatacttaggtataaaacatagtatcatggttagagcagaaataaggaacctaaaagttaggctaatggcttggtcttttatattgaagaaccaatttcatgtgacaattggatcaaagggaaaattaatccagtcatatatgtagaatatagcaaaggactgccagtatttatctgactttagtcttaacatttagaatatcaacctggcattaaaaagaaatataaccttctttcatttcctttatataattaataacattacaacacagtgaacaatttttatatcacagtaacaggttgttctctttaccatctcttactgtctttacattttcagttcagagaagccgaactgggattaccatgcagaaatacaagcttttggacatcggttacaggaaaacttttccttagatcttctcaaaactgcatttgttaatagctgctatattaaaagtgaggaggccaaacgccaacaacttgggatagagaaagaagctgttcttctgaatcttaaaagtaatcaagaactatccgaacaagggacatctttttcacagacttgccttacacagtttcttgaagacgagtacccagacatgcccactgaaggcataaaaaatcttgttgactttctcactggtgaggaagtcgtgtgtcacgtggctagaaacttggctgtggagcagttaacactgagtgaagaattcccagtgcccccagctgtgttacagcagactttctttg

SEQ ID NO: 98919 - DNA, 1672 bp, Homo sapiens
tagtctcagctgctgaagaggctgagctaggaggattgcttgagcccaggaggtcgaggtttcagtctacttgtgatcacgcctctgcacctctagcctaggcaatagagtgaagccctgtctcaaaaaagaaaaaaaaaattataggattctaccttctgtggaattttggtagatcatactgcttgaaataggtttctcgggcttgcaaatttttttaatccaactatgatttttgcaataaaattagtgtaaaaactgtgggaatgaaaaagaatagtacatttttgtctttcgtttcccattaagttttaaatttctgttaaaaatgtactctgtggcttctctaatttaaaaagtgtaaaaaatgtattttgaattgtcctaatgttctttctactaattaaaatgtataaattatatttttatatgcaggacttcttaattactcaaatgactggaaaagagctctttgagatgtggaagataataaatcccatggggctattggtagaagaactgaagaaaaggaatgtttcagctcctgaatcaagacttactaggcagtctggtggcaccacagctttgcctttgtattttgttggcttatactggttagtgaaattttaatcttaactttataactttgaggaaatcctaaaaacagactcctcacaaagccttaaaaacactcttcacattccataaggaatgttaacataacctcttcagattccttaacgtaacttctaattgcatgaaaagattttttaaaaatctcttccccatggttattatttactacttcccttcccgctagttatgcttaggaagaatctgagttttgctaatagcttttgtcagccaactatttgctatagactttcagtgtgttatcttaaatttttctgtgtagaagtacaaatgttgacttgttcgtgttagagattcaaccttaatccattcttgtcagtagcttcaactgagcctagaactggaaaaggaagggccttagttatccatcaaaatgtgtaaatcaacccatgttgagagctttttagttttgttagtaaaaagttgacttgccccaaattaatctcagatgttaagattaaagtgttaaatgtaaatattgaatatttaagatagctagattaaaatttaggtaaatatttttctaatccttgtatcacgaaagactttataagtataaaagaaatagaagttaccacatggggaaaatggatagtgttgtataaagttttatctattgaaatgcaaaaacagtgagatactctttgttacttacctgattggcaaaccttttaaacatatcttttatcatcagtttatatactgctggtaggaaaaaaatgtaccatatttctgtgaataattttgacaaaatgccaagcatcttaaaattttttatgttctttgattttggtatttcaactttgggttgtttgccttagatttacaggcaaattttgtgaacaaagacgtttgttgtttacctctttatgctccatactttgaacagttgctgggacatggtggtcagtaaatagttgttgaactaaaaaacaattagaaataaatttgatattccacaagagggaaatgatacgtatacatgatggaatatagtacagctattacaggcgacatt

SEQ ID NO: 98920 - DNA, 1049 bp, Homo sapiens
caggcagtgtgtgtgggttaaccctcaggagacagcagtgagtacagacagactgaagacctgtaaccacaaagctcagaatctgtttcattaaagaaaagcatttcagtgagagaaattcctctaggacaggagtcagcaaacttctataaagagccaggtagtatgtatttcagatttgtgtgtcataccatctccattacagcttcttagctctttcactgtagcatgaaaacagcaatcaacaatacaagtaaacagatgtggctgtgttccaataaaactttatttataaaaacaggatttgtcctggtagacttgccttgaggaaaatagtttgctgacccctgctctcaggaggataaaacatgttctggcttcttactggcaaaaaagaccaatcttcagatttgaacataaaataaacaacaagtacttaaaggaaaataggcaatcaggtctatccaggataaaccgaagaattcgccagcatctgttgaattgcggcaggattgctgtacagccttccttgataattagaacatccacatctgcttcctcctcagtggtttacataatgaaggagaaaacagaacaatcgtaagtcagttttttcacccctcattatccgtaggaaaatagatgaatagatttggccaactctgtgagcccataaagtgaaaatcttagctacacttgcagctgggtcaaatatctctggtcattgaaacataccagttatactcacaatagatgtgttattgcctttctcgaataaacgttttaaaaattcctttaaagaagcatttaaaacaaagaccctgaaataagagggttggaaattttaagatgctttttgtcttttctaggtaattttaagtaacatctaaaagttattgaccagttttgctgagtgtaactatcaggaccagctacatagtttgtggggtcctgtgccaaatgaaaatatggagccccttgttcaaaatgtataagaatttcaagatagcaacagcagagtattaaacccagtgcagggccccatgtaa

SEQ ID NO: 98921 - DNA, 1966 bp, Homo sapiens
ggtaatgctttgatacatgtatacaatgtgtaatgatcaaattagagtaattaacatttcagttacctcaaacgtttctcatttctttatggtgggaacattcaaaatcctctcttctgttgtctctaatattagcaccttgcttgatgcctgacccataaacaaagacactgattttttgtttcctttcttctttaagcagttaggaggccttgtgatacccagagattccaaaataatgtttgatgtttctaaaatcttaagagaaatgaagcattcacccttaataacatacaggctgaagtgtttatttttgactgggattgaattaaaccaagtggagcaaaacaaaacaaaattgtttatcttgtactgaccagaaacccttactatcagtcatttattggcaaaaaaaagaaaagaagaagaagaaataattcattatcaaatgtagcttatttggatgagtaagatttttttaaagcctggacttgcagggaattgataataaaagaatttcttgatgaaaagttttgtaacccctagctaggggtttctaaagtcttttctgtttctcttttaacttctttttaactttaatatttagtgggggaggggaacctagaaagtacaaaagggtagtttaagaagattctctttaacactccttaaaaatcctttgatttttcagtctacctgatgacagctgccatttgccctcaagccggccaccagtcctgaggttatttttcccttgtttgttctttggcttcacagatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtggtgagttcatgctcagcgaagcctgttctaggatgtgctggcggcagaaaggcccttgagtgctttaacttaattccagagcaaatctaacttttcatcttttaaaaaactggggaacagagcagggtgctgagaggcaggatttttataaagctcatgtaaatctgtgttatgtacaaaagttaccatgcatagcataatatgcataatatatgcataagttatgtacaaaaagtattaatgcatggcgtgtgtagtaggctttttggttgaaaacttaaagatgaaaggacaattcatgaaatgagtataagtgagcattaaacacagcaactcattagcagtcttacattaccaaattaaaaattggatttctttttttacttagcagatcagcaaaaattaaaaacattggtaaaatccttcggtggctttggtggggaggaagcaggacccttgggcactgttcgtggcagggatctgtggtccgaggacttcctcggggtcctggctccagcagtcccgctccagggaatttatactgtgaacataagcacacaatgacaaataaatagaagccaaatacaaatatacagtggaacgtatgtgatcatgagacttagatttatataaatggaaagattatgcaatatatgattgatttcagaaaacgagatataaaacagcagatatcaatctcgcttatgtaaaattcttttctttatattcacacgtcaatagagataggtctcagaggatcttcagtaaaaaatattaatggtaggatttcagaaaaattatttctgaatttgaaaaaactttttcgagatagagtctcactgtgttacccaggctagactacagtggcacaaacatggctcaccgcagcctcgacctcttggactcaagctatcctcccacctcagcctctcatgtagctgggatcacaggcatgcaccaccacggccagctaatttttttactttttgta

SEQ ID NO: 98922 - DNA, 1052 bp, Homo sapiens
gcaaggggcgggcaggtgacctgtccctgggagaagcccttggccgtgccagtcttgtggtgggtacccccgtgtgctctcttttttttctgtgtgatgtgggcaggttccccaacctctctgcatctctgtgtgtaagagtctgtgaaatgatgtgttcacagagctgtgcacatagtaggggctttatgaaagtttcttcccccatcttctgtgcagctactcaccagccccattgttggggatcattgtctccataattggctgtgagtaactggggagatgttctcccctataaaatgcaacttcatgacaaaaagaagctcagcccccttcatccctaaagattcgttggtgcagtttcttataccagaggttagataaagctgagaaggagaacttccattgtcattgacttttaattctagaagtccctgttctcctatcttagctttggatgttggcagcagggcagcaggcgggtcttgtgaagaaaagttctgtggaacctaagagttattgacttgttcttcagcatcttcgcgtaatcctcatagcagctctctgaagttcattggtggggaaggaggcttatcactgatcttatagatgaggaaactgagttgcagatcaggtatgtgacttacccattgcaggcaggcccaggactagacaacaggcctgttccacagtagtgttaaatgggcataggtttcttctgggaaatagcaaacgtcccctggcccttaaatcccttcacaaggcattagcatcaactgtagcaaaggaaatggagtcaggttacaggacgaagctcagtagctgggtgactaaatccaggttcggaaccatgtttcccatcacttaacatggtttctgagctttgaagaacttttttcgtttgataggtgcttgcttggcaggaagaggtgggcagtgatcacctttttacaaaatttttttgagattttctttgcaaactctttgtactgaaggaagaaagcaaaaggcgcaaagagttggagataaaagcacaggaacctttcttaaag

SEQ ID NO: 98923 - DNA, 1029 bp, Homo sapiens
tgcgagccatgggccaggaaagtgctttctgtgcattgcctcaccacgtgagaggctgatagcccaagatggttctgtagctgaggaatctgggtgagtgacaggtgtcctcctatgcgagattaggggagtaacgcccagctttcagacagccagcaggggggctcagtagtgctaatgccaagcccttcatgcagagaagtgacttaagtgtcagttactactttgtgccagaggtaaatctctctgcagagggaaatgttggcacatagctggtaaacaccagtgtctaggtagccctcctgggcacaaccgtcctcattttttcttttacttgactctccactaaatcctttttgcccgaaactttgtagaattggtatttattgatttgtaccagctaagagttggctatttagtctctgacgtgctctttatggctgaagaaaaacaggtaactccttcacagaggagagattaattccctagaaaggaagacaaaagttttcatggacaactttggaaaggtgtgaagcattaaatatctatgacagcaagacacgggaatacacaagcctgtgttaaggcctgatcccttctgggccaggcacataagctgaaaatggtacctgagcaatttctgagtatgtcacgaaaaggcactgaaatacagaagtttctctatggaaaagagtgtcccggcttggaaactgtgtctgaagcaaaaaatttcctcaaaattgttcttcagaaagggagttgccgtctagtagggtccttacaaaatcattaagagttcgcaaaaaaactagatagatgagatccatgagtgactggctgagaacagatggggaaggcaaattcgcctgaaattctctcagtcaatgcatattatgaatgcttatcgaggttgcttcatgaaaaggggttaaattttaaaaaagagaggcaaagaaattgaatacagatttagtacttgttcttgaggttataacttcagagttgccagatattgaacgttgaattagt

SEQ ID NO: 98924 - DNA, 1118 bp, Homo sapiens
tcaatgcaagcgatctccaatgcttttcctcttgcgggtttggcaggtgactttgtagcccattctaccaggagaatagaggtcataagtatctcctcacgtcctcccccatctcccctgtacagacttttctgtgtttacccagtcatccaataaatcttcttaagcatctactgtgtctgggtactttgttggatactcataggtggtaaatagagcagatccttgctcgcttgaaactgtcattcttgtgggagaaaaccaactaaaagcaaacataatatgttgtaaaatgtatgataaatgaataaggtagaattataaagaaaaatcaagttagactgagaacttagagaaatatagagagatggcctccttggggcagtgactaatgtctccagctgtgtcctgaatcccaactcccagtgcctctctctccttgtgagtgttactcccttttcttacttttatcttcagtctctccctgtgagcttttttcttttttagtagtattttaagaatgccttaacctcccttgtccctgcatcctcagctcacctgtagtgacaaccacgtctctccaggcttcttaaactggtctgcccttcctgttcagctctttgcaagctggccagagtctcctcaaagttcaaggcctgtgacttcctgaacaagcaatcttttttttttttttttaatttttattaatatgctttaagctctggggtacatgtgcagaacgtgcaggtttgttacataggtatacacgtgccatggtggtttgctgcacccatcaacccatcacattaggtatttctcctaatgctatccctcccctacctcactccccgccccccaccacaggccccagtgtgtgatgtttccctccctgtgtccctgtgttctcatctgaacaagcaatcttatggatacccactaggtttctccgtggcatttgatgaggttcttctattcctttctgatggtttttttttttttttccatccctggttgccaccttctggttttccttattcctccctggcatctctgctacctcttggggttacccagggttcgctgtcatcccttttgtgctctgtgtatttgggtgaacc

SEQ ID NO: 98925 - DNA, 1041 bp, Homo sapiens
aagcactgttgatgttttgttcaccggatatgttgggtagcagaaaaggcctagaaccagttttaagattatgcctacatctctagaagactagtacactggcatcatcttaggtttctaaatattatttaattccttaatttggaaagcagttttaatgtttacagtttaagatactcattttcagtaactagtgttaaagatttttatctttgcctgtctactgtaacttaagactttcatagaataattttttatagagtatatggtatattgtgtcaatcttggaaggaaagctgttgcatatcaattgtaggtcatgtattttactatatgttgcatagtattttgcattctgtaaatacgaatgttaaaacatttcaggtcagcaaaattagaagtcatttctagtcctcaaagcagaaataattagaaatgttaacatttaagtgcttatcatatgccagatactattctgaatattttatgtatattcattcatttagttgtcatattggctttatgtgacataactgtcattataccagtgttgtccaaggttgctagcaggaaatggcagagccaggagttggacctaggtttaatcctatccatattccatgttacaaattgacatgattttccatattaaaaaattttcatttattttgtacctcattcacatgaatagtaatgtgacaaactaaagttaatacatgaagcattgcaatatggaattttgcacatttttgttagctttacattatttgctgataccaacttttggtaggaaggaaaacagggaaggtgattgctgctattctggaatgtgtccattgaaaagaaaataggcgctttgtctcctacaatcttagagaaagttttacatacttaagtgggtaccacagataggcatgtaccttaaattcaaatctacagttttacaaaatgttttcctttgtgtgcctttcctatgtcaaattagccagaaggaagaagagacgttaagaatggcagataaatttaacaggtaatgataca

SEQ ID NO: 98926 - DNA, 2302 bp, Homo sapiens
ttaacacatttagtgtacacaccagtgggccaaggtcccagagctagtagtggtagagctgagtttatccaggtactctgagtccggagtttgtgttctttaatacataggctacccaagttctgtgagttttgagtataactcagaattcagtagataacagcatcaaaacggttaaactataggtggcatatgctcacactactgtaattccaactaattcaattattcaactgctatccactttagcattcacattctgatttgaggaagtgtgttgtaaccataatattacattttcaaacagaacctttttaaagtttctgtgcttttatctttggtaatccagttagtaaagttcagtctctgagtgttaaaatgacatatcagttctgttcaaagatacgaatttttatgtgtttatataaaaatactatctactttcttttttaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgaccatctcttctattaaattacagtacatgttctagaccattgagatcaagcctttactccctttgagagtttccaacatcagttgattgagcttcaggctttacaacgtttatccctgtagagatcatctttacagttcctcgggaaaatgtgaatgtgctgcgttttgttttctttactgtatgaaaacaggaaaataaaagagaaatttagaaaatacagctcattacaataaaattgttggatttcatttccccaggtcttcagtgttgatgtaaatgtgttttgtagtgttgcttagcactttgcgcattgtgtaagttgggtaacaaaaatggcaaaagaaatgcagatttcccagttatcttgctctgaagacatttctttagctagtcttatttaattttaaaggtttgataaatatacaaagacccaagcatacaatttgagcatgctgtattctaccacttgcacttactcatcttctagccttatgaccaggaacctttgttttgggctcaagtacacatcctgatttggtttctccctgttgtaatttgagatttcccaaattaagtcttataatgattaggttttgttctgagttatttctagagaaagaaagtattttagtatgtgtaaattgtacaataatttttttgctgttgtactcactgctaatagtggattgtatagggtggtgtttttatttcatttattgtagacaaaaataatgaatttagtatacacatacccactaattcaagtatgtcagagcacaaagttggcagctggttatatttaattcagcccctctgaaaagcacatacagtctatactttgtttataaataccctaggtcctccctgcccctaaatatatattttggtgaagctgtggtgcactattaattttctgtttcaaaatgcaatctaaagatgcaataaatatgatgaccttgatagttttaatgaaatcttcaattcttgcagctgtgttttggaaagtgattaagcaatatttctcaaacctgatgattcttggatatttagctattgtcctccaaagagtcatcgtttcacgttttcaaacatgtgctttgtgctgaagattcttgtcagatatcctgtgcttccagagtatttttatcttcaattttatttaattttgtttcattttgttttcataagacaatgtttcagatatgtaatggggcaaaccactatagatttctgttggatagaaaaatgaaatgttactaataagtttaaattgacccttcgttgactatcagtactgttgatacatttattagaatgtatgtctcagaagatggtttctgtttaaatttatggtcaagttacaacaactgaattctaatatggattaaaaactccacataaatatttttccccatgcgtcttgggttataattttccttttagacttgcaaatatgcttttattgcaattttgtctccatctgtactgtagaattacaagccttgtgctctttatctctacattttccacttctacatgatgcaattaagatgccaatgaaaagtattgtgaacattattctcaggacacttttaccatacttgagtagtactaagtcaggtgtaacat

SEQ ID NO: 98927 - DNA, 1052 bp, Homo sapiens
ggtatgaatttgtgatgaggttgtgacataaaaagcataataaaatatatgacaagaaatggttagataacagaactctagggagatttttggcaaggagattttaggaactgacatcctagtggtacttttaaattatttatttcactgactgaatcttggcagtacatactcttgtctcctcataaagccttagagattacagctacattttgagttagtaagacaacagatacctatctgagataattttggtgagttttaacttggagccatggtaataaaataatcaattgacctctgatagtcataagcaatgaaaattatttactggtaattttactactgaatattttcagctactgtttttcttccaggtaagaaattatattctgcataaaaacaaaatcaactttattatctcaaagttaaattcctcatttttgaaaaggataatttagtattcaagtaaacattaagacagtttctgaatgcgtacttgaattaataagtgtgtatattcagaggctgaaattggtttttatctgtggattacattgaattataataagcttgcttataaaccaaattttaaaattagatttatgataaatgtctttatttctattttagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtgaggactcttcactactgggctaatatagaaaaaacagtaacattattaacaaaattattgtattcaactaattttaaaaacaattttacaattaagaaatcctagtgatgtaacacttatgaaatgtatggcactcacttggtaactaaacatggtgatacatccaaatatgtgcacactctcggaaccaatgtgtttataactaaaatgatagtagaatattgtcacatgaagtattaagaaaagattttcactgctattaataccttt

SEQ ID NO: 98928 - DNA, 1035 bp, Homo sapiens
aagaaaaaattacataaacttttcccagaggaatattttataaatgtgcattgagtatttttcgtactgtggtataggagtatattttgtactgttgatgtctgctactgacttagaacaaattgattattgggttactatggagaaaggtggtcttaagaacagcaagggctgagcagcagtaggttggggcagagtgtacagtagaaattatttagtgtggggcctttgtcatttaatatctagctgagttacttaggactctctcaaggtcttgcctatagaaagttgaaactgaacttgattcctaaagtttcctttaagttttaaagtccatacacacacacacacacacacaaatgtttaagggatgttatcctgtagtttgtaatttcaaatgtgtaagtttgtttgattttctaaaacctggtttgatttactgaaggttctacttagccaaacacagtggtcgacagctcacactccagcatcatatgggttctgcagatctcaatgccacattttatggaccagttaaaaaggtaaatattgatagtttgaacgtattaagtaacttaaagttagtctattagagctgatgtgtgatttatgttgacctgggtaaattacttacttctgtttctctgcctgtctcacatgttagaaaggttaaaaatcctagctttgatttattacttctgttctctcagttgctaactgcacctttgaaaatatgaagactataccagtatagtcttccctaaggactaaacattaggataattacatattttattcataaaattaggtttgagaaaatattgcataaaatagtaaaatgtaagttgatttcagtgcatacaaagccatgagccccttttcaaaattctgtcacctataatctttatttctaataaatcaagattgggaaaattaacatttgtgatttgttagatatataaatgttattaaagtaatttaaaaaattagtattagaccagtgatttgccttcatttttaaaaagcaatcgcatt

SEQ ID NO: 98929 - DNA, 1167 bp, Homo sapiens
aaaaaaatagaaataaaaaaataaagtaagggcaatggcctttttactgtttggattataacaaattattgccttttgtttgcacagttgaggctttcagtgagcttaaatgaaaaattccgtcttttggctgtgtaagtttttgcctgcatatgcaaaggcttcataaaataatctctgtgactaaaatttcatttcatctgttctcaatcatcccttaacccagcgctatattaccttatgcctccaattcagtggtagccctctacggaatagaattccactccaacccctcattcatgatgcactaaatgagaatgtaagaatgatgctactgtgtgaagtaggagacactttctcaaaccgtatccctttttttgatgtatgtcaaccagatatctatgttttcaaacaatagtgtttttaagctgtaaatgaaccgtagtactgcttttgtagaactaaaattgtataattgttacatcatcttaattttgcagctaacagaacaagaagtagaaacaatattggataaagcaatggtcctttttaggtttatgcaagaaaaagatgtatttgaacgttattataaacaacacttggcaaggagacttctcacaaataaaagtgtttctgatgactctgaaaaaaacatgatatctaagttaaaggtaaggtgtgttttagatgaaatagagtgcacctaactgaggtttattatgattgtgtactgacaacgtgattggaaattaatttggtagattattaagtgtttatttctagaaataaaggtagattgttttggagaagaacacagactacactaacatttgttcaagttcagggacattcagagtttgctggaatttctgttggtgtgtcaggatacattcatggaggcctggaagggaggattagtaaaagggaaacaataaagaggctatgctgtgtagttctttttcacaaagtgtggtccatagaatacttgcacgtgaatcacctgagatgctagttaaaaacagttctgggccctgcctttcatgggggtatattggaatctctgaaagaatctgggaatttgcattttaaaatcctaaagtttgataaccacaggcacagagcaactgttggaaaaatttacaggaagattatcagggatagcaataa

SEQ ID NO: 98930 - DNA, 3556 bp, Homo sapiens
cagatagcactatgaaatgaagttcagaggtatctttttttttttttgagacgaagtcttgctctgtcgcccaggctggagtgcagtggtgggatctcagctcactgcaagctctgcctcccaggttcatgccattctcctgcctcagcctcatgagtagctgggactgcaggctcccgccaccacgcccggctaattttttgtatttttattaaagacaggggggtttcaccgtgttagccagggtggtctcgatatcctgaccttgtgatccgcccgtctcagcctcccaaagtgttgggattacaggcgtgagccaccgtgtctcgccagtatcttattattttattaagtgtatgtagaaataatgatatttaatttttgcatgccaaattattttcatttacttttacattccctttaccccaacatttaaatacaatgaaattgtagtaatttatgtacaactaaatacacaacatgtaatatctaagcaaaacttacaacaacataggattgaaatagacaagttgtgaaccattttgttagaagtatttggtgtgccacatttactgtagtatgtgtccatagattgttgcatttgtaatacctgttctaaatatgggaaacttggttgtaatttatgctaagtatgtgagaagctataaaattgccatgtgtaggttactatgggcatatattattaatggaaactaactaaaatttgctgctgaaagtcactgaaataaagtttagtaaaactttgtaaatcttgctttgaaatattttaaaaatgtatacaactttaagctctaaactactcttagaactgtagaccaaggtaggcaaattagggcctgcctggtgcactaccagttttgttaaaaaaaaaaaaaaaatcaagagtatttacacatgaaaatttatataaattttcagggtccatgaagttttatttgaaacatagtcacactgaataatttatgtattatctgtggctactttcttgctacagcgtcagagtagttgagtcagagctctatggctcacattttaaaatatttattatctgatactttacagaaaaaacattggtcagcctctgatctagaaactcttaatgccattttaaaaagttattgattgtaaaacttttaaaattatcattgtaaagttctgacactgtgttctcccagtaagttgttattgcaaagaaacactagacatatgggaaaactgtattttaaaatctgtattttagtcttgtgaaaaatgatattaaaaaatggataggatccagagttttcattctaaatttaaaaagtatagtgagatagaccaaattttgaagtacagatattggcttaggatgctacctgggaaacattagggattgctctcaggaaaatattgaagaagtggtatttatattatacatttcataaaaactttacctgaggtgtaatgaagtaaatcctagtatagttcatttgatttgttttcatgattatcagttaaacctttggaaatacccataagacttaaactggctttaaaatttcttcctcattacagggactaccaattacctcttaattagtgaccctttttgtagacgttttgtagtgtcattaggtctgcattagagttatgtaggataaagtatttatgaactcaaaactgcagttgccatgtttttgtgacattacttgtttattatggtttttgacatctcttccatgtaaatttaaatttgctaggacatttaattgatggtttcaaagcatctcatctaaaagttgtgttttataaattacaataataaccattaactagcctacttcttcatgttttcatatcaatatatgtatatttttaatagtcatgtggtcagcaaatgggggtaatggagaaataagcttctctcagtattatagcgtgaacagagattcgtgtttttttctttaatctttaatgtagccaatttgtgttttctgatttgtagaccttggttgcatgtacaagttatttagtcgtgtgccaaatggtttgaaaacaatgtgtgagtgtatgagttcctatttgagggagcaaggtaaagctcttgtttctgaagaaggagaaggaaagaatcctgttgactatatccaggtaagtaaacccagaagattctctgtgtttatgataaaggcattttgacaagtgctaaaaaggccacttttaccatgctgtgtattgtgtactttcaacttaattgtcccagtagtaaattaatatttgtaattatcctacatattttaggattttgcaaggtgtgcgtatttatatcagggagctaaaattcagctgctacttttcatttaacttctttgatgaagaccttgtttaaatagcctcaatagtgaatgtgaggttctttggtatgccttagtgtttgtatactgtagtatattggaaaaaacaactggtttaagtattttttgtttgaaaatgttttgttttcaaggagtactatgaataaattatgtgccatgttttgtgttttaacataatcagctttttttggtacattttttaagctaatttttttcactggctaacccattccatcaagacaggagaatgagaaacagtgaggaggttctttggttcgtttgcattgtattaatacatatatggaagttataatacttctctcattgacatttttaatagaggcttagatataggcttgaaaataatatcaaaactgtaagtttaaaaatgaatatacatgtttattaccagcaaagttaagataaacatacatggtcataagtgtattatttatggaaaaattattataatgtgtcctaaattttgtttttatttctaagggcttattggatctgaagagtaggttcgatcgcttcctcctggaatcattcaacaatgaccgtctctttaaacaaactattgcgggtgactttgagtattttctcaacctcaactccaggtctcctgaatacctctcattatttattgatgataagctgaaaaagggagtcaaaggggtaagtagtaatgcatttgaaaataacatttaattttatttaaagatataaaattatatgtaaaattaggacatttcacagataaaaattaagcatgacccattgctgtgcttaaatgggtgccatggtctattaaaaaatattgtttgaaatacttgacatgcccaaacgtagttagacatttcacttaatgtgtaattggcttcaaaaacaagcaactggatgggcttggtggctcatgcctataatcccagcatttggggaggccaagacaggaggctctcttgaggccaggagtttgaaattagccttgttaacttagtgagactccatctctacaaaaaaaaagaaaaaagaaaaaaattagtggcacacagtggtatacacctgttgtcccagaagctgaggcagaggatcacttgagctcaggagttcaaggctgcagtgagctgtgatcgcgtgactgcactctatgctgggcgacagagcaagaccttgtctca

SEQ ID NO: 98931 - DNA, 1535 bp, Homo sapiens
ttcctggggtaaaagaaaaattgtgacaagtatcctagaagaaattacaagttaaaagaacaataaccatatcctctattcttagtttctgatgctttgttttaaaactttgcctttaccacttatatggtattaggaaataaaaaacatggtactttgttctcctgcttcctagacgaaatctaagcaatattttatccacttctttttagtaaaagaaatacatattgcctgttggggtcatgagctatgtagggaatgaaaaaattttttaaaggagaattataaagagaaggaggatacaagagaaaggaaaacgaaagctggtgggaagttgagccatgtttatctctagtggaatccttaccttgtgttttaaaattgttaaatgtttgtatatatgagaaatccctgaaaagttatatgtaatttaaaaaaacaaaaaaaaaacaaaaaaaactagagaggcttcctttttaaaagactcttcagttaaaccttttttgtaaaagccaaaaaaaaaaaaaaaacagaagtcatctagtatatttgctgtgttttctaaaattgaggtccaagtcaggggttggcaagcttttttgttgttgaataaaatggcttgtgagccacgcagtcatagtgagaaaatagtcctagacaataacaaatgaataatcctgtgtttctataagactttatttatgggccctgaaacttgaatttcatataatttttatgtgtcactaaatagcattctttacagtttttcctcagccattaaaaatgtgaaaaccatccttagttcatgagctgtacataaatagatggcaggctgtatttgccccacgggttctaattcgatgacccttctctaagtggtctctggtagactgggactttatgcaaagcatttgccctgcttaaacaaaatgagtattgataaattatgtaatgtactgtttaggtattgaatgaatgctttcttacctaccttaggggataggaaatgtttgatggagaggttgttgggcatacctgaattacagcatctctgtaacctgtgtggagatgtatgtaaaaggtgtcaggtatgcctatcatggcgagcacttacgtgaatgaaggaataccataatagtactcaccagagttctcctttatttagtaccttaggtttccaacaacacagtagctatctgtgattctaaattaaattttaaaatcctgcttttgtccaggcagggtggcaaacgcctgtaatctcagtatttttgggaggctgaagcaggtggatcgcttgagctcaggagtttaagaccaacctgggcaaattggtgaaaccctgtctctatgaaaaatacaaaaattagctgggcatgatggcacatgcctagtcccagccacttgggaggttgaggtgagaggatcatttgaatctggctggggaggtcaaggctgcagtgaaccaagatgatgccactgcactccagcctgggctacagagggagatcctgtcttaagaaaaaaaaggtggg

SEQ ID NO: 98932 - DNA, 1689 bp, Homo sapiens
ctggtactaatctgtaatgaaatgatgataacaacaataattgagtactagtaaacataagatagtagttataaggtaactgtaacaaggcatttttcctgaaaaccgtaactacctgagcagttaacagtaggaattttgtagtgttgccaaaacagatgtattcgtaggaagctaaagtgttggccgggcacagtggctcacgcctgtaatcccagcactttgggaggctgagacgagtggatcactatatcaggagattgagaccatcctggctaacacggtgaaaccccatttctactaaaaatacaaaaaaattagccgggcgtggtggcgggcgcctgtagtcccagctactcgggaggctgaggcaggagaatggtgtggacccgggaggtggagcttgcagtgagctgagatcgcgccactgcactctagcctgggtgacagagcgagactctgtctcaaaaaaaaaaagaaaaaaaagatgaatagttatttaaaagctcttattttcaaactttagtgtacatgtttactctttgagactgggagtgggatggcactggaagacttaattaaccagcagtatgccagcaaagcttatgataaacatgatgaatctttctggttataattttacattaaaacaaatcaaaaaagaatgtcccactgtatcttggagtcagatgcttctaagcttttgaccctcactggcgtgtatatacttgttctgctattttttggagtacattggcacagtttgaaaaacattgcttacagataatgttttaatttagtattatgtaaataccaaaggctttaaaggatataattcagactatatcagtctttcgtgtaatgagaaattacacaaaatgctaatagtacttattttatttaggctgatttattataaacactgtagaaacccagctaaaagcaaaaacactcttttcttctatgtttaaaaaatatatatatttttaaatggcagatggaaagccagaaatttttagcagaaaatagtgcttcagtatatataaagaaagtagaagctagaattaatgaagaaatagaacgagtgatgcactgccttgacaaatcaacggaagaaccaattgtaaaggtggttgaaagggaactcatttccaagcacatgaagactatagtagaaatggagaattctgggctagtacatatgttgaaaaatggaaagacagaaggtaagtgttaccgattgaaaaataattaaatccttactctgccttatcgatatttttaaaattttcctacaattaaagcagataatatcagctttcaagaagttttggtgtgtattgttaatttgtctccattgttaactttaatgggatttccaagcttgattctgtcttactaacgaagattttagatatttctaatgaattgagcatttcctgtctttaagtctcattttacatttaatccagaagataaaaggtgtaatagtattggtgagcccagtgagctcctcattcattcctgtacttcctgtataccaaagggtgtgggctctctttagtcctacatactctcttggggttttgtgattctcttaaaaccttaagtttccaccttaagatttttgtagactttcctttgggatttagttgtgacagggtgctgaaaatgcaaaaatatttgtgt

SEQ ID NO: 98933 - DNA, 1074 bp, Homo sapiens
gccttttaaatatttatcagtaacaatcaatctaagttgtataaatccgtactttattcaactctcagttttacttcaaagaatatgatcttcaactacagtatttaagaacgaaccatgtttgagtatgctgtagctttggggagaaagtgtgctaccttactatttacctttttttactctgtttttttcttcctggctatgatgcttactttttaccctttttctttaggtaaatgggccaccatttatagccattgtcaattgtaaaaacttaactttatataacttgagaggtgctggaaagttgcacattgcttaagatcatttgaagtgtttctcacctgaaaaatgattgcttttggaattttatttcctttatttgttattgtagcacacaataattattatgctcacaagaactgtactcatatttatatgactttaactgtaggaccgtgtgtatgtacaacaaaataatgtggagaacgtctacaatttgggattaattatttttcgagatcaagttgtacgttatgggtgtattagggatcatctacggcaaactctattggatatgattgcaagagagcggaaaggagaagtcgtagacaggtaaaatttctctctttactcttgtggttttggttttagtgattatatcttgagaacgattcactgtcttagttttattaaaataaataaaagtttgaatgttgagcacattgggaaaatcctcagaaacttagtatcagagttaacagttacccaaaatttaatttgaaagcacacatcttttatatttttagaagagactatcctaagcttttatttaatatgcttttcagctagccgtcacttttggcttttcatttatttttcatgccagcatttttttctttttttctgtgtaataacatttgtatttttttttctttaagggcttttgtctgtccttcattcctaacatttttgaagaaaactattgaacatagtctaaaatgactaagaactcctgtgccccttttaagtcagatttcatcccccttcataacaatgattgcagtgtcattt

SEQ ID NO: 98934 - DNA, 1055 bp, Homo sapiens
agacggtgtctcacgctgtcacccaggctggagtgcagtggcaggatcttgactcactgcaagctccgcctcccgggttcatatcattctcctgcctcagcctcccaagtagctgggctacaggctcccgccaccacgcctggctaatttttttgtattttttagtagagatggggtttcactgtgttagccaggatggtctcgatctcctgacctcatgatccgcccgcctcggcctcccaagaaagattttaagaaaatttttactgtggtggaaactctgagctttttagtagtggctaagtccaccaggttttttgacaccatatcatatgcttctctaccaaatttatcagtaatatttttatatctagaaatgtttatctgtacaatttactaattcatatgttactggtgctgttttagaagtgtagtcagttactggtatcatggaaagtattgagaaagttctttaaacttcgatctaattataattagactttttttcccccactatgattctgcagtagaaactttttactacttttctgctcatttaaaatttttctatttctgtcttcattgtgttaaacctttttaaatctgtatttatttcatgatttgaaagtgaactctgaaaatattttattacttgttaatagaggattaccttagtgattaaatttggtaaggcaagttctaacatgttctgacagacttgtcatagagttatttgcctcttttttttttttttttaattttaaatgtgagtttaacttttcagggtttatctctagcttactagcagaataagtatttaatatttataaagatttttttaaccctgtttacatttgtcttttcgtattctcttttacagtagtagacaaaaacagttacagatgttcttagtatgaggataagaaactgaaagaagaactatttaagagtttgattaaccagcttgacagttagcttaaaagaccaactttcacagcaattcacacattgttaaaccttttttttttttcctaaataaatagctactgctggcc

SEQ ID NO: 98935 - DNA, 1603 bp, Homo sapiens
acagacctgtggtcaacccttcacactgcccagcagtttcactctttttctttagtcagcttgctccagcagttatttctcttcagacctccatctctcccttgggtttcctcccttgtagtaaatgatcttactttctatttctcagagaaaagagaaagcatcaggtaggaactatgctcattttttgccgctaaatctagaactttacttgtattttctccccttttatgtttttctttttccctcctcttttagtggagggtggtgtcctcttctgtcaggccacatctcaacctgtgctatgggtcaatccctttctaccttgtcatgaaccttaagtattttagggttctacctttcatattggatcttactcaaccagcattaaacatgttcaagccactcactcaatcctcagaatacaattctgttaaattctctggtgaacccctgcactgtctcccaggatctgtcgtgtgtcattcataactaaatgtgttgtaagaaatgttgacatttgccatcttccttttctcatctttcatacactttgaatacattacagttaagcttctacctcaactattatgttaagttttgcccttactagtatcaccatggtatcttttcatctcagaatagagagactgctaatccccattctccttgtttttttttttttttaagcagcatttgccacagttggtcattccttcgttcttctaacatgtttccttgatttctgtaacaaagaactctctttgtatgcctcctacctaccttcttactgtttcttagcctctcctcctccttcaatgactactaactgcccccaccatccccccttaaatagaggcattcttggggtttagtcctagttgttcttctcatggtacactctcttcaccttatgtagcttcatgtgcctctgtgcagatgattcccaaattgtgtctctagcttcatttcctgagattcagactcatatatgcatttgtctagttaatggagccttcattctctgaagtacttcaaacttggcatgtccaaatgagctcataatcactatcattcagttgataatcactatcatactgaaacctgagaattattcttataagttctttttttctccctacatcatctgttgctagactctccagttttctctttattgtctgttactcaacatcaaaccaccttcatttctctcttgaaatattcagtgttgctagtcttacagtgttcactgggctcttctctgttttccatattgctcccaggattactattttaaagccaaatctgatcatgtcactgccctgttgaaatccttatctctcatcttggaattcttttacatatcttctgtctggaaatgtttctagaattttttttttctttaatgtcacttgctctacttattctttatgtcttaccttatatttctggtaagctttccctgacccacgtactccccactggctgcagttgctctcattgtacctagtactattcctttgcaacatttatcacagtcattaaccaactattcagtgtgtagtttgcccagtggagtgtatgaggatggaaacagtgt

SEQ ID NO: 98936 - DNA, 1089 bp, Homo sapiens
catttggaaaacactgactttgatctcagctgtttaataactttcagagagattaaattccagttaaaaaaaatttggtgctatagaatgacgctagattcattaagtttaattactgtatcactccaaaattaataagttaatgacttgttttacatcagtgtttatgtttgtgtattggatataattatttttcccaaagttttacctttttatatttttgtttctagtttttttagttttaatgtagtgatgagagcttgtcctagtttcttttacttggtagaataaagcaatgtttgggaagaatttccaatgagaacaaacagctgtaaagttttttgttctgctctgtgaattcagtcaggcctattacccctggttttgtaagggcttagtggcaagggggtcagggagaggccacttcacttttaagggatttgataaaaggtataacaaattatttagcttttctgagcattatttttctcatccggttataaattaaccttgtgttatcattttgaagttaaatgagatggtatgtgacaacatatattatctggcatataaatttgaaataagttagcttgttgttttcgaagttctagatatggtgagtctttaaatcgcatcctaactatctaacattaagatagaaaaccacttgtaatcttacggtttattcttttgacaaaagaagaactttaaaattttatacacacgcagactctgatgttatttttaaagtgtgttttgtttcagtcctcctcctccctttttttctttcttttttctttttttttgcaacaaaatctcaaaccttgaattctgactctacacatggtcaagaagttaattagttcacccctcaggttcctcatctataaaatgaaaataatattgggtagagtagtcatgaggcttcagtggaacaattcatgtaaaccacttgtagggcttggcccatagtaacatgctcattagagattaactggtattatttcttgtcccttcatcttttcatcaaacccattcggtagtaccacagtgctgcatgaactgaaaattcatacagggtagattgat

SEQ ID NO: 98937 - DNA, 4171 bp, Homo sapiens
gaataaagaaatcttacttaaccaaagaacaatgatcaaaatcaggcagtttaacaatataatactgttgcctaatacattccttattcagatttcaccaattgtcctgtttagtggtgatttcctttatagcaatttgttttctgatccaggatccagtccaggatctcatgttcagttcctcagcctttctttgtctttcagcacattgacatatttgaagagtataggtcagttgttttgtagattatccctcagtttttggtgtgtctgattgtttcctcatgactagtttcaggttatgcatttttggcaggaataatacataagtgatgttgtgtcctcagtgcatcacatcaggaggcacttgatgtcagtttatcccattattggtgatgttaactttgatcattggtgtccgccagatttctccactgtaaaggtaccttttttccctttgtaattcataagtaatctgttcagatatattttgacactgtatgaatatcctgttccctagaaactttcatgtgatggttttagcatccattgatgattcttgcatgaatcattattactatggtggttccagaacagtaattttctatttctgctctttcttctgtaatttctttctcttaaagggaattacatgagccacgcagttagtatcttatgaagcaaggtgattgtgtttttcacacaatcagcagttttttattaagtgcctattatgcacagctttcagtcataatgtagtggatgcaaagagataagatactatcctttcctggggtttttattgtgatgtgagagatggatgatacacacatttagataaccgtgtgaggcattatataattaagtggcaagtgagttgcataggcaataaatggcttaagaattcaaacggaggagaggttgccttgggatgtaagattttatgggaaagaatgaaattgaattgagccttgaaaaatatttgggatatatatgaacagtgtggtggaaggcattccatgatggcagatgttgtgaaattatatagagatgaactggttggttaaacttaggtggtaagtagagtttgactgaggcatataataattacagggattagtggattgtagtgttacaaagatggtttgggaacagattgtagaaaaatttgggtgccagactaagtaatttggactaaactgtagacagttattggaggtttttaagtgggtgaaaatgtgacagaatatttgaagatgtgattttaagtgggtgattatgtggcagcatattatgaggatgctataaatgtaaaattgagaggaggtttataaaatcaggagaagacctggaaagatctgggtaaagtgataggctagaaatgaatggatgatgtcagaaattctaaacttaagtctagacaaagattgcttactgggagaattatagtgccaccaattgcaaatactgtgaagtaatagtgggaaactgatttgaaatgggtagagaatatgataagttttgtttagattatattgaaaatgtttatccttggaagataccttagaaatcattttgcatgtgaggaaaattgagtgtgagatcatagtaagatgcccaagtagagatatcgtatgtttggagacacatagatttagagcttgggcaggaactcaaaattagatgtggagatttggcatttggtaacgtatactgaggaacaagtgttggagttcagaaaatgaagagcccagagccaagggatgaatcttaggagcaaactatagtaagtaggtgtgggaaatggaaaagaccaatttaagaaatttggcatcaaaaggacaagtggaagagttttgtttaaagctgctgaaggagagaagattggaacagctgagttattggatatagagagtatgggattaagaacaatggaaaagaagtaaacttggaagaggggcatgttctcattcgtcagaggttctatagggaatgataattaacacaattaacttttatttagcatttactgtgtgctaggcccagttctagtgcttttacatgttttaacttagctaacagtcacagcccaatgttgcagatactactattatgtctgttttacaaatgaagaaaccaaggcacagataattggtcatttgtccaggtccatatagctgttaagtggcctagccggaactgaattcaggcaatgtggctttagtctgagcccttgaattctctgtagatctgctcctaaggtagaatgatcaagttgtagtatgctgaaattcagtgtaaggggcttcaagttaatggacttactgtctgtaaacctccagtcctttaaattctaggaatcctttaaatttacttaataatggagttggaaataatatccctgagattctttatttctaaaattattatgaatctaataaaccatccatcttctgaaaacgagacgaagagacttggagtagcctttgtaagggatatactaaggaattggcaagtgcagaagaagatagcttcataggagttggcctgaatgtgtgctatgtcagtttttttaaaccttgggcacaggtgcagaaaaaaacatcagtagttgtgtgttagggttgagaagtggctcgtccaaagagtgaggagaagagagaaggccagagtgtgagatcagtgtttcggtgaccaagttttgggctccagtatggtcaattggatgttgaagatatggtccagtagatattgaagttacgtgagcagtcactccatgagaactctgagtttcagtatattataagttgcttaaagtggtcccatatttaaggttaactgttgtcttcctcatcttaagctactgtaacaaatcccataaaccaggtggcttaaacaaatatttctcaccattctggcaagtgagaagtccaagatcaaggtgcttgcaggttcatttttctggtgagagtccccttcctggtctatagacaaccacctccttgctgtgtcttcacagggcagggagggagagaggtcatgtctctcatgtatcttataatggttccatcctgttaatgagggtaccattctcaagatttaattgcctcccaaaggccccacctctaaatactatcacatttgggattagggtttcataatatgaatttgaataacacaaacattcagtccataacaattatcatttcagaatataggcagtttttataatatattcccccaaaacatgcattcaagttgattgtactaaataaattttaaaatatacagtatatgctaaattcttaaatttactttccttatacatagtcattaatgatcattgccggcatctgaaaatgttcttttatttattcttttctttcacgctcatttgaccagtcaatttttgactaggaaatgtagcaatttcagcatgtctgttcattgattatttacagtgaattaggttttgaagcctctgctagtttctgtgcttttgttttcatgtttactcctattttataaaacaattttaataatcatataaacacagtactactgtattgaaggggacactatcgaaagaactattaactgataggtaggaccatctgacatgtttgtttcctaaggtaggacctctgacatgtttgtttcctaaggtagtaagtctcagtttgttctactaaatgagacttagagatgttactgatacaatgtgcaaaagcatagtttgcatgaaaatcagtactgcctatctctgcattgcatcttttgactagaaggtgagatattctttcagggttctgtggtatcagaatacctatctttaatctcacagaatatacctttttttgttgttctgaaagcattactgtttggtctgctcatcagtttttaattcacaatgcttttggcagttagctgaactgcctgacgaaccatatatttatttattttaaagcaaagtgcttttagtgctatggtatacatagccaagacccatcttttcacattgaagaattccaaggaaatataatttttacatggattgagggctggtttgttatatagtttgttggtactttgatttcaaggtgaggatagtgaacaaagtcaaacattttggtaaagtagcgcaacacagactaccagacagcagatgacg

SEQ ID NO: 98938 - DNA, 3108 bp, Homo sapiens
aacttgagctttaggattggaggtttaggtgataattaagagccagtaaaacagatgaataggagacagaagtagaagaaaaacaagagattgtagtgcttggaagttaagtgaggaatttgtttcttttttttcttcttcttttttgagacagggtcttgctctgtcatccaggctggtgtgtagtggcgcagtctccactcactgcagcctcgacctcccgggctcaagcgatcctcccgcctcagccccactaaggagctgggactacaggtgcatgccaccatgcccgactaatttttgtatttttagtagagatgggtttttgccatattgcccaacctggtcttgaaaccctggactcaagtgatcctcccgctttgactttccaaagtgctgggattatgggtgtgaggcaccatgccttgccaaatttgtttcaaggagtaggagtgatcagctctttcaaatgctgctggataggtaagtaagaggagaactgagactttgcccattagattttggcaatatagaagtcactggtggccttctcaagagtagttgcagtgaaatggtagagatgaaagccctactggagtagattcaagatataatggaaagatggaacttggagacagtgcatgtacaatctcctcttcttgcctgtgattttgccataaatggaaagagagattagatggtgctgaaggaatatatgggtttgtgaggatttgtttttgacataggaaactgacatttttttttttttttttttttgagacacaatcttgctctgtcacctaggctggagtgcagtgttgtgatcttggatccctgcaaactctgcctccgggctcaagtgattctcctccctcagcctcccgggtagctgggactataggcatgcgccaccacgctcagctaattcttaaaaaatttttttgtagagacagggtctcactgtattgcccaggctggtctcaaactcctaagctccagtgatccttctgcctcagtctcccaaaatgctaggtaggattacaggcatgagccagtccatgtggtgaaactgacagttttcagtatgaatggaaattatctaccagaggaaaaattttgatgatgcttagatgtgtgattactaaggggaggagttttctttctttttttttttgagacagagtcttgctctgttgcccaggctggagtgcagtggcgggatcttggctcactgcaagctctgcctcccgggctcacaccattctcctgccacagcctcccaagtagctgggactacaggcgcccaccaccacgcctggctaatcttttttttgtatatttagtatattttttgtatatttagtagagaccgtattagccaggatggtctcgatctcctgacctcatgatccgcccgcctcggcctcccatagtgctgggattccagacgtgagccactgcgcccagccaagggaggccttttcaataggtggtttggcatagaactagagatttacttgtcaaatttcattctgtataatattacattgggttcttgttaaaatgtcgattctgtttctgtaggtctggagtagggcccgaaattctgcacttctaacaagttcctaggtgttgcttatgtgtctggtccttatgctatacttcgagtacaataacttggcactttgagcacaagaacctagcaggttttattggcataaaatcaggtcggttggtgtgtgaatatgatgggaatttgtatagtgtctcatcgggttgtttttattttctcagtggaataggaagcagtcataatcatagagtgaggatggaggaggtggtataaaatcatctagaagagtagagtgagtagactgactagtggaattgtggggttgcatgaaggctgcacttaacgttagtggttatgaatttaaactcagatggaccaaaaatatgggcatatgttattctttgttttctttcagctatacggatatatgtcaggagtatgtgggctgttgggatttaacttggcaagtattttggtgggagagagataaggggtaagtgacttacgggtatataaatcattatgattttatttaaagtgaagagttctgctccaggtaagattggagggaggtcttaaaagatgagaaagtgcttctaacagatctagaacctatttttaaatgtatcctttttttccccctgttaaaataggttgttaatgttcttatgtgtcatagatttataatcatatctatataatacaatatttactatatatggacaaatatagaaagactttcaaccattggttttttttttttttttttttttgtctcttctctctcttggatattacagatgaccatggatgaaaaatatgtaaacagcatttgggaccttctgaaaaatgcaattcaagaaatccagcgtaagaataacagtggtcttagttttgaggagctctatagaaatgcatatacaatggttttgcataaacatggagaaaagctctacactggactaagagaagttgttaccgaacatctcataaataaggtatcaaactttaaaggactgttgctaatactatattgaatgtagaaaatcctttataccatattgcactttgaccggaagtgttctttttaaaggtgccagaagcctatagaaattactaattcgtgactgttaataagcactcatgaaaaatttataatcagctaaatcgaaaatttggatatttgagagatgaagtttgtgagctataataaatgctttctttaaatcataatgaagcaaactcagtaattcacaaatgcttattaatatgttaattacaaggaatttttttccttaaaatgatttaatcagcccatttttactttctcatttttctgtatatttgaaaacaataaaactacgttgtttaaaatatatttctaagatggatcactaactaaaattgactttattttaactgagttctgtggtacatttgaattttttttaaagataaattattgttgggctgttcacattattaaaaatggttctctgatttcagaaagatgtatttttttagaacaaatgttt

SEQ ID NO: 98939 - DNA, 1423 bp, Homo sapiens
gggattatagctgtgagccaccgcgtttcagccttagtgcgtattttaagtataccttcatcattgtctgtagaagttataatacacaacagtttaatgcacaatttgcatttttaaatagaccttttcctagaagttctttttaagatggaagacaataaggacgtttctgtatttgtaagctgttgacaaaggaaaagtttattccagtttataagctttcccgccttgcacaaaatgtatcatttcacatctttttgataatgtttaaattttaatttgtatgcagaggaacaaggaccacaaaactttttaaagaaagcaggctgtaattgtgaaacttctggaaataatgtgggtctggatcaaataattctgccccagggagtctcttccttactcctgggctttgttccactatgtaggattagttgctttcaggtgaaccttttattatctttatctttgaaaaatcatttcttaccatttttactgtctggggttttgcccacatgggtttgatgagcttgattagaattggagaggatacgtttgaatgaaaatgctgtcctttcctgtatcaaacggtaataaagcctttcttggcctagccttcagagtttgggaaacctgttatgaaggtgactgtctccagaatgtaatcaggctcttaagatctctaccctggggtcctggaagtagcttcagttagtttataaaagcttgctaactcatcaggagaaagagtgttatgataaaatgcccactccctaatgctagaggaactccacttgtgtagcatggacagcaactgtttggaagtgattgttagctggaacatacagggcgactcacattagtgaaggagttttatgttcatttgtgatatacttaagaacaggaagagtcttaaggacagatgggtacagttaatctttttttttttttcttttcttcgagctacagaaatgtttgccagatttgagggaacagctttcatcttcatagtaggtttctctttcttagggaaggtagttgttggcatagtactacctggactggtacatagaggaaagctggatggtagtcttgcagatcacactgagcagagaattaattataaatttgcttttcatttttcatgttatgaaacaaagtgaaacagattcattaaagtgttacttatacttaaactaatactgtttatagttttgggacagccagtattgtcatagctgttagtactactatgactttagaagttagaaaaataaaagcatacggttgttattaacaaagtatttattttgtcttgtctttctagatagcagttcagaggaacctggaaaattattagtaccaatattgaattagaaactatttaagtaatatgaaatataatgtaaaaatttggctttttaag

SEQ ID NO: 98940 - DNA, 2176 bp, Homo sapiens
cggcggccgccgggctccccctcccgtcctcccacctccctcccccggcatctctcactctccggctctcctccctccctcctcccccctccaccctctgggccggatctcgtctcgctcaggcggaggaggagaaggaggaggaggaggacgacgttcggcctgcgcagtgagatgtttgtccgtcgccgccgccgccgccatcgcggaggagcgcgataaagggagccgagccggacgtgagggggaccccgcggagccgccgcgccagcgcagccccccagccgcatcggagtcgccagagtccgagccgccgccgccgccgccgccgcccccgccgccgccgcggctgcccaggggccggccagctccccagccctgcccgggggtcgcgccgccgccgcccccagcgtcgcccctagcctgcctgcccgccttaaatgtgacaccggcgtcgcggagcgcgacctgaagccgccgccggggaggggacgagcaccatgtcgaatctgagcaaaggcacgggcagccggaaggacaccaagatgcggatccgggcctttccggtgagtctctcctcggcgtccgggaccccggggccgggggccgggccgagagccgcacgcgaggcccgggctgaagtcccccaacaggccgcaggcccggcctcccctcccccacgcccgccggccgcggggcgcgagccttcccggcaaccgggcggcgcggggccccggcgcggccgccctcccgggccgttccccgcgccgggagcccgggcctggcgccgcgcccccgtccgggagctgctccttcagccgctccgcgggcgtcggctgcggccggggcccctcggccgccccacgcctccccacgttgccggggttgtaggcccagtctccggcgctgctagcagccgcggagtcctccctgtgtggggcgtgtgtggaacttttcacgtggggtttcgctacactttgaaaatttacccagcctagcttttagggtgatgaaggggctgccctctctctctgcccccctccccaggaaggtctatgccatcaacctgcccccgacgcagtgacagtggttccacggaatgctccgtggtcataaactagtaacattgggtgtatttatagcgtctttcatcctacaagcttcctaagcactttacaaactcttgtgcaggattgcctcgccactcggaggaaggccgggtgggggggaagcaacagagagcaaaccggccaattggttctccatttctcagccttgggagcccaaagaatgagtgtagtcgccttgcggagtagctttgtttcatcgctttcagtgacagcaaacgtgttctgctcagaaactttttcttttttggcattacgttgagtcgtacccttgcgatgtttagtatataggatataactttgggtgtcaaatctggttcagcttccccgtggcaagcaattaaaatgtactgttaacgaactgggcatacttgcctatgtcgctacaataaaaggcatacgtcaagacagacgaactagcaatcggacagaagattttaaaaagtaaaattagagaaagatcttggtcttcccttcttagattcataaatacttcatatgatgtaccagcgaaagagggggatttgttgtcactttttaaagcatgcttttcctgaagcgcagttgcagtgaggaaagacttaccttgatgtgattgccccagttgagtcaagtgatttagtttcagagaacatgaggacctctctgaattcctaaaatttaaaaggatacacctcatgcagaattctgaaattgtaagaacataaatactaaagtcagtgtgcgaaaacctctgctttgtgtaaataggtacgatggaatttaggagaataagtgttttgataataattaaagattttttgaatgtttcaaacttttttctaagtaaacgtgagaaatgttgacaagcgagtactaacgaagcttactagtatgttttcccttataattgggcagagctgggttatgcatttgtgagtgatattaattttcctactaaattctgaccactttagagtttagaattacttagaattttatgaagttaatagttgtatacaacagattttctttttttttgagacaagagtttcgctcctgttgcccag

SEQ ID NO: 98941 - DNA, 1031 bp, Homo sapiens
aaataataacttctaatagcatttttgaatcggttccaatgcattgtgaaaatgcttagaattccaaagtaccatagtttttttttttaaatccaccagtaattaccaaagatatttgcatttgcagtcaccttgtatattttgtgctatgattagctttttcttaaggacaaacttcagacgattcagaggttaaatttagctaaattgttaggataggaaaaacatctaaatttttttctacatgtaatttcatcaaatttgtaccaatgtgattccctttccccagtcctattttcttcaaagcatctttcttaatgcaaaatagtattgcacctccatattcctctcttcaattttcaaacaatcccaaaggtgaatatatattaagaaattcttctacttcttttacttgtctactgacgtcactggactttaccagccaagtaactttggtaaaagttaagtcaatcaaagtatgtattactttctaaggaaatccaaacttctgtaaatctgtgaattcctaatgtagacaattgtttctggcagcctgagacatttttaatttttagaaaataatttttagaaggtatttcatgttaagactaaaaattcaatagatattattgaatgtctactacatgtgggtatcatgacaggtgttattgggaagagtgggtgtggtaaaattctagaaagaaaaaaatgatctcctccatctaagatttatatatgtatactaggggaagatagatatgtaaatgaaagtctgatacaaaccaaaatgtactgttaaaaattggaagcataatggagatatgaaggagagaaagatgaaaaccaagtgggtgagtttaagctatatttcttaactaaaagggcatttgagctagcacttgaaggaatgtagataagtgaacttcattcaaaatggacatgccgaggaaggaaaatagcataaaggaatattgaggcacaaaaatgcaggcttcatagaaaggcgagtatttgcgtgattgggacatagg

SEQ ID NO: 98942 - DNA, 1151 bp, Homo sapiens
agccttccttctcctggctattattttagaacaagtgtgaaaaagaggagacccagatttttgagaagcttggctgctctgcttggaaaataaattagcagtgagaggtagactgtaaaaccaagagggtattcagcactcctatgctcctggcaacagcggcctctgaaagaatagctaagggtaggagctatgggagtgcatgagctgaaaagaaaactgccagctattagtgattctgtaggaggtaaatgttctaagctttgatgctactgagaattctctgaaggcctgtgcaaacagccccagtgtgaggagcaggcaggcgcaggcactgagccttgcctgctgctgagctgggcttatggtattaggtacacttgatctctgcttccaaatcccactgattttctccatggagaaatttgtgtctcataaataacctctgaaataacctccgggtttgtttccaggcattgctcatctaaattcattgtactcgttcaaagcaattgtagctattttataatgcagaataagaaacccatcagggcctactttgtaggtgagttggctggagaccatgctctctttgaggttctgataggatattctcccttcacagttcaacctccctgggccctcccctttgggaaaattatcagataccagccattaactcctcctccctacagatctgagttccagctattccctagaattccctacatttaaacattttaaatgggaagggccctacagttaagggaactttagccagtagtgcaggagaacaccactgggattggaaaacatatgagtagcacttttgaaattataggtagacaaaagtcacatattgctgtctggtaatcaaggccagcctggtgctcttatctcctccagtttagattctcttgaacaccctctggggaatgagtaggctttccctggctgcacttccctctcattgggaaggagaatattggcatagtctctgctttgcaccaggagtcagtaaatgctggcctggccttggccacaagctagtatttcggcaggaagtaaatggagtggacagtgcacatacatgagatctctcaggaacactggtcttcaggcccatgatggccctcacagctcccctggac

SEQ ID NO: 98943 - DNA, 1077 bp, Homo sapiens
tcatgccagaaatagtttggggtcatgctaatccctttcttccaatattatggagaatagagattttgcaaaatggggtacatattttggtagttttgcaccctaaaacagaaaaagaggaagcattcaagggtggtgtcagtatctaatactgtgtcatagatgatggtctgggctgagaaagtaactagttgccttattatggataggaaacttttcagagaagaaaacatactgaaattatactgaagagtatggcatctgccacttctttgagttgtttggctctttctcaaatccagggcatgactttacagttcttactaataggaacatgtgttctccctctaggtccaacttcaaactggcttaaggtttgagagtaaacataactgatctcataagcatacaatctagtctccagatcataagtgtatggacaaaccagagagtagcctcttgactctggaattcaaaatgccattggtgtcaatcaagatggttacaaagttgaaggaaaatgatatctaatccagggatttgttaaataatgattaatttagaggcttctactgtgttatctcaggcatgtaaataatgtataaaacaatatgagagagagatattggtagcctctaatttgaggtgaagataacaaaactgaacgaattaatgtgcctggggtcacaaaactagtttgtaatagagctagaattgtatgttgaatttttcaaattggccgttgggatatctgaaaacagcattccatcatacatttttttttgtttcaacagtgaaagcaattattagctaatcatacctaagcctcatagtatcattgtagtttttctttccaatgagagcttgaaaatgcctatcccaaaataattcaaaaagaaaagtttctgaaactacctagcagtttttactgggtcacatctttctctctcttccactatctctacccactttccacttgctacaaacaatgcatggtctgtgctctcaaggagctcacagaccagtggaggagatcaaatcagagaacacacctgaagggtgtgataaaggaggtgc

SEQ ID NO: 98944 - DNA, 1075 bp, Homo sapiens
gggaatttctatatgcttaaatattgtttcaagaagcaagctttagctctttgccatgaaaggtacttatattttctaatctattctaatttattgttttaaaatgctggttacaaactctaattttattttacaactagtggattgaaatgaacacttcaaagaacagtagttctgattaaagtcccttgttgtatatatagcaaaagtgagtgtaaataaaaatatacttcaaagtaattttccaatgttctgcatcctgactgaggcagagaagggattagaattatgtcttctagtttaagccaagaccctttcagtcccacttgactttttgaccacactgttgagccagttccatgccttacttcatctggttccaccaaaatgttcatctgagttctctactttcactgtcgccagatccaggactgtaacacaggtcctacaactttgaacccgatcctttttgtacatgattacactttcttattcctactataaacagactaaggccatttgcaacttccattccttaacaaacatcttaattaaaaaaaaatagtggatagtattgtggggcttgtgactgtgaaaataaaaatatccttcagagtcatggagttgtgagttgtgaaaagagttattgtgagcacagttctgctgaaagtgggaaatgtgtctctcaccttccagaatcagccagttccagtatcacacagtgtagacattattttccttcaatggattcacattttcctgcttgaattacttatttaaatataactctaaaacatgataagcaaagttatagtgctgctatggaaaggactgtttaaaaggatactttatgccatatacaaaataatgaattgcatagctttttcctttatgggtttctttgtttcaaagggtgtggaattaaatttaagttttgagattctcttagatattgtggttagtaaggaattcatatttgttcattagtaatatatggaatctgggctggatatctcaaagagcccttcgtattctgggattctgtggccacagtctttctaggaagggacaaggc

SEQ ID NO: 98945 - DNA, 1035 bp, Homo sapiens
tgtgacgtgttactcctcatgcctttgagtttgatagtgccaatcagctgagacctcttagataatgaactaaagccacctctaccctagattttcatacattcattaccagcatcaccgaggcttattttaggggtggctccaaaaggtttcttttttagtcttgccacagcggcaggctgcactagcttctgagatacccattggtcaaaccaggccctttgcgtattgccaccagagttcagtcctagttccaggcctgtctggatgcttggccacccaggttatgatcattaatgcattccttgcaagacatgtgtgctctggtttctttaaagcaggatctcaattctataaagaatggctaagggcccttttgttgggggtggggtgtaaggtgctcattttaagcctccaccaaacattccagctatcaagaatttatcccagttcttttgtattttgagttggcctttttttattttggaaaccatgtcacctgacgtgacccattctctcattggcccttattatggcttgcgcttatttcagcactctttttatcttaagtggtttttaggttatgtgatccaaatttagccttgctgataacacttggctgccatttgactggcactgtgtagaagtctgtatgttttaggaagtagagtattagttcattttaatcctttaatcttcctgtaggctagatactattctgctctaacacctacatatcaggccttttttctggtgacatgcaaaacctgtagtagaaacatttggcactaatcaggtaaatgtgagtttgctttgaccttcattgccttttttttttttaacttgattttactaacttcctggaaaattatgttggctgagtaaacttttaatgatgttttttattataccatttgcttttaggtgttaattctgtgatcattcttgttttgagctgctctcgacagctggctctatggtttcatgaaggcatgctagtgggttgatgaaaccgaatcctaccatatggaatgg

SEQ ID NO: 98946 - DNA, 1077 bp, Homo sapiens
cggctgataccatgtgcttgggaacaggaaaggggacccagctataaactcctcagcagccatgccatgccctatcaccgtcatccttccccaacaccttctgaccttgataaacacagtcaggaccaagaatgtgctcatatttacatataccactccctcccataaaaatagggtaacctttaaaatcacaaacaacacagcccacactaccaacgttcttccgtcactgacagtgacaggatctagctagttctcatgctccaaaagttatatatatatacatgaactttaaagagagagggtctcactctgatgcccaggctggagtgctgtggcatcatcatagcttaccccaaactcttgtgctcaagagatcctcccacctcagccttccaaagagtccagtttattgagaaaaatattcgagttaaaagtatccctaaagataataaagctcagaatgttctttctacagacaaatagactcaggaccatacagtgtaagtaacttggttaagatgatacagctgttacatggtagagttagcaaacaaaaacaaaaataaaaaccctgatattctatctccaggttaatgttttctcccatgctatactacatcaggttgtacatgtgtaaaatgctttgtctgttttgtatctttatatacaacatgttgtacatatatgttgcatattcacatatatatgtgtccaaagactgtatgttatagatgtcattgttcattcatttgatcctcaaatatttgtaaagccattcactattttggctttactatttgctgggaatagggctaggaataagacttcgtttccacacttctgagcttatgttctagagggagaaataggcactaaacagatcaagttaattcagatagtggtaagtactcttaggaaaaattaggcagggtggaggagtttatgaacaatgtatcatactaaatttatcaaagaagctaagtagaccacactcatatttagttttattgtttttgaagtttcttttgaaaaattctattgggcaagatgccattcagcaattcacacatgttt

SEQ ID NO: 98947 - DNA, 1033 bp, Homo sapiens
atttaaatctttactactttattttcttttcctgttcactttcatggtacttaggcattcattcccccaagactgagtgaataactagttcttaatatggtataatgggattaagtattaaggttaaggatctttttgaagactttctggataccaatgtctcatatttttcagtgctcaaaagaattaatgctttttattggaatagtctttcaacatttcaaattctgggagcaatttattttatacataagactacatacaactaattaatgaaatttatttacactagtgatgtcctgtcacttattttctccaaagttattaacactggacaggaatggaataaggagaatctaccctgtctcctaaggaaagtgtgtattgctgagataatttctaccttgaagcaaagaggagcttctctagtggtcaaaaacatttatgactggtaccctgctattcttgctaattgtggtccaggaagaggatgaatagaatggggtagctcttgctacaaaatagaaactttcgagaatgtggtaacagataacatttgaattagaggctgggcatggtggctcatgcctgtaatcccagcactttgggaggctgaggtgggtggatcacctgaggtcaggagttcgagaccagcctggccatcatggcgaaaccccgtctctactaaaaatacaaaaattagctgcacgtggtggcaggcgcctgtaatcccagctactcgggaggctcaggcgggagaatcacttgaacctgacaggcagagattgcagtgagccaagatcacacccttgcactctagcctgaaagacaagagcgaaactctatctaaaaaataaaaaataaaataaaaataaaaaaattaaaaaaaaacatttgaattagaatcgtcagtgtttgatcgtttttttggtgacttaccaataagagtatagtaatagcagtagtgttagttttcttccagattaaagtaaggaggaatgaaattcatccatatgaaggaaatttttaaaaa

SEQ ID NO: 98948 - DNA, 1029 bp, Homo sapiens
gaatcataagatcccagggcagcgctttttctgaggggccaagtgaaacatcacaggtggaaacgtaccaagcaggtgcaaatgttatgacccaaaactgctactgagcagtgggagagagtttctctgttgttccagaaaagtttgagcagctaataatttgcttaatgtttgcaattgtttaggtatctttttatagtaaaaataaatccataaaatgttgcatatattgtagtcatttctctgagttccccctcaataaatactatctccagcattgccctacaggaagagacttgggatccaaagggcatgccaccttttttttttttttaaatcacaattccaggaaaatagctttgtgctatcttaaatgatgcaatggaaaaagcagttcttgggagccagagatcttgggctccaacacagcctgtgcccttcactagcagagtgaccttgggcaagtcacttaatttctctggacctatttcttcatcagtaacttgaggattttgttctaaattattctaacctcctttgcagctctaaacataggaatgttgtggagaaaatgactgatactctttaatgggtcagttgcaatgaggattctttccgaagaagctgttgacagggtcatgataaagcatgagaatagcctgttctgtccatttctagcctttggatcagacattctttatggacagactggggcctggaaggaaaacattgtttgattcaggcctgacattaacttttcttgcttcaagggggcattttcgagttttaacaaaccctaagacaaaccctcctgatcgaccagcctaagtttttggaaccatctctagactgaattatgctcctcttccttccgcctttttaaaaataaaatgtgtgtgggaatgcaaggcacctgctagttcctacatcctaaggtcagctctcagaaacatcccacccctccccacactatagagtaagctttaaccagtgcacactgtggaaattaacacatgcatcctgttggaa

SEQ ID NO: 98949 - DNA, 1067 bp, Homo sapiens
gtccctacctccgtccctccaccccccaccccccaaaaaaagctaaataaaggtactgtacctctatgggggaaaaatactcttttctggaaggaggggagggttggaaaatttatttgcacgtacctcacaattatcttcataggaaggattttgatcataaaaagctaattatgataataaaccttttaaaaaatatatctctcagtgttaaagcatttctgctttaaaaaacacaatttcagttgctaaatattcgataaaaattatgaaataagcctcactgctgtgacaaattatgttcagaccaatgggtttcctatggaagataatcactgatcataggatattagtgccattttttctacttgctgatgttttactaccaatttaaaggtggttaatatttgttataattatactacagtaaattcaattgttctctacaattgttttattaatgggctaactggaaattcatttacatttggttcatgtaatatatagaatagaaagagacgcgtttgtgggaactcactgaagtaatgctgagcaggtatgggtattattctgtcacctaagctaaattagtcttttggtgtattgtaatgaaatacactgtatgaaaaatttactccccactgaaaattcacggaacagaagaacaagctattaccaaaatctgttgctcaatgctgccatctataggagagttagagccgatttgtgtaatatgctaaggttcattttaaaagagggctaaaatagtgatttcatcacaacattgcaacagctacgttgatgtcactaatacagtcctaattcaaggagttaagggtttacatgctatggacgcactttggggcaataggtctacaactagctttaaaattgagttattggtttatgtatgatactatcaggaaaataatgcaaaatttatagattattacatatatctgtaaagtgcttgagttgggtggatgtaaaactaaacatttcaaaattataaaacactttttgtatcaaaacatatgttttccttaagatgtatgggtcataactgg

SEQ ID NO: 98950 - DNA, 1053 bp, Homo sapiens
aaaggcttctggtttgctgcaggcctgccgtcgctgtggaaagcaagtattctttcaaagaagaatagaagtgcattggtttctaaataatcccaggacgctaggatcagcatcacttgggaacttcttggaaatgcacattttggggtcttatcccaaacttactgaatcagaaatatattttaacaagccttccagttgataccaatgcacctggacgctaaagtttgagaattaatggcgtagtgataacacccattgtggaatcacatataatggaatttgaattgaagtaattcctagatggaaaaacttggacatgttacctcacagggctggaatatgaagatgcaagaaaaatgtttaacacaaaacacatagaaaaccctcaaagatgttattaagtaacttattagaactgcataaaataagtacatagtttgtgctggaaggattcttcagcggggtagatatgagctgtagcgcatggatattgggactgctgcttagagggtattttgtttacctcgggattctcaattctgtgtagtcaaggttgttggatgcaggatattcagttaaaagttaaagcagtgcatactaatgctattgtggttgtaggatttttaagaatagcattagtatttatgttgaagagtagtttttaattctttggccttctgatctcttcagctttgtttggagacagtctctttctgccacccaggctggagtgcaatggtgcaatcttggatcactgtaaccgctgcctccagggttcaaacgattctcctgcctcagcttcccaggtagctgggattacaggcgtctgccaccacgcccagctaatttttgtatttttagtagagacggtttcaccacgtttgccaagctggtcccgaactcctgacctcaggtaatccacctgcctcgtcttcagtttagttataccttctttgacccagaatttggtaaagaccagaggtaagcactagttttagagttgagaattattgtaacatagtgacttgcaagcgaaagccaaggctgaat

SEQ ID NO: 98951 - DNA, 1027 bp, Homo sapiens
agtcaccctagggggttgaagcattgtctcctctctgattatgttcaggaaataaaacaacttaactcctttgaaacaaggaacaagaagtgtgccctatgcctttctttctgtttttctctgagcctaataactctgcctcacctgtggaagatggtcagtatgttatttgttttgggtcccattgatgaccttgttaacattcagcctcttccagtaaggaagacgctaaacttttttccatcaaggagagttgataaattcctctccatttctctctgtgtgtttccatgtctctttctccatctatgtctctgcatttggggtatgtgtgggttctaaacacatacccccccaatgcagagacaacagatggagaaagattttcagtcttaagactagaattagagttcctgagctccgtgtgcagcagagcaacttgatgatccaactgagcctaaagaaaccagttgttcaggaggttgatgaccttgaatatccaggaccacaaatctaggagccgaattaggatgggcagaatcaggacaactagcaaaagtagaggtggaagcgtcacctctctgggaaatagtccctccagttattttttatcatctttgcttttttttaacctcaagtttccaaattgcctggggatcccctgcacctcgctcaccactaccaaggcctcatcttttcctctcactttggcaaaagtctctagtcccttggaatgaattaattgtgaatcttataccttcactctgtgtaatttagttaaactgacacatgagcctttttgttgttgttgctattgttgttgaaagtagtttagagcatttcctaaatctgcagttcccttcctcagccttttgcctttacctgaaaccaatgctcatgtagttcctttggatcttttaccctcaacagccagtcgtcagtgtagtaaagcttggcgtttgttgcggtggtgttggtggctttttgttggcttgttttaccttttagttcttcagccattctatcc

SEQ ID NO: 98952 - DNA, 3400 bp, Homo sapiens
ttattttttaaatttaattaatcttattttatttttagctatccactatcatagctcaccacagcctcaaagtcctaggctcaagtgatcctcctgcctcagcctcctaagtacctaggattataggtgtgtgccactgcacctggctaatttattattattattattattattattattattattattattattatttgtagagatgaggtcttgctatgttttccaggctggtcttgaattcctggcctcaagcagtcctcctacattggccttacaaaatgctgggattataggcgagagccactgagccaagcctgcagattttcttttcttattattaaattctaattaaattttacactgcatattacagatggatgttgagctaaaatgaagcattgttttggtcccttttactacttttaaaacattcaaacttcagcttatcctccaggaagcatttatgtgaaagaaaagtcactgacatctcttctaaatgttcctggtctagtgacttaagttaaaaaatattggccacgaagcagaacattgaactatttcctggcatgcctctagatcacagcctagaattttagaagatttttatttaactacttatagccatttgaggcatctggtacatgctgtggaagtgcagaatgtggaactcggctttcttgaggcaggccaggctgctggggcggctcacaggcataggggtctcgcaagggtcacagctgggaggcaggaaactgcagggcttcacggcggaacagcactgtctggtgggaagagctgagtttgagtccttatactccagcttctgggcatcatcaccttggtttctttatctgtgtaataaagtggaatttctgtctgtctttcatggtttcacaccaaaactactggaaggacttttactaaattgggcacaagatgtaatgtgtgggatgcatgtgaaatttactttcgtcccctcttgtggtgagagagtccatgtgactgcccatctgtgggaatggccttgcttattaagcacgttggacagagaaagtgaaggactgaaatttcagcatccccagaaagtctgaagggccgaagctccatggatgtacatctcacgtgggcaactctacggagtgtgctttagaatgggcagctggacagttaagtgattttcttggccggtggtgggtagacccgctaatcgataaggtggaactaatttcttctacaggattgtgagaattaagtgaaatgaagcaaattgtatgtaattacttttaaactataattgcataaaagttattattgggaggtatgtaaatattataagaccttgattcctgggatgaatagcttgaagttgatcagatgatgttgataaatatttaatatctgctaatacttatatggtacttatgtttcaggcattattctaagtgttttacctatattactcatcaacaactctatgaggtggtccttattattatttagtatctgttttataaatgaggagactgaggtagagattgattaacaacttaacctaagggccgggcgtggtggctcacacctgtaatcccagcactttaggaggctgaggcaggcggatcacccaaggttaggggttcaaaaccagactggccaacatggtgaaaccctgtctctactaaaaaatacaaaaattagctgggtatgctggcgcgcgcctgtaatcctagctactcaggaggttgaggcagaataattgcttaaacctgggaggcggaggttgcagtgagccaagatcgcagatcgcaccactgcacaccagcctgggtgacagagccagactctgtttcgaaaaaaaaaaaaaaaaaaggcgcttacctaatgtcatatagctcccaagcaattaagcaggatttgaacctaagtcatttgactccagagtccattccattaattatgacactattcatcgtttttttaaatctacttaaagatattttttccataaagagtatcactacctgagatactatgcagtgttttaaccatgaatatagaaagtcattgagtggattgaggtggggggcacaacatagtgaaattggattttaagcaaattgagtcaggtgctgtgtaagtagactaggggaagagtgtaaggtgataaaggcctgatttctgttgagatctttcagtgtataatacatgttcttattaatggcttatctgtctagaacattcttcatatgtccaatttagtggtcttaaatcccaactcctcagaggttacatattttgcctatacatgccttccacatgggtggcactgatactaaaggcaggctattataaaggacatctggacattatcccactaagggatcagaaattttgtatttgtattcatctggggagatggtgtatgaaggaaaaaaggaaggaggagcttttatgtcttaagaactctaggtttgagcttgggtatggtggctcacacctgtaatctcaatactttgggaggccaaagtgggaggattgcttgaagcaaggcgctcaagagcagcctggacaacacagcaagaccccatctctacaaaaaataaaaaactagctgggtgtggtgacacttgcatgtagtcccagcttgggaggctgcagtgggaggaccacttgagcctaggaattcaaggctgctgtgagctatgattgtaccactgcactccagcctggcagcagaatgagaccctgtctctaaaaaacaaaaaaccctctaggtttgataaattaaagtcagaaagatacagccagttgtcattagagagatagtctaatggttgtgtcaagctgggtgagaaagtttcttaatatggttataacaataaagtgtatgaagttggagaaccattgtattaaaggtctcagtaggcttcaaaaggagaaaatgctctcagttcccaatttcttctggaatacagtctaagttgtagatatttctgtgaatagatactggaatataattattgagagagtgtcacagtagtcataaagacgagattcccattaccatcctaatataatttgattccagtttttattttatatgcatgaagtcagttttcattcattttgattgtcttcatttctttgtatctctgccattaatgtgaaggaaggaaacagagatccctactctaattccctctgattttatcattaatgtagctctggaagacatttaatggattagatagccggaaaaaaatgtcatttatgtgcaactagtcatcaaataattatgctgtctaactaagattccacactatacccccaggactccctgtttactaatcaactcaggtagaatatgcattctggtaaattgaacatggtgtaatgatgt

SEQ ID NO: 98953 - DNA, 1054 bp, Homo sapiens
tgggattacaggcgtgtgccaccacacctggctaatttttatatttttagtagagttggggtttcaccatgttggccaggatggtctcgatctcttgaccttgtgatctgccggccttggcctcccaaagtgctgggattacaggcatgagccaccgcacccggccgatctaatgcttttaagccattttagctgtcaattgtcttggtagtagaactttttaaacaaaaggctttacttaacactcaaaatgtgaaatggatcagctctgaagtcttttgggttgagaagtggaatggggcccctttcaccttactcccatgttgctgtggcttcctcagaggaggcacctccacaaaaccctagagctccaggaagtacagtttcagaactgctgatttagatgaattttttcccttacagagaaggacttggaaattcggaaggttaagagacttatcaacaaacagtttgtggtagacaccagccttgtgaggattcaggccccctgactcctgtctggggctcctgcccattcatgctgcactttcttcctttggttcttttctctgctttttgtttagaaaaaggaagataagttgtgttattttttccacctcttccaccagcttcactttccttaatctgtcttgtgcaactggaaatgcataatgtttgtttttactgtgggactggacgttggcaaagggtgagattcaggaaggttcagaaagaaggaagatttctatttgctactgttctttacagacagtttttattttggttttgatttgtgtgactgtgctgggtgtcttaccttatttgagagtattctcatggggctgtgtgtcagcccggtaactccaggtccttctttaatgctaatttcccatcacgggcagccactggcagctggcccataaatgacagtgacgtggcccctgagtaccactcatttacaattgtattgctacttttgacagttccacgaagaaagcctaacaaaatcttcaaagttttctttgagaaagcatccggtaatgtctgtccctta

SEQ ID NO: 98954 - DNA, 1029 bp, Homo sapiens
ataacagtgcgtttaatattcttatgcaactatttctgaagtgctttttatgcatttcattttttagggttccccccaacttacatggaaaagggatggttgcatttctgtgtcatatgcatattctttgtggaggcaccggtaattctgagcttgggaagtaaatgaaatttcctgtctttgaacttaaagtcttttgatttttaagatttgactgctttgaatgataaacttctaatatacaagcatctacttacacatgtatccaaataaagactacgctaaacactggcccaggaaacctaagcagtgaatgcttctttgagatggatctcggaagaatggctgaaactagagctctctttgcaatgcattgttatttgcttgatggttgtcaattagaattttcattgggaaaacactgtaaatctttagaacaaagcttgctttattgcaggactgtatgggctgcccttcgggaggaaaaaaaatctgccaaagcaaacatttggtggacctctgtgttttatgaaagccacggaattagtaatttcccccagttacagagttttatgaaggaaagccaccccaaataggcatcgtgaggagtatgaggcatgtggacttgatgccagagtgaagcaatctccctcattcacgtggtgcttttgcttctcacagtgtctgtgtgtacttacttcagaggttgctctgcttcacatccggctttccattttccttcgtgtcctgagaccctgataggtgatagtgtctgaaggggtgtcccaggagggagatgtgcaggccacctctggtgcctccttcctagaccaggcttctgtcccttcccacctcctacccccaccaagattctgttgatgggaggaagggggatatgttgcctggttttaccttctagcgagattatgaacctctgtgtgttctcgtctgagccttaggctatctagacagaaaaccaaagtggagaatcatgaacatcacccagagtaagacagccactcagcgact

SEQ ID NO: 98955 - DNA, 1111 bp, Homo sapiens
atacggaggaggctaggtccactttgaggatgatgtatattttgggagagaataactttttctgttctaagactgttttaaaagagtcgctgttggtttggagtttttaaaagttgttgactaatattataaaaacttttctttttaaaagaaagcatcactgagatatgatccagtcagtatttataatataattattaaaatgtctttgagtttctctgatgtgttctaattgcatctgtagttgtagatttcattcaatgagttcttacccagagaacattcaattatagtgtcagtttgttgagggcttatgatcctgtaatttttgagggagaattcctcagtgtaactgacattgaacagattttgatggaccagttaattttagttaaagggtggtataaattcactgcgtgatatataccaagtaatttgaactctcaacagagggtcacatttcctcctctttcaggcagttttgtgaagtgtgatgcaccagtaggtaaaaatactttaggacttgctaatgaaagacagtgtgtacagaatctgcttttctagcacatatttttatagatgttgaaaatgctcttgtcaaacagtattttaaaaactgtcaggtgtatgtgtgtttttcaaatgagttttaaataattcagtactatgcaggcagcagaaaaatgactttataaacttgcaatgctcttttgtattgaatgtgcaagtagagtctatgaattaaaaatgaatactatctgatccatctttttactaataaccaatgtagtgttgatggaaatttattgtttactaatgtttggtatttttccattaaagaataaccttaaagtcatttaaacagatacaacacgtatgcagatggtgaagtagttttctaatagaagtcctgtctggtttatacagcttgatggccgactcagggtggcctccttcccttttcttccctactatgagctgctgaatcggaagtgaggacatgttagacatggaagatagtttacttctagtgagtaagtgttagattccttagtgcttgcccatacagccacgtagttggtgagcagcattggtggaatatttaaacttc

SEQ ID NO: 98956 - DNA, 1096 bp, Homo sapiens
gaagaaatacctgagacagagtaatttataaagaaaagaggtttaattgactcacagttccacattgctggggaggcctcaagaagcttacaatcatggtggaaggcaaaggagaagcaggcacgttcttcgcagggtggcaggacagagtaagtgcaagcaggggaaatgccagaggcttataaaaccatcagatctcatgagacctcactcactatcacgagaacagcatggaagaaaccgcccctgtgatctaattaccaccgtgtggggattatgaggattacaattcaagatgagatttgggtgggggcacatccaaaccctctcagtggtttttgctcttctttcaggcatgtaaggcattattccataggctatctaggggagaaggatctgggcagcctttcatacatttcctggagtgggtgctgttcttttcccacaggactgtaccatagtgataaaggatgctttctctggactctccctagtctctcttgtgagaccagatgaggttctgagaaaacctgaaagtgggtgtgaatttctttatatcatagccctccggggattctgggttcccttgctggcttacagtcagcctttaccaatcttcttacaatttggccgaaattttttcactggtgtccagcagagactgtcctaggtgaggaagtgctcatgtgtcattttagatttatatttgtttagttggctgatctgctacctcaggtctttgatgggttcaagaaaagttattaggtagtctctctgagcctactctggcttgggaggctgcccaattaaaaaaaacaagttaatttaaggattatgtagcatttatgttttttataaggatgaaagtgatgccctttccagctttctacatcccaagaggaagctaggagcattccttattcttcactggggtttgaattatcatttcttgcatactatttatcaattttgttttcttacataaagaggatttttccatcatgaaatagatagaaactatagtttctttttaaaagtctgggtaaatctctcttggattccaaggttttagactaaggagttaatgtaatagtta

SEQ ID NO: 98957 - DNA, 1069 bp, Homo sapiens
agtcatgcattacataatgtttcgctcagcaacagaccacatatgtgacagtggtcccataacattataaaactatatttttattataccttttctatgtttagatacacaaatacttaccattgcattacacttgcttatggtattcaccacagaaacatgctatagaggtttgtagcctaggagcaataggctataccatatagcctatatgtgtagtaggctatgccatgtaggtttgtgtaactacactttataatgactgcacaatgacaaaattgcctaatgacacattttttcagaacatatccctgtggttaagtgatgcatgactgtcctctcaaacttttctttagttaaataaattgtaagggtacattgaaaaatcaaggtagctagcaacttttaacctcagaatttgctattatcgtatttcataatagtacctggccataattacaagtcctaaagatcatgccaggaataataatgcctaagttgcctttgtagaagaaatattgaaatttatattatttcaaggggcttgaacatttactactactaacaaaaatcttgtcttgttctgttggcagtctcagcttttataaatgaatccaagaggcagctgataccacagtaatagaaaaattttggaaaggagccatgtttttctttgagtcaaaaggcagatgccaactaggaacattagctccttgcattttttttctcccccaaccccacatccctctgtgcataatttatgcctttttcttttctttttttttttaaatagcctgccaccaggttaagttggtgctgggtacaaagctctgtccttttcaatttctatctgccagcgtgcagcatgggtactggttgaagccggaaatccttactgacatgtggagtaacttgtgcttcttttcttagattcttctgaaaggcaaatggccacaatcacactttggctgtcttgtgaaaaaatcaagcagaattgtcacccccagctctgcactacacagttgaggttgctaggtagcatatatgaaactatggtggaatatactac

SEQ ID NO: 98958 - DNA, 1006 bp, Homo sapiens
ttcttggtctgtaggcccacctgtgcagtggacttctggatttctctgtgtgctctgaggaagggatccaagtggccattgttgacaggccattggcctgtgttgacagcttgtttctgttatgcctttgctcagtatagtcttgctggtggtagcgacagggggaagtgaaagaccactgagtgcctcttaaatcagttgtcattttggcagattcaatctaaaccaaggatgacttccatatgcaatggctgtgcaggatgttttggcccaagcaaataatacttaatcagcagtgtggttcatcttattactctaaggagaaaataacctactaccaaattctactctattgtagataggattttttaaaacgaaaataaaaacatctgctgttttgtagctgcttgaacctgaggctctgtgcccctagaggagcagcggttgtacaattgctgtgcgttctgtgtctcttagaccttgccaccaggctagggggacactgtcagagttaataagcaattaggacgttctgtcctgtcaattaactggcagaataatgagaccgcaggagcactctccttaaaaatgccgagacttgtgttctgaaaagcgtgtctttctctgctgtttgcagttacacgaatagacaactacttaacacttaaaaaaatacagtgaaaattatacctacagcaaacagaaaagagaggtatacaaatgggatatcattcactctaaactcagaattcatagattttcctcctgagtggctgtagtgatattataatattttctgtcaccttatttggcttaaagattgacagaatacttaggtagtgaacatcctttgttgtataaatcaatgtttaaagtctaagttttggacaatctgggtattgatgccaaatttgaattagtgagttcctggccatggtctattgatggatttttgtttccccttgaatgtgatgagaccttagtgaaggattttcatagaggagcg

SEQ ID NO: 98959 - DNA, 1032 bp, Homo sapiens
agggagggagggagagggggtggagggaactagtaaggcatcaacaaaaatagctactacctataaactaatgctaaccaaagagaagggcagcagatggttgggaatgtttagggatggggtgggatgggacaggtggatggatggatgaaaggaaagtggtaatggtttccttatttgtctccatgatgaaaaaagaagccattaagaccaactttcatcacattccagttcttattggaattgatgcaattaagaaaatgtaaaatagcgtgttttttgtgtattctttaggcttgagtctttacttttgaggaatgttaacacaatacggtgaattttaatgattactgcttgtgttcctttcagaaaaatgccttttaacatgtttcttattagagaggaatgaaatttttttttcaggtctttagtggttaggaaagttgcagttcacatgagcaccagttagagacgattataacccaacggtgtggttgtgccatttaaggagagctcagctgacactttttgaaattgtggaaaaatgttagtttgagagccaaatggcagcggtttggccctagaagaattacacagagttctcagtaatatagttattctaaggccttagaaatggcctggcccagactgccttggcactctgcaccctggaaagagaggttgttatgagctcagagccacatggcctctcaatccctgggcttatcctggaatctatatcattacactccccattcaaagctgtttctaccttatcacctaagtttgttttaactataatatacaatcaaaaaagttaagttcttcaggaagcagtaaggcacgtgctgaccatcgtgagctattctccagctaccttaaaggattgtcagtaagatcctctggtacttacattcgctttgagaagcatctgtgaacaactacagagaggtgggaagatcattattttaaaacttattttaagttttaatgggttccagcgatcattttggtgatgcgttcttaagaccc

SEQ ID NO: 98960 - DNA, 1001 bp, Homo sapiens
gaatgggttctcctgcagagcctccagaaggaaccaaccctgccaacaaccttgatgtcagacttctggcttcccaaattgcaagagaataaagttctgttgttttaaggaactcagtttgcaataatttgttatagcaaccctaggaaactgatacaagcatcaagggtaaaagcagaaggccagtaggagtccattgcagtaatccaggcaagagaggactgcggctccacttagtagctgtggaggaggtgtgaagaggtcagcttctggacacattttgcagtaaaatgaaaggattttttgacagaatgcctgcaattgtgagagagagaagtgaagaatgactaaggtttttggccaaaaccactggaaagttgaaagtagttcaggtttacaggaattagagttcagtctcagaggtgtatacattgagagaattagtagagctccatgtgccatcatcctggagccctgttgacttttagggatggcaccatgtttgagaggctacagaggagacccagagccagtaagcaagacatagagtttatagagaggacttacagcatagtccagtggcagcgggctagacaggagaaccgcaattgcttgaaaaagcacgaagtttatagcaaagacacaatgaaaaaaaaaacatgggccgatatcactgatgaacatagacagaaaaatcctcaaaaaaatactagcaaactgaatatagcagcacatcaaaaagttaatttaccatgatcaagtaggcatcattcctggggtataaggttggttcaacatacgcaaatcaataaatgtgactcgccacataaaaaccatatgattgtctcaataaattgctagtttttccagcattatttgggtgagtagttaactactctcctaaataaatagatccttgatgctactcatcttggagctatggagagttccccaggtgagaagcaggtcaatcacaagaaatgcctgcaatttggaccatc

SEQ ID NO: 98961 - DNA, 1014 bp, Homo sapiens
agactacaggcataggccaccacattctttttaattttttttttttttggtagaaatgggagtggggtgggttgtggggaggttgggagcatgggagatctactgcaccagaagctttgcgtgtgagacccgggattatgtgttttaataagctctgcagatgattctgttgtacaataaaatttgagaaccattgctgggtcccactctcagagttcatgatttagttgttctgggatgaggtctgagaatttgcttttctaacaaattccctgatgatgctgtgatgcagatctggaaatcatctgagaacctgttatagaagatggaccaactctttgtgaagtggcccccgttcccaagagtaaattgcataaatcccacataacaaatatttcaagtcaggatctcccaagtgtaccctccatacttgatgaaaatcttcctagcttttttcccatgatctggtaacaaactgtgtctggcttataggagggctgttaagtacttgttgaattaataaagagattatataaatcagcctgaataaaatatctgaagttgagaattctttttttctttattttattattattatactttaaattttagggtacatgtgcacaatgtgcaggtttgttacatatgtatacatgtgccatgttggtgtgctgcacccattaactcgtcatttaacattaggtatatctcctaatgctatccctcccccctcccttatcccacctctaactttctgcatgtgatggctttttggccttcatgataacctattagtggaattccacttttctgatccgtaattctacaactcgttgtagaagtcattgttgtagtaatttttctgtctgtagcttgataaattttaattgttatagtggaaagaaggtaattcttaactagagaagagtgtagtatgtccacacccccaagaggcatttgcaaatgtgtgtgtgagagggcttttgggttgttgaaatgataggagtcagggta

SEQ ID NO: 98962 - DNA, 1029 bp, Homo sapiens
agtcaaaccaagttctgagtgtccttagacagcagtgtgcactctgaaccaggcatcaggcacagtcagaatgagagctagatgggccttttatctcacttccgcccttctgatgctctcctgggggttggggtgggggagggggaggaggggcagaagcaaagaggaggattgggggcaagtacaagtggggggtttgagtgaaaatgtgagccagtaaccagtaccacctgattaggcctaacatagatcattttgagtattactgcatccaggattgattgtcttattaccatagattatgtctgtttatctcctctgatttggagttagcatatttaggaggctccggatcattcctgcaaagcactcactaacacgaggcagcatgcacaatagcaggaggaaattcaggattagaactggttaaactatctacattcatatccatatctgtatctatatctctcccagtgccttgtcagtctcctctgctctggaagaattctgatatgacatagaaactgctagatgctggcaaataactcctgggtttcgggccatctagacaataaacaactccataatattcaatgcagcagcctctgtagcgcccatctgtttcaaaataaccctaattctgcttacgatgcggaatgctttgttgactggaatttgtcctagttttcttcagcagatttaatgtcataggcctctggttccacctgctggcagatataaataccagaatgaaactcgggtggatatgttcagttgcaagaaaaatccgagctgtagctcaatggttctcaaaggctgatgtacatcggagtcacccgggagctcattaaaactacagcggcctgggctctgtgggaagcccacccaatcagcaactatttcttaaacagccctcctggtgattcacacacccacaccaacgttagcagaccccacttcacctggaatgaggggtgcagaacccagcaaggttagggatgattccagaccactatatcctactcatgc

SEQ ID NO: 98963 - DNA, 1065 bp, Homo sapiens
ttacactcatggggacacctcctaccaccccaaggaagcttgtccagattctttcctgtgtgctgaacaaatgtgagtacatatcagaaacacaaagataagacccttcgagaaagcctgcaaaggatgctggaggttaaggagagaggtagtagatcatatgacacaagtggaaactatagaaacaatttgacacatgaatgcaaaggtggggaagtagaagacagagtgtacctgagactgagtggacagccaggaagccttgtgccgagtgtggctccaacgcagagcacacacacagtagtcggtgtaggttaggggctgacatcaactttgtgattctcttcgaaataagtttttatgcttaaaaacattctcctcagatcaactcatattcaaaacagtgtagttttcagagttggaaacaaagcaattcggccattcttcagagagtaagatggcttttgtatcaataacactgagttggaaggatttaaaatacccttaagagctggcatgattacaaatcgggcattattgtggtttgggttgtattgttatacccaaggtcttcttggttctagaaagccgaaccatgctagtagccagtggaatttaaggagacccacgtgggaactttagagttacgtctttgatatcagcagagtcccacagaattgagaacttagactggaacttcttatttttctgttttcagatagcagtgagcttcccacatgtccatatccatgaagaaaagggacactgggtttgggcaggaagggcgggaatggtgagaggtgcaaccctgaacacttgcggtgtgagaaccgatggccacgtggggaagtgggaaaagactcagaaggttcgctgttcttcatgctagctcagtgacctcagatgtgtccctaacaccttctgagcctctgtttcctcttctgcaaaactgagatgattctattgggagtgaaagctaagtggagaagtgtaccttgaaagggctttataaagaagagtgtgatgattattcttctcatgacatgagttttctacttcagcatg

SEQ ID NO: 98964 - DNA, 1049 bp, Homo sapiens
ttcattacctttaggttgctggttccttgagatcaaggactatgtatttttctccctttattactactcatgatgcctgggagaatgctttcttatgtagtgattgaaattcttgtatcattacaaactgtgtttttggtaagtttgcatccctaagaaactcttttcagtaacgatttccacagtccttcatatgatcttgaaatatgatgcctacatctttgtttacctgcccagatattgatcagtatggtaactctgctccagtggttgcttgtgtgtttcaatcacgcatgattcttattggccacattggggcaggaggcggcacattagagggaagaaaaggagcacccaaaggctgatcagaagaagccaaaccagcctagttggtggggaagttagtaaaggtggcaacaagttatatatgggcataaaaaaaaaaagacaataagcccttgagatactgtgtaagcctaaatgatgcaaattatggagcacgatggaaggaaaaatacaagtgggaagattatcaagaagcctcaaaatgagtcaaatcagattcatggctgaaccactctaaaaatatttacttgacgttgaaatttagtactgacagctgaagttgaaaaatctttgttatatttctgttttgtgttaaaatgaagatgacacccaagctatcactttgttcccttggaatcctagggtacacatgccttgtcacgtcagaatgattgatttttcctttggctttctcactacaggaaataccagaaatagcccaccaccctacgggtttcatctctcaccagaagaaatgaggagacagcggcttcacagattcgatagccagtgaggtggcatcttgggaagacatggcctattcgtgtaattattgcccatttggctcattccccaagcccctaattcattttaattcattttaaacaaaagcagagtacaccggtattgctccagatcgctcacatcacctgggacagtcccatggcccctatgagtcaactcacagcttgcggggagtgggc

SEQ ID NO: 98965 - DNA, 1063 bp, Homo sapiens
tttttccgttgatacattcagcaaatttggagcacattgaccatggagttttgtgtccaaatccaatctgaatttacctggaagaggccttgacacctgcatggaaatgagctaagaaaaccactggagccttgggagctctttggcctcctggctggcccagtaatatctgagctcctttggttaatttataactgatataaaactacatcttctttataatataaattgtacctgtgagtctagaagctttaaatgtgtttaaattaaaatattcaagctaaatgttactgctctctcccaaattctgtaagtttgactcccgttaccccaattagaagtaacttctttgtttcatgccacttttatagcatttggtaattctgctataacacatcttgcccctattattaactgtgcacagctacacaaaggtgtgccttctacgtgggaacatggattgtgaatgactctgtaatgaggcctgagtcttagttatctttccactcactccccgtctcccctttccaaccccaaaggctcacgataggggctcactaaatgtcagtgtttcaccaaagtattttttccattgtattaagagtccagtcactgtatatggaagtattttattttttatttttttatatcacttgagtccactagtagtacttccttgctctgtttgacttgtcagatacaaagacacgggattagattttgggtggtaaaattgtgatacgcatggctgttgatggagtggaacatcttagtgatgtgagaaaggtcattttagttataaatgtaaaccaattactttagcacaacaataaagatgttctggaaattattataattattttagttaatggacttgcctgtaacaagtgcttatgtttggaatgtccattttattttattttcctctacaataaggaatccctaaagttatgccaacaaactggaattggattgagaaagacaaaagcaagtgagcaagtgtattagactaattatctctagtagggaataagcacttagagctaattttttaatttggttt

SEQ ID NO: 98966 - DNA, 1042 bp, Homo sapiens
tgtcattgaaaaaaatgaattggcagtaatgtgttcaactctgtgctaggcattaggcatacaaaaacgagtcaagcatggtccctgccctcaaggggcttgcattttggcaatggaatgaaggaagtgcactgagacattaaagaagcaatggggaacggagaaaatgaggacagccccgtgcactgcacaagagcagcagaagggagcctaagtttcccccagggaattcacctcccacgcagggtaaactgaccccagggaggacatcactggtgaagcaggagcaaagtcgaagaggtgctgggagtgtctgcagagctgcacacagttcatcatgacaggaaatactcctagagggaaccctcgaacagtccccactggacctttcaccccataggaagtcatttggacttcatgggcagcggagtcacagaaggattctaatccagagggtgacaaaatcaagtttgggtggatcttagatggcaactgggatttgaaactaaggcaccaactgggagatgcctactgcaagggtggaggtggaaaacaaaggctgtgtgagacgggcacggggctaaagaggaggtagccatccaaagcagcgatgactcagctttcaatgtggggagtgtgagagcagaacgaaagggccactcatagcatggaaacctgcctggatgaatgggctccactcactgagaatcagaacccagaaggaagcatcccagatttccagcacgggcacagaacagaacagttcccattagggcaatctaggcacgttccagtctacaaggttggtggggaggcagggagagaagggtttgataaggatcatctccaataatgggttaggagaacaacttaaaagctttgttcatcacctccacagagaaagggtaattgaaggcacattgatatataaccaggtgaagaaaataatggtttaaggtaacaggatcttctattccaagaagttatttttccgcccttttgatcctttaaaatacttttgtaaaattagagggcagtgtta

SEQ ID NO: 98967 - DNA, 2873 bp, Homo sapiens
taatttttaattttatatttttaaagtccaagcagctttccctcaaattgatgaggaaattttaagtttaaattttattgcaggcatttttttagttacaagcagcatgcatgtttacgcagagagtatgtgtgtatgtgtgtgtacacatttgtgttgtaattctataataatttaaaaaatttgctcctaagcaatatcctcaaggtacaatttcagctgataattaagaaggcattttgttgaggaagacattttctttcatcttttatttttgctttgtatgtgttcagtacttgcaaatgagaagtttcctttcgctctttctataaggtattgtcttctaacttcactgcgtagaggagactgacattttaacagtcagccctgtctttaaatttttctcccacagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggtatttcacctttacttagaaggttgcctgttaaatctttgttttatatgtttctatgaaaacttttgagtttttctaaatgttatttagaaaaggagttggaaaatgcaactttatacttttgaaatttctattcattattatagtctgaattgcaaacagtattttttagtaattcaactaattattgaggttttacacacataaaatgtatacatttttaagtgtgtacttgatgagttttgacaaaagtgaacacccatataaccaccaccacagtccaaatagagaccatttttgttactctgcaaggttcctttgtgcctctttctcactcagtccctacccctcaactctaggcaaccatgatctcctttctatagccagagaatagatttgtctttcctagagtttcatgtaaatggaatcatagagtatatactcttatctgtcttcttttgttcagtgtaatgtttttgagattcttctgttgttgcatatatcagttgttcattcagttttattgctgggtaatatttcagtttggatacaccataatttgtttttccttcatcttcattcgttgattgctttttgtttgaagctgttaggattaaagccactgtgaatattcaggttcaagtctttgtgaggacatatggtttcatatctttaggagtgaaattgctggattatatacaagttattttcaactttgaaaaactgctaaactgttttccaaattcttgtactatgttgcattccatcagtgatgaataagttacagttgctccacatccttgccaacattttgtattgtcagtctttttaattttagctgtttgagtgggcgtgtagtgccatcttgcgatgttaattctatttccctgattattaataattttgaacatctgctcatgtgctttttgtccatttatatatatttgttgtgaagtatctattcaaatgttgtgtcagtttaaaaaattggctgttgtaagagttttaaatattctagatatcagttttttggttatatattgtacattgcataatttcttatttctgtatgacagtgataaatattagtgaaatgtcaatacgctggaagcattttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggcctggaagcatattttgaaagaaactaatgcttattgggtggtataattcaaaagcagaagaaggtaaatacattttaacaaaaatcactgtctttttaaaaaacctcccgcttttctcttctttgtctcttttcttgaaaactcctaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaagtaagtagaactttagtatcaccggaatttgaaataatgtagacaaaggtaaaagagaagagcaaagaggctttatcatatctttagcaatatgtcatgaaagctttccatatggaacattactaataattctaatttacaaatgtgccaaataagttattatgctatttttaaaatttgaatattatgttttaggaaaaatgtaagttttgtggtaagtattattaagttcctgtggtttgaagaaagagcctttatgggtaggtgttacttgttaaataataagaaaatgttgggaagtttagcaataagaagtaaatgtatcactttgttataaaatcagtctagcaaacagggcaaagaaaaccctttttcgcttgacactacccattctcgctacttgattaaaagtttctactgagctactctactgcatcacgttaatgtgccagttgacctaaatgtagcagtgtagactaacaaggtgttagtaacaga

SEQ ID NO: 98968 - DNA, 1104 bp, Homo sapiens
tggtgattctgtctgctgggaactaacaaagcaactgttcaataaaccatgtgatctgggcatgaaatacaaaatgcccaagtcatgacagttttcagtgttcctacagtagactaggcagtgtgaatgaggagaaagaagctgtaacactgacattaccagctcttctcaaaaaggaatccgaactggagccagtggggaaggatcttccagagaacaagaaagaagaactgtaaagaaagagttggaaaatgctgcctgtaagaagatttgacacaaccttgaacagtgtgactaagtcaaagatgtggactctgccgttaaatcctatcaatcaagccgtgatatgctttgaaaaaatcagctacaataaaccctaagagctttgtgagaaggccattgaagttggaagaaaaaacagactggtctaaagatagagagtaaaagcttttgcccaagttggcatctcttacttcaaagaggagaaatacgagaatactattcatttctataataaatctttggaagagcactgaaccccagatatacacaagaatcgtcaatagttaggaattaatctggaaagagcaaaatcagttggcatatataaaatctgacctgattttggaggagaagagtaaaggcattgagtggtttcagaaatggaactatctccaagccatgccagctttatacagaagccatcaaatggcatcctccacaggatgccaaattctacagcagttatatccaaagtgtacagccagagctggaggagtagaagaaatatctagctagatccacccttaacacagattatacttagaaagcagcagccttagaatctgaaggatgacacaaaagccatgaatgtctagcagaaggccctagacctgtaattctaccgtaaagaagtagcagatggttattggtgcccagttcaattgatatgacaacgctaaggatgtgaagcaaaaaaccatagctatatgacatatcctaaaacaaatgcagaagggctcccagggactcagtgaatatttaaaagggtcctgtggaagcttagaaaatcaagaacttcatgaatatgggtctgatcacact

SEQ ID NO: 98969 - DNA, 3948 bp, Homo sapiens
tagaagccaggaaggtttatttataatacagatgctctccatttcctatatgtgcctgtaaacacttttataaattgttcttataaataagtatataccataaggttaaacaaataataattgtaccaagtaaaattgatacttaaaaagaaactagagtagcgttcttaaagtaaatagacattcctgtttatctgcattatagtaagtagggtgtgtgtgtgtgtgtgtcttgttttgtttttaaagcaagtctgtcagtaatacactgcctggcagcaattcttggttgccttttcttagttcgttgtaagttttttgagtagccttgtatcgaggttcttttgatgctaagcagctactagcctactaagaatatttctatttccttccctctctttgtgccttaacagatccgagcagttggcagactaaaaagagagcggtctatgagtgaaaatgctgttcgccaaaatggacagctggtcagaaatgattctctgtgagtagaagcactagcattttatctcgtttgtaagttttctcaggatattttctgtacccatgtttttctaaataattacttcatgtagtttttaaaatttgttttacatcaattttatatttttgtaatactttttgtaatcttaaaatctggccattttgttggtcctgagaatttttcagtcaccttatcctttcctgtgtagtatgatttgctaattaagttgtcataagatggtgaactggtcctttccagctttgcttctaatgagctatgttaaacagtgtagcaagacaaatagaatttttttctttccaaaagtattttttagctttctcccttacgattcattgaattttttggtccttttcattttcagaacatacaagtatgttgtttaaaagactatttgtttaaacctttctttttcatttggttgtattatcaaattctgatcttaaagctaccacaagattattaatgtcagtgcttttttacttttttattaaaattaatggatttttacaaacaaaatgttcttcgaaaactggtcagaattttaatcagaaagtcattgtcagtagtggctttttaaatataaattaatatttcttcctcattaatgttttggccaattttcgtaaactcatgaaccacatgtgatggcaagtatcatgtaagcgtctgtggaaactgaaagaatcaggagatgatacatctcttctgagagctagcaaatctaaatagaagcaaagcatttaattttatttacaaaataactagaggacaatacagtgatttatattacagcatattaatctctagtttggacctctctaaagagtataggggtacagaaggggttttgttggggttagggtcattgatattaaaggtagagagaggttttttttttttcaaatccttgctttgaaagaacaaggaagttctaatttctatataaattatttgcttgccttactgaaattccattctcttgtgttaggtgaaaggagaactaaaactgctctgatttcttatagaatattgaaatatctcctaaggtagttaaaattattctgaaaggctgtgtaggaagagagcaggttaaaatgaatatatatctccttcagggaatgcttatgcaagattcaaccattagtaatataaaattttttgattgtgttttccctaaaggtatctggttagcagtgatgtcagcaggcccatgaaatccattttttctagactatttccaaatgtattacacaaacggtaaagaggctgtatcatttatggctaaggtggcttcttgatctgctttagagtgattaaacatacactcaagagctttaattattttctttttgtaacattatcctaaggcaacaaagatttctagtaagcttttccactttataaagatgtggcttactatttaggttcttagctactttgacattttatattaataaaaacaagattattgtaatatagcaccactcttattttttctcccgaagtatatattatttatagctgcattcagctgaagagaaaggaaacccctttattatgtacgaaaaccagtccagtgaagtataatttagagtagatgatatagatgtttttgtatttactcaataacataagttcctcataacagaaaagatttacagtgttaactaatacttgattttctttttttttctttaagttgctttaatgacattttctaaatttttagtaaaactgaaaatctcatttttgatagtaaaagtaatgaatctttatacattttcacagtgaaacacttaacattgcttaaccatatttttcattatggttgtaaagtatattaccatgttatgtatgtattttgttaataatgtaactttgccctttcttttcctactgttgttaattttataatttacaatttatctttaagaatctacatcttactaactttagaattttgtataatgaacatattattcagtgttgttaacgtagtgaggaaaaaacaattgatataatacctctattaaaataattattaaactcttactatctttacctactttagtgttttctttgtaacatgaaattgttgtgcgtcatagtgcatgaaactttgcctgtctccactttattttattccatggctttaagaataaaagtgcgaacgggtatgagagcaggagcactagcctttgttttcttaattacttcgaagaggcaataagattgtggtcagctattagcgcaaaagtgaattctaaacagtaaaatcagatctagctttttctttgtgttataaaagctgaatatgtaaaagaagcataattattatttaaggtggcacagatcagattctgccccaagaaataaaatttcaaggttccaggcaccgatttctgcaccggagtacacgtaagattttatctgctctgcttttgacaagtagttgttttgattttgaaggattatgttaatactaatctattcaccaggtaattgacgtatgctatcctaattatcttcctgtttggctttttagtacctctgtttcaggatttctcaaactgtcattatatgctttattaaggaaaaaaaaaaactagaccatctaaggaagttgtatatgattttgcatgtgttggtgaaaggaacctgaaatataatatgcacataaggaccaagcatccttttttgtttattttgctttggttggtataatagttctcaacagattcaacgtcacctggtgcagtgatcccaatttttttttttttaatttcagcgcactgtcttttcttcttctatcttgtttctgaaggagaatggagcataagtgtggtttgtcatttattttataatcccatagatgaaaacgatgcttggaagcacttttttgctattattaaacccactctttccatgtgacaaaataaggtatgagaatgactcactcatggagcacaacgttttggtatataatacaggtattcaatagctaatacacttcttaagcaacagaagaaactgcaccgaaagccaacagttttcctcttattctggttctattattatgcttccaggaactattcagttgccatagatagtggcaatatattaaaatttcctctgtatttacaattccaagagaaattaatatatttgtgttttagtgaaaattttttctctttattgttttaccctattttttggaagagtgatacctcaccgaagaggttaaattcacaggttgggaaacattattcctatgaaaactcaaagaggtacttgattttgaacttacttttaataatgatatagttatgccaagtaaatttttatttaaattttaattctgacaattggctggtgtttttttggttgttttgtttttttcttttgagacggagtctcactgtgac

SEQ ID NO: 98970 - DNA, 2780 bp, Homo sapiens
gattaagattattgtcactaagaagcccagaaatggttatcagccattgataatttaagaagtgtccttgccttcttttgctgtattcacagatttgggaatatttttatgctttagtcatttaactagagaacatatgcttactataattaaacaatcaaaatgctttgttaccattttctaagactaattcatccttaaatcagtgtcatttattcgtcataaacttcaacttcattggctttacgaagtgtttgaaatggtgtttttatggaatcacacttttgattcatgtgtttaaactttgacatctgtatgtgagaattccctgtcctactcttctaatcatccataagtcgacagcagtgttgtttcttagaagttggtttattgaattggaatataaacacgaagtaaagaatgctgcttctccatgggaggggttgaacacattcattgctgtagttctcttccctctctacagttctttcatattcagtttatttattttgatgtttagggttacaaagttataagtgctgccttgtagctagtttttggaaacaattcaaaatatttattctttgactgttttcttgtggggagagtgaagggtgggaaaggggcaagaacactaagaaaattaagataaagactgctcagctgaagttttataaaaatctgacttgagtgtttttctcttcatttgctgtgcttgtgtaaacagtgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcaggtgattggccatccgtgactcttgacagctttattgcatattttttggcctcttgtttagtggactgtggtgtctttcttttctgtttttaccttctagcctctttctaagatgcaatgatttgaaacagcttgctttactttcttttaatttgaaattattgtccaaaattcacatttcacaagattacattagctttccttctgtcagggagagtatacatagaaagtgtagtgatttttttcaaaggcttttctagcctactctaagtacttgattccacttagggatatgccaaggggccccgtcccattggattgagtgttagactgaagtttactagtcctcgttagtcttttgatttaatcatttatgctgctgatatgattggattaataaagcaaatctgaggaggtgatgtcagcgcagctgccaggacacttttttcctttcctctcagctacggatttctaggcttgttttgaaaattccaggtgctatcatctttttgataatactgatatttttcagtgttgataatttatctcacttttgaacatctccaggtaaaatcatcagtagtatacttagacttattcatacaaataatttttttgcagttatctcaagtactttttgtccttgctttattactacataatgttttaaaggaaattcagggagcttttttggcatagtgtgggaaagatagagtcaatttcatttcaactctgaacatttatctagtggcttctggtagtcagggtttgaattttcatgattatttaattgttactttttgcattttgaagaatttcacaataaattaagctatcccttctaataaatcctgtttcttaccttaggaacgaatatgacttctgacttgcactggacaaactttttcttgttgagtgcttgtagtcctcacacaggccctgggtatgtcaccatacttcgtaagcacctgtccatgctacttatcattgttgaatccagggcctttctgagccttcccagagttgacctagtgctatgcatttgggcccaaggactgaaagctgcactaagaagagcttaaaaagaaagctcatggcatgagggtgtggggaggggaattatatatacatgtatatgtatagatctgttttgtttgtttttccccaagggtttagactcccttttatgctttttgaagcttcaaagccattcttggactattgggaagctgtaagaagcagcaaggttcagaacaaaaagcatggattcagggagtcagttagaattaacccggatccaccccactacatagctgcatgatggccttgaacaaattgcttagcttcttttggcctcacttttctcatctgttgagaaatagagaggaagggtaataatatctagctttgtgaattcttgtgaggatcttctcccctcccccacctttaattataatatagggataatggcctccaattctttatttagtatggtaggagatctttcaaacgatattgcatataaagtagctggcacttaagagctaatatttacaagggcctgttttctcttccctccttaaaacagatttattgtccatcagctaacttgtttaactttttaattacaataagtccttagtggagaccagattattaggtgcgagtatatcatatcaaatgctattacatttaaaatatctgaatgagagagatatttccaaatcttgtataaaaagtaataatagctagatggcagagtcacagtacattaaaattatatgtcccaaaaagtaaaaaaagaaaaaaaattatttgtcccaattccccctcaccagcatatacacagttcattgcaataatgtggaacttataaaaatatggattttttcctc

SEQ ID NO: 98971 - DNA, 1095 bp, Homo sapiens
tgcttctatgttccttgctctgtagatcattttttcttttctattttattactcttggctattatgctaatgcaataccttatctttggtcatatgccatcacattaggtgtagttaatttaaactagaactatttggcagaaaaagaaaaaagctttctgcttgctttatcactatgaagtaatgcagattcacaattccttgacataagaactgtgttcagtttacattttaaaggacgctgtcaaaaggtttgtgtaccatatatttttttcttacaagaatgtagatgatctaaaccaaactcaacgtgaaaaccaagttaaatcctaggtacatgttagaaaagtttatttacacaggtgagtgttacgcatttggagaactgatacactgaaaatttaccaaagcaccaggtgtgtcatttgctcaggtgcagcagaaattaaaatactattatgatttggtccttaactggttagaaaatgccggtctctccctgtatctgttagagctatgtatctcattttacaatgtaaaatattcgcatcttcaaaaagaaacttagttcctgtgtaagaaccttatttaaatattgatagatgagtcatgcttagctctcatttttacgaggggcttgattatttttatgcagtttttccttaacagattgtaccagctttgagtgcatagaataagaaaccaatgtatgaataatttatatttttggcaagtatccctataaatatacagcttggaagacctagaaatccagagttgcagtggatacagcgtttgttatttataatttttctctttaaaaaagtgtataattcctgatccccaattaaactttattttctgtagcagattacatttttatagcaaagaaacacatattctgttacgtcagagtgtatttactcaaaaaatgtcagtacgcaagttaatggcggagcttggtggtagccttggatttctttcccttttgccactctacaaaacatactgttgagaagattttatgtattaaatcatacttatcgtagaaaatggtacttgaatgaagtttctaactttgccacatacctgtct

SEQ ID NO: 98972 - DNA, 2340 bp, Homo sapiens
tcatatccttatatttctttgcaaatcgagatttcagatatctaaaccttagttaattcaggatataaattgtgagtaatcgctttcatttgtacttcattctgtatgttcagttcagatccctttaacaattgcttctgtttgatttttttcctaattattcctctgttatgtggcctcagagaaagagaagagttttattttgaggatgaagtgaaggaaaagggaatcttctacctttattttttccactaatcatttgtaaacccatagttccagcatctactaacttagaagtttacttctctaactggtataattaccctaactgctccaggttgtttactgtgttctcatgaaataaggagacagttaatgagaaagcaggataatttagccatagaaggaatatttggagatggttgtagattatctagagtcagtacacaccatctattgtttaaggttttttgcatactttattaaagtatttttattacttttaacaatatttaaaacaaaaggattttctgagtagacttgtctttaacatgtctggatgaaaagtataattctgcttcatatccctttttgtgggtatgtactttttgtagtggggacttgctgggataggtattagaatagatgatccatttgccaattctctggactacacaggaataacttttaatttagtttatttatattctgctcatttagaaaatttactatgccattttactaaaataaccatttagggtataaaatacatgtgaggtgaattatgtggttatataagttgtatctcaatgaagctattaattaaactaaattttaaaatgtggaaatccaggcaaagaagaggaatggcgtttgtctttgtttttcagaggtttagtgtcattcacctagaaattagtgccgctttagaagtaactacattggaacaaaaagtacttttttaatatgctttctctggattttgtcttaatggtttttcagtattattttatacacagcattttattcattattgggccaattctggagctaaatgtagtggtaagatgtattcaggagattttataattgtttctgcgggagaacacagtagagcataagtaattggaaataagtaaagaataggccaggcgtggttgctcaggcctgtaatcccagcaatttaggaggctgaggtgggtggatcacctgaggtcaggactttgagaccagcctggccaaaatggtgaaaccccatctctactaaaagtacaaaaattagccgggcatggtggcaggtgcctgtaattccagctacttgggaggctgaggtaggagaatcacttgaaccccagaggtggaggttgcaatgagccgagattgtgccattgcactccagcctgggcaacaaaagtgaaactctgtctcaaaaaaataaaaagacaagaagtaaagaataaaaatggcaagacaagaggcagtgagaagaggtgatgagtctttctttttttagagttagtctactttgtgttccctgctagtgagtctgtgcctatgggcttacatatggacataagtttgtgtaagaattatattttgttctatcctaagtggcagctctcaaaccttttcagccagggaccctttttagcatcgccaatccttctggcttgagaattttctatgtgtttctttagtcaggatttttttcccattctccagtttttagtgccctttttcaatattgtagacagttgtcattttaagcttttttctttcctttattagtacaaattcaggtagtaaaatattttagtaattcatattattaagtaccaattttctgaatactactttgagcattacacaaagcatgatgtggcgtgccatttactctgagttctactttactattcatttgtatttctatctcttatctgcaggtatggcatttcaaatatagatacaaccattgaaggaacgtcagatgacctgactgttgtagatgcagcttcactaagacgacaggtatttagtgtaccaaataagatatatttctcagttatattcatacaatattttaaagtgatagttctcaacattttattattttctctcctgtgggactatcaaactagtaagccatcattgattttctcattttgattaaagatatattaaactaccatttacatgttttgatcaccgtaaaacagtattaccaagatagattaatgtaattctggccagtaacaaagaatctttagcaaaccagtacagccatcagttgcttgtttggcttttgaaatgtggaacaattactttggaacctttgttact

SEQ ID NO: 98973 - DNA, 1011 bp, Homo sapiens
ggctctgcattttatttattgtgtttttattaaattttttaaattgtaaatgtaatatttgctcatggttgacaaatttaattagttcagaagtgtagaaagtaaatgttctcttcactctcataaagggaatcccctatttccattctccaaggatgaaagttaagtttctggtgtatatttgcataattttttaatatacatacacatatgtaactgtagatttttgaaagacaagcataagccatttgagatcaactagtccttttagacaatatctaaaagtccttttagagcattgtaaatctaatgattcctccattttgatgtggagttgtgctaactggcgttaatgtactaaaattcctaagaatccgtttgtcccggcagttgcatcaaataaaaacatggcattgttccagtactgcattaatctaatcaaactagttcaactgtgtgagacagtaagcctgtgaaaatcaagttacttacctgatgtttttcaatgaaaattcacaattggcattactgttgcttggagaattacacatgagaggaccttttaagagagcctggatggatatcagcatgcaatacagagcaccaatgactgtgatcacactgaaaagtgatgaaagaaacatctgaaaaataaaatagagccatttgcacatgttatgacatgttcttgatctgtttcaagcttcaggagcgtatacagtcttttttaaatccagtcgccctaaaatcctggatcttaagatcacagtttattaggtgtgaatgatacaaaaaggcagagggcagtctctgctatttgattacactcaataaaagatggttggggctgggcatggtggctcacacctgtaatctcagcactgtgggaggccaaggtgggtggatcacctgaggtcaggagttcaagaccagcctggccaacatggcaaaaccccctctctactaaaaatacaaaaacttagccaggcttggtggtggatgcctgtgatc

SEQ ID NO: 98974 - DNA, 1099 bp, Homo sapiens
gctttgcatatataagcgctcaataaatactgtctattattaatattattatcaccattgtgtctaccctacttggctccagacccggcccatgcctcagcgaggccgcagtgactcctcctggccagcagagggcgccagcggacacttggctaccggccgcccagggcgggcctcctcttgccgtccccttcctcgtcttttcccctcaggagaagtcgggaaggtggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgtgagtgcggggcggccgggcgggtgtcgggcccttcccgggaggtgggggagcgggcggcgggaccgggacccttccggggctgggaaagagccgggtgccgtgggaggcggtcgggggcggccgttgggcgccggctggcgggcgcggcgtgggaggctgcgggctggatgcgcagggcccgggcagccgggctggggatgcgttttcggttttgccgggcgagggtttacgttctgggcagccttcgtgggtgggacgtgggcggggttggggtcagggagggggcgaccggggcgagcgtccctggtctccgtcgagcctgcggccgccgccctcgctctccagctacccggggcgccgggctgtggggggtgggggaagacgctaggaggccgggggggaggtccatgcgggtcctttgtgtgccccgcctctcagcggcccgggagccgcggtgcg

SEQ ID NO: 98975 - DNA, 1595 bp, Homo sapiens
aagacctttaacgagaaattctgcttcatatgtttgaaagatcaagtacttatgagctaggtacacatggctttgaatcctgactccaagtattagttatacggtattgagaatgtcactcaatctatttgagcttgatttttctcttatatgaaacagtgaggataagatttcccttgtaagttttggatgtagatttgttttcagtattaaaaataatgtatgttaaacatctcacgtaatgcctggtatatagcaagtgccctatagatgagaagcatcaaggaagaggacatgccatgagtaagggaacagtactgtatgtgaaagatattaaataagaaatatcctaataaaaatctgtcactttggattttatggttgtaactcaaaaccggaatctaattggtttaaaaatatgaagggtttattgattgattttaaagtaaaactatacagtggcttaataatattgcctagattttcctcattcgagcatggttgtccccagctcctgggtatactgccttaattatgtcgttggtccaatactttcagaagttctgcatttccctctgattgggttagcttagatcatgccacaactggacacatgttctaacctgacttcattgtcacaaggatccccaaatagagttcccaaatctgaaatctagaattcttgggatgtagggaatgaagactagagtggcaaccatcaaatgtctactgcagaacgttggagggacaatagcttctgaagatttttttctttgacaagcaatagtgcaggaaaataatttaggaagaataatataactcttgggtttaataattatgtatctgatgtttagatgacatggtataattgaaagaatatgaattttgaagtcagattttgacaatgctactagcttcgtggcttagggcaaggtgttatgctaggccactacatgcagattggcccagatccatccttgtagcctcagtttctttatttatgttaagaagatatcatatagctcagggttgttaagaggattcaatgatacacatcgttactgtatttacttattgagcacataccgtatttgaggatagggctaagcactggagttacaaatattgaaataaggcatgctagctgccgttccttgatttacctggaaaatatgaatacatagcaaatagtatccactatcatgaattctaaattttaggatagtgacataccttctatcatttatactaatacctttttttaaaataaattgaactagcatcttgttgttaatgttactagacttggagctaatctttcttgtttcttttttttcagatgactgtcctatatgcttgaatgatgttcattcagagtgtaactgaatttagattgtaaaactttaaaatgaacttcagagttagatgcagttaaactatttgttactgaggcagaatgatgaaggcatcctaactgattggtttgtcactatctttcactgtctttctggttgtatttatggaaatccctaaaattctgaatggacacttcagacatttaaaatatagccaacagtaaaaatggccttcatgtt

SEQ ID NO: 98976 - DNA, 1056 bp, Homo sapiens
aaatattcgggactaggttttactactccccctcattttttcccccacttgaatgtgttttctaattcaaatcaaagtgatgattgtctagggaaatacaacttggatacctttaatgtatgtaaaaacgttttaaaatcagttataactttgagtacttacattaatagcatgttccttgtgacattttttacaaccttacacacgagaactattgctaaagacacctgattgaacattagaatgaaattcatgagctattcagtggggacaggaaacttatttgagttgtttgaaatacagagaattaatttttgtttgtgttagaacatactttgctcaaagacttctgactaagatagcaatctttttgattgacaccatacatgttttgtagaggtcataattataccttacttttattctggttgcttgttttaagaggaatgttaacaaactggagcatgctccaaggaatctgatcaagatggtaaggaagtttgaaactatgtattagaggaacatttgcaggaaccaaaaatgctactagcttaaagaagaaaagattagacagtgggggagctgtacacatgatcactgtcattgggtaatttaaggcattgggagaggtaatacatttatttttacgactctagggggagatgcaacaccagtgtttgtaagttatggagaaacagtgtatgttcagaaaaggaaagaggaattttccttgtaattgtcagattccaaaaattcttgtctttccatatttcttattttattttattttatttttgagatggagtctcactccatctcccaggctggagtgcagtggcgccaactcagctcactacaactttcatctgtcaggttcaggtgattctcctgcctcagcctccctggtagctgggattacaggcatgagctgcaatgaacttccttcaatatgatcagatgcatcagctactttttttttttttttaactgtttctgggtacttttataatcttctgctctggaaatgctgctgtctaggcctgctgtgcggctctc

SEQ ID NO: 98977 - DNA, 2014 bp, Homo sapiens
attttcattccagttgcttttaagatcttctctgtctttgaagtttcaccgaatcgtttctttttttttttttttttttgagacagagtctcgctcaggctagagtgcaatggcgtgatcttagctcactgcaacctccaactcccaggttcaagtgattctcctgcctaagcctcctgagtagctaggattacaggcacccgccaccatgcccagctaatttttttttttttttttttccagtagagatggggtttcaccaggttggccaggaactcctgacctcaggtgatccacctgcctcagcctcccaaagtactgggattacaggtgtgagccaccgcacccagcccaaattgtttttaaattggattttatttatccagattttgatgagctgtgctttttatatctgtagatgcatgacttttattggatctgaaaaaaatctcagtcattatcacttcagtgttaccttccagttcattaattctctctagttatgtctaatctgctctctacctgatttggtgaatttttaatttccacatttataatttttcatttctgaaaattctgatttttaaatttgcctcattctgataattacatatttcctgctcatttttactccatctttcatttaatgtttcctatatactatatttcgtaactggtaattcagatagctagtcttggagggaggtggtgttaatcttttgcatttactgactcaagctcattggtttgtttcatttttgtgcgataatttttactgcagcctcatattttattgaacttaatatttggaaatcttgatagcttaaattgaaaatgcattcctttagagagaatttgcgtgttcatgggatcctaggatcctatgtaacctgaaggtattttatttcccatccagggtcttaggtttaacttaagagagatatctgaggttgagctctctcatctcgccttggctattgttggcacttgctttctgaacaacattgcttcttgtgtataacatgggacacatttctggtttcagcttaatttttaattttttgtctttcttttctgtggggtgggggatccttagagatttccctttctgaaaagttcaatagtatgttaatagtcgtagggttttcggggggtaatttatggactatcatattgtagtagaggagccttttcagtttgccatactgttggaagtagaaattaatgagattaaatatgtaaagtgccagtctagatactgtatacatattaatttcctactgccttattaacttacattttgccaaccagttcatataagagtgctttatattatatagtttatttttggttatttgttgtggacactttccttagtctgttttctaacttaaattttaatatatattctatatggattttaaacatgtatgtttactttgttgtttattgtttcagagagagaaatatttattctgttttctgttgttctgaaaagaaagttatgcaagattgaaccttggtagagtttatatcttagtagagagccaaagaacttccatgaatttcttttgcttggtaatttacatatttattatatttagagcagtggttctcaactgcaggggttttaccctgtgggggatatttggcagtgtctggaaacatttttgattgtcactgtttgatgaagggtgctactgacatttagtgagtagagccaggaatgcagatgctgctcaacatcgtacaatgcataggacacccctccacaataaagaattatccaacccaaaatgtcaatagtgtcaaagttaagaagccttgatttagagaaatcaagataaggtgttgatgctggtgggtatcacaggatttgcgagggaaggttttccaggttttagaaaaatggaaagaaagccttagaatggaaaaccgccctccttctgttaatttctttttctaattcttcagcatagacgttcacattcataaagccaagactaaaaatcta

SEQ ID NO: 98978 - DNA, 1211 bp, Homo sapiens
gaagtcactgaagatggagcaaacagtacaaaaagaaaaagggaaacttgcaataggttgctaggaaatatactaaccttgtaaatgcttgttaaggaagacaaacataccttcttatagtataccaaagaacatcttagaaccaaaataatggacaggtatgtttggttctttacagtattaacagtatctgtgttcttaaaattttgagaggtgtgtagagggtgatgaagatacgaagtgtgggacagttggtacagctttataaccaaatctttatggatttcacgtgcaagtgttctattatcagtttatcttttttaaacctttaaatggtaaatatcacttgcatagggaatagtaccagaacgtaagtttacatttcaaaataagttgccatattctctcgtcaccttttaatagtttggaaagggccatattcagtcacataagttttggattaaaaaggctctatcatacatcttgtgcatgaatgagttcatgcctgaagatgagtatttccaaaattaaaagatcagaaagtatattggctttggcagcagccttggatctttgatccccaccagggagttttagtgagctgtggggcatgtttggttgttgtcactattggaagatgttgctggcttaagcaggcaagcaccatgaatgatgaatgacttgtaatgtgttgaacagaattaacctgcatgccatatgctatgaatgttcctccagacatttatatgtgggaaacatctgtgtatggtcttctgcatatataatttaattctgtcttaatacttgcattgtagttgaacatcctattgccaaagaaagtcatgctccaagcccagaatcagagtgagaggggctaccaagttacagggcaaagggcatggatacaatcacacaactgatggcaatacgaattgtattttagtcatcaataaagtatatctgtattggtagctgtggtaagcaaataatgttattactatttatagatatgcatagagaccatacttacagagtagatcattagtttctacagatgtggtttacaaatttcttgactattactttagtgtttatagacttctacagtgtgtttggtggaggagatatgtatatcattaagttacagcacataatatgccagatgctagtaaaatatttcgcattggagcactttgtatttatttgctgaa

SEQ ID NO: 98979 - DNA, 1072 bp, Homo sapiens
aaaaagagaatttctattgtgcatacatttgagggctgttaaggaagttgctttcactcatacaccaggtattaagtgcttactgtgtgtcaggtaccaagcatacaaatagtgttgaatcagagaggaggttcctgcctcatgacatagcatttaaaaattatgagataaaggtagtgaaaataatgtgagagtgcgtatctgcgatttggtagagggattattgtccctttggattgggtggttagggaagactttctgaggaggccagtaggctggaaagagtttagaaattagtttggagggctaatcaggggtcacattctgttaagcctaataggctgtgatgaagaatttgatttttacgttaaggaagctgttataaggtagtttgtgcttaaataaattacttttaaagaaaccctaggacaaaataaacaagtcggatttcatatcgcctaagtctgatactaccttacctgtccatttatgtggctggttcacaaaggcactatgcctcagagatctcacatacagcttgtgtgtgcctatttttagttactcagttgcataagttctaattcttgctagcacattttataaaaccaaatgttaagatagagtatactgtaaagttcctaaaaaagatgtatgtaaatgcaaaaccatcagtttctcttgtataaagcacatgtggatagtgtttttgtttgtgcaggcatcattcagtttatgtattgtttagatatgtgtcagtcagaaatactaatcagctggtggtctagcaatacagtcaaagtaatgtaggctggatccgtgtaggaaatgttaataatgtacttaataatgtacttgtttttccagtattttacttgagtcatggcatatatttgagattatttctctgagtatggactttttctccctcgtttattccttttagggcaaaataatatgttggtaatagaattttgtataggtccacggtacctgtttagagagcttctaatggtatttactgtttgttaatatttatttttgttcagtttttctacttccaaaaagtggatat

SEQ ID NO: 98980 - DNA, 1282 bp, Homo sapiens
ctgtgattatatcttacatacaaaaggaggcaggattacctagaggattactccatctctactaatagagaaaggacaaaaaagaaagtatgaaatctagttggatgtatgtagattggcttagtgaaaaaagattctctaaattccagatcctctgtcctttccttattcttttatctttctatatagaggttataagcagagtcatgccatgtggtttattctttttatcctttttatgaaaataaggttttctccaaataaaggtgaatatccatttcaacaagtttccactccaatttgctgtccccctcaaggattactgatataatactgattcttacctttccttttatatatgagtaattgggaatgagtatggaggtttcctatttttggtattcataactgagtttgttaaattgctagccctgtatatatttattatcatgagttggctgctgtgctggatagctgctatctgcacttctcactccagtcttttccctgctctggctccaagcagctggtctgtctggatatacaaatgggcttcttgtccctgctttctagttgggttcagctggtggggaacattttcagctgattgaaggaaaggaggagagagaggttaggatttttacttttcatgacttcttcctgtgggatttctgtagcctggccgcatccttccattgaagtttccagttcctatcaggcagctgacatttttctttcttcccctgctttactgccaatgggtagtgatatgccctgctgttactaaccctgggatataacactctcacttgtgatttccttacaacccacctatgcttcgtaacagtctccttattaaacttccttcaaattatccaaattgactgtgccatccatttctatagtaactgactgataaaatatgctttaacatgttttagattctgtcagtgtctgttatgattccaattatagagtggattaggactaagggaaaaaattatcaattttatgaatttattctgttgtctggtgtgattttatttttagttcttccataatatctggctttgagtattgccagtttattgaacacttaatatggcacagcccattatttgaagcattatggggaatccaaaagtaaatgagacacatgctccgtgattctactactaggcagtttggaatgagtttcctgtgagagctacaaaatgctagaagttcagaggagggagagtgctctgtcaagaccactatgattgtgtctgcagcaggaatg

SEQ ID NO: 98981 - DNA, 1052 bp, Homo sapiens
atcatgaaaccactaccacaataacaagatagcatatattttcattgtgcaaccctttgtaatgaatccactgatctgcttttcatcgctgtagactggtttacattaaaaatttaaatgaatggaaatatgcagtatatacgttttggtgggggggtgcacatgtttctttcagcataatcttgaggtttattcatgtttcttgtattaatggttttctccttttaattgctgaataatgttcttctttggatattctcccatttgtttattcacttgtttatgaacaattgggtgatttccagtttggggttattatcagtaaagctgctacaaatatttatgtacagtctgagtgtggaaaagtgcttttatttttcttgaataaatacctagaagtagaatggctacatcatatgctaggtctatgtttaactcttgagaaactgccaaatgttttccaaagtgcttacaccattttacattctaaagaattccggttgttccacattgttaccaacacatgatgcagtcacactttgttttcggcttttctagtagtatatgcatgtctgtcttgtggagtctcagtgtctttttttttttttttttttttttaaagacagagttttgctcttgtcgcccaggctggagtgcaatgacatgatcttggctcactgcaacctccccttcctgggttcaagccattcttctgactcagcctcctgagtagctgggattacaggcatgcaccactacgcctggctaatttttttgtatttttagtagagatggggtttcaccattttggccagtctagtcccgaactcctgacctcaggtgatccgcctgcacccggcctcagtgtcattttaatttgcattttatgcatgactaatgatagtgggctgctgatatctttggtgaagtgtttgttcagaccttttgcccccgctttaaacaagtgttggctgggcatggtggctcgcgcctgtaatcccagcactttgggaggctgaggcgggcagatcgcttgagctcatgagttcgag

SEQ ID NO: 98982 - DNA, 1076 bp, Homo sapiens
atggtgagtgaagagtttgtatgtagaataaagcctccccaaatcacatattaactatgggtaaggttagtctgacacaatgaaggataaaagacagacagtgagaactagataggtatataattcattatcccttggctttttgttggtttggtttctgaaaacctttacttctactttatcttaactcatctgttcctggcagcaggctttttgttgtaataattaccaggaaagttagggattcttccttctaatcattccctatctctgttagcttctttaaatatgttttgccctacaaagcctccgttcttaaaaatcattaatttagcaagtatttactgagtcatatctttttttaatttattgagtttcatcttctgtatactaggcactatgctaaagctctggtgtagtaatccatctacttaattgtctgttgtagcctttgctcaaaatattttttcttttgacctaagaaatcagtttactttctggttaagaagggagcatttacttttccctaactaaatctatcagatgttaatttttaaaaattaattccaacaggttgtacatatagctagtaagccccttgctatggaatagggactatatctataaagctagtgttcagctactgagggttcttcatttttagctatatgagcacaatttaagttactaagactcattaactatgaacttttggttatttctttaatagtattgcatagtggatactttcatcttgggaggttaacaagatggggcagagagtcaaaatagagggaataaataatggggaagtaacgagcttcttgtttgcttgaggaactctgtttcaacccaagagaatctgttcagagcctgttttggtcctgagggaacatttgttgtggtttacagcagaggtctttaccttcattcaggagcacattagctctgacttgcatgctctatcaaaatttgtattcttactactttccaaaatagactacatttttcttttttttttggagactgagttttgcttttgtcacctaggctggagtgcaatggtgcgatctcgg

SEQ ID NO: 98983 - DNA, 1006 bp, Homo sapiens
attactttgccaggtgagtcttttgaaccaataactatcatttgattttatcctttgataagacttggctatactgaagaatttgtattagtagtatgctaaattatgggaaaatataacttcttgtattcattctcatacatcttttatctctcccatttacttgaaagcagttgtttgtgattattatgtagtttagtgacagtgaacacttagttaacacgtataccaggaattgttctcagtgctttacaaatgttaacttgtttaaacctaggcaactctgcctctccattttataaatgaaaaaaatggaagcacaaagagttgaagtattaatagtttgcccaaggtttcacagccatttagtggtagagctgggatttgaactcttgtctctggaacaggtgctcttaagcatggttttccttctttcctcacctacttcatatggggaataagaaggagggtaggacaaaacccagaattacaaagagcaaaagctctcacataatcccacacctagaggtcaggattgcctatgtttggacattattatatccttgctacctctcctttcttgactcgcctcctcacataaatcatgtgtttatatgactggaatcaaatctgaaagacctgtgaagtttcctctttccatgtcaaagcagagtagctatgagtattgtattatcgtaaattttttttccttgatagatgttgggtttgtttcccagtttttgtgaaattataaagagaggactgtggttaacatccatgtgtacatgcatctgtatacacttaccaattcttaaggatgtttctggaagtggcacttctggtgcacaaagcacacctatttatatattttagtaggtagcaataaaaaattgtaaagttcacacttagctcataggtgaataaaaccttaatttgcatttttgtcaggttaaaagtgttttcatttttgtgtctcctgtcttctgtgaattgcttcttttgttca

SEQ ID NO: 98984 - DNA, 1112 bp, Homo sapiens
gttccaatggtttgttatacattaagaaattgttggttaagtggttgaaatgtatatatacttgttctttttgctattgctaatatgagtttctttgacttctctgcaactttgtaaaggtgagttatacaggaatgttgctatagctatatatatgtgtgtgtgtgtatacatgtatatatcatgtgttatacaatttgtaaaacatgaatctatggtgaccatcagagttagaatgtatagtctctttgatacacttttctaggaagggatttctttagtagtagagttttcccacatgtgtgattgtgaagcatgttgatcattgaaacacaagggactttgcattataccttattcttaaaaatgaacaaaatggaatattttcataagttgctacctaaagtttgtcttctacactttattatagttgatggggctgtgacagatctgttactgtgtggcattgcagcctctatcctatacaagaatggttcagaggcgtagtactgtggattaaatcctgccctttttgatgacacatactaagacatttagataaatttctctgttttcacaaaagattgagtgaaaaatgagaaaggttaactcagcatactgtaactcttcgtatgtataagtgtgttttaagtttgcagatagttttgtataaagattttgcagatccgactggaatatctttatagttaatatgtggtttgtagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcaggtaagtgttttttcccaacagcttttgctggggatgcatataaaacaccaagaaacatcaattctttatcacactttgaggatcagtaaacattttttgttgaaaatgttttgtcacttgtaactgttgagctgtaatatgtaaccatataattgtgttgctttttaatcacagaagagattatatttaatgtcggttggcatgacctctttccgtggaaaaatggggaaagg

SEQ ID NO: 98985 - DNA, 4854 bp, Homo sapiens
atttgctgagggctgctagtttgcgtcctatgatctatcttcctgtctcatgaatatgtgtttttctttgaagaggaatgacaactattagcaagactcaggctcattaatttggggtcttaagttccacactaagttgactcctttgtactttttgaaatacgattattcaagaaacagctttaccattgtgttacattctgcttagcttggatttctttgtacagagattgcctgagtgtccagacagtaatttttgtattactgaatttattagtgttgaatttgcaaagttgtgttttccaaagtttcattctgcagcacttataatcgattgttgaagatagtgaatagatcagtacctagaagtaaaaatggatacaagtactacaaagtcctgtcttgcctatttaataggtattctattaatgtttggggctctgaattatatgctataatttctatgctagcattcattgtttcttaaattttaatgagtttaaaattgcaggcttctaatagaatatgaatatcttcaatttatttggtgatcttgtcctttttttaaatttttatatatgaccatggtgagacatttgtaaacttaaaaaaagctctattaattaaaccatttttgtattattattttaagtatttcagttattattcagattcacatagttgattaccatttttaatcagtgaatttttccaggatgttttctacatctttgtctgctttcctataactcagtactgtaactcagtactctgaaatagtttcctttgttaatagagtcacttttatagtactgtgcttgaggtcatatacagagtattgtgtccaaatttatcattgcacaaagtgtttttggaaattcttggttactccttagtaaattacctgtaattgggttacatgctggtagggtttaaaatctgattgctaagtgaattctctataaagtgagttttgatacatagaaacttttcatataattcttaaactcatgtgtcatgtattttcatttatagttttcatattcattaacatatgttgttccttaccatttacagctcagaattctgcaaatgcagattttgcaaactttgatgcatttggacagtctagtggttcgagtaattttggaggtttccccacagcaagtcactctccttttcagccccaaactacaggtagagcttctccagcattgtgcttaaatgtttactttacaaaacaaaactctctaaatgtagttttgaaaaattagtctaaacttaaattctgtaattatctgactttaaaatggttctatcttcaaaagctctggggaaacctgaactctttatttttttctatgttcatttgtttttctgcattatttggtatattgtctgtttgacaacatccattctcctccttttcctgcgcatgaatcttccttatatctaccatgcacacaggacagaggcatgacactactataagtatttctctctctctgtctctttttttttttttttggcaatcctcctgcctcaggatggaatacaggcacatgccaccactcccagctaaattttttttttttttttggtagcagctgggtctcactatgttgcccaggctggtcttgaactcctggcctcaagttatcctcctgccttgacctcccacagtgctgggattacaggtgtgagccactgtgcccagccagtactataagttttttaaggttcatagaatccattgatttaggctgacattatacctcttaataaaggaagctggttgcttctgtagagctaaaaatgtaagtaattttcggggcaacaagcctgagaaaaatttttatatgtttattagacaagagtagattaatgatcacttcagtcaaacttggaaatagttttctgtgcaggaattggtgtttaaacattgaatactctttccataaattgtgctgttttcgtaaactcatggaacccttatttagatttttggctgattacttttctttcaacttttaactctgtgtattgtcttaaagccttttctttcaattttcttttttgttttttctttaactttcatcatttacataatttctggctgtccagcatttagaatgctttcatctagctgcagttttggtgaatttacttcagcttttcctcttcaggctacccacagtaagttctgttgtcaagtaggcatcttatactaatttgtatatttttgctatacttcaagggtttttccagttatagattgttaataattctttagtgataatccttcataaaaatctcttccaactctatttattaaactcagagttagagaacacaatagtagacaatcaaagagttacttggtttaataataatttgaaataatattctttatataaattttgaaagtttagtatgtactttgtttgccagctccttgtaacaggtcacaatattttacatacaaacatatattacttacctttaattgaaaccaccatgatttaactcttgaaagaaatttgatcagtgtatattttttttagaatgtataaaaacctgcttgatagaaagtgttcgtgtttttttaatagaagttcatgcattctgttttaaaattatctgtagttgtcttttctatcactttaatatataactgtgtatatatactgttttgatttctgaaactaaagtttagaaataaagaactaatatcccaaaaatgtaggatcaaaagcatagaatgaaatatactggttttagtcttttgatagtactttaaggaggtctctataatagagaacagattttaaagatgtaacaggatatatataatagtggccattaggtgaattgtggtttataaagtcaaaaattgctataatgtattatgtactgtaattttaatgccttgaactatatggtacggcatgattttacagtggacatcttgatattgtatacacattaaactattatgtggaattaaatagtagctcttcaagtgaagtaagtataaatgtcaacgaccatcttttaaggaattttggatcaccgtaacacattttacacattgttaatcgctacccctgggattgtttaaactgtttcgtcatggagccacaaaagtttgaaatcctcctagtaagatactttgcatcttgtttgcagtctgttcagggagaactagtgaaaggctgtagtatatttggactagaaagtaactgaatctcaaaccaggtagtgtggagatacccctccatgaattacattcttcattccagggtaggtaatacacagaaacatgttactttacctgttgccaaggcctttgaaaaatctacttttacaaaattggaaaacgtcacttgtagtcaaaagccattgccagtcattgattttaatgttgtaagattgcttataggacatttaatttaggaagaaatgatcatacagtctatgagagggtactaggaaaagcttagaaatttcaagtgctctgtttattctgttacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtatcaagctttaagcaaaacaaatacaaatttgtgttaaacagtgctcttaatttggttgtatttattaaaatctgaacatgctacacttttctcagttgttgtatagaaattttgtctgcactgtcattttgagtaaaatgttcacttgacacattttagacctgaaatatcaactacaaaactgaagacatagggactgatttgtaaactttcagtcttactagttgagaaaaattttattttgtcctagaaggcgtgctttacttttctttggctataaagagccaagaaaccccattggcagagctgaatggaggattatttggtggtttctgtaatatatttacttcgaacaattttccgttaacatcttggtgggttttttatatttaaaaaaaaaaattcatgaattttacagtatagtcttgtatccagttttatcttaaggctagtagcctctacaaatgcatgtggcactggtgaatagcaggtgtgtgttgctaaatggaattctccattctgatctctgggcctgttttcctcctctccaaaatgaggataattctaagcattaaactcatggagttgtgttctaagtattattgcatgttaaggcatatagaacagtgcctagcacatagtaagtcctcaataaatgtttcccgttattaccatctctaatttttttgtggagaatgctggggaaatgatgctattgatagactgttcacattaggtctagcattatatgaatttatatgttcatgtgaacaagatccacccgtcttggagatgttaacgtaagagcacttgagagtttctttcttatgcataatccagacaaatttttttggtacagagtgttaatttttgttaagagacatattctgtctttatcacagtggtatgtataacaactaatcctgtccagtatggtccaggttatttattagattaatgatttggaatcctgcttaactctaaatccattttaagtttacctgtgtttcatggcaaatgtggttgataagttgaaagtgtaactttaaatttttggtgtaacttgattttgttcgttcccaggtggtgatcagggaagtggcttt

SEQ ID NO: 98986 - DNA, 1064 bp, Homo sapiens
tagtttttagtcatgatgattaaacagtgaaagtcccatattataggcttagttgtaaatacagatttttagaagtgtttgcaccaaagcccaaaatcaattctgtatctcttcagtgtcatcctcatatttacaaataagcacatctgctgttatgttcatatatatctgttagaattcttggcagtaggaagtctaacacattttaggacattacacttgtaaaaaacttttctagtctttattttagagttgcggaaatagtctcagaaatacaagagatttacctataacaatgttttattcatctctgttttccaatcctgtggattgtatttactaatttctttagttatcctggtagcttattttcctttagcatcttttctagaaagaaatgttaggattgtaacacttccggaaacataaagtctggaaacatactttatatataatacatgatttattgatattacattacagtacatcaggggttcacaaactgtggtccatggaatgtttggggtacctgagaccctttcatggggtctgtgaggttaaaactttctttataataattctgagagattgtttaccttttcattaattgatatttgcattgatggtgtgaaaacaatggcaagtaaaacttgctggtgtctttttatttttttttaatactttaagttctagggtacatgtgcacaacgtgcaggtttgttacataggtatacatgtgccatgttggtttgctgcacccatcaactcatcatttacattaggtatttctcctaatgctatccctcccccagccccccacccccgacaggcccccaagtgtgatgtttcccaccctgtgtccatgtgttgttcttgttgttcaactcacacctatgagtgaaaacatgcagtgtttggttttctgtccttgtgatatagtttgcttagaataatggtttttgctggtgttttaacatgaatattaagatagtggcaccaaactgtactagtcgttacaatagtcatattccttcccactacacattcagttttacttgtatttt

SEQ ID NO: 98987 - DNA, 1086 bp, Homo sapiens
atacactggtttttacaaagaacccaaatatatattgtgtagcattttcttaggagtcaaagcaatgatttgttatcagaatccttgagttttctgtcttgataaatatagtgaaataatttaaatcttaaatacaaaatgtattaggattttatagtgtattttataattttttaaagctacgccttccacaaatccatttgttgctgctgctggtccttctgtggcatcttctacaaacccatttcagaccaatgccagaggagcaacaggtaagaaaaagagacagtggaacagtaagttttggggaagacatttatcaacaaagacaccatgtgaagaacaccagaaaatggggcctctttcttagtgaagtgaatggcaatggatagaagagtttgtccataaagacaaattctagctgaaagttcataaaatcctggaatttaacagttgagagggaccttagaaattatctagtgtctgccctttccagttaaagctttcatttttcaggtagggaagcccagacatggagatgagactccacagaacgtttatgacagagataggacttgaacagagcaatttagatgtatttggtggtctggtttcagaattactggttgtcactcatgcagtcttaatggaaccattttatgagaagtttttattttccctatgagattgcatcagatgactttactacatgaattcttaattattaggtctttttctagtgaatatctctttcaggtgttaacattttttaagttgtggaaacttgattcagtcgtgggtataatactgaatattttctcttttgataattttttcccttaattctctttgttgtctccattttattttttgattcatactgtaagccattcacatctttctcatgttatacctctgatttttgtcgtattaccttaaacaccagagatatttgccagtatcttggaatgtcagcaggtgcatttggtatggctgggtatccattaaatctagagtttgtatgctttgtttttgtgtatatgtcacaataatttagaactaaagcctaaactccagttatagcaa

SEQ ID NO: 98988 - DNA, 1056 bp, Homo sapiens
ttaagttagcaagaaagttacattcattgagtatttattgcaaagcactctaattcgttgttacatttattcttcacagcagctttgtgaagtatagatactattgtctctatccctccacctcatttgcaaatgaggaaactgaagcttataaaataaagtaacatcatgcagccagaaaatgacagaaccacaactcagaaccattcaattttttaatcattcttatgccaatttaaaaagtattctaattttaaatccatggaaatatattttagacacaatcttcagattgttaaaccgaacaaacaaaaggtactagtatttaacaatttaagtttactttctattaactttatatgtaacctgtctgtcctcaaacatgccaggtgagtaagatctgtacaagatgcctttttcttttttctctcttcttttcagccattgtattttaacctgtaaataccgcttacctttctcttgaactagaatatttaataatttttcccttgtaatacttaattagttcatttgagttatttgtgtatttctagttaatgtgctgatttgtaaataaaacaatctagcattgttcatgcactctctcccaagacttggttttgatcctaaatgtagatgctggataatctcatatgatcctatgaatagcgtatttagatgtagcttatgatgcctacaaagcattttttaatgactgtaaaaaagttgatgcctatttgtttaaaaaattgatttcatcactgtttcttaatttgttatttattattctaatctcccctttattttaaacagtataaatattacaggtcatgaagatggttgaaattaaaagtcttattttgtgaatgtgtttttgttatgtattatgctacccccttagcaacagtacactcgaattttataactttttaatgaaacaagtatacttttattttaacaatagttatctataaattaattgacgttggtctctttatggctttccataaggcctttctggagcaatgcattctcaagtgtttcctcacgctcatt

SEQ ID NO: 98989 - DNA, 1111 bp, Homo sapiens
taataggaaaatatccttttaattgtgttagtgttgttaagagaatctctcttctctggctgtagttacaaagctgcataggttctgagtggtctgcctgtaactaactatttgtcctataagtcctgttctttttagcgaactattcttcagcggtttaaaatttttttttgcaggaacacatattatgttatgacagatacttcaggagataaaattttggctgttattttactgcatataacaaaacaaaactaaaaacaaaaatgtatactagtatacatattaattgcatgatctttaaaacacaagactactgtttagacttgaatttataatttgagaaattgtcttgggatttcaaacaacagctttagtagttagtttcattctggtcattgtgttttagaagaataaaatttctacaagttacgttaaactgtgtagcactaaaactcattaactttgttggaattttggaattaaccctgcctttaatgtacatcttagtatttttcaaggtaaatgatgtctttttacatttacaatgttgtgagaaactaaacatatcctgttgtatgtaactgatcagcccttctcttctgtcagcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggtaagatctaacatttggcgagctgtaagttcattttatgtatcctttttatatcataatgttgtgtgcttgggcaggaagacttttctaaagaatactatagtattatctactgagtgtttacacaaaaataaaagcctttggtgatttggacctcagaaagctaagtgattttacaagtttttgtgagcaggttacaatttatgggaaatcagtgactatgtaaagagcatcccgtcattctcagaatttctattgcctttttctgattatttcgtcttacatgttctaatatacctcttgattttaaaaggagaatttatagacctagaatgttgggatt

SEQ ID NO: 98990 - DNA, 5412 bp, Homo sapiens
attaactcgacatttttacgtatttcatttgcttcagtttgaagtgcatagatttgaagattcttgaatcacaactatgtggtttcttttttctttttttttttttttaagtaagtggttatttaaaaatctgaaatatgggctgggcgtggtggcttacgcctgtaatcccagcactttgggaggctgaagtgggcggatcatctgagctcgggagttcaggaccagcctgaccaacatagagaaaccccgtctctactaaaaatacaaaattagccaggcgtggtggcacatgcctgtaatcccagctgttcaggaaggccgaggcaggagaattgcttgaacccgggaggcggaggttgtggtgagccgagatcgccattgcactccagcttgggtgacaagagtgaaattccatctcaaaaaaaaaaaaaaaaaaaaatctgaaatatggaccctggaagagccataaataataaaaatatttcctacaaaatactgtgatgtttacatagaaatcattgtgttgtctgcacagcctgttccaaatagtcacaagctcgtctagtaatgaaattctataaattttagttattgagacaagttagaatgaaagagctgaatgaaagttctcttggccaggtgtgatggctcacgcctataatcccagccctttgggaggccaagacaggtggatcagtcgagtccaggagattgagaccagcctgggcaatgtagtgaaaccctgtctacaaaaaatacaaaaattagctgggcgtgctggcgtgtgcctgtagttccagctactcgggaaactgaggtggaaggatcacctgagccctggaggttgaggctgcagtgagccatgatcatgctactggactctggcctgggtaatagagtgagatcatgtctcaaaaaaaaaaaaaaaaaggttattttaagacatgctacagtaagtttgtctttggtatctgaaagagcttgaggcctaacaacttaactttaacattttatttttgctgctctggtaggaatgtctctgaaagttattatgaggctttataagcatcagattgtctcttgaaggtatgggttataattggtggttctattttaacaaggtgcaggttttgcagcatttggacaaacaaagccagtagtaaccccttttggtcaagttgcagctgctggagtatctagtaatccttttatggtaagcaaaatttaaaattaaatactttataagttgttaaatcttattttaaaattaggaatagcaggatgttaatattcctagatggtatttggtgttatattgatatgagtgacatcataagattgtacaaattgacacagagccattatgtgtgatccttttctgaccttttaaaaaattagttgcaaatcaaagcattgatagtttttaaaaaattagttgcaaatcaaagcattgacagtagatcagctattttataatatgaaacttatctgctttcttgtcaaaataacactttatgagaggccctaggaattagtgaacataaaagagaggtcttaagagtcagaagttttgtttgaatcacacgtgcttttctaagaccattctaagattcttcttagaatctattacaagaactgtttgaagtactggatatgaaagacgtagcacagttcatgacacatagtagtttgatatagcttattgccaataacaaatattattgccaataatttaaaaaataattcttaaccaaaaagtctaattaaaaaaattaaattcagtttaatgtttttatattttgtacatgcactacttttgtctctttatttatttgtcttatgttttcctttagactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattctagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaacatgtttatttatttaagtataacagtaataaactaataacttgctaacataaataccatttttgataaaaataacttttccaaaacaaaaactaatgagaacaggaacattgttttacattttatgcatttaaatctggcttaataaaagcagtgagattttcatgctgcttttgcattccaacttaaaaattacacagcatacacacgctggaaaactccactgtgcacttgtgagatcaggagaatgaaaactatgtaatatctcagtagtacaatgaaaatagtttgacttttcacagcctttcaaagaaagggttgtagggaccattaagggtctccagactctttgagaaccactatactttaaatttgtgtatttctagaacagtatttacttgca

SEQ ID NO: 98991 - DNA, 1034 bp, Homo sapiens
tacaatccctgcagtggacctatacttttaggatgaaagaagcaaagcatagagaggttaagctagtggcagctttttgctctggggaacagatttggattaaatgctatcacatttatatatgaatgcattctttcttaatattttgaaattctgaacaagttaacgttcttgtcttgtatatctaaaaaaactttaatcacttgaattcctttcataatttgatgaaatcagtacagtttattcttggtttttttttttaactttagaagtaaattaatatggtaactagtggagcgtgctttagattgaagactcatctgaagtatcacagactcctattttgtaaagcattccacctttattgatacagtttgtggcctatacacttttaaaatttattttttaaaaggtgatattaaaatttgtatttaacctgttgtattcatcctcattagttaagtttttctttttatgttttaaaacttagtgacattaaacttttcacgtggttgtttgtgaacagatgaatatataaccacgatgtaatccagtgttgtgctgctgaatgtttaacaaccatctttcatgaaagaaaaaaggccctgttttgtagcatttactaatatttatggtataaatactgtcttcatggtgattttacctgccaatctgatgtcattaaatgcagtttgatgaaagagatagccaaccagtggctttcccaagccttggcaaaccagcttcagcacagcaaaggacatacaattccacaactcattaattaaatgtattggtcatttgatgattatatccagtatttggagagcttttatattgttaattcatttagcaagcatttgaacacttgtttatttttagagatatactgggcactgaggtatttaatctgcaaagacccaagtatcgtgaaccttggttttaaaaagtccaattattgtgctcttataggggttgcacattcaaggcttacactgaattctgtctgcagttctgttttgtgtgaccagcac

SEQ ID NO: 98992 - DNA, 1767 bp, Homo sapiens
ttgactatatgatcattaactaaaggcagcaagggattgtaaactaatcttacatagtcaatgtttcatagaatgctttggttacaatcaggttttttaaagactttaaaggttttttgtatgctataatatatgcttatgatttctaaaaattatgcagtatacacaaagggcataaagtcaaaaagtgtgtctccctctgtgactttattctcataccccagaggcatataatttcttgtattcttgtgtagtctttaagaaatgttatcgtttattttatatatggctctctctctgtatgcctcttcctgttcttattttaaatgttcaagtttgtgacttggttcttgtttaacttggttgtctttccatattgccaccttccagctctaacattaatgtctccaggattccattatatggatgtccctttgggagaacatttgtttatagacttttctactaaaaatattgttataatgataatatccttatgcatatatgaagattactcttgattctgcctgactggaaactttattaataaagtagacattattctattttgaggctcaccagctgtgtaggtatgatcttgtgcttccatttaagaaattcttccatttaaagaagaaaaaaaatctctctgactatctgaagatatatgaaaaagcctatgcttttaaattaaactgttaagacagtccattgaaagattgtggaagttcacatctattttgcaccttaattttttcattgtccctactcatgactctaaaaagtgcatggcttggggctatactttgttttgcagtttgttggtatcgtgcctttccttatctacattagcttagactataccttatttttaagaagagaaagtggaaattaactgtggcaaaacctattttggcacaaccacatttgttcattatacaaaattagcttcctatgctttagaaaaaatgtgagttattactctgaaagttgtgattctgattcctcatggtttggagctcagaaatttcttaacatgtctttgctgttagtcaagcacaggatttgttttctgcaaaagtttattttcaatgaagaatacttgtcctaatagctcataaaaagtacctttgcactttaaatcctaggaatagggaacaaggaaacttactgggaagttcaaaagaaagaataacaggaccttctagtcagcagggcatgtttggaaaatgttaatacgccatgatttttgaagaccaattttagttcaggaggtggttttaaatattggatgaaaacttacaggctgttttcaatattcatttctgaaatactttagtatgatagataaatttggttaagttcttgttcattgtgaaatactgttggaagaatttttttcaaaataaagacttctgaatttgtgtaccatttgggaatagcctctttcatttaaatgagtgtcaaatctggaaaattggaagaatatttgttcctttcatcactcacattatgcatttctgtaaagcagctcatgcatttacttccagcttaacgtgttttccattaattaataagttttgccatttttttctgtatttttcaattaaaaagtcttcatttttaaaaagcaggatctatttgttacttaatttgcaatatttttttttcaaagatggatttttttttttctggagtacacattgatggaagttggttttaagaaagcattgtaatgggaatttacctaccttactactgttgaag

SEQ ID NO: 98993 - DNA, 1053 bp, Homo sapiens
gctgccggtggtaattatggcctcccacacagtgttcccacagtctaatgaacaattacagagctggttatttctgggcaaaagtgctcagcctcatatcccatggctctcattgagaaatatttgatgaagattttggtaccacctgctggctcctagtgggttggcaatgttgcccagacacctgcattttatgttcccttaaatggctcttagtttctaattctttattccattttgtgtcagaataactcagagggaaaagaatatccattaacgtcctccttgaaaaatagtcaaaagccattttgaagaccttgggtcccaggaaagagtgtgtctctttgttcttgctttggtcttgctggcaaaacattttaccccaggatcaagaggctggtggttgaactgaacaaaggagctccaggctggtcacaggatgggcatcatttgccagtgctggcttggtgggaggcaactggcggacaagtctctctggagggtgagtttccagactattgaaaacctattgaggcagttaaatggagggcattatgaagtatccacgtagattagacattttaggcacttcattgcgaaggttttcttttcattgcccacatatttggcctggtttttgtttggttttgtaactcagttttgcttgtatctaattatagtttttttgggtaacaagcaataaaaattacagtaacaacaaatactctaaatgaattggggaatcaacttaatggttttcttttttttttaagcatcagcatgatcttatgatagcaggaattataagaaggagtatctgctttcaagatgactttattattgagtttccatcacccgttatgttgacctactggaaccttggtagactcccagaggtcacttagacatcggttttgaaaactattgattttattttgaatgaaattcattgtattgttattatgagccctgcttttctctgatgttttagacactgtgcctttttttaagaaagttttaactcaaaatattcctgtaagattcaattgtgct

SEQ ID NO: 98994 - DNA, 1064 bp, Homo sapiens
gacctctggaggccctgagcttattaagatactcctcctttttccaactgcatatctgtgtcaggctggatttttactccagccaaaacactgtaggataatagattcatcaaagaaggagaatgagaatccagctgtctttgatcaagacagacattaaagagattggcaaaaatataaaataatggccactgtactcattaattcttttttattttggaaaatggagttttttttccaaaatgtattatgtatgtgatcatgtaatgggcttatattatttaaaaatgaattaataaactttttaaaagtctcagtgttaatttagaatgcaataagtatctatagatttaagccatataacaaggacaatttggagttctcaatactttttaggagcatagggatcccgagagtaataagtttgagaaccactgctccaacctttctcttctctttggtcaatgtgtgaatgtgcttttccaaatccaccgttaaaatctgaacgtaggacgtcctgggactccacacctgagaagtaaatgaaagccttgctttccagactgaaaggaagttcggggcggggtgaggggtgcggagtgcggtactccccctcccacttagagagtcacagagcacgtgacaaaggcaagccactgaggacagagtcaaaaagcctgtctggctttatttaaattcattatttctcaaaaatagtcaaaccttttttgtgtgttgccttttaatgtcctgtggaacgaatcttctaccaaatgtgttttgggaagcctgacattgattagtccccttcgtcctgagttctgaggagcattgcaaggccagatgagggcatctctggggacagtggagcttcctggggcctctggacccttactttggggttgccttgctgccagctctgtcattaaggtgggacctacaaagtgtgactcatgcgagaagaattcattaggaggaagaaacccgaggaccagaaggtactgaagccggatctgagggctgtgggcttctctaatgaggctgatcttgataattccctaaat

SEQ ID NO: 98995 - DNA, 1098 bp, Homo sapiens
gaaaccatcaatgacagatatatctctctggctcatctattcaagactggctgtatttgaaaatagggataggtccttggctgaatattcccactggatggaacagaggttaatttagctgaactgaagataaatgacttaatgagatgaaaggtgcctaatagggacataaacaggaggtttccctgtggaaactgaaataaacaataacaaggaagtggtcatgtgtcttccctctcctctccccagagttggtacataagggcctcccccagcagaaggaggcatcagacctcctcacctctcctgagtcctcctcacttcacctgagtcctctctactgacaccatgggttgctgtggttgtggaggttgtggtggctgcggtggccgctgtggtggctgcggtggtggctgtggtggtggctgtggtggtggctgcggtggtggctgtggtggtggctgtggtggtggctgcggtggtggctgcggtggtggctgtggtggtagctgtggcagctgcaccacctgcaggtgctaccgggtgggctgctgctccagctgctgcccctgctgccgtggctgctgtggaggctgctgcagcactcccgtgatctgttgctgccgccgcacctgccactcatgtggctgtggctgtgggaagggctgttgccagcagaaatgctgctgccagaagcaatgctgctgctaggtggccggcctggttccacccctgcccaggagctgtgggaaccctcactgtctcctgctggcaaggctctgcttaaccccattctgtctaatcctttttctaacctatctgtcaccagcagatccccttggcttctgcctcatgtgccttgtgctttgtccttctgggatcttcctttgcccacacacggcaccaacttgcccagaccacacaatgtgaaacaaacgggcaaccgagcagccggtgataaccagataaagtcagagccaaccaggaaacttagtactttattattttgtaatgttcaatctttcctaaatagtcagtcctggatttcaccatttttctgttcactgtctgtgtgcaatcttttccattgcttttgtc

SEQ ID NO: 98996 - DNA, 1104 bp, Homo sapiens
tatacaaagttactattaattgacattgacctatttccagaaatatgattttagatatcattcaaatttcatgaccagtaaaggctgctgctataatgtcctaactgaaagatgatcatttgttagttgccttaaaataatgaatacatttccaaaatggtctctaacatttccttgtagtaccaaatacttcttacctctttgccctgccctccccacaaaaactacttcttttttcaaaagaaagtcagccatatctccattgtgcctaagtcatgtttcttgatacatgtaattctaccaaggtcttcttaaaagttcttttaaacaattgaatattatcttcagattattaaagaccaatcctaatgtggaccttaggatacagttttgagtagagttgataaaaatcaattaaaatagtctctttaaatggaaagaaagcctctttaaggggaggaaacagagggctgaaggaatggaagttcatctgcatgtatgcagggagactgggtaggaaagaggaagcaaatgggagagagaggttggaaaacataaaatgggttacttgatggtgattaggtgggtgtagagaagaaagttaaaaggctaaatggaagggtaagtttccgtcatctatagaaagctatatgagacaaggactccaatttttttcccaaaggtgttgtaaaaagaatgaagtctccttataaaaaaaaaattatacctcaatgtccccaacaagactgcttaataaattatgtttcctccaagctatgcaattcttttaactgttgtagaagagaaaatgttcacaatatatttagttgtaaaccaaatgataaaactacatattgtaaagccaacttttaaaatacattgtatatatgcgtatgcacagtaaaaatggaaaatatattgacctaaaggcattgaattactatatactactatatattactatattactatatactaattactatatactgccaaagactctgaacccaaaaccatccctttctttgtaaacaaaggaaggaagaaaggaaagaaagagggagggagggagggaggaagggaaggaaggaaattagcaactgt

SEQ ID NO: 98997 - DNA, 1055 bp, Homo sapiens
accaacattgtccaacatggtgaaaccccatctctactaaaaatacaaaaaattagccaggcgtggtggcacgtgcctgtagtcccagctactcaggaggctgaggcaggagaattgctcgaacctgggaggcagaggttgcagtgagccaagatagtgtcactgcactccagcctgggcaacagagcaagactccatctcaaaaataaagaaaaaaaagaaaagaaattttccaaggcttagtataaggagcaaaggacggtcttggctgaggaccagctagcccagatgtcaaagcagttgggcatgttcaagaccaacctggaggaatttgccagcaagcacaagcaggagatccggaaggatcctgagttccatgtgcagttccaggacatgtgtgcaacctttggggtggagcctttggcctctggaaaaggattttgatctgagatgctgggtgtgggggatttttattacgaactcggtgtccacattaccaaagtgtgcctagtgctgagcattggagtggaggtccaataactctagaggaactacatcaacaggtgttaaaaggaaggggcaagttcacccaggatgtcagtcaagacaacctgatcagggccatcaagaaactaaaggcacttggcactggcttcagcatcatccccatgagtggcacttacctcattcagtctgttccagctgaattcaatatggatcacaccatggggctgcagctggcagagaaaaatggctattgactgtcagagagatcaaagccagtcttaaatgggagaaccaatgagcagggcaagtgccagaacacctgctgagagaagggctggcgtggctggacttacaggccccaggggagatccactactggctgccagctctcttcactgacctctactcccaggagattacagctgaggaagccagagaagtcttcccctgagtgtggaagacttctattggccaataaacctgggcagttttgtttattaaaaaaaaaaaaaaaaatagaaaaaaaagctcccttcaaaaaagaacta

SEQ ID NO: 98998 - DNA, 1069 bp, Homo sapiens
attgagtaaattttaattctgctagtattgtatattttggaaaattacttagcttttggctcatttggtttccacatccatgccaaaagcttaattagcagcgtatgtagctcaatgtaaggacagttaattctagtcttatttcttgacaatttcattcttagtatgtcagaattcttcattttggggagaaatgtgcaaaggtagaaattacatagtgcagtcatctctgttaagaacttttatctttttaaaaaacatcagctttattgagatataatttacataccataccatcatactatttgcctttttaaagtatatcattcaatattttaaagtatatttacagggttgtacaactatcatcacactcaatatgagaatattccatcacctccaagccctctacccattagcagtcacttcccctgaattctccccatctctacccctagaaaaccactaatctcctttctgtgtctatagatttgcctgctctagacatttcatgtaaatggtgttatacagtatttgatctttcatgactgccttctttcccttaccatgatgtttttaatgttcatccatgttgtagcatctacccgtacttcattcctttttattgcaaaataacatttcattatatgaacgtatcacgttttagttatccatttatccattgatggacaatgaggttgtttccacttttgattattataaatagtgctgttatgaactgaatataaatgtttttgtgtggacatgtttttagttctcttggatagatacctaggagtgaaatttctgagtcatatcttaactctatgtttaatcgttcaagaaactctcagattgtttgccaaagcagctgccctacatcatacactcagtgtatgatggattcacgttcactgcatccctgccaacacttgttattgtgtctttctagtaatatcattctagtgagtacgaagtgttatctcactgtacttttgatgagcacttccctgatggctaatgatgttgagaatattctcatgtggttattggccatttttatatcttg

SEQ ID NO: 98999 - DNA, 1036 bp, Homo sapiens
ggctctcttatttttctcatttcccaatgcctctctgtgggagagctccatgccagttttcaccacgctcaggcaaatactctgcagctgttattggatgggccattccgatctgccttatgaaattccacaagaatgttaggggcacctatgggatctctagtggggtgggcagggtgctgatggggacgctggccgcagggaggaaggaacatctcgggagggccctctgttcctctcccacggcagatgccctcctctgtatgcaaatcagcacagcctttattgagctttacaactaacaacctgatagttggcagttaattcacagttacagataatgcttttatttacataaatataccaagtagtaccctcttattgtattcacttcatctattttcttagaatacttgcaattactaatgaccccttccctttccctcctgctgccctgtccaccctctttccccttctaacatccttagagggatgaaatctcagcatatgttgcaggacaccaaaaggaagaaaacaatcaagcaaataaaataaacagtcaaacaaaccaggagtttaaaacaacaaccccaacaacagaagccttggcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattgccctttttttttattttgaatgggaagttctcactaaaacaatcctgagatttcttaatttcatggttctttaaatattataaacacagagtcaacatagaatgaaattgtatttgttaaaatacacacattg

SEQ ID NO: 99000 - DNA, 1092 bp, Homo sapiens
actcacagtactttgctgttccccttcctgccctttccacggcctgccttacatcagagtcatagctgtgcaggtgccaagggtgagagttttgtcctggtgaactgtggagctaggatttaaacctcaacttcacctgcctcaaagactgtgctctgaatgagtattcaattatttctttcccgtggatattcggccctccccagtttcatagcaatccccatgcctatgtgttatattgccattgtgtataagaggttcccaataaatacttctggaatgtatcacacttacacatctttattaaaaagttattttcttaaagggactactcttgtcacaaagatacaatagtccttaacttctgtgttttaattttttatatgtggcctgtattgtcccactaaatataaccattgtttggaatcattctgaccaaatgtcccctctcagttctcacggtttccacggaccctcttctggtctttctctcctcgcattcgtagtatttctatttgtgtcactaattttaaatgtaagtatatactatttcatattatttcttagatgatctcttaagttttatgcctttccataatgcctatgccccaataatagtaattctgtgcattttgtggaatgaataaaacaatgaaaggatgaaaatcccttcttggcatattataaacacgcttttaaaaagacagtatttgaatcgtttggaattatttttcttagttttcatactgcctacctagctaggtgataagccagcattctactcttgattcttctgtagatctttcatttattatcagatcaacagatgctcatcagttcaaaaacagtttaggttaaaaaagaactgggcactgctgttatttttaaaaattatcttgggaaggaaaactatcatgctttaggccataatttcaagagaacagtttttgcgtccttggcattagaagcaggcagcctaagtgaaatcaaacattgagagatttggaaagagacccaggctaggagataagtttaataaagattttgtttttccaactcagtgtccttttgattccttcctattattcaatt

SEQ ID NO: 99001 - DNA, 1052 bp, Homo sapiens
tttctacttttcacttaatctttctgcaggatctaattggtcacaacagtgggagaaatagtcactagcattgcttataacgtatgtcatatctactctgctttggagaaggaatttttttcctgccccacctaaaaactagactagaacttaacagtatttctcaaaggaaggcagctatagaatcctggattttggctggcggtcaaaagaagagtttccttcaggtacttaaatgaatagtttaaagtgaaagcaaagtttctgaaagtcctggatacttaccattcagccaaggtctttcttgccgagcaccttgagaatgtgctgttcatctgtgcaagctgttaaagtaagaagcaaagtatcaatatggggccagtgattggcatctggttatcactctcttgagcctgcctcacttaaaaggctactccaggctcattaaatttcacagttttcatagccaccatctgttcgctagaaggaattgccataccattccatgactccagcatattttccattatgctggctttatatagtctacatttatgggctctctttggcatcagcatccgagacaagtaggtttcatttctccttaattatgcttttactccagggttttagcttagaagattccagtatgatcatgttccatgacttcctcagacttcttttcatcaaagggaaaatggctgcagtttaaataattttaagtcattacagtagtgggcagttgcagtgtgactcttcaaaaacacaaacaaatatgctttttcactttcgaatatggcaatttttttatcaaaaattggataatttatgaatttaatgaattcttgggacaattacttatgttttgaggaagtcaaaagaaagttcaatgcttactgttgttcaaaacatttcttgaaaaacaataatgtctatgcagctcagaccatttccctgtgccctaaacttcatggctgataaacaaactcatctcatccaaaacttaattcatcatttttcttcctaaattgttctttcttctgtgagtggca

SEQ ID NO: 99002 - DNA, 1049 bp, Homo sapiens
gagaggattgtgggtgttaatgaacctcgtatgagtggatcggccaaatcacacttggtatgaacacagtgatttacctgctggtttgctgtgatgaaactttagccatttgatttcttaatggagggggattatagcttaatatctagaatggagtcttcagcacgcgtatgctatgtcctcaaaatagaaacttgctcctttcaaatatctgtctctgagggaccagaggatcaggggtggaaaattctgagtattttcaaatccagcccaagtatcatcacactttgtaaaaacgactcagcataatgaaggagtcacggtgcctctgacttcatccaggatatggaagttattgttatattcccagtgtttgagactgtttttgcatatataaaagttagaatggttttcaaaaattggctattttaagttcttggctagctcctgcacatccttcacatttcaacacatgtgttacctcctctgagtggcttccttcaactcctctaatcccactgaaatacctcccctcttgtcacatatttggcaatttgtattgaattgcctgtcatctgtcttcctgactagactgtgaggtctttgaagagagggactgtttagtttttgtgctttcatcacctagaacagtgcctggtgtagattaagcattaggtaaatgaatggatagaatctggattctaccgtatgctggctcctattgtgctcattttgacaatttagttctgtttggttggttggttgtttttttgtttttctttttttcctttttttgtgtgtggcttaaaacatagttttgtattcatgtttcctttcaacagcaattgtgttagaagtagaaaggttgttggtgaatcacctggctttccttggattatataaagaagtataaattatactatttccatgcttatgaaatgttttacttgggggtctatgtttacatcaatagtttaatgtcaagcatacaaattattttcatccactactggcgaatccatttgaccactggagtagaacctttggaa

SEQ ID NO: 99003 - DNA, 1574 bp, Homo sapiens
agggttgaacacagaatttagagcacctaatttcacctggagggttaggaaaaggctaggaggtgaggaggtgacttgtggtctgtgtcttagtgtgaggggtcattcacaaagtaagtcaggaagctaggatgggtgttggagagccatgcccgggagagaatgcaggatgtgcacaaccacagaggtatgtaaggatgtgttgactcagggaaaggtacctgatttgttagggcctcagtattggggtgaaaatgaggctacaaaggtaggtagaagccagattacagaaagcctcaagtgccttgaactttgtccagaagacagtgagcagccatgagttttaaggaaggaacctgatgagatttgtattttatttttgtttgttgattctttcacatgaaccatggaagacaagttttacccatgtctcctcctggccaggcagccgctgaggtgctcacaggtcatgccttgggagggtggactggagaacagggaggcaggagaggccccgcctcacctgtcccctcccctgttgctggactgcagctgccttgctgcctctgaccggcagagtcccaggcaagctccctcctggacccacttcacagcttccatgccagtgctccatgcccatctccttcctcccctgccatggcttcaacctcactgccctcctccagaatacctgagagtgtttctgcttaaacatcttctttttcccatagtataatgggggcacaataattactggatagattcagccccttggtcccaggctctgctcttttaactttggatttaactgatgcttgacagaatacagagaaagattggtctcatcttacatctttccatgccactatttatctcctcaaatggaacaactggagatgctaaaaacccacttcttgaaattacaggacagaaaagaacttgtagtacttcacttccctggcacgtcttgagtgccatagacacttaatagtggctcatgcctcagtggagaactggggaaacaaattgtagaaaccaaaatggaactagagaggatagaaagacagatagtatagcagcttaaggaaagagactcaaatctttctagaggtttcccatctttgattcctcagagcatatattcttgacaaactgcaaaatgattcaatagatatgttatttttaaattaaaaaataaaagtgtcttcaaatctttgaagtcctgttgaattaggataagtagacacaatgaataaatattttgaataaaacaaaccatatagcagtcatggcaaataaaggaggtcccaaagaggcttttttagagttaaaatacaatttcctggccagtcttctcagccccgacttagaccgatactcatcctggtctttgatgagtaaatttgctttggtttctgatttataataacttgacaaaaagaaaagtatatcttttaaataatctactttttgcttttttcaatttatttcctccctttttgttttaaattgtttccacaggcacttgatattacatacagttctactttggaaacatagcatcacttgttttg

SEQ ID NO: 99004 - DNA, 1045 bp, Homo sapiens
tcttctgcttttagctgcacttcccagtaaatgccaacatgcatcatattctgcaaacactattaacttttgtttgtccagcatttaactctttgtggcatgcactccttggcttcccttgatgatatagtcacctttaatggaaggaactaaagcagctttataaagcaggaagtcatgttttgtaactcagaacaaggaagcttagagcgtctcatattgcaccttctctttgctccagtggtttcatcatgctgctgccaaatggttcttctaaaatgccatctgcatcagcatgccattcctctcccaagcccttcagtggctctctgctggctgctaaatcagcttgaagcatcctggccaaatttatttctcctttcattaaagtttctgctatagacaggttacatctcaatatttttctcttgagtcacatttttgaacctactatatacctaagcactgtacattttatgttgcattatcattatgtctttagatatttggtcttccctgcaagagtccaagcttcttaagcatagtaatcatgttttaactaccttggtagcttcaggatcctgtagaggtctgctgagtggtaagttttcagaaaacaatggttaaatgtatttgaatgtatgtatcaacaatgtaaacctaaataataaacagggagaggctctctaaaagaaaatgatatttattcaggagtaggcattgcaatgggaatatgtgtaacatagtaagctatgtatgtattcggggaggtgaaggaaagcagaggtttttagagaaaaaatgaggaagattacattattgtttgagataattatcctttgccactagcatccagcaataacaagggtggttccagtttgaggctggacaggaaggtactgggaagatgtcctcactgaagtattttgtttaaggttgagatggcttttatgtgaggttgtgttttctacagtcttttatgatagttcttgttatcaggcattcgtgcatgagaaccttctcatggccttccctagctctattt

SEQ ID NO: 99005 - DNA, 1030 bp, Homo sapiens
aacacagctttattgaacaccttttgaatacaaggcatgggattgatggtaaaatgcaaaggtaaatgaaatgactttcctgacttgaaagagtcatgttcttacggaggtcagaagactctagaatcaattgatgagatctttcatggacttcttgaaagaccaagggagtcacatcaaattgtgtgattaagtttccctcatttgcatgaagacaatacctgtacttgctctttttttttttttttttacaagtatatgtagtatgaggatgagagagatgtgtatgcaatgggtttatcattgttaagctatctctataattaaaataattgtaataaaatagttgcaattgtcatagtttatttaaagaaaaaatatggtgcattatcttgtatcattttcctagttagaaagccttgtcttcagctctttaaagagggaggtgttcagaatccagaaacgataaggagaaaggaaggaagaagaaaacatagttttaaaaagaggtgactcgattttctactgaaatgaactatctcctttgaactactaaggaaaataaagcagtatttttcttaggccgtatcctaactgcttgctcgctgtgaattatgaagctttaaagcagtaaagagaaatgtgtgcttttctcaagtgactagagagtgaatgctgtgcattgtttctcacatgtgatgttaagttagagcttgcttcacagactccactcgccctttgttcttgaaaagtcttgccatcttggctgtgagtctggtgaacccttttttaatggtcatacaacaaatactgtagtggttgaaagttggctgctttcgcattgcttcagagtctgtgtcatcacatttgttattaatcaggaacataattatatttgaagcatagaaaagaaaccatttatcttggcaggatgggatgagacagtcgcaattcatatgcctgtaaacccaccagctaagtcaaatcactattgccagctcaatcgttttaggttaacctggaggcgaaa

SEQ ID NO: 99006 - DNA, 1132 bp, Homo sapiens
aagagaaatagtgattaaaaggtgtttctacagaatctcccaaagaacatataaaccatcagttgggaactattcctaattatgcttcagtctttaatatactgttttatttttcagtattgacatttgtatttgacattgtcaactgaatgaatttatacaagcagaaaagctatagggcttatataatatctgattcttatgctttcagtggaggtaacagaaacagaaggaaacttaacaacatctaatcaaaggaatatagtttccctccttactgcaaatacaatccgattcagctatattagcaatgatatcccaagttgttgtgcttaggtttttagtcaaaatattctggaccctgatttatatctagtctgattttctttaatgcattcaaagctcagcattctctatatgcgacaaagaacatagcacatatgtaagacggggcgagggggttgttacttttacgatgctctcccaacaagtgtgacttcttcaatttgaagtttacagtaagacacttgtataccagcttaaagtgatttcacacatgaggtcagtagaacttcattttcataatcatgtcatgtatttctgtcctgaaaattccttgaaggctttattttatcttgtagcagtggtggacttcaaacatcgctgtttttgtagaaatgtcttattctttaatcaaactcagggtgacattaacaagctattttcacagctgacttcccagtgctggagctttctagtgtgttttgtatgttcccgctttgctcttcactttcgatttgtttatttttcatgacacatctgaatgccttcttgtaagcagagcccttgtcttgagatccaactgtggggttattattacaagggcacattgcagggatccttagtgaggggttaagagacatggttcagaaattattttcttttctgaccaaacatatgcatgatgtttttcctcccaaggagatagaagccagtcttgaatttctgaaagctctgagtatgtaggaccctggtgcttttgatgttatctgtctgatcctctttagagagatttatattattatcatctagctcaaccactagaagggaaagaccaataattcaaaagctt

SEQ ID NO: 99007 - DNA, 1071 bp, Homo sapiens
aagcaggcctgggatggattttatctgagcacaagggattttagtgaaccaaaccatctggggagtcaagggaccttggatctgcatccttatgggtgggcatagagggtgaattatctatattctattgaagtagttgacagaagaccagggaatctggtctacatgtattaaatttttgcctgtgcaacggaagcaagaaggcaatgatgctttgcatatatatattttttaatgtaagtttcaccattgttctaggtaagaagcccagtttttatcttctgggagaaaatgaactagatcattagggagtcataatttcctttgtagtttttctaatagtttcattgaaatgttgtttgatgtgataaaaagaacctatttttaattttaaattagcatagggaattaaaatgttaatgtatataatcttactataaattattacaatcctattactaaataaaactgagtttggagtatgaaataaatataaaggtgtcttagtcactttggactgctatgacaaattccatagatggagcggcttaaacaatagaaatttgtgtctcacagttctgaaagctggaagtccaagatcaaggtgctggcaggtccagtgtctggtaaggggcctctttttagttggtagatggctagcttcttgtatcctcatgttggaggtcagagaaggaggaggcaagctctctggtgtgtcttcttataagggcacttgtcccccatcatgagggttccaccttcataacctaattccctccccttgaccccatctcctaacagtgtcatattggagattaggctttgacgtatgaattttggagggacacaaacattcagtgtgtagcaaaaggtatgatgttccaattatacaatgtaaaaataaaaacttctataaaggggaaaggggatgattatattctttcaaaagtgagtgaaatcaatgaggttttcctccaatcactttctacttctttccagttgattcttttaggcagtgaaatcatttcttgaccaagagataggtcttctagggagaaaatcctaattttc

SEQ ID NO: 99008 - DNA, 1138 bp, Homo sapiens
tcaaaaagaggaacctttgcccggaagaggttaagctctgttaatatttgatatctgatgagcaagccttattctccctgcctgtaagatctgaaatttgaatcccagggtaacctcctcttcgtcaacttccttggtcctgagagattgaataaagttgctgctaagattgggagggactttgaggctttagtacctgaaagacagcatcttctccaaaccctcatggaggctgtcctgggtgatgagccgcatggcaggtggaaatcagctttgctgggcttggatccttccagggcactctgtgactggctctgcccactctgggcatcagttttgactcactctaattgtcaggtagaggcccctcaggacagttgccatctataacaggacctagagggttctattaagatgacagagggatttgatgagaatgagccctcactctgtgataagaacaacaaacatctccctgccaagttataggcagcaccagaaacgatgcagaccagcttctggtgtcagtcttccatttctcttccctaaggaaaagctgcaagctctgagctagtttggagaggaaccgtctctgcttaagtctcgctttcctccttttacctgtgggcccacatggttcttcctcttgatcagcttctctcttcagaattctaactagtgagtcttctattaacaatagcttcttcttgctgctgtaataaatgaccacaaacataatggcttagaacagtgcaaatttgtttactttttttttttatttgtgatgagtctttaaatgtattttttttaacttgttatagaacagttctatatagtgttctacatagtgttatggaaaacacaagcttgttctcacacatttatgcaggtgagaagtttaggatgggtctctgtgaactgaagtccaggtgttagcttagcgatcttcctttctggaggacgtaggggagaatctgtgtccttgccttgcctggccccctgcttcccttggtgtgtggcccattctccatcttcaaagccagcagtggccaaatgtttctcatgctgcaacactctgacactgactattctcccttcctctctacatttaagggccttgatgattacattagaccca

SEQ ID NO: 99009 - DNA, 1007 bp, Homo sapiens
cacatagagcccttagctcagggtctgacctttctctcaagcattctgctaggtactgtacacatgagagttcagggcgacttgggaactgacagtactcagcaggtgaagccactggtggcacttgaacaattgtaagggctgtcaagttcacactccttgcccctagccccacccatttacaaagaactttaaaaaattgcatatctcagatcccaggatcaaattcattttcaaatggactgtttccttctctcttgaggggagagattgggtttagccttgctgaattggttattcagcttttagctgcctgcagcagaaggaaactcactgtcggtgattgaatctcccctggggaggatgggccgcttcctttccacatggcgctggtctgagtgaagtgggaccagatcagattagagaccaggataaaggaagtgcccccaatctccctggctcatggaaattccttcctattattctgaaatggagataaattatgtgataacatgttacaacgtggtgatccctcttgcgtaaggatgtttcaaaagtctattggccaataataatgataaaaaatctttgtttcacagaatgcacttgctacataaacattcagcaggttaactgacgcaccacaaattctgtttgctgcttgggaattttgtcagagcagtgcgtttgtctctgggaacatttgtgtctgtgtctgtctgtatttttctaggtgaagaaattcaggcctataaagagttgggaacttgcctaaaacctatgttgtttatagctagcaatgtggcttgcctccttatgtgccaggtgggatgtgaaatgcttcacatgggttatttcttttcattccatccttataagtcaggcactaatattgcacctatttcataggtaagaaagtcagcccagagaggcagaagttcagaagcgatagagtcacttctcccaggttccatgtctgggaatccatacagataatgtaagaaact

SEQ ID NO: 99010 - DNA, 1125 bp, Homo sapiens
tctccattctggaagccagatgctgaaatcaaggtgacagcagggtcacgtggccattttccccaagaaggctctatgggggacctcttctttgcctcttccagcttctggtggcttctggcatttcttgggtcatggaagtatgactctaatctctacctccatccccataggtccttcctctccatgtgtttgtgtgtctcaaatctctctctcctgtctcttataaggaaacagtcactggacttagaagccaccctaaatccaggatgaccttatctgtagatccttaactcagttacatctgcaaagaccctgtttccaaataaaatcatgtttgcaggtactgggggatagcaattagacatatctttttggtggacatcatgcaatccactgcatcctagttccttgaatccataatggatccagaatatcaagactggtgtctgagtctgtttgagctcctataacaaaatacaatgattgggtagcttgtaaacaacagaaatgcatttcttatggaaatttatttctagactgggaagtctaagattaaggtaccagcagatttaatgtctgataaaggattgctgtctgcttcatagatggcgccttctatgtgtcctcacatggtggagggggtgagcaagttccctcaagcttcttttgtgagggcactaatcccatttataagggtcccactctcatgacctaattgtctcctaaagaccctatctatcaatactattcattggggattagatttcaacctatgaatttgggagagataaaaacattcagaccacaattgctgcaaaagaataattcatgcaaataccctgttctttgcagagcacagtaagagatgctttgtccctgagtttcaagggagggattaggaaggtgtctatgccatagtctctgctctcaaagtggtaatcatgataactagagaagaaataatgaatagttactggatttttatgagtgatagtctgtaaaagggctttcttgaaagtttttgtttaatctttccaaatatgagataacctgttattgaatgatattacagacttattccttcatttataatatattttctttagataattggcctctgtt

SEQ ID NO: 99011 - DNA, 1004 bp, Homo sapiens
gacttaatgaatggtaaatgtattttctcttccttatgattttttaatagcatttctttcctttagcctattttattgcaagaatatagaatgaaatacgtatacaaaatatgtattaatcaactttttatgttattggtaaggcttctggtcaatagcaggctattagtagttaagttttgggggaatcaaaagttatatgtggatttttgactgcatgggggcttgccattcctaacatctgtgttgttcaagagtcagctgttgtataggcaataccttgtaagaaatatctttctagaaaaaaaatttattataagatgttggctcacatgattatggaggctaagtcccacggtctgctgtctgtgacctgtagaaccagaagagttggtggtgtagtttgtaggtctgggagccagagacgtgatggtattaaggccagtccgagtctgaagactttagaaccaggagcatcacaggcaggagaatatagatgtcccggctcaagcactaaggcagagggagtgggaatccaaccttcctctgcatttttcttgcttttaggccctcaacagattacgtgaggcctgactacattgaggagggtcatctactttactcagtccacaattcaaatgataatgtcttccagaaataacttcacacacatccccagaaacaaacgtttgatcaggtatttggtcagcctgctgcttagtcaacttgacacataaaattaaccatcatatcctgcttcttccaagttagtgtaaggccattgattttttgtgtatatgctgtgcctttgacaccttgccttgttcccaagtagcctgtaaaggtattatgctaaaccaaaggagaaattatatcattcccttaagaggcaagagtgtcttccattactgatggctttaaataaagaacagatgacatgaggtaaagcatttgaattattttcacccactgactactattttaaggaaataacttttaagaca

SEQ ID NO: 99012 - DNA, 1068 bp, Homo sapiens
attttaagttatctcattggctcatatcaatggaagaggtcaaatcagttgagttgtcgatattgggcatgaagaattaatttactttcaggtaacctgtaacaatatgctgacctaattatcgaaggatttgagatgaaatcaaacttctgtactcttacatctgcaattcacatagttttcatctgggttgtgtatctcaaagggaagaagccaggcaataaatttgaggttagtctgttgatactaatttaggtcacagaattccgtggaagaaattggtaaaggtgattgccgtaggaggactactcaagtcacagggaatgaagagagttctggctgagggaatagtgccacctactgaattgtgtttgtgttttctacaggttctaatttatgcaggcttatgcctggaagtgttactttcctttattgatcttgcacatctccttaagtagtcactgccagaactttaaacaatatttagttattatcggatcaaggtgtaattagaaacagctgtgaacaattgcataccatccagctcctgaagtagcaaactaaattgtacttggccttggattgattaatacagattgtgtctagcaatcaaaataaatccgtctccaggtagagtgccaggagccatcttaccaagataacacagaaagattaaaaatgcatgaaatgcaccatttcctaatgtcgccaggttaaaaaaaaattaaagcacaaagcattggctacaacaaaattgtcaacatttttatcctttttcaaaatttcagccttgatctttactttgtgtatttatgaaagcatatttagaattctctcatctttcgcctaagtatttaaaaaaaatctctacagtgcagtgcatacattgtaatatacctatttaataatgacagcatttttagttaatttgaaaaatcatttggaattacatattgaattgggtgggtcagataatttgttaccatggtgaatctcttcattggaattaaagagtttgtctcataaaattatatgcctctgtgtaatatgttaattaatgctcctaat

SEQ ID NO: 99013 - DNA, 1039 bp, Homo sapiens
ccccaaacaaatcatttcggtccaggaagtgaaatacactagctggggatgtttcttctgtgatggagccaggcatggggtctgtttgctcaaactatgtggactcccaaagggaaatcagatatgttgggaatgaagaagtgagggaatgaacactggagaaccaaaaaattactgtctacaacaaatatgatccattttttctgaggagggagtccttatacatatacattatacaccatgagaccacaatgtagaacattagaccttgggccactgggtatcttgtttcttttccaggcttggttcagtgatcacccaagtcaaatgggtattttactgagtactagagggaacgcagggacttctccaagacgttctcggtacctatattgaagagcagggatttcaatcagattttggtgatggacagatagaagagggaaactgcatgagttaaaatttagtacaatttttataagcactgagtgtttttagagcacagtttttacagcagatgtgctagcttttacacctggtgatgtgagtatcactgctgttttcttcccccttctgagggtccaggagagaaggcagggtctgctccctgatttggcagtgaaggctgcatatcagacagtggaacctgcaaatttgctgttatttatcgcctagggatccaggaacttgtttgcctttctctaggaatgtggtttctccattctaccagctaagggtccagtgttttctggggaacgtagtgtgaagggaatctatacccctttgttttaatttggccctctttgaacatctgcacaaagcaaaatcttcacctgttctacgtagggaactgtcgatgggtttatttgtcatctgcacagtctctcttgtgaatattccagtgtctcaaacagaacaatggggagttcattcagtctgctttcaatggccttgatgtgtgtatgtttaaaaattagccaagcaaagtgcttcatttacagaaagcataactcttagtgctggtttatggagcttaaat

SEQ ID NO: 99014 - DNA, 1061 bp, Homo sapiens
ctttatagcagcatgatttatagtcctttgggtatatacccagtaatgggatggctgggtcaaatggtatttctagttctagatccctgaggaatcgccatactgacttccacaaggggtgaactagtttacagtcccaccaacagtgtaaaagtgttcccatgtctccacatcctctccagcacctgttgtttcctgactttttaatgattgccattctaactggcgtgagatgctatctcattgtggttttgatttgcatttctctgatggccagtgatgatgagcattttttcatgtgttttttggctgcataaataaatttgcttaggaaaatgtagcttaggtatgtagagtcagtgggctttctaaaactgccatatcttggttgaaacccctgatatgttactgtcttctctctcattgattttttcctttccatttacgactgaatgttttccattatgatcaatttagtagactttgagaaggagaggcgatacatattgaaggacaatttgccatcttttcccagaaatcctctctggattgttaaatcctctctaacttgctaattttagccatttgaactttcctttcttgtatctttatttaagatgaagacagtgacacttaagttactttcaagtttaaagagatatttataaagtacttcgaacttttttgtgggagcagtactatataaataaaatactgccattcaaatacagcccccgccccaggtttgaatgtagaggtcaatgaactatagagaaaatggtaacaaataagatatgaccaaaaagtggcaataaataacacggggtcataaaaatttcataaaatcctcttttaaatatgaagggggattttttttttcattacatccctgggtgtttcagctcctgactatccagctagtagaatataaaaaccactgtaacaacaggtgcagatgtgttcctgggtgtgccagttgttcatttctttgtttttaatgaaaatatacattcgtttcttggcaagagaaatgatgtctgggcttctgtgcgtactgagtg

SEQ ID NO: 99015 - DNA, 1073 bp, Homo sapiens
tctggctatgtttaaataccaagaaacctgagcaaacactgagtaaacaagaaattcttaagtttgaggtctcctgagataaggaattatgtgcaagtagccttttgtgcatgcagaaacactgatggaggtcagggaagtggagcagggaaggggaagaggccagtgaaggtgctctctcctagttagctctcaggagtgaggtaagtggagcttagtcctgtgtggaaattctcagaaatggaaacaaccacccctccccatcccaactcagagttaagccacttgcagggccagggagctgaggtgtttatactttaactctgctactcattgattgagaactggggcttccagggggtgttaattccactgcacttttctcccttggctttggaagaagcttcagggcacaccgaagtggggaggcctgagggataagggaagagcactgatactaccagctctaggcttccttagcacacggtctaagaaatgtgatgactggccttttattttgaaacaggaaactcttattttctcaatgtcagtgtccctggttcaagttcagctccatgaaggcaggaaacatgcctgtcttattcaacactgcatactcagtagagcgcatgactcagtattaataagaagattaatgaatagatggctgaataacccagcagtaggatttaagaggtaggttctttattgtgtttcaattcaaaatagatcagagcaggtaagacacaagctggtaatggaacttgacagatgtcaagtgctgtttgccttcatgactcttagaaaacaaacagaccaaacacaaagtagaattgtgcctgggagtagcccgaactgcttatcgaaaccattggcattttggtgaccatgcatccttgagtcaattcaggtccactgaatttggacagaccccatgctaggtcctacccatgtaggttgatatctagtcctgggttgtttggaattatgttgggtttaggtggaatgaaaacaaataatgattggcagtggctggtgaaatatctatgctgaggtggactcatggagagctc

SEQ ID NO: 99016 - DNA, 1362 bp, Homo sapiens
gggtgggggatatgtccaatgagggactcagttgaggacaaaagggacaaggtgagtctgggcagatgggcctgtttctgagcagaggtccgtgtggccaaggagagtccagcctcttttttgcttcgtgctgctcagttcagggctaaatccaggacaaacaaatgacctacacgcagctgcctttgcttaaatcagctcagcagactgtgttctcaaacagctagataaaatctggcatttactttgtatctggcgacctttgctttgaggagagctgcttttttttgttgttgttgttgggaatcttgcatgattgggttttattataatcttgcattaaagggcatatgcaatttccaataggttagtaatgaaaatggttcagtcttactaaatggacgctatgagctctttttaaatggtatgaaaatttgagggcatcttttacttaaaacttacttttgagtagttttttttcctccaaattctctctttctttttggtgttcctgttcatcactccattttaagagtgggctttagtgttttgaatgggaagcattttcctaatgtggtataagattaggagccagaggaacccagacatccactaacatctttagaagggaatatacatggaagggctctgttttctgtaggctgggtgggctgggggctgatgggagccatggaggtccctagcctgcaggctctgtctgcgaggactggccattctttggcctctgcttgtgggaaacccaggactttcacagcttctctgtatgaatggggaggggcacagagcctcagtatgaggagacacagaattgagatcatgaggggtaagatttgttgatggtcttgggaccaagaggggagtgaaatttgcaccttctctttttaaacatttgcaaaccagaggggtgagtagtgaaagagttagtggttaaagggatcacatgcaatttctttggactgagttttcacatctgacctttccagagaggatctggctttgggttggggcctcaccctggggtcagctctgctcttcacatggtctccatgtgtcctccgtccttccttctcttgacttgtgcccggtgcatagggacggtcccacttccttcttcacatctttttctgattcctccagaccacaagagacactttccgcctctgaaatgtcagaggatgtgtagtctcgatcacatagtctagctctgtacagaatttgacacttaatggcaaaggttaatttcaatatgggtcatttaaaatgcctttataaataataaaatatatttaattggatataattagtaaacattcagaagaaatggactttttttttattgtg

SEQ ID NO: 99017 - DNA, 1027 bp, Homo sapiens
ctccacacctgtgggcgtttctcgttaggtggaacgagagacttggaaaagaaagagacacagagacaaagtgtagagaaagaaaaatgagccgcggggagagttctcttttctttgtgaagggcagggtgccctggaatgggttcgccccgagagaggggcccgtgccttggaaagcgtcgctgttctggcggcgtccagtgaaacagcagttgaacacgggtcagtcggtcctgagagatgggcgagcgccgttccgaagggacaggcaatggcctcccttgccctcagcggatcgaaagggagtcgggttcagatccccgaatccggagtggcggagatgggcgtagtggagttgatggcatacgaagacgccaatcctgagtgtcaatcagccgttaagtcattaaaaggaaaggttcccgcaggctcagatgtaatctcagagtatttaaaagcctgtgatggaattggaggggcaacccaccccttcagagggcttgctaggtggcaggagacctggcctcatccccagagattctgatccagcaggtctgtggtggatcatggaaacctccatttccagtaagttctcagatgatgctgatgctgtgaatccagactttgagaactaccatgctgaaggtttgaaatctttttcttagttacattgacattttgagactttttttttccttcctaaagcttcattctgtcactggaagcataatgttagcacatacttattaagcgataattatttatcaaataatgtcttctatgcgcatacagatatgcactttagatggattactaattcccaactaactgcaatatttataacacttaaaattatgtaggacataatttaatctttgatgagtcgaccaatatctctgttctgtgcattgcctaaggtgtaccttataaacatcaatcacttctggtactctagaaaaaattaggtcacttgaactttctgcaaagactcatcaagcagaggtttaaaagatgaaggagacttcag

SEQ ID NO: 99018 - DNA, 1051 bp, Homo sapiens
ttctctttctctgccttttccttttttaatttttttttcaggggagaagcaaatgcatcccaaagtcttaaaaatcatgcaaatatttgtcatgacactgttagaccatagctgaccaccaagaaatgaatggaagccagttggacaaggtcaaagcaggataggtcagagtcaactcttttaatgcccctgttttaaagatgaagaaacctggagagaatgaatgtcttacctcagccacactgctttttttgttttgatgatgtgtatttgtaatgtataatttgtgtcatggatcagaattgatgagggtaactatgggtttaaaagtcaataggaataagtagggataagaatgtgaagggtaaacatattctcagtgacacagtggtaccagtctgtatgtaattcagcaaatatttttgagtcatttcagcggatgatgaggctaaagccagattagcatgggtttatgagagaggggcaaaagggatactggagaagagggtgaagcaactttaaaactgaggttttctatagaggggatgggagaaatgggaaaatagctgtggtggaggagagattaggaggtgtggattcgaaagaggatttttgttttgtttttagccaggggaaattatagcttgttttatgctcatggaaatgatcctggagagaggaaaacataaatgaaataagggagtgatatggtttggccgtgtccccatccaaatctcatcttgaattcccaggtattgtgggagggaccagtggaaggtaattaaatcatcgtggctggtctttcctatgctattctcgtggtagtgagtaagtctcacatgatctgatggttgttataaggggggggtttcctgcacaagctctctttgcctgccgccgttcatgtaagatgtgacttgcaccttcttgccttctgccatgattatgagacctccccagccatgtggaactgtaagtccaattaaacctctttcttttgtaaattgcccagtctcgggtatgtctttatcagcagtgtgaaaatggacta

SEQ ID NO: 99019 - DNA, 1757 bp, Homo sapiens
gttggaagacagataccttacagagaaataaataggctcttggtgttgtccctgccaatgcaaatatatgaagtgctggttgacagagcatgagccttggcttcagcccagcagatggtttgtagatagaactacgggtaccaatacataaaataaaatgtttgagttggtcgctttcgtggagttgttagtatatttatttaacttatgatgtcacggttaaagagctagaattgggtctgtttagcttagaacataaaaacatacagcaaatccttcttatgtatgggtgcttatccaatgtgttttgatcatgaagaggtttcttgttcaagttcagtggggagaatttataaactgaatttaagggtcttgtcaggccatagagtctatttcacttaaatgagtttcttactttcttatacattgtttattgtttctctgtcattcatatccctttcctgataactcttgggcagaatatttcaatattcaatgaacattgaaaagctaaaaataaaaattaaccattagtcttgatagttgctaggatctttggggttttttttttttgtacttatactagggttttgtttgttttttccttaagcaataattattgatttgtttttatgaggaatgttcccagagtgtggcttcagatgaatccgagcaacaaaaattaccttggcaagtgattttgtgtatacttatattttttggtctgagtaagaaaaatctacatttcacccaaagcacacaggatctatttctgcatcagccagataatgagacagtaattggtgtgtaagccgttcattctccaagttttctcacggggcataatttgtctcttatttgtcagggatgggttctacgaaacaacactcctattcatgatgggcagagcaaatgtacgaaaacattatcatagctgggattaatggtccactatggatttatgtcaagaatgttaatgatttgtttatgaataagtgggcctgtcgcatggtgaaacagtagcctgcagaactgctgaatggacagtttgcttgcagaggattcttgcaggaaataaatactcttgccaggccttttgcatctcttaagtagctactgtgaattgactctaagatttgaaatggtggcattgacctccccaaatcctgtgatccctgctgctgatcttgtaactctacattttgttgacataatatggagaaagaatatctttttagggttgaatataatttgggttttgtgtgtgtgtgtgtaaaaggtggtgagaaaataataatttaattaaatctcccgctgagcaaagtgcccacgacctccacccaccagattgtgtgttctttttgaagtgtattttaatttgtggaagatgtgaatttgcggcaggttttaattggtagataaaagtgttaattattgccaagtagagtctaggaaatgaaaaataaatcaagattacttagtgattcatacatgtacacatatacagatggaaagatacacaggtagatagctgtaaaaaatatagtatgtgtgtgtttgtgtgtgtatgtagtatgtgtgtgtatgtagtatgtatgtgtgattgtgtgtgtgtagcatgtgtgcatgtgtctgtgtaggttggctgtataaatgtttaggatgcaatttaatgatgtgtattctagctactttttaaacatttatgttttcaggaaggatgatgttgactttctcttgagaagagatttaaagtt

SEQ ID NO: 99020 - DNA, 1087 bp, Homo sapiens
ggttcaggccattctgctgcctgcctcactctccccagtagctgggactacaggtgcctgccaccatgcccagctaattcttttgtatttttaatagagacggggtttcactgtgttagccacgatggtctcgatctcctgacctcgtgatccacctgcctcggcctcccaaagtgctgggattacaggcgcgagccgccatgcccggccttgccttctaggtttttgtgtcacctccttgcttcctgtttggaatggatcctccccctcctttacatattttacttttttttttttttttaagttcaagtagtcgctgtctgatactaaaccatctcagaggtcatgtcaagagaaagaaaggttaataaacaaaaatttagggaagcgggctttataaaaagtaatgaccttgctcttgggagatattttgtggtttgaaaaaaagtgattatggtgaagattttcaacatgtatgttcattttccttggtaataacctttccttgatagagctatcatggtagcctgctatcaatgtgatcctaagtgcttgaattttgaatgctctggaagatcagaatttctgcccttaagcaattgacaaataaaaatgaacctgagtaggcatggagggactattatacttagcattaaaaataaacttatctaggagagaaaaaagaatagcattccacttacatttgaagtaagggcatctcaaggatgatgaaggatcactatttttcaaagccagaggattccaggctaggttgcagtaattaataggatgtaatatatgaaatggacaaaacatgatcaatgtttaatttccaagtcctaattcaaagttgtgttcctggacaattcggtggctgtcttccatgtggtgattcagggatccaggcttcttccccactgtggttccactgcccctgtggcctcattgactgcacctagttggcacaagtggaaagatagcatgaggaggcacagctacttccttaaagattttgctgataagaggcagatgttctttctgctcacattccattggctagaactcagtcatcatttcatacctaatt

SEQ ID NO: 99021 - DNA, 1032 bp, Homo sapiens
cgaggattactcacatgtgtttttaaaaggttaaaacctaagaccctaatctaccaactctaatttgtagcatctccatcatttttctgctcttttctctgagacatggtcatttagctgctggtcatcatggtggtagtatattcttcttcctgtgagttcttatctatgcagctttctcatcccactgttttggaaaggaaaaccatcagaacacccaaaacaatgatgctggatgttggaggtgagaagcagactgtcagtatcaagctctgaatcgggaggagaaaccttccaatgagtctgagcgtccacttctcctccacagctgtagatgcacgtgcccccgggcatgttgagggggaccacgtggcaagcatcatagttgctgttagctattttaaaaagctgtctttgtagttcattcttctgctgcctaggagtctgccagtggaatcacaaggccaagtattgacagcttcaccttccgagagcccttcttcttaaagccgagtgtctggctatcaagccaggaaggcttgggtcactgagggggacatcctcttctgcaggaaatatgaggttttgctgaactcctcctggtattcagtgatttccagaccacgttctgcagaggtgattctgctgtctcacaaacgattttgattttgattttgattatatttttaaagtatcttttcattagttggaaaccataatacaaggcaacacaaatcgtttactgtgttatgcattacatttgaacaggttggttggtaaaccaccagtacattaattggagatcatgggtaagaatttaattcttttatttactttattctgattttatcataacatttctctgccatatctgtgtacatatttgaacttatgataaaacatattcccgattagatgctaacactgtttgtttttggagtcaagcctacacctgtctatacatacccttttcatgggaactccccatggtggtagtttgagtgctcagttgagtgtaggaacgcccaggtg

SEQ ID NO: 99022 - DNA, 1137 bp, Homo sapiens
cctctatcctgccttgtgctgttgctggcaaagcttcagcttggttccattattgatttctgcaacgtgtgcgggaagagttactctgtgattacgacttgtgcaacttgacagtatatggacaggggttgaatgggcacaaaaagaagtaaaacaagtgaagattgtcagtgatttcttttctatatttcttttgttgtcatgctttttttttttttttttttttttgctcaggaaacaaaattgtagagaagttatttcaagtgataaaaaattcatgaatctatacaaacttatgttgtgaacttttgtattagttcatgttgaatcatttcaatcagctgccatattccagtcactctcacaggccctctttggttcattgaaaaagaattagtactttagtggaggataaaaataataaccggttaatgaaagtaaaggactattacagagatagatatgtataaagattttgggctgcacagccgaggaaacactcagttgtctggagttaggcttggggaggattcccatcagaagtgaccattaggctgaatcttacaggtcattatagatggagagcacagtatagtgaaaggctcagaggaatgaaatatgtgttagaaattgactggtttggggtagttggagggtgcgtgaggagaagattaagcaagaagggtagaactaaggaccatgtttagacctaccttggaatgccatgagaagcagattgtctggtggtgataggaaattcttacaaaatcagaatgaattgactttaagtgactttttaccatgaggaacttgggaaataatgattgttcatttcacattgagtatctctgtattatttgaagcttttggagaccttctttataggactagtaattctggctcctctttgtaaattaccaattatacactgaccttctccaaccagccctgcgtttgagctgggtctcatgttttctgtagcatcctccctgtctacaggtggagccacctgctcctctctcaccctccatctctctccattttctgatcccaagtgagattaatgaatcttgtttacttcacagccagggaaaaggagaggctttgaatgaataatttctgactgaatttcttctt

SEQ ID NO: 99023 - DNA, 1051 bp, Homo sapiens
taatatattttctatacttatattctatattttatattgtgtttatatatacacaaacaagtatatatactctataaacattatatacatatgtgtgtgtgtgtataaaatatgtccctttggaaattatagtgtgctgtattttgaaaagtagactgtgatttgatatgtaaaattaaaaaactaacttctttttcattcccagtaactcagacaaagcttcacaagctggtactacaaagacccaaaggcggcagtaaattcctcttttgatttaaatcccattagggtccacacttatgaaacaaatgttgaaaatcctatagctgacaaagcagatgacttaagggggctttataccaaagaggcttataggagttattcacagaagaacttccagttgtaaaagagataaacaagctttggatctgagtggtgtttaatctgagtgtgcataagggccaagaagggctcatattgcaaaacttaccaaagaatctcagcactttaaaaccttagtggtcctggcttcactgaccaaagtttattattctattcagtcagtctctgtctctccctctctttctttctctctcgtttctttctttctaatggtgaagtgcaatatggtatctgcttttggcaccaaattacagttctgaacacctttatttacccatgtatacagctaaaaacttcttgacaacatattagaaacaattactctcttttagattggccccgtttcccaggccaaggttaaacattacaattagagaagtgtataagcaatggattaaaatgtcaggaaaaatatcaaactgggacagttgttttacttcataaagtcttagcagagctctctcccagcatgccttgtgtctttgtaatagtcttaatatggaccatatgtgcaaatagaagaactaaataaaacttaatagatcacctgagtcaagttattgaataaaacatctgctctaaagccaagttcaaatgtcctctttgtagaatcagcatgtgatgatgtagggtacatgaagcaaagagg

SEQ ID NO: 99024 - DNA, 1021 bp, Homo sapiens
agagatggggtttcactgtgttagccaggatggtcttgatctcctgacttcatgatctgactgtctcggcctcccagagtgctgggattacaggcgtgagccactgcacccggccaagagggacctttaagaggtggttaagtcatcagggctcctcccctcttgaatggaatgaaaagccttgtacaagaggcttcgtgccatgttcagcctgccccttagccttccactgtgtgaggacacagcattccttccttccaagtgctgcagctctcacaagacaatcaaacaagcccgcaccttgatcatgatcttcctagcctccggaacggtgagaaaatcaatttctgtttttttttataaattatctactctgtggtatttcgttatagcagcacaaacagattaagacaaggaggtaaaagaagaggagtgggaagtaggtttggtaaaatgccatcacacatctggactattgagacacatccatggcaacatgaatgacagaaacctgattatgggagagaactgaccaaagtttgggaactccagcatagctgagagagtgttcttctgttcttctgaagtagctccaagtgactccaaagccacacacatttggttttagccttgagtctgctactgtatcagtggagtgatcttggacagatgtctcagagtgcctgggctctatcgtcgtcacttgtaaaatggggctgatagtacttgccttgaaggattagagagagcacacgttaaatgcctgttactgcttgatattaagtaagtgggagacattgtttctgtgacatagtcatgtgatggtagattcccagaataactttatgtgcaaagggatctgcttcaaaggggatggggcaattgactgtgaaaattactatagaagcccaattgtggtgcttggatgaatcccccatagactaaagggacagcttgggtttgagttcactggatgaggggctgtgtgctttacttgactagacctaatctgcacctgagt

SEQ ID NO: 99025 - DNA, 1401 bp, Homo sapiens
atcatgttgaatctctttccatggaggtctgtttggctggcgtttcttcttgcttcagactggaatgccgattagccagtttcttggaatgattttaatctctcatctctccagcccatccatttgaagtaactaataggaccacaatgtcactgcatgagctcaccctttccttgctcaagaacaacgataatacttgtcagtgattgcaacagtggaggacagtgttggtgccagcgttccagtgactatttcaaggattaattttagtgtttctagaaagaagtagttcaaaagtcaggaaaaataaatgaaaataaatcttaaacagatttctaatagaaaaaaaaaacacataaacatattgcaaatcacccatctagttaccattcgctctcttgtgtcctttccctttctcgtgtctccttggaagtcaccaccttctgaggtcttagtcaacagacttcagactcttcctgctgttttgctcccttgagtgcaaactttcaggaccacagcctgtgggcagctcctctgctctgcctcaggctctgagtagagtagctgtggttttgattgatttctcctcctgaatctgccttacttttccttttctccagtggagagactcactgcttctgagagctcctcccgccacaggggtcaaacttttgatggcttttgaggggctggagggagagagctgtacttgtaggaactgagtggtgaagaggagcagagaagcctagagagagggtgggagagaggaggaaacactggagagggacaagaaaggggacaaaaagctgttgatcagaggctgagataatagtatcacaactgttatttcagtactcaaaataaagcatgatgcatttgattaccaggatttagaaaactggacttgtagtcactaatgatgtaagaattgctattaatatttatgaagggagtttttatatttaatatttagcatcaggcaccatgctaggtgctctgaaaacgccatggtctttcacaataggtccttgtttgatggtcagtggctatcagaaactccagacttacctactacttacttacctaacctcctgttagctttctcttcagttaaagagatgggtatatttctagtaggcaaatggccccccattctcaccctaatacctgaaatttgagaacattccatacattagtttcccttactgctctaataaattatcacacatttattggcttaaaatgatacagatttatgattttactgattttgaagtcagaagccccaaatggatcttactgggctgaaatcaaggtgttgttagggctgagttacttctggaggcctagggaagatgctgttttcttgcctttttaagctaccagaagtttccctgctca

SEQ ID NO: 99026 - DNA, 1982 bp, Homo sapiens
gcaaattcttggcccctcccgctagcttactaaatctgaaactctgggagtgcagcccagcaatctgtgctttaacaagctttcccagagattctgaggctctatgaagtttgagaacttgttctctatagtaagaaaaaacttaaatcatttttttctcatccttttggttatttgacaacaaaggtaaagcagaatctaagagttcttggtggtgatagtagcggggtgttgaataaaccacttttcaaattaagtgatgtattttaaatagtaacaataattagtggtaatatctttacaatattcttgaggtcattactaatgctattgctgtgttactgtgaggaaacaggtttaggaaagaaggtagccaaagtcaaggtgtttagtagtggagccttgatgatgatgctggtttgaccaatactagcacccatgctgcagcccacttggtaatgctctctgagatgcctggtaatgcctgtctcctcttatccctgcccatgtcttccctgtgaggccagagacttactcgtttctttttaaaaatgcaagaggtggagtgaaagttcgtgtctttgtagattaactctggcctttcttactcatttgtagactatcccacctcccaaactagtagccaaagctaccttgatcaaggagagggaatgctgtactttattcgtaaggcaaacaaatgtttatggcctcttttcttataagtactgtacgctaatcgattgcgctgctagagccactatggcctcttttctttcaaaagtttctctctttctggaagtagtgaattcactgaccaatttatctttgggctctggcctgcggtttttgaaactttccaagatcaactgagcgatgatatggtttggcattttaaactgcgaatatagtataaagttggatgattttgagagcaattcatgctcgaatgaagtctttatcccactgagttatggtctccaacccaacccctttaaaaaactttgttggatgattagaggcaggctttccaattccactcatgacaattgagggattcatttgcactccaagatatatttattttcttgaccaccaaggaaatataatgttttaaagaagtaaggcaattcatattaaatggaaaggaactatctaaattgaaacttaatggggtcatattttaacataaaagtgaaaacttaaagtaaccttcagagttactaattagtttgatactagctccactttttctaccatgtagatttcatttagtagaggagagtaaaagaagaacattaattaaaattggaatgattaattttgttatgtgtctgtgtaaattaattccagtgtcagtataaattaactccagtgttagtaattccatagacttcctttccatggtttgcttcaataattgagaatttatcagtcattctgatatcagaattcaaataagtatttatacgtgcttgtgtgtatggggcgggtaaaggacatgaaaatgtatagatatttaagaaatgtcacttttactccaatttcttatttatgttaggatagccttcaattttaagcaaaacacctatttagaatgtttctccttcatctccttctctacctaggtccctttcccttttctcacaccacttataattagaagcaagtgaacagctttgcacttggcagagattaaaaaacctttttttttctgttgtacaaggtgatttttgtgcaaacaattgctatctcttccatcaaaacagtgttctctctagagaataatgcttgttaggtcagtttggtgtggcaatatttataggggatacgcttgaatgactgaaaattgtaagtggagatgttcacataacatttgtttgcttctcttgtccaccaaagtaattcataactgtagatatctttttatgtgttgactgcctcgttctacaacactgacaggtgttggtgactgcatattt

SEQ ID NO: 99027 - DNA, 1026 bp, Homo sapiens
atgcagttcttattatatggagtgagctgagtcatagcaagtgctgtgagttttgattttagctggcctctaattaggcagaacaggaaaactctattttagttgttggattaaatatttttccacctcatgatctagaggtagaggtctctgactttaaaaatagctatttactagccaggcatggtggctcccacctgtaatctcagctacttggaaggccaaggccagaggatcatttgagtttcaggagcttgagaaaagcctgggtgaaataatgatgtagtgagatcccatctcaaaaacaaaaacaaaaacaaaaacaaaaacaaaaacactgatttactgagtgatagctctgtacctgatgctgtgcttaagaggtactgtgttactagttactagttactagtattttacaagggagaaaaagggtacttatagaggtttatgaatttgtcaaaagtggtgaagatgggagcaagacagttctgtattatatgtaagcattttgttatatgtgagttttgaaaaaaggtaacttttgtaagaaagcaggtgaaaaaatgaaaagattctattttaacttcagcagagaagtggttaggtgctttgcttcttatttggtgatctaggttgattattataacttttctgaccatatgggggaaaataaagcttgatttacaatgctgagaatttgtactacctaataactcactaacttttcaggaaaggatatagtttgagtagctttcagaattataaagaaagaattggacctcttaaaaacctgtgctctcataaagaatactttttcattctgttttatttgtgcaacaatcagatttctgtggctaggttaatagtgttttataggcttttctgggtaaaataaatttttctgttggactgagggcaaaatggaaacagacctagcctaccaaactgtaaaagtcaagcctccacatgttaaaggtgattagccagtaatttaactgctttttaaaacacaaatcaatagtc

SEQ ID NO: 99028 - DNA, 1705 bp, Homo sapiens
aagtacctgtcacaatttggtctgcaaaatgaaacaaacagagcacgaaaaacagcccaacaaccaacgaaactacagccaaaatgaaggatgcaggataaaacatgacttaaacattcccttggcctaagtgaacgtggtataatgggaacagggtagaactaggaattgggaaattttcagggaagttttagccctactaagtactgtctttataactttgggcaagttacacaaacttctgagcctcaatttccccattcagcaaaatgagtctaataaaatctacctcattagcttcttctgagtgtgaaatgagataatatatgtaaaaatgtttcataaactataaaatacgttcaagtattttttatcagtctgctgataaaaggtgtggcatagctgccccagacccccagtgctaattgtcttggtaagcagcactgtaatttgcactctaagtaatagtaagtgttaagaatttgtaagaatttttaatgtaatgtgcacaaatctattctgattaaaacaagtagcatcttcataccttcaggattataattgttgttagtaaaggctgatgagagggaaggaaagtaggcaaggcaatacaagttgcctttttcacttgaacttgggaatgaggagtaagaagcacttgagcttatatccaccactgcatcttttaccaggaggcttggagtgttacaagaagcatcattttcatcttggccttgtttgggagtagggaggcacatggccaagagacaagctttatgaagtcatgtgctccaaagggaacacaggaaaaagggagtgcaagagacttagtcatgcagaagagtttcacacaacaggtgggcttttaagagtgttgtcaaggagaagatgcaaatgccttaattagtttggacagctcttttaagtgtaaagaaaaacatgtctactggtggagatgggctttgcaacacaacagacctgtgtgtgcgattttgatcttaggcaactgaaaagcaagtaacgctccctttctattacctgaagcttctgcttatggagttttgaagttctccaggatggtttttctatttctctgagcactgaagtggctaatgccatggcagatgtcatacctaatgctgcagaggcagagcataaggtagggaggattttgtaggaaccttctgatgggaatccagagagcaaagcctgggacatgaagctctcaataaggaaatgggaaaggaagagtccatggttttacttttaacaaagtagggaattgcttttgcagattagataatatgtgaggattgtggcaatagaagaggtatcttgtgtttgtaataaatgcattatttggggggttacaaaataaaatcccaaaagaggagaagataattaactttcttatgagaggttacctaattttgactgagttgaaaggaagaaaaattaaaggattttaaaggattgaatctctctttctgtctcatttgctttctctctttttaaaatgaaatggttggcagagttggaattttggaaaatagggtcatgaatatttgttgatgaaaacagtcatgcttagtagctttgaggggactccctatagacagacttgattcctagttctagttttcacagctggttgcagttgtttggatgacgataagaatcagggatacttggttctgtatttgga

SEQ ID NO: 99029 - DNA, 1124 bp, Homo sapiens
agatgtgtgagttctggagctttcatactagccttgggcctctcactccaggctttgtttctgtgtgagagatggaaatgtctatgtcctttaaaccaatgttcttttgctttatctttcatttgcagctgaagctaatcctcaatgatacaccgtgctttctagaaatcatcattgttaaatttttgctcctctatggagctttgtattcagtttgccccatatgcacattaatgatagaagttttctggttttatttatattccctttctgttttccctgagtagaatttttcttattgtgatgtggattctgtttctgtacttgagttggtgggtcattgtctgtggctttggttatttttactgctgaggctaccttactttttttccatcatgataaaccttctccattttgcaaattgctaaattggtctgaaaagattgtgagaactggctttcttaggcgacttcttgtgctgaccaacccagctggagaccggatgtgcagaggtaagcacttggaataatcagaaaataggaaattttaactattcccagttgccagagacattttgcttcagttgaaggattggaggcaggtttttataatgctggccttgcctagtgagttttgttgagcaaatctttgtactttttggaatccactcatgtttttatttgttccgtggatggttcttcctctgcaactatttattgccactaaagtttgcggcacagtcagtcccacagataataaatgggtgtgtgtgcccacagctcaacatgaatagagtgactgacttccagcttgtttattgttagacgggtatgtaaccaaggaagcctaactcttcaattatgtgtatgtgtgtttctgtgtagtgaaatatgggcctgaaaatggaccttgcagggatattgcatgatattccattatttcctttacagcaattatttttcaaatgttacgtgaatgaggatggtatttacttgcataatttcatagttatgttatttcatgacctgaatgccagcagctccgcagtttgaagcatcatttccttctggtaggctggctgtattggctccctggctaatatgaatttgaaagataattgataa

SEQ ID NO: 99030 - DNA, 1041 bp, Homo sapiens
ctcctttctgagctgtatcctctccctctcctttcaattcagtgttactccaatattttttctttctgcttaagtcagccagagttggtgtctgttgcttgcaaccatagaactgaatgatatacaggtaacatttcccttgaaccaattgatgttcagtcttcaaattctgtttcacaaaaggtgatatgtggggcagagcatatgtctggggaaaagtgaaggagccatgcttgaaagctctgtaaaataccagaaacctatggacgcacagtgtccttgtatatgggtacccttccgtgtaaaaactgtgcatgcttaactgggagatggagaaagggtgcaatttttttttttttttttttgcttggaatttcttttaagcacatacccttactttattaagtgactttgaatgaagataatcctcattttaccgtagtactggcccacagcttccaggttctggcccatctttggagaaaggttttttggtccttgttgtttataagggtgtagtcctgctattggcatctcctataaatcttaagatttttataacttggatgtcactctcaccttcctgccaaattgctgcactgaaaaagcagagtgtcattttaagtaatgatgcttttactgcatccaaaacaaataaagtaattttggtacacattatgaaacaaatccctcttatctctgagcctagagtggaaatagtgtcagggatgcaaatagctgctttggccaaaatagtcaaagaagacatggccttagtctgtctgagcttcatttcttaagaaacatttgtagttgttggttaaaaatgtgaatggctctgtaagttcactctaggacaatgtggattctttagcccagaaagttaaatacctccaactttggcagtcctgaccttctgggtagagaatatagttccccagttttcaagacctgctttgctactttgatttaacacaaggcagaaatcttcaaaacaaagccctctggatccaggaaagttcatctggcattagttagctt

SEQ ID NO: 99031 - DNA, 1056 bp, Homo sapiens
gtcggaggggcaaaggatgtgcacacaaagaaagagagagaaatggtaggctagaggaagtcacacgagcagttagcactgtccctggcacatgaatgctccaccataattatctataagatatggaatgcagtggttggatactaatacattattacttggagccaagacatcacatgctcaccctgctcaggtgttgaatgctttggtggattatctgactcagttggaaaaacaatgccctttagaggaagagcttggacactttgagggatcataaaagcagatctaaagccacaggggtgagcagtttgggggaaatggggataatgagaatatttctttagattacaagtcagaccacttgtaacccattcagactgttaaacagtggaaagaccatgggtttttaaattaggcacccatagttacaaatcttggctgcttcacttattaggagttatttcagagcctctgatatgtattttgtgtttgtattttctcaacttaaaaataaggataatattataacacttagctcctggttgccgtgaatgttaattgagatatggactacaaagagcgtagcttagtatccggcacatctttgggagtcagataaatactaatatcttcccctatttcagatccaagggtaccctaggaataaaagcatagaactttacagccatgtgaataatagaggtttgctgtttcccaaagtgtgtcccatgaattcagtgtgttgctcataagtcttgccacagaagtttcagtctttaaataatttggggaagccttagatgaaacaaagtcaggctgattacttagtgcaagacttcttgtagcatttaagatgccagtgccctgggagtttccaagtgaaggaagaagacagctttagctcctttgtaaagaagcattccattgtccagggtgcttcaatacttgaactcctttaggttgacaaactgtgggcctgaggtttggctttagcttgcagaaatatttccttcggctccttcaatatataaaatctttacaaattcatttcca

SEQ ID NO: 99032 - DNA, 1009 bp, Homo sapiens
tcgctttggagatgaaacttatgggctggaatgtgaaacacagttactttgaggtggacctcagtgaaacttttccagacaggctgagaccaagggaagactagtattaaggattttatcctcaaaacaaactaggttgtcagagtccctgtaggctctctgggtagcagcctctgtgatttgcctcttcctgactaggaaaacctgtaagctgacaaagaagtatatttaaattgacctccaggtgagcctcatggtatgtcaggttgattatttgtacctggtttggtgttttgttttgttttttacttgataactgtataaattattttagtgaagagcctgttcttattctggaactcactttgaagacaaaaaaaaaaaaagtcagccatgtcataatacttattttcttgggcaagcttgtctttttttgatacagccaggaaggcacaaatgtttccagtccctctgagacgaaggcagggagcctgtccaactgcagaactgctctgtcagtgtctctttctgagagtgaagagtcattctggtcttaaaatgctgttttgcttttcattctcttctctagaaggaatatcccctgtgtccatgggagcaggaggggaatggacagttaccaggggaaaggagctgcataattgttagatccatcctaatcctttcatgacaaacctttcctcagagttgctttatagttgtgggtctgagaataaattcacagattcacccactgcatgctttgatggtttcacgtcaggaatgggcctacttttcctcaggtgagagcggaatcctgctgtacaagccacctgtaatgtgggcagtggcaactgctgtttcctttccaagtcttctgaggttgtttcctagtaagtgagctggaggctatggggcctggtcctggtggtagctattttgcttttggacataaaatcttggtagcttaatgtatttgttcctagggctgcaatagcaaagtaccacaaac

SEQ ID NO: 99033 - DNA, 2111 bp, Homo sapiens
gttgagtttagatctaagctcctgtcttctcttctgtccatctttcttgtccatctactacgtcccaagtactatgctgggtgtgggtgaagggtgagaagaagggcatagttgtaaacttagaggactcacggtcctattccttattgttcaaagttggacttaatatatatttcctagtatgattgtaactttcagtgtttctgttcatatgaagaagatccctagctagctcagctttataagccagaaccagtatgttaatgacctgctcactgtccacttgtctctgtctcctcacttggggaagctccttttattctcaatgtataggaaagtgcgacgcacagaatgcaattgtctttacagttgggggtgaagatgatggaggttcatatatgatagtgggtgttagggtatgggtgagctgggctgggacttgggggccacataccttgtggcccttgatcacttgggtccctgttttagagaggcctgggtgtgactatcctgaaaatggtctgagttgacatacctcttatatctcctttagtttctgccaggcggtggtctccaggtcaggatgaagtgttagttctctcatgttataaatgtagtaagggaagtcgtgctgaagttgactattgggaaatttcatgtatactactgagttgagagtccactcctccaaaagaaattttagataagtgaagccgttctagaagccatcaaatgcatgtttgctcccaactatccacagctagaaggttatatagcgtggcaagtattctcaaacagggcacagagaaggggtgctgtggtcagggtcccagaagcaacatttccttccactccagcagtgctgctagcagactctcatttaattgggttttattggtgatttttacttttccagccatactcatttccaagtatggagaaaatcaagaaatgtcagctaccattcattgcaggcttatttagtagtagtgtcagtaataataacaatagcagccacctttttcttagtatttactgtgttcccagcactgacctgtcctcccaacagcctttggcagtagagctggggttcatagccagcagactggttgtagggtctgcactcctaagcactgtgcctcttgtgtcatggagcagacattttgttttatatgaaaagcatatttaatccttgagaaaattctaagggacagagattttgttgtctcatttttctggatgatgtaacaattctccagagactacagataacttttgcttgagttcattaactacacatcttccatctcacctttttctctgcagatgaagccccagcttgttcaggcagcagatggtcataccttggcctgagggtgggtgttctagcccagccatgataataatctcatactggtccaaggattgtcagagaccagtttttaaccattgggatatgagaggatatctactaaagatactttaccttcatgaataacaaataaagcttcttggggaaatagccttttcctccttttctgtcttcttgctgtcctgagcatagatgtgatgtctagcattgcagcagccatattgtgattctgcagcaatacatgacaagccttaaaaccagtccactaagaaggctagcatgataagatggaaggacttggatcagtaagcagcacctgaacctacctcctaacaaaagttatatgagaaaaatgtgaccccctttcatttgtttatgcccatatgtgaattgggacttctgttacatgtatctttgacattcctaaccaacacagctactaagggaccaaaattcagattcaaacccaagcctccatatgttattcattgttgaaggttgaattgtgttcccctaaaagatgtgttgaagtcttaacccctggtacctgtgaatgtagctttatttggaaataaggtttgtgcagatgtaagcaagttaagatgaggtcatattgaattagggtgaaccctagagccaatgactaatgtccttataaggagagatttgcagacacagaagcggcacagagaaggccattgtgaagatcaaggcagaaaccggagttatggcatcataa

SEQ ID NO: 99034 - DNA, 1043 bp, Homo sapiens
ggattaagaatgggaagatactagtaacctgcttttgtggtgcaggcactgtgtgtggcactgtgccgaggagctttattttaactatctggctcatttgcatcctgtaaccacttttatccgcattttagagagaaactgaaggccagagagtcgaagtgatttggccagcgttgagcagctagaaatgaactgagctggagtttgaaccagacagtttggttccaatccttacttcttaagcacttcaccatagtgcagaaggataagacaggcacagtgcaatgtacatgttggtgctgttgttattaataaatacagttagagcaatgactgttttgtgggctcagagaggctgctgtcctatttcttgctgaagcagtgggttgaccaaaggctactctgtttttggtggctcaaatctttggtggcacataagctgctgtctcctattgaagttaaaattcacaagtgccattgaagagcttttcagctgaagcacatagcatttatccaaactagagaccttgaaagccggtgattagggtggattgtgtacacattcattccaagtttagacaaaaaaaaaatggggagaaggagggaggaggttggagattttcagagcggttgcttagaaaaaagcaacagctattattacagaggcacaggtttctcactaaacccattctagattttgttgttgttttcatcaattgtagttgagtaagcacaaaacatcgggccctattgttcataaagaaaactaggagttgtcattaatccggggccttagtctccctcaggaataaaatgctatcttacatcattgagtctttctccaagtttgtcagcaaatctctttcaagcgatttgcaaaatcctagcctgggaacaaactctgtgccccttgcttaaccatggcctaatggctgtttcgtgttgactgtactgagttatcttggagtgttaggcaacttttgcattttgtttgatgttccagattaggtccctcccataccaatacccctccacactgaccc

SEQ ID NO: 99035 - DNA, 1071 bp, Homo sapiens
ttacagccccaagcacagtttctcagatgcagggagaggctaacctttgtctaggagtcctcatacagaggaacaacccgcagagggcattgcatttagcagaaacagatgccccacagctcctttccaaagctccctgggccatgatttgcggggagtgtgttcaatttatcagagcctgagacaccagaccagttccccagggtctcaagtagaataaacaagaaaacctgcatttagccttgcagatgaggaggtggatgaccaacctcctaaccccctccttgtcttactaagagaatatcagcactgggctctgaatgactgatagaaggtgatgtaaatatattttggcagtggcaccagataccagtggcgcatttgaagttctccttcggttaaaggcgtaacttctattccaaaggagcagaatgattgaggggagctggcaggtttcctgttcaagtgcagagggtagcttttggaagtccttagagagatgtgaccaaaattccttgaggtggcttttatggcctgatgatctgtacctctgaagagtttgtagatttttgactattcaagttcttcctaccggcctgtttcacttagggaatcctgtgcgctctggagcatgtgacccttggcaggtgggcgctctcgcttgccttcccatagagattgctcctcactagaaatgtctcccccttattttgtgaaatgtgcacgtgtgcattttggcgtgagcctggtttattgcagttggtgtttgcaatgcgtttattttatttcaaggtgtcatgttgaaagaacctgtttttaggcttttgaaagctcatataaacagggcttatcaccaataagaccgagtcactgttggaaggtccttaccaacagggggctcaacttcatgctgcccaaatttcgatgagtctcttttgaaagtacatacatctcaagccttgagattagagaagtgagacaaatgcggaaaaatttttttatatccgtggcttcttcccaaagagtattgcttgactctccttgaaaacacataatttatatgtttttact

SEQ ID NO: 99036 - DNA, 1021 bp, Homo sapiens
ggcgcgcggccgtgcccacaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcaggtaaggggcacccgggagccgggggccagcctggaggaggaggtgcccgggcagaggaacctagtttttgcttctgcctactttaggggatttgcccaaaaccatcttgtaagacgcatcgatggcaacatgatgctgtcggtttacccagcgccaggaacccggcaggggtatggggatgatgaaattgataaacgcacgggttcaggcgttacaacttttggcttggaggtgcttgtgtgcgtgttggttggtacatataaggttggactttctgactggcaatttagattgcattccactgacacaatgcagtggtctggggttaggatttttgaagccagatttttttttttttttttttttttttgtggtcaccaggaaagacagaacaagtgatatgtgaaagcatccatttgccaatataatgtggaaatatcaagcttggtttggcttggtcatggtatgctacttattttatttttccctattcattggttctctccctttatcttccttaaacccaagctccttcagatatttaagaatcaaaagtaggttcagccaggaatatttatgtcctgggttatcccatcaaaagttttttactgctgtctcctgaaatgccagactgccttgaattggattctggaagctggggatttgcgggaggcgattgaagagaaagagggacctttcccagaagaactccttcagtgacacgttgggccttgggattgccctggttgcaaggtttgaggactgccttttgctggca

SEQ ID NO: 99037 - DNA, 1035 bp, Homo sapiens
ataaaaataaacataactgatgaccaaaggtattttcctgtttctatgcaacagagcagaggagttccttctgtgtctttgggagacaaacttggttgctgtaaccagatttacacaaatactctttaaaagtttattgccgagagcctaatgttctacattccggattaagagaatatacttacatttggcttatttccatgttactacagttcatttctttatggttttccttcatgaccactgccttgttaatatttatagtattttgcagaaagaaagagttgatagaactttttaccaagtgtgttgttcttccctctgtgcctcaacttctttcctgctgtgttgccaccaaatttcgactcttctggcctctctttacttatctgtcctgtttaccctaaatatgttacttccaaatatgttatttgcctgatgccacgcattggggtaaatatctaaattagccttttgtttaacattgcccgcttctcggggagcatcggaggtgctcattagtgtcctgaatgattcatttgctggatgtttcgtattttcaaagagtcaaattcattgctccagtcacatttccatgaaacagttatggcttgcctgtcttaagtatgggatatatatgtatctttaaacttgctgttgcttagatgtgatggccgatctcagggtgagagccaaaccagatctctggggtgtggcttctgtgttaggaagctgctgaaggtcaccatttcctttggtgaaagcccctttgtgctgcttttaaggattttccccatgttgcctcctgtcctcaggcatagttctcctctgttctgcacagtggacttctaccctgcagctcactgccggccccatccccactgggggtgcaaccctctcccacccccattctgtctgagcctcagacccccaaacttagctcatttctaaggcctcactgaaatccccctcttctggagtggtttatgtagaaaatggccagttaaaattctattcagcatgcattctcagatc

SEQ ID NO: 99038 - DNA, 1028 bp, Homo sapiens
tgcatatgctgagaagttccagtgcaaaactaaagattatttttaaaaagaattctttggaaaactagatattctaaaatatcgaagtcatttgacatctctggggtgaagtaatacaaaggaaaaggagaaatgcagtagctacagcgactttagacagcttcaattcggcacttccaagtggtacaaaaagcgaacagttatttcaagcacccaaaagctctgcaaagagaaagctctaaatagtcagaatgcagaacagcttaagtgttactccagggatagtatatgctttgagttaaatacaagacaattaatttgcacaatggatagatgattcaaaatcatggagctaattactttgaacttgtaacttacataatgtagttgcttttattgagcatctactaggtaccacatactgcgctagactcctgggttgcaaacatgatcctggtacagtcccgtatctaggttaatgggaaagcaacagcatcaataaacagaaagagaaaaagacaaacataagaatgaagaactcagtgcctccccagtacactaaaatgacaacactaaattttatggagcacttaatacatttctaactgtggctggctcctttattttttttcagtataaaaaggctaatgataggctaatgatataaaagtgtatattcctatttctttagttgttttctccttataaatgtgcatcatgacctttgtggaacggttagaacctttagagaaataaaaagaaagtaagtcacttgtaacctcccgaatcacagatgattatctttaaccatttccctcataatattattcacatgtatatgcaaatatgtcatagatttcaagtatatttacatatacaattttatactctgccttttcccttaaaattcttatgaggatctctgcatgtcatcacatatcatacaaaaattgcttttcaatcattgactgacagttcgtcatccagatatattgtaattcattgaacatttattgtgttgtcacttc

SEQ ID NO: 99039 - DNA, 1021 bp, Homo sapiens
tgatgaaataatctgtacaaaaaaacaccgtgacccaagtttacctatgtaacaaacctgcacgtgtcctcctgaacttaaaaaaattctcagtcacttaaggagcacatttacatttccttaaaagaagtcaatgaagaatgtcacctctactaaaagatgggccagagcacagtccaactactttgagttctgtctatacacatatgaggtatgtgtatacctaacttacaagcacaggtataataaatacagtaagatgtagacaaaatatagcagttatattctattaacataatataataatagtatctaaaatatctgtgcctatatacatacatggcagtcattgatgaagaaaactgcagccgccagcgtgctctgcagtttcaaagctaaacaagtaacattatgcatacataatatataatgtaaggtatagagtacaggttatcctattaaacaatagtaaaattttggctcttggagggatcacagagattctttaggtcagttgtttttcacctggaatctgtgactgcttttgaacatcatcaaattggacataaacgtcagagtttaggtggagagccttcataacttccatcagactctcaagatggtgagtttaagaaaggctcatggagaccagatctcagaggtagcaaaatggaggctaagagcggtacccgatttattcaaggtcatactgtttttgtctgcccgggtccaggtcctacagttcagatcttgagaccaaaaatatttatatcatagtaaggttaaattaggtcaaatggttttgtcctatataaatattaaatgtttatgaatatgcagagttggggacttgcttgctagtgaatggagtggggagtcattctttttgcacttcttttagtaatttgtagatgtgtctatggttaagtattgaaatctgtttaaagaaaggtttaatagctaaaaaactgagttcctctgtgtagccccatttccaatgtttactgaagtctaatgtttt

SEQ ID NO: 99040 - DNA, 1052 bp, Homo sapiens
taattatgcttggagtccctctttactgggtttgagttaggtgcataacatggaaaggagtggtgccttcaaatgaatgtgaccactccgtattgtggagtgacttccctagggcatcctatacatcctaccacagaaggccaagggacagagcaccaacttcagtatccaagaaattagatccacaactcttgattttccacactgaggactgtcgcgagtaagttgtaagtttgccgtcttccttctggcttagcaggtgctgcagctgtactctcgactcctgtctgtgagcgtgagctcaggaaatgagagtggagtctattccaaaaaaaaaatgtgatgaagtttttcataaaagtgcattcatatgccaaatcctttttggaggattctggatgctattgttcatttctctactagtaaaatgatcaagccttcatttattttaggctttgttttttgatccattttgttttccctgctgtaatgagaataattgtttggaaatgtcatattctgtatttatgattctctgagaaatgcttttgtataagtcttaggtttgacattgcagtagttgacatacacggtaaaggataacctagtgacaaatcactgaagatgcttcctttgttacctcaaaaaaaaaaatccagacaaaatagcatttataaatatagaaaacaggattggctgttttccaagaacttcaagttaacaattcttatgcaaggaaaagttcttaatgctaaagacttgttctgcatgaaggagacattctttaataatggaagaggtggttttatttttactacaagccgactcatatttccaaacctataaccaattgctgatctcctgtgtaaagcatttttttccttttatctgaaacagtgatttatatgaactgttggaataatggaacctcaaactacagatgtgtatgtaaaattgcataaatgcactgacttccttctccctgactatatttttaataaacagcattatcctacatggtcagttttattaaattatacacaactagaggg

SEQ ID NO: 99041 - DNA, 2554 bp, Homo sapiens
gcttcagcctcctgtgtagctgggactacaggcacaacacagcaccatgtctggctaatttttgtatttttgtagagatagggtttctccatgtttcccaggctggtctgaaactctcaagcgactggctcacctcggcctcccagagtgctgggattacgggcgtgaaccactgtgggtattccattttaaaaatcagaagacataaagaactgttgcctccatgttatacagcgagtttttaaatgataaattaaagcaggttccttgcacttaatgtatattgaatgtgcaattgccaagcaagaaagaatatcttgtgtgtaatattgtacggcaaagcagtggaatgttttctgatagctgatgttttttaaaaacttaagttccttgtctttctttttctcttaatcaggattccggagtttgaatccacctttgacaattgtccgaaagacgtttgaatcaacagaaaacccagatgacttcttgccctctgtaatgacttgtgtgaactatcttaagttgccggactattcaagcattgagataatgcgtgaaaaactgttgatagcagcaagagaagggcagcagtcgttccatctttcctgatcatagcaagaaatgcagtgtctgcctgttacagcaaaagaaacaaatcatgatttcttttctaatgttatcacctgagtcaaggaaacatgttacgccttcttgttgtaggaaaaacggcttgcagattataaagagacatttggttgatattcattaatggccccatggacttaaagtgatcaggccctaaaacgttgttgtgatgaggtttctttagcaagttcttgtttaaattatcatttatttgatgagtgaagtttttaacatgctttgctgtgtgaaatttaaaaaagggatgtttttccaggctggaacaataaatgtggctgtgcagtttaattctgggctgtgtgtatccatctagctaagtctgcagttttctttcctccaaagacaactcttgtacataagtacagaaatttaagctcacatgtatttgacaaatatagtttagtagactagctctatgtgcttttcactttcctctgattttctctccctgattcattattatctgtgcagctcacagttttttttttgtatacaactcacagttctcaaattttcgttacccatgggcttctgttgtcccatgttctctccagttaagatctaatttaaaattcattggattgaaatttattgaatataattcagcttttgtaactaggtagacttttcttatagtttagttttaatatagtttagggtattactggctttttcccaggtgacacactaaggactgtttacatggcaattccagcagcaacagcctctggaatgagacaaggaaagctcatttgtttcttttatgaaggttaagaagtctacagcttgggctggccggtatttattattctgtggccagaggattttaaattaatgtaaattttttaaacaaaataagcagttttccttccctgttggagtaaaaaaatttttttccctttgttgttttacgtttttgttcatagtcttctttattccacgctcctcttccccttctcccagtgctgacttgggacaaaacagttcagcctttgtctcgacgcagataaaagcacctgtaagcaatgctgtccagtcattttatgtgctgatttctcaaatctgcaataatccatcaggttaatgtttttacctgaaaataaagaaagtttgcttcacctttttgtttatagttttgtgctgtatgcataactttcaattgtatagatgtatttcaatgcaaggaaatccacatatctccatgattcgggtcatggctgattttgctattcaaacaatttataatagcaacttgaagaaactaaaatgtgaagagaaaatgggaggagattccttcctaaggtccaaaactaggcctgtggcataaatttgaaggaattttccataattcatctccttgaaaataagagatgagctagtttttttttttaattgaactttgagaaatcaatttttttgactgttctgtaagttttaattaattgacacaaaagcccttttccctatcccaccacccaaaagaaactcagtggcttgtttgacatagattgctgtgtcaatttacacttaaatggccttatatggaaatgtcccctcctgagagttcacttgggcagtgaccccattaagtggaagggaactgtcagaggagttgggggcagagaattctctccctgtctctgcagagactgacaagtgaatggcttttccctgaaatccaagaagggaattgtgtttctgcagttttcaccactaacagcacagttgctgagcagcttcatcaagtgaagttaaagactgaaacaatttgttttcaactgttctgatatcttcctgcaaattaagcacaaggatttttgtgtgaacatagcattttgttcctgatttttaaagggttctgttaaaatttagacatgtataaacaaaa

SEQ ID NO: 99042 - DNA, 1069 bp, Homo sapiens
gttcagcttgcttctcccacttctttctccagctcaatgttctctcccttggcatctgttactgtatacctttgtgtttctgaaagccaggatttataaaatctccctgactagaagcagattatccatttaaagcacctaaagtaatgagaagaaaggaaaactgaaatcaagggtcatcaggtgtttttggtttgagaggaagggtttctcaggaaccaagtccctgcagatgggcagggtacttaatagcgtacagctaaaaaggaaatggaatctctaaattttattttattttattattatttttttttttttggaaagaggtcccaagcagaaggttttagtactgagactgatactcttttatggtacacgtagacctttattttcactcacgtaaacaaatgtttccttagtaattctttttacccttatttaaactcacagctggatcagctcctttgtggcagtaaagcagacacttgggatgcaaagacactgatggaatgctgtaggcctgatcatggttatactcatgacaggtaagtactggggtctgccagtttttctgttgattctgaagaatgtggagaggggtgtgtgtgtacacacacatgcgcacatgtgtaaacaacaaaagttggagtggttcattttaaaatgtgtctacctgttaatggatgcttacttctgttttggccttatttctctgaagatgggaaattaagacccaagggtttctttctcaagtatttctgtgaaaatactaggggttggggaagacagatttaatcttgttccccattattacatatagtaaagcagaaatatctgtacagtaccagatcaagtcttacttattacaactgtaatcattccatttgaattctagtctagtcataacagaaacgaatttaagtacattgtaatggaaaatgtatgtgtaatttaaaagtgctaatctaatttttatgtcatgtgatgcgatgcagtgtgattaaaactctattttaacctgatgaaataattttggtatatttatttctgttatagtcgggctgtgaag

SEQ ID NO: 99043 - DNA, 1674 bp, Homo sapiens
atcccaacacttttggaggccaaggcgggcggatcacgaggtcaggagttcaagaccagcctgacaaacatcgtgaaaccccgtctctactaaaaatacaaaaattagccaggcgtggtggtgcacgcctgtagtcccagctactcgggaggctgaggcaagagaattgcttgaacccaggaggcggaggttgcagtgagtcaggatcatgccactgcactccagcctaggcgacagagcgagactctgtctcaaaaataataataataaccagagtcccctgttacttaacagttctgtgattcataagtaattccttttagtattcagtaggactgtcttcttatcctgtttcttctactgactttgtgaaagctattcttccatcttactagcaaataatgagttaacatttagattaaggttatctcaaaataatttatactaatgcttataattttctatcaagaaaatcctaatgttttcatttttatctgaaaatgttgtttctctacccattgggctacccaaagtcagtgatgactagataatgttggaccaataagagttgctttttcttacccttcaattgcatgtgacttcatttccaggctttgcctacttttagtaggaagcacacactgcagacaggttgggttctaagaacttcacaggatttagaactaaacattttacgttaaaaattaaaaacccttaatagtggctaattgtgattcttcaaacattacctttaattctcaataacattttatcctcttgggaaattctcatttgattcccatccagtgaggtaatataactgtatggcatgggtttcacataaatagatttttaaaacacactaaatgtaaatgcacatggcattttttttttacattttgttattggtaggggccccacattagatgttgacctgatgttttactcatgtagttttctagcagattattttaaagtcttaataacttgtttgttctttataaagtgatccagaagggtgtttcactgtactttgccacatattaaatagtaaagagatttgaaatcttgtcacagttttttgaaaactttctttttgcagctggttatattctgggcactaaatgaaggcgtttctaggcaatttgattcgttcagagatggatttgaatcagtcttcccactcagtcatcttcagtacttctacccggaggaagtgagtagcttatatctaaaagaaatggtcatacctataattttagtggagtgtttctgtgctgcctagtcaaagaccgtattgttgcacaaaaacaaaaaaatgggtgttagatagcaggggatggatgtttgggaaagacaaggaaattgcctgagcaaggaagaatgttaaataggtgtcccctcttagattggggagcgggttccacgcgtgacagtaagcatagcatctttgtcagccaagaccctcaatgccattcagtggagaatggggacttgtgctgtgtgtggcatgttctacatgtttctgtactgctgtggaagcaaagagagacatggagggggcttgactttattccttaactaaacttcgtttcgatgagacattgtttcacaatcaaagttagtccttgaagttttaagaaagtattataaattatctaattgccaaataca

SEQ ID NO: 99044 - DNA, 1004 bp, Homo sapiens
ttgagctttgcaggggtagaaagttaatcactatcactagatagtatgttttttatatttacgatttcccaactgtattattagtattggctgtatacttatacagtattggattcaaaattagcctagaatttatgaaaagtttgtctagttctagggtccacattcttaaaattaactaatatgcaacctattatgcacttactgtgaaatttgatttgcatatgcttaaactgagcagcagcatctcataatgaagaagcacttcagctctcttttcttatgcttacttcctttgtaatctcagtgactctttcatatgtagattatgaccaggaaaaaaataaagaggctaagagttgaacccatcagctttattaggatagcttatattttattaggatatcttttatttttttaaacaaccgtaagttaattttgcttgacaccatttctcccccatttgtgttttttagaccaaagagagtctacagtatgcattagaaaccttgactatgaatggctgctcagttgaagatctaggactggatttcactctgccagggtttcccaatatcgaactgaagaaaggagggaaggatataccagtcactatccacaatttagaggagtatctaagagtatgtaactgtgtctttggggggtaggccagttgtgaagacggaggactttgcctgattgtaccttgcttctggctgcacacgctatggcttgagaccttccacatccccaggaccactgcatgaaggctgctttacaaggcactagcttctctttgctcttgagtgcacatatcagatatttcctgtcttatataaccttgaattatttctcctcaggcttgaatgctatctaattacaccacgttttcttagtttaaaaaacaagtgaaaagagacattatttgtgttctcactaaattgcatttttgcatttccatcaaggcagctagcttgacagaatttactccaggcaccgtgcag

SEQ ID NO: 99045 - DNA, 1780 bp, Homo sapiens
cttgggtctttggagaggtgaagaagtaactcttagcaatccaaaaggtaatgcctatctgtaagttagttggtttgtgttactcagatcaggtaatggactctgacagtttattagacatatttaatttctaatggacagctgtacttgctttcttttagcctctgttttctcatttatcaaatagggaaggcctgtccagttctagaggacttcattcagtgatctgcactccaattttgagaatgcttaatttcttaaatgttcttagttaccaggttttgttttgtttttggaaacatcatctgaagtttgctgcattgcttgtttttcagggagccaagaagggaccaagtatattcaaaacctccagggcctgtttgcgcttccctttggtaggacagcaaagccagctcatatcgcaaaggttaagatgaagtttcgcttcttaggaaaattaatggccaaggctatcatggatttcagattggtaagtttaggatggtttgctttttgcagttttggtgtagaatgttctgtgcaagtacctcagtcccctgtagtttactgctatagtttagagcaatgcttctcaaacttcaatacacatatgaattacttggggattttgttaaaaatgccggttctgattcagtagggcaggggtaagactgtcctactgtccaagattctaaattttcctgtcagctcccagggcatgcccgattgccaggttgtggacccctccttggatagcaagggttcagataatcaggcaagttaaggtggtattaattatttattttttaaagtctgacattacctttttaattcagtaggaaagtttgtgcatgtaactaaacttcattaaatttacattagagtgctgttgtgaaaataacccgagtgatcagtattcatagaggttggaatgtttctggacatttcttcatttctttttctcttgaacttctggcctcaagcagtcctctcacattggcctcccacagcactggaattacaggcatgagccaccgtgctcttctcatgttttcggaggcactttatcagtatgtttaagacattttcacctgtggccaaattgacaagtttacaatttcactttaactgaagagtgggcagtttatcagttattttagaagttccatttagttttctattttaaatatagtaagttttttcccttaacattttttgcattgggatattcagtaatacagactacagtggaaatgcatttagagccccaaatcaagagaatcaattttgtgtagtgggagaaatagtttgtaactacagaattttctttcttggggattacttgacctattaatatttaaatgatctcctgaagtgccttagatggaggtaatgctggaagttcagtgtgacagtgaaaatattatgcatattccatttcaggtggaccttccccttggcttacccttttataaatggatgctacggcaagaaacttcactgacatcacacgatttgtttgacatcgacccagttgtagccagatcagtttatcacctagaagacattgtcagacagaagaaaagacttgaacaagataaatcccaggtaggcttagaagaaacagtccagtagatcaagtctttattttagaaaaatgaggcttttgttaaatagtttgtatttgactcagttgttatattaatgttttattttagaagattttaattcttttattgtactaactaagacatatgatttcacagtgggtcacatgacc

SEQ ID NO: 99046 - DNA, 2422 bp, Homo sapiens
acataattagtgcagctgcctcctcatgttgttagaatgataaaatgagctgcaatgtgtgaaacactcagaccattgtcacataataagtgccagtatgtgttagttttgagagaaaaagattccattttaagtcaagttgtcaaacttttgtttttctgtttctggggttttatgctttcctttcctttaaaaagaaaaatgaagctcaaccaagtacctacacttttagtggtgtagttgggtagaatgataatccctgaagagatcaggttactctgtgggggtgctggccacccccaggttgtatcagcaaagcaaacatgacctgggccttccaccttctgcagaggctcacagaggaagtgcttttagtgatttaatattttaagaatccttttagaaacaacagcattggatgaaggaaatagactaatttgatctgtgacttctgttgaacctgggataatgttatgccaaaaggagaattgactagcaccatctagtggataccatgtgttactgcaggtttttctttgcttctcttttgttcctcaggcctctagtgcttgggattcagtgcagaacagaatatacaaagtactcccacccccatgatggagcttatcttttagtttggggaggccaatacatacacacacattcatgtacacatatatgttaggccatgtggaagaaaagtaaaaataagaggatgaagcattatggggatgcgtagggcagtctgaggacatttgagtggaggcaagtcattgcgtctgggggaagagtatctctagcacaagaacagagaagcagtgttcctagcctgttggaggatgagtgtggctcgagcatagagagcaagggcagagtagtaggagtcagagagactgagcagggtgggcagaggggtcatgtaggccgtggtaagaactggagctgtgctttgaatgagatggaaaacctttggaaagtagcaaagggatgccgcgaacttgtgttttgtaaggattacgcttgctcctgtgagaatgggatacaagatgtcgggaatgctagtgcagagaccatctaggaggctttagcagtggaccagatgacagagaatggcagctgggtaaagttggtaattagtttagaatgcattttgaaggcagcgcttattgtatttactctgatggattggattatgcgagtttaaagaatggccaaggacggctctaaggatttggtgggattattcattttgggtttaatggtgataccatttactggtgtggaattctaataggattggggttaatcaggaaagcaccactaggcccaagcagatctctgttttgagagagttaaacgtttagtggactacctctaaacttttaagctagtgtgggtaatttttaagagtaactgtaataatgctaaaatagtaccctttgtttacaagtaatctataaatgttgccttcttgacagggttacagttagacttagagtataacctgtgatatgaacttgtcactacctgcatatctttgtttatggtctgatctggcgggaccttgacagatcgtgaaggaaggagcaagctatgaacactgcttcaggcatgtccacatcaggtgtctcatggaggagtagtttcactttaggctgcacagtcaccttcagaacttgtttaataataccagtgcccaggctctaagctgtacctgccagatcagaatcttcaggacgtggcacccctatatgtgcatgttgataaagctctggggattccagtgcaccctgggagttgagaagcattggtgtcctgtatgaggccgttagtcctttctgtgctggtgtggaatcagaccttccattatttgtattttattcgacatatctctattaaatggctactgtgtgtcaggtactatcagagataacaggatgaccaaaatagttatcatcctgtgaaatatgcaagcatatactgaaattgtggtaaagtcatgtagtaagtatttaagtagctgaaaaataagccccaagaaaaaaggaacagactaactgttgggagcagatgctggggggagccttccccttgagagggtgacatttgagctggttttggggtaacagttcactaaagagaaaaaggggaaagacatccatatgcagacaatgccatattgttcctgaaggaaagatatgtagccacagtggcacttctgtgagtacaacctgaaattgttcaactgacatgttggggccttagcggctaggaaataataaagagttgctagtttttgtttcaggtgaccaggactgaaagaataaatccagccaggacattttggaaaataatctctaatgcatcctggtaaacagttgctgttagtgtgcacatttccaagaggttggcagtaaaaaaa

SEQ ID NO: 99047 - DNA, 1528 bp, Homo sapiens
tctagcaggaccttttaaaatctcatttgcaggtgtttgtagtagtgcttgtaggatcttggcagatcagagccagtaggtttccagctcacctgtttgacctgtcacctccatatctatttctctatctaaatataaatgtacccagggaaatttcatgaaactgcagccctgagaattgcactgatatttggcaaagacgatttttttcttccccaacttgaattttctgaacttgccatggccacaagataaattagtaattactcttgcatctgatttccttaatgtatgccagggtgctgttgatatttgtagcaatacagctacctcttaaccttttctgagttacctgtttaaggaaataagtgttaacaattgagttgatcttgttcttttgcatttcaagaaatgccacctgtttattaaagtgtaatatgggtagagcatagtttcctgacagttgtactttctttgtagcgtactgtgaaccgagaggagctgctgaaacaggcggagtctgtgatgcaggacctcggcagctcacgggccatgttagaaatccagtatgaaaatgaggtgagcttggagtctggtgatggttatttagcttgacttgtgctcttaattaaatgttatttgagtttcttggtactatgaaattctgaaagacagttgggagactttgctctcttttctcttgaatgatttgttctaagttctccatttttcaaaggttcaactaaataataaaaggcagtttttttcctggcgtaagaacacatttgtgttgttagtctttaagttgataaattgaaaggatattttaaacagctgataactttcaaaatgtttgaattgccttttttaaaaaatcaggtttactgagatataaataataactgcatacttcaaaaatgtagttttgtagttttaagggttgacagatgcaatttgttaccactttcacgtcaagataaagaatactctgatcaccacaaaaagtgcccccatttcactttgcaaaatcagtcattctatcccctaccccatcctcagcccttgataaacattgatgtgttttctgtccctgtaattttgtcttttttacaatatcataaatggagtcatgcagtatgtagcctttgtcattcttctttcacttagcataatgcttttgagattcatccatgttgcatgtgtcaatttgtttcctattatggagtagttccattatatgaactatatattgagtattccattatatgggtgcaccaaagtatgtttaacaatcaccagttgattcacatttgggttgtttccagtttttgactattttgagtaacattgctgtgaacatttgtattcatttccttgtggagacacatgtttttacttctttgggtaaatgcctcagaactaaattgctaagtcatttggtaagatagagatatgtttttattttgttagagatacaaaacttttccaaagtggctgtcacattttacattcccaccagtaacgtata

SEQ ID NO: 99048 - DNA, 1099 bp, Homo sapiens
ttaattgacctggctggacgtggtggctcacatctataatcccagcactttgggaggccaagacaagtggatcacctgaggtcaggagttaaagaccagcctggccaacatggtgaaaccccgtctctactaaaaatacaaaaattagccagttgtggtgtcaggagcctgtaatcccagctacttgggaggctgaggcaggagaattgcaagagcccgggaggtggcggttgcagtgtgcctagatcacaccactgcactccagcctgggcgacaggagcaaggactccatctcaaaataaataaataaattgacctaaacaatttttactgattttatttacaattttctatatcatatcaaaagttgtttctaatataagtttggattttttttttagtagtttctgattctcatccagataataaacttacattgcatctttttacagcccatttttctttccttttgatacccggcaaatgcttttttatgtaactgcatttgatcgggaccgagcaatgcaaagattacttgataccaacccagaaatcaaccagtctgattctcaagatagcagagttgcacctagattggatagaaaaaaagtaagtttctccccaaaatctttaaataatctgagcttttcaaaataatgggaaaaactagaaatgtagtatatctaaatatgcatgttggtcttggaggccttggtcatattcagctagccctattttcctttcagtctcttggaactgggctgtgattcttccttattcttcattaagagtttctctcctccccaccccccagtttctgaaataatttctacaattctcttttctcttttagttgccgtaactcttagaccaagaaagaatcttgtcttctctcactgaaacttttttcattctaaattaggagttcaaactatctcctgcctttaaaaattgatcccttatgtaatagttggaattaatcagatccatttcattcccttaacaagtcactccaattagaagagcctgaaacaaaatcctttatatgttttgagtctcttataccagttagctccagtattgctaacttaatctgtgt

SEQ ID NO: 99049 - DNA, 1332 bp, Homo sapiens
ttatgaagttttcatggtctgtgattgataaatttcctattgcactagaaatggaaacagtgattcagctaaatgcagggctcctagcccagtaaagtacaatgtactcatcagtggaaacttctcccccacttttttttctcctggcccacagtcttagattaattctcttggcagatttgtaaaattctctctaggaataaatttatgaaattaagctacaatatgaaacttgaacatggatttattatagttaaaattctttaggtacatgtaaccagaagtttatatatcaagtaaaagttgggtgaaagttgcatgctgcctttgatatttatatagcatagagaagagtaaaggaattggccctgcatgaaacattagctgcaacatcactgaatgactgagccagcagcagtggctgggcggggtgcgcagcagtggcaaggggtatgtgtgagggcttaacagtgtattgtgggaattgttgttttagttgggacacagtaatgagaggctgtgtgttgtatgttggaaaccaacacgtgaattcagggtactttgcatggacttggggataatggaagagattgtgaatataatcctaatattttactacatgtagacttttttttttttaaacattttacagaatgcaatgtgcaaggaaattattccaactagtgaatttattaacagtaagttaacagcaaaagcaaataggcaacttcaagatcctttagtaatcatgacaggaaacatcccaacatggcttactgagctaggaaaaacctggtaagacaatcacttctgtaatggtggccttggaaatgttactgggttggtcttgatgtattttgttacagaaacattgtctttactggacctagtcaaatgtttattaatactgttgatcacaacttgcttaattgtgtggctttagcatgtaaacagactaggcaagtttgggggctggatcttcttggtagtatgtgtctatgtatgaaacaggaaagtacacatagcagtttggctgaggatagtcaaaattatctgctgtcatggaattggattccaaaggtgtagttgcttgattctctgagcctgcttgggtcagggactctagaactgcagtgataaatgtaagccactggccatatacatttaaatcggcagtccccaactctttttggcaccagggaccagtttcatggaagacagttttttccacagacatggactgggagatagggctggtttcaggatgattcaagtgcctcatgaaggtggtggtcatattttaaaaatgagctttcattagttatgttatac

SEQ ID NO: 99050 - DNA, 3136 bp, Homo sapiens
atacaaagccatctgggctgcatgtggcctgtgggccgcaggttggacaagcttgctttgtggaatcatacagataatcacagtttaagtttgtatctgactcctgccagagcttttctgaaatgagcaattaaacatcatgaccaggtttcaactgcagtagctattaaaccgcttcgttcaaaactattatagcaaggtaaattttaaaggttagtttttaatgtaatattgtagctgaaatctttgaaataaagagttttttttttctttttaaaaaatataattcaataggaatgggcaaaatattgcagaagtgagtgtgcttaaatagttcaggaatttttgttccagaaaaataattaaatattcatgggtgaagtatttctgctcccatggatttatgatgggacagagatcaaatattgacttaaggttttcatatgcatgcatacacatccgtcttttatttcttacgtataaaaattttttctaaataacttgaattattggctttaccattcacagaactggtaagtaaatgcttagtactagtgtgtcttatgaaaatgcagtttgtattaacttgcctttatttgaattaatgtatattaaatgtgaaaataatagactaacttttttttcacaaattatcttgagcttttctctcaacagaggatcacaggctttaaaatttttcaacacacatcaattaaaatgccagttacaaaggcatccagactgtgcaaatgtgaagcagtggaagggtggacctgtcaagattgaccctctggctttggtacaagccatcgagagataccttgtagttagaggtactttccatatatttgtttcgtgtgttatatatgtatatttgggagaaatttacattaagagttacatacattatttctctgtttaatgttgtttctgttaaaaaatagatggcaggaacttatattcctgtcttttattttctacttagtatatagtcatacattgaacttactaggggttgactgcttccttgaatgttgagttaatttatcttggtgaaatgtagtagaaatgacattttgtgtttggcaattttcttagacctttctgcttcatagatcagagtgtaatatatacaggttgaacatccctaacctgaaaatctaaaatgcaaaacgctccagaatctgaaactttgattgttgccgtgaacatcgcaagtggaagactccacacctgacaactttgctttctgatggttcaatgtacatacactttgtttcatgcacaaaattattgaaaatactgtatatcattaccttcacgccatgtatatgagatataaatgaattgcatatttagatttgtatcccatccccaaggtatctcattatgtacatgcaaatattccaaatctgaaaaaatttgaaatctaaaacacttctgggctcaagcatttcagataagggatactcaacctatatgtgttttctaagaatatgtttaaccagtgtgtatacaggatttttttttttttacacctaaaatcgctaagagtttaaaagtctacttgggtcttcagggtatggaagagtaagagaagatgatgaagacagcgatgacgatggatcagatgaggaaatagatgagtctctggtaaggtactatattcccaccatgtataatgtactatataaagttcagggcctttggcttaaatggcttttgctttgctttattcaggctgctcagttcctaaattcaggaaatgtaagacacaggctgcagttttatattggagaacatttgctgccgtataacatgactgtgtatcaggcagtacggcagtttagtatacaggctgaagatgaaagagaatccacagatgatgagagcaatcctctaggcagagctggtatttggacaaagactcatacaatatggcaagtctgaaaattctttcttttgttttttcataaactttgaaactgttcttgtgttttagaattcacattaacttaatggctggctttcataaggatagggggccctaaatcacacattttagttctgaaagacgatttcaaatatttgataaggtgcatatgtatatgtagcctcctcattcattctaccggaaaatgtatatccatggacagtaatcatggtttacatctgcttttctagatttatttcaggtctttaattaagacaaaaatgttgccataagatattaggtaatctgaagttgggcatctctgagtccttaagagggatttggatgcagcttcctgcattgtctgtgagtgtctgctacatatgcttgaagagagccattcttcccagaaccacccttggagtttctgaggcagcccctcctgggaaggtggtctctaggtgatctcttctaagaagttctccagattcacactagggagagagaggagaatagatctcagaacagtcttctggtaactgtggtgtctgtggcttagattttggctttgtatcagtttcaaaatctacatttggtttatatactgtcttgtcattttaggtataaacctgtgagagaggatgaagaaagtaataaagattgtgttggtggtaaaagaggaagagcccaaacagctccaacgaaaacttcccctagaaatgcaaaaaagcatgatgagttatggcacggtaagatggtagataaaggggaaaatggattgccaactgggcaatcttcccattttcatgattttcaaagagtgatttggatttagtagtaaaatttttgaatatagttgagaaataaatgacattacaaacagtttgatcacatttaatcctcaactttaatatctagaaaatgaaaaattaagtacctacaaaattaaattgggaaggaaaattgggaaaaaaacttattcccagttcatataagagttcaggtttttatgaaggttgaaacaaatttcattggtagaacatgttcactaaacaagagactgaaggtagtgataattggccaattggcccctaattttttatttgtcacccatgacagtagtacaattatagtaattataaaaagtgatgccaggtaatgtaatgaccatcgaatataaccgtcactttctaatagacttat

SEQ ID NO: 99051 - DNA, 5293 bp, Homo sapiens
cctctagaacatgactggcacagaattggcattaaataatcactaaacaagaacataccttgttatgacagtattttttttttttttgagatggagtctcactatctcccaggctggagtgcagtggcgctatctcggctcactgcaagctccgcctcccgggttcacgccattctcctgcctcagcctcctcagtagctgagactacaggcgcccgccaccacgcccggctaatttttgtatttttagtagagatggggtttcaccatgttagccaggatggtcttgatctcctgacctcgtgatctgcccgcctcggcctcccaaagtgctgggattacaggcgtgagccaccgcgcccggcctgacagtattttattactccctgtttctgccattttagtttgctttttcagtgagtgaagatataaaacagtggtaattgctaaacttatctcatattttcccatggacagtcgattaagtgatgttctaaagagaaaacgactgccaaaacgagggccaagaaggccaaagtactcacctccaagagatgatgacaaagtagacaatcaaggtaacccctttgatgaaactatggggaggtaaaggggagggtggtagcaggtgcagaaatgtactttattaaaactgccagtagctcttgaagtatgcctaagtttcctgaggactaagtgttcttagttctttcagttaattaatctgttaagactgtgaatcttaaaaatcagttgtttttcatcacttaaactaaaatgacttaactgtagttcttttttcttttcatagctaaaagccccaccactactcagtcacctaaatcttctttcctggcaagcttgaatccaaaaacatggggaaggttaagtacacagtccaacagcaacaacattgagccagcacggactgcgggaggtagtggccttgccagggctgcctcaaaggataccatctccaataataggtgaagtggggggagttttatgtttcttctattcccatatcagaaaaacttaaacattatttcagccagtacgtttattgtgtggagacgatacatagacacagcactttaatttgttcttaaaagcatagttcaagaattaggtagtttctcagtttatgaaccctgcatctggctttgtcctaagttccagtcatgtgctttgaaactccttccagcatacctagctgaaagtcttatacgttcaaaaccacattgtattccttggggaacctcttcctcagttttgttccagacaaggaaaagctgacattttctgtccacattcttcacatcttttatgataaaatttctctacccattacaatggaacttcaggattttaggggagagcctttttttttttttttaagtccttgggacttgttttatttttgggttctgcatgtagcataccaacatgattacttccctctgcagataagaaattttaaaagaccaaatgtcattgagaaaataaacatgctctctttggttttgttggttgtttttcttaatttcagtgtataaaaataattaagtgaatggatttctgaagccatcagcatttgtaatttaagcagccgggtcttatttgccatagcttattacatccttaataggcgcatgtttctggtctgtaaatctttacttcagctctccaggaaacacaagttaaggataatgcagatatgtatgtactttaggaagtaaagggaacacttaggaaagtgttatattgcagggttccaaaaaattattacactttgtttacaattcatgtaatgacctgcagtgtattttaagtttttaaacagttctccaggtggtacatcgtagcccattttcaaagtgaaagttaatttggttatggaatctggagtttttaaactgtaagcatagaccaggatgaattttaaatgtagcagctatttgccttgatcagaagttatatcctttctacatacactgggactttaatatctcctttttgtttcttgtagagaaaaaattaaaggttggattaaggagcaggcacataaatttgtagaacgttatttcagttctgagaatatggatggaagcaaccctgcattgaatgtccttcagagactttgtgctgcaaccgaacaactcaacctccaggtgctgtgtccagtgcattttgctggtctttttcagtctcttcccagcatctcctgctactcttttccttcatgactctctagcttcctatggatttagctatcctacatcgacttttaccttatatacacccttggtgctggcatttcttttacttatcccttgactatcaggattcatcagtctgtattaaatgtactagaaacctcatctttgactttctttccttcacatctcatcattcttgacaaatgaagaaacttcagaaatgtcctcacaagcacatctgttttctaagtcatcctcaactataggtatagatgataggccttccttagcccctctcttcacatggggtctcagagtggcaggagaggctagaggtttactaataagtgttttacgtttcatctggttctcagtttttgttcttatttttatttttatttatttatttattttgatgtttttgatgtaccttgagcagttttggtagtatgttttccaagaaattgttcattttgctgagaccttaaatgtattaatttaaagccacaccttgtattcttgattcatctttccattctggtgttatagccccttattcttcagttttctgttctcatcttttaaaatactcttttttaaagaaaactacattggttgaatatgaagattttcttcttatgttattatggattcctggttttcctcatgaaatatttagtgtgtgtgtgtgtgtgtttaaaatcataatttccaaggatttactaagactgtaccactcccctgccctcttttttaagggcgttgagaatatattcatttccttttgaggatatgtgagttgtgtattttttaagtgctgcttaaatcaatatagaaatacttttcctaactctttcaggtggatggtggagctgagtgccttgtagaaatccgtagcatagtctcagagtcagatgtttcatcatttgaaatccaacatagtggatttgtgaagcagctgttgctttatttgacatctaaaagtgaaaaggatgctgtgagcagagagatcagattaaagcgatttcttcatgtatttttttcttctccagtaagttatctaataatgcctgtgtatcttttaagaatcagtgctcactaatgcatatattttcatctcagtaataatttccagcaggtcttggtcaagacattgagggaaaacttctaggttttcacatagttggaatccttcaacttctgtatatcaaagtaaatagtaaaacaatgaaatggggatttaacaaagcccatgtcactatttctatgattgaagtatcttgagtcttttttgcttgcaggatgagccattaatagtagtctctcacctgtgaatgtattttacttgcaatatttgtttttaaatgtattgaagtttgtattagttccttttagtgaaacagacatctataataagatagaggagttatattttcttgttttgtacataaaatacagttgtaacagttccaatcaagggcgcttaatgaccatttatgtcaccgtttataatgtggattacaaagccacagagtggctccccttccttcactcttaagtgggccagagcaagagggtaatccttggatgctgttgacagcattctccttgttttacagtggcttaaagagaaggcatcacttggaaacgttccctattatctgtgtaatagggcttagcatagctctcctatgtattaacactatttcaccatgcgcttgcagtcctcagaggcatttgagcattgcttgtattttaacttgtgagtcaacctaaagcaaagttagtatttattggagattcattagaagcgtgacagtattatgtatagttttacagcatacttaagattatgtgcaatctcttttctgaaacccctggagtttggtcggtttcaaaggtcctacagtgtgtagtacattaaaattcccagcagtttctgaatagcactgtatattatatgcattaaatatttttatagcataacatgaatattcttactaaaatcagataaataaagactgtaaatagccttatgtctgtttggatcagattttgccaccaagtgacttgtgttttcagagcctttggatgtagagattgtgaatacaggattgtgggctgtacaaaacagttgtctttattgaaataattgacgtggtaacatcgttcaaaccaaatctgccataaaagataaagatgaatagacaaattattctcttttataaagctgcttattaaatcttctctttgaggagacttttgttttgaaaaggctttgtttaacctgtttgtttatttataactttagcttcctggagaagagcccattggaagagtggaaccagtgggtaatgcacctttgttggcattagttcacaagatgaacaactgcctcagccagatggaacaatttccagtcaaagtacatgatttccctagtggaaatgggacaggaggcaggtaaggaccattgcctggctatacccttgccactggaatttggtacttaatttcactgaagtaagatggcaagaggtctggtaaagtcttgattggcccagaaaacattcagctgtaatgatgaaagaaattaagcactctaaagaatgaatcaaatgctttcttatctttaaaattataccatatgccttaaacaggatgctttataaatatataatccagtgattgtatttgtaacttgtaataggcttagttttccttaaattgatacacttcagcatacaaaacttccttaagaactttatgtttaacttcagtagggataaaaaattttttgtggctgtgagtaatgtttacattttgagcgatatgatttatatgtaatattagtggctataactttgtattttgatggggtcaaatgtttgaagttttactagtttaataaatatatatatttttaatgtagttttaaggactcttgaggtgctacaggaaagaattgttctatgttgtggaatgttacaagtttcatggaatattttgaccggaggcctagaaaataggaaatttgtttggtttttatttatttatttatttatttatttattt

SEQ ID NO: 99052 - DNA, 1062 bp, Homo sapiens
gttagcgctgctttggtacctaagaatcatatagggagtaaaatggtaacatattagcatatatatattatatttttccttttgtattttgttaatgagaatgggaagaaaacatttattggaaacctactgtattgggctgtgtttaggaactgtaagagattagttttattcccactgacatacaaggaaactaaagttcagagacatttgtgacttgcacggtgttacacacttatgttacttgtaggctctaacattgtgggatttgaattctggtttctgatttcataatcttgtgactattttttgtgctgctgcatacatacgacctcagagacatccagatattaatacagttaaaaatactgaaaattagaagtcttagaataaaggccaaaaaatactgattccccatttatctttaattggcaactgggagttaaatactttgcttttaataagggaaaatgagagttcttaaattctctactcccatttatttatcagcttttaatctttgttataccatgctactaagaatgtttccaaaacttccattggtttccattttgttgtgttagaaacaaatcacactctaaaagtgtttttatttccttgctattagaagcttaatattactagatgagtggtacctgatgaaccaaattcagttctgaaattcagtatgtattcacttcagtactctttctggctccttttaaactgaaaagtagatcatgctaaaatatagtaataataagtggggtccaaaaatttaatcttataatctgcagggtagcattgtcttgtgcaggcagccaactcaggtaggagaggggatgaggggaatttggtgccacctggtggcagttttctagtccagcttaaatatgaattttggcagtttcaagacttctggcagactgaacttctggcacagtgggtattattttaggaaactgctgagtttaactggcacccatgttgtttgaccagtctgaggagattgggcttggagagttctggggactcttccacatccctgattctgcagttgct

SEQ ID NO: 99053 - DNA, 1598 bp, Homo sapiens
ttgtcaaccccttgtatataacttactgcttatcagttatcttttccttacactttatgtcactaagcaaagtggtagaattaccttctttatccattttacaaagcttttagtgaaatatggtgcatttctagaactcagtttcttaccactggtttggttggttaggattggatttccctattgtttcattgaatgtatatcagtaaaataaagaggtacagtgcggtgatgaattgttactttcagctggccccaatgggtcactagttttctagacagctgaattttgtctgtcttaatgttgcctttagcatctttgtaaatcctagttgatcatatcatagaagttcatgtgttctataatgaaaaagttttcatagcatttcaagaattacactggcttgagtattttatattgtttattgtgtttctgaagtctgtcacttcaggattgcacatatatttttttttaatgtaataggtggatattcagagtcaaagaaggatgatgctcgagcacagcttatgaaagaggatccggaactggctaagtcttttattaagacattatttggtgttctttatgaagtgtatagttcctcagcaggacctgcggtcagacataagtgccttagagcaattcttaggataatttattttgcggatgctgaacttctgaaggatgttctgaaaaatcatgctgtttcaaggtgtgttaatgaaaatagtagaaacattttacaaatacaaatctctgcaagtaatttcagaaacctctaaagtaataatagaaaaaatatgcacaaaaatttgttaggagtatcttgagctcttttttgtctatttatattcacataatagcttttataaaatataaaacttgagcatttaagaaaaatgtttatgttaatagaatggtttcacaatgaaaatgctttgctctcaatttaaagtagtatggccaaaaataatcatcaaattcaggcagagttttatatacaaatgctttctttttttagtcacattgcttccatgctgtcaagccaagacctgaagatagtagtgggagcacttcagatggcagaaattttaatgcagaagttacctgatatttttagtgtttacttcagaagagaaggtaatgtcatataaattaatagtcatttagtctagatagtacttcaacagaaataaagttttaatctgtcgagcaaaaactgatagcttttcaatttaaaaatgacatttaaagctctgttagcttatagctctgtgtacgtagaatgtgtcttttaggctgggcgtggtggctcacgcctgtaaccccagcactttgggaggccaaggcaggtggatcacttgaggtcaggagttggagaccagcctggccaacatggtgaaacccagtctttaagaaaaatacaaaaattagcggggtgtggtggtgcacacctgggctgatgtcaaactccttgcctcaagcaatcctactgcctcagcgtgggattacagtttgtcttttaataagagtctgatagaatgatagaagccgtggactcttccccagaaaaatgtgaacgtgtgctcattcactc

SEQ ID NO: 99054 - DNA, 3535 bp, Homo sapiens
ccttgtatcaagtttgcatgtaatcagtgttgcttaggtagtgattttcctgatcacaatacaataagattcagttacatttaattgttaacgttttatactatgggccacatattttcagtatatttgaattgaagacaagtacataaatatatttgatttgtggtatgttgaatgcatttttgtgcaaagtacgatgcttctcaaggaaagaaataaagggttcctgaagtctcaggggtgagaaggaattgtgattaggcacccagctaggtttggactaaagaacgaagtctccagaaagagattgttaaaatctacacaaattttttttaggcctttattacagcacttttgcattttttacattaatttctgcattatgttgctttgtaagaaaatgattctgattattttccccccttgggcaatgtttgcctttgaatgaggtagtataactagtttaatagccttttgttttttgttgttggtttttacagacattgcagaaacgcttcactttctcctgtgtggtgcctccaatggaagttgtcaggaacagattgatcttgttccacgaagccctcaagagttgtatgaactgacatctctgatttggtaaagattgggctaaatatcactttgggaggccaaggcgggtgaatcacgaggtcaggagttcgagaccagcctggccaacatgatgaaaacccgtctctactaaaaatacaaaaaattacctgggcgtagtggcgggcgcctgtaatcccagctgcttgggaggccaagacaggagaaattgcttgaacctgggaggcggaggttgcagtgagctgagatcgtgccactgccatccagcctgggcgacagagtgagactctgtctccaaaaaaaaaattggtctaaatacaacttttggtttgtgtgagattatttttctttagagacctaacgtttactaatatttcataaagttactaaaattattgtactttttgttttcagtgaacttatgccatgtttaccaaaagaaggcatttttgcagttgataccatgttgaagaagggaaatgcacagaacacagatggtgcgatatggcagtggcgtgatgatcggggcctctggcatccatataacaggattgacagccggatcattgaggtagtagtttcatcgtaccgtttaaatgtgtctattttgttggagagtgggtgtagggatggaatggggaggtggatatgtggatttgaatgtgcttgattttgaattaactcaagattctctcattttgtctcctgagaacaaggtcctcatttctgttcaggtcagaaaacttcatgttctagtcctgcttctgctgctaactacctgattgacttggagcaagtaatttaagtttgttgttccatagtttcctcatttctgaaaggaaacattggaagacttaggccgtaggtttctaaaatttatctatcttctatcagaaagcaatgtcccatgagcaaagatttacatacaaatagtttcctctcaatatttttccagagcagaaacgtggaaacaaatgaaatagccagttctgggtaaatagttaagtaaattgtgatacacgtaggcttgtatgttatccagatattattgggacaaattttaatgatataaaatcaaatatgaatgaaaaacactatacaatattaagtgaatctttttggaattcagcaaaataagtgaacatatgaataatacaaaggggaggaatgtaccaaaatgttgacagtgattttctgtgacagttttatgtgatttttatttttacttccttatatattgtttgcactgaaatatttttaaaactaaatgagcataatatttgctctagcttaggaggtgttgatcactgtgttatttgtgatgccatgcataatttactattttcaatacatgagacacctgtaagaatttatctattttctaatttcaatctttgatgtttgaattctttttagaacatcacacattttgaatagacagtcttctttaaaggtgccttctagttcgtttctaaaaatgaattttagaaaaaattttaaaccaatgacttacctcataaaatcaagagttttaaaaataaatccagtttcagagcaagcttttatgagaaaattgactttgactggtcttctgtgcagcattatatataagcagtgtataagcaggccaatcctgctaatagtggtcctggtctctaactctaagtcgtcttctttttagcattttcctgatcattgcaccttcactattagcttactctctcatatgtgctgagagtcttgtcttccattcagcctaggagttccatagattggattctgtaatgagaatattttgtcacttctgtagtctgtttaaagtcaaactgtgctaattgaactgtgtcaatttaaatatgttctgtataccacacacaaccttggcgattaatctgtttcagttgtgtccctttcagtcttaaagttatctttgtttaatgaggacaattttataggatcattttgtttaagggaggattttggtaggtcgctaagaattcatcatgtaaataatatttttaatctaagaatactaagatatatggataactgattttttataagcaatgtcttaaaagcattctcaatacaaatggtgtcttctttgtgtcagtgatgctacacaggtggatctttcatcaagattttacctgcatttatgtctaagggtccctgataaggcttgaggcatgtaacctatgtctaattaaaaatgatttgttgaatgaatgagttttgtcatatctacactattattccatcttctgttaacttcaccatctaaaacctgttgaaataaatatgtaagatagcatatttggagggtccccactgtgtcttaaggtaatagatttctcaatgtttatattcaaagtttctctctctttgctctcaggcagcccatcaggtcggtgaggatgagataagcttgtccactctgggacgagtttatactattgattttaattctatgcagcaaatcaatgaggacacgggaacagcacgtgccattcagagaaaacctaacccgttagccaatagtaacactagtaagtacattctgagttaaaatagcactatactattgtgcaatattttgtgtttgcataataaataataattggcttattaagtatctttttaagcttaagacaattgcataacaataatttggttttcgattttttaaatcatgtccattaatggatgagtgagccagtattaactggtatcttttccacaatttgtctgcttacctgatgtcctgagattcgagtcagaatttgctcatacagatttttatctgatcctgtcattactattatacctttagatccattgactagttctttccaaccttgtattttataccttcctgccaaaattatctgaactaattaaggacagataattgtgattaaaaaaacaaaacaaaacaaaacca

SEQ ID NO: 99055 - DNA, 1030 bp, Homo sapiens
agaggttggtttgtttcctgtttgttttgaaattgtgatgttactgactgtaccttgcttaggcccatttgcattttcaaagctgtcatttactaattgagcttgccttgaagaatctggggttaggaggaagataaagtagtgatacatgacagtgaaaatgctttatgctaataaattttattttcctttattaaaaaaataggataaaaagtcagtagaaagcacttgcctttgttttgcacgcctagtggacaacttccagcatgaggaggtaagtgtttagtctttggtagtatttttatgaggttgttgaattgctgaatcttgatgtaataattcctttattcttgtgtttgtgaagaatttactccagcaggttgcttccaaagatctgcttacaaatgttcaacagctgttggtagtgactccacccattttaagttctgggatgtttataatggtggttcgcatgttttctctgatgtgttccaactgtccaactttagctgttcaacttatgaaacaaagtaagtgcaaatttactgttctactttaagcaggaaaagttggttcttcattaatatgtaaagtcaacataagccgagcaaatggaagagattactaatattataggcattggatagtaaagaaaagtgttaatatgtaataaatttgtgttgggacagtatgttaatgtttctaacatactccttttaaagtataaattaaatgtttgcccttggtgtttctggggctaacaatacaaagtcattaatatctatgccatgttagtcatgtaaccatccttgattaggagaattctgagttttatgttaaccaataaccagctgtcttcagcttatataggttgctttttctgcccatgttagattttctagcaatttttctgattccagaatgctgtcttccctcaaaaagtaggaatgtatttatactgatgaatgtctctgatgtttgctaatttggtatttctaaaccttttcaaatttagacctttcaaattaaa

SEQ ID NO: 99056 - DNA, 1048 bp, Homo sapiens
attgatagaatcagcctagttttgtaatttttagtaataattagcacattaatataataactttcagagaagaactttaaagtacttgattaaaaataatctaatttctagaaaacatgccagtgaggttgatagctatttataccctcattatgtagctgagaaagttgaatcagtggggaatagaaattttcatatggtttctagtaaattgtgtttttggtctgtcttacggacctttttgtttgtttaacgcacaacaaaatttgctttatctgataaacttgcagtatggtgtaaagttaaaatctgattttaaaattttgttgtgtaaaacaactcatctattttaaatctgaagatttaaaagttatgtaattgggtttggtttattatgtaaaacatatttttcagtatcttagaactgcaaactggttagaaggaaactgttttggctatactttgtagcttaagctgctaagtgacttgcatcctatggtgggttacatgttagagatagtatacatggatgtaaattagagaaaatatgtagaagataagttattgggaaagaacttaaatgataaccttatggtaactatatatatgttcccagctgcaagttattcagtgtattgatgtggcagagcaggccttgactgccttggagatgttgtcacggagacatagtaaagccattctacaggcggtaagtgttgttactgaaggggactacatttcactttatgtagaatttttaaaatccacatttgtacaggctacttgattgcagtttttgtaagatacaaatgttgtttccagagtaatgtgctagactttttatgagttaaattattttttattgctgataaaggatttttctttaccttaacagttttctatattttagggtggtttggcagactgcttgctgtacctagaattcttcagcataaatgcccaaagaaatgcattagcaattgcagctaattgctgccagagtatcacgccagatgaatttcattttgtggcagattcactcccattg

SEQ ID NO: 99057 - DNA, 1049 bp, Homo sapiens
agggtacttaacaagcttcaattcagtgcatttaaaaatttccattgaaccagaagacagtgaatgactgtcttatccccaaggaggaaatttctttggtgactcagctgcttcgagaggacagagtgtgtatcctcagcagttttgcattccttcattagaaaaacatacctgaaatctgcttaagatcttttccacaagaaaaactaaaatgaaatcagatatttaaacttattcatgcatatatggagtaattatattaatttggctttaattagtgcataattagtttctgatgtgatctatcttatgtttaaattctatattactgtacattttaaagctgagtcaaatggtgcttatctgttttagagaagcttgttcacaagagtttaagttatggtcctgaatctgtgctgacatttgttaacaaatgtcagtgcattgctgatcctgtttatttatgtatctagtatttattagcactagtaagtcctcagggatatattaataggcttctgaaaggggttagagctaccaaaaggataggttgtaagtaacaagaaggctttgtttgtgacctgtatcacgaggtgatggttatctagcagcatactcaagtcggagtcaccgtgtgtgatgaaccatcctgagtgtaatcatttctgtgaacgcctactaggttttatcttaaagttatttttgtgtggtaaaagttaggaataatacttccatttcagttgaagttcaaatagaagaggaagaaatacctctaggattttcccaaggaatatagcttctaatattttgttatctttttaacagattacgttacttcagatggagcacaattttgatattgtaagtatatattgtatttttttaatggtgtatatttaagttttgagtttttactcattaaaatctcttcttttctagatgaaccatgcttgtcgagccttaacatacatgatggaagcacttcctcgatcttctgctgttgtagtagatgctattcctgtctttttagaaaaggtgatcctactttt

SEQ ID NO: 99058 - DNA, 3687 bp, Homo sapiens
ctgcctacctgtaagtagcattatagtgtgtagttattggttaatttcctttttctttaccagaagtgtgggttttgcccagcctttatacaacttcagtatttctggttaatctgtctctctatggctctaaacttttcagagtggtgggggagttaccaacacttttgtaaaaggccagatagtaaatgttttatgctttatgtagtctctgttgcaagtactcaattctgtaattatagcgtgaaagcggccacagacttgtaaatgaatgagtacagctatgttctaataaaatttttatttacaaaaccatgtggtggactggatttggcctttgggccatattttgctgaccctgttttaaaccataagcttttctaagaattttttttttaatcccaataatgaagttacatagaaaatacttaatggtgtgtgaagagaatggtaatatgaaaatacagtcagtggctggtattttggcatctttttcttcagacaagctctttaaactcgcatatgttattcacacatgcctctttaacaattatgacaaaaatattcttcctggcttgcattctgtcacaatctgtgcagtatatagggcttaaggtattgtggaagagcttatgtagatcaatcatctgtgttaaaaaaaaaaaaaaacccaaaaaacaaacaaaaaaaacctttgacctcagcagacacatagaggcacaattaactgctagttttgcaggaatatggttttacttcctgttcagatttataatagactctacctccattagcttagactgtttttttgtcattgttggtcaggttagtatttcgattaatagtatcctgagtcttaactcttcatttcacactagttttgacactttagttgccctgtctttcatacttcttgtttttgttttgagacagagtctggccctgccgctcaggctggagtgcagtggcacgatcacggcacactgcagcctctacctcctgggcccaagcagtgctctcgactcaggcatgcccaactcagtagctgggactacaagtctcactatattgcccgggttggtcttgaacccctgagcttaaatgatccttctgccatggtccgcaaagtgttggtattacaggagtgagccaccatgcccaacctccttcatgcttcatagcagtcatctgttagttgtaatatctttttgcactcttgaagttaatgaaaacagataaatgattgtatcaagactgtagtccggaaataaagcagacttagaaggcagacgtctacatacaacatttcccccaaatgtctattttgcctttttattatttttgttactaattggccatctgttaaataatcacaattgttacagcagtatgttctttattgactttcagaagagggattcaggacatcttaattaaagaacagtttcaacggcacaagaaatttgtcaaaagccacatataaatgaaaaacaagcataaaaatacaacctttttaatactaaaatagttgagctctcctttcattcctaaaagctacaggataaagtctagaagaacagctgagtgtacagtagcaagacaagtttaattgcctttattcaattgtagtccgcaaaactttggtttttctaaggtaagccagacataatgtgtttaagtgctcctcctaaccctcatctttcccctccaccccaagcctctagttctgttgcaggggctgttggcatgaccacctctggggagagtgaatcagatgattccgagatgggacgtttgcaaggtaaaaacagttattgagcctataagaaaccattaccatgagctacctgttaataccattctttattgaaattaatttagttaaattcatttgaccataatctagcagtgcctgcacctccaagaaaaaaaaatttttagtagcaatttcatgatttggaattggaagatgagctgtccgcctcttcgtgtttactgtttcactagatgaagccttacatatttatttttgtttaaaatttttaaattgtggttgcatgtgtagctggtttcagtaataaataagttaaaaatcttgaaaaatgggtaccttaatatatttttgtctggtatccagtagcattatgaatgcatttaacccacttaggcctagtgttccattattggaacactaagaatgtgggagttatttatatcctactgctcaaggccatcaccaaggtcggacttttcactcatgcaaaaattcaaaaaattgcaacctgcagcataaatgggttttaataaggcgtttggccatggttttttgtcttcttgatcatgtttcaaaatgaatgtatagtgtatacacaaattgtagggtttttttaatgttacaaatgcttttacaaaagcagcctaatactatgtatggatgggtatgtatttttatctcatttgatttataacagatctcagtgtgaggcttacaataaatgtattatttataaatcattttttattgcttttaaattcctgagggaacatacaagtatctctaggactcggactctcaggaacacatagtttttgtttgtttgattgttttgagaccgaatctcactctgttgcccaggctggagtgcaatggcacgatctcagctcactgcaaactccacctcccgtgttcaaatgattctcctgcttcatcctcctgagtagctagaattacaggtgcctgccactgcacctggctaatttttgtatttttagtagaggcgggctttcatcatgttggccaggctggtcttgagctcctgacctcaggtgatcctcccgtctcggcctcccaaagtgctgggattacaggtgtgagccactatgcctggcctgttttgttttgttttcactttttggaactaataaaaatcatactgttttcatatggttttataggttctgatgaccaatatctgattgggaaataatgtcatacagaaaacagagcaagggtgcttaacatattagctcttcaaaatatcaaaatatttaccttagatttttcttgaaatatttacacattcctgctggcactgatttaatatattagggtggtcttgaaagtttgtagcttctcttaaaagtccagaaagcaaagtaacattgactgaatcagttaagcgagatgaatcagttacttgaaatttttagatacatcagttgcatgaagtcatcttagttgttcactctgcccttcttttttctttagctttgttagaggcaaggggtcttccccctcacctatttggtcctcttggtcctcggatgtcacagcttttccatagaacaattggaagtggagctagtaagtaaaaatgttccttccctgaaatccctcaataattagccaactgctattgttacttgtaacctattgatgtaagtattaagaagtttttcatcaactttaacccatttttaaaaataaggctgtgtacaatcacaccttaaatacagctttcattgctgaattatccagattttgtagcgagattgattctgtttgaacaaaataagaataaagaatctcaaacaattacattgataattatggcacctgatggcatgttttgcatagatttgaatcttgagtttgtcataatgatgtatttgtcaaggtgagaggat

SEQ ID NO: 99059 - DNA, 1035 bp, Homo sapiens
tgctagtggtactaaagtaaggaatgaactatttttctttatgcttgtaaaataatgtcagcttcattttgcattgggtagctttatagtttcggaagaaatgatcagggttagatcacataaagaaagtggtccaattttgttaactttgcatcaattggttaaagtataaaaatttgtcactccatgtagaatgtttgcattctgatttagacaacatctctccagtattttcacttgtgtgtattggaaactgtcttacacagtactgtgaagataggctaagactaaacgggaaatatctgttgaaaatctggcattggattttatctactgatagtcacatttttatatttgactctgggaacaaatctggcctatgcctaaggaggtttgaagccttgacgaaagaactgtagctgactgctgttgattaattacattttcgtatctgcatgaccttacagaacagctatctctatactactacttaaattagccagaggcttggctggtttaagtcttctaattttgtaaaacatacaaaactagtagtttttttgttttttttttgttttgttttggtaaaaccaaactaattttgtaaaacatatacaaaaatagtttttatatatgttttacaaaattagataactcataactcatatctaaactcccactttagataacctaaactacttcataaaagggaacaaaagcttaatacttgctatcagaggtatggcaaaagaatccttttcttcacaattagtttccaatttctgtcaaaaccagcaccctaccctctactgataatcagacttctggcagtagctcacacctgtaactccaacattcagaggccgaggcaggtggatcacttgagttcaggagtctgagatcagcctgggcaacatggtgaaaccctgtctctacaaaaaaatacaaaacttagccagacttggtggcatgtacctgtggtaccagctactcaggaggcggaggcaggaggatcgcttgagccctggaggcgga

SEQ ID NO: 99060 - DNA, 4217 bp, Homo sapiens
ctgtttttaaattttttagattgtttaaaatatctggatttagtacacctgtttgcttttgaggttgcatagcaacttttctgaggatttctgaagaaacttcttagttttccagagtttttgtcctattttgggccaaattttgaatcttaattactcaaggtttagtctgagatgcaaactggatttattgtgtctgaaaattaattttaagccatatgcgaagtcaggtaatctagtgttgtaattgtcttgcttgccctgctgttctctgcaaccgtctctccttctactcaacgataattagcacgtgcgaaattacccactgaggcatgatcatgctgtgcgcaggccgtctaatctagccacctgcttgaagtgctcttcatggcaaatcttttctgaattagttgagattctgcttatatacagtgccttggtcacctactaagggtgtccttgtttctctttagagtagcactccttgagggcagcagccctatgtatccaaagtggtcagcccagtgtgttggtggagattagatcttaaatgagtgaatttgaatcccactaatttgtacctttgtaaaatgggttgggaatgagctgtttccttgtgaaggaaagattagttaagcaaatttctgtgtagggaagctttttctgtaatgagaataaactcttccagtgctctcaggtaagccagagccttcctttgtaggtcagttgtgcctgcttctctcactttactgtagtgtgactttagtctaaaacatgtctttagtaacaggtttctgcctttcttgagataatttggggagcttttgtttaaatgctatcaagtttgaataattttgggggaagtatttttgcttctccctggtttgcttactgatttcgctgttgaaggagaaaaaaaggtttattatcaataaaatgtaattttctataggagaaataagtggtcattctttttccataatttattctgtgtctctgtcctagatgaatatctttcccaaatgttatctgtatttattaataatattaaatccataatttaaagaatggagttattcattattaggatagttatttttatatgatttaggtaatctggaacacgggctgggaaatttttttccatctcctcctcctcccttcctcgcattctcaatgttaatctgcagttcttttgtataatttttttgttgttgctgccgcccaagatggagtgcagtggcatgatctcggctcactgcaacctccgcctcccgggttcgagcaattttttgtcttggcctcccaagtagctgggattacaggcgcatgccaccacacctggctaatttttgtatttttagtagagacagggtttcatcatgttggtcaggctggtcttgaactcctgagctcaggtgatccacctgcctcagcctcccaaagtgctggggttacaggcatgagctaccgtacccagccagcattaatatattaatccactatttaccctggaagtgatgctctattttaaacgaattgaattttctctgcagaaagagtcacttttctttttagttggaagtgttttaaaaatcgtttctgtttctgaggatgacaacagctcacagtaacaaaagcttgtattgtaaatgcaatataacttggaagaattttaaatatacaaagtcttggttgttatacatggtgattttgtgcacttacttttatttaaaaagaggacgaagaagaaactggctttgtgctccatgaatttgagctttgtgttgtgtatacattgctcctggttcactggtaatgctgcccatgatgacatttttctgttgtagtcggcgaggctctggcctgggcaaaagaggagcagctgaagctcgtcgacaggagaaaatggcagaccctgaaagcaaccaggaggcagtaaattcttcagctgctcggacagatgaagctccccaaggagctgcaggtagattggtacttcttagctttaaaatgcgtttctgtcttttacagatttgatgggcagagggagggaagtatgctaggtgttactatcgtataaacttcttgttctgttttgttttactttaccagtttgatattttgattagttggatttggttgccattttaaaattctcatccaaatttgctctaattacattcaaaaggcttttaggaagaagcaaactctgtttaagctttttatatattgactagtgtgtataattgcccattgattgaaagaatttaaattcatagtaaaaatgtaaggatatagtttaaattgcttcacacatatataaattttaatttagaatttttgtaagccctaaaatacaagtattcagtttgaaccttagctgtaagaatagtatttatattgttatgggcttctcatttttattcttgatatattagaagcacaaaattaaggcttttctctcagctttaaataatgtacccattacctgtaccaaaacaaggctaatacttcaactattaattctggctgatggatatcaaaatgtagtttctgttgacatttctcaatgacatgaacaactgataaaaaaatgttaaaatcaatcactataggcttatatgtatgagtcccttaaatcagatgatacacacaggtttagatacaggcatatacttccttttgaataaagatatttcagatactattgtttactattaggatacgttgtcattttctttaatgtctgtggttgatcatatgtcatagtttgccaggaaggttgtggtttacccgctattgatgtcttcttgttttttctagcttaggatttttttcttttaagcactacactttcttagttttatatgataaattatatggtgggagaggagttttttcccatatttgttttcctagaatagttttttgaaggtttaaatggtagatatttggaaagtccatttaattgcaactcattaaaactggttgtgactcacagtctgtcccagtgctgtacgctccttcccagtcttctaatgtttatttgaagcctgaatgtggaaatggggcaattcccaaatgggtaacagaaaaggagctgcaggctattaatgtagactcactacagtaattattataactaatatacagtgtacactacattgcagtccagccatagtattaagcactttacatatattcttatttaatattccaaacaacctgctgaggtatgagtgttattattaccattttttaagtgaggaaaaacggagacaaacattgcttatgcttgctcagggttacaagctgtgatgtgtgacttcccaaagccaggcatatttgtaacagcattgttgtctaatgcagttacaagagtttatataatttatacgaatatataattgaaggctggaatgggaacggggttcaaaattttgttcccctatttatttacctaagaggataaaagcatacaggaatcaggctcatccgactgcctttctaaacagttccaggcattacactgtcatttatgtttcaaattacagtgtggtacaggtgtttcccaagctgtgtattgtagctggtgataaaaaatacatgtggcatgtgcacttgtattagaaaactgacttcattacattttggaggatagatctcttatgaattataggaatttctctgctgactcatgaaagtatttatggggaaataagctaattatttagcagctttacgttaagttcttcatgataatgtgctttagtttctgcatgtgtaaaatgggaatgtagaagaaaatacctaaattagtatggtgtataggtttgtggacttagagctctttttgacaagtaaacgttttcggatagtacttgtatagtcgatataagactccattggaaacatttatttggaaataatgttgttattattttaaaaagcccaaccacattagctcttcatgtaagaaatgctagcctttgaagttgaaagtgtagtgtttgccacgctttcccacgagtcagaggcagactcctgtgcattctttttttttttcttctttgaggaaaagtttctctctgttgcccaggttggagtgctgtgttgcaatctcagctcactgcagcctctgcctcctgggttcaagtgattctcttgcctcagcctcctaagtagttgggactacaagtgcctgacaccacagc

SEQ ID NO: 99061 - DNA, 1499 bp, Homo sapiens
agcaaaattaaaacttcctgaaaagaagtaagtgaccaggaccaattgtataattaattagtctctgaaaaagttaacagctgtttaagatgatgctgagttctcatggaaatatgattggtaactttggagacctttcactgttggaggtctttgtttagattgagtatactgcctagtatgtcatttgtggtaacactgtgagggttgggcaagggtggatgctgtcttggctttcttattgttcataaaatagtaataaactttacttaattgatacaccattttcgagcctattgacctgtaaaggcattagttagcttccagaataacatgtaaactgtgcttaattgagtctcccccctaattatccagtattttataaatcagtcttcctaataaccttcagtccaagtgcatgtacctttctgatgggtggtataactcattttattctctcataccttattgatgagccttatataaactaactgaaatgggacaatataagaacagtgtaacaaagttgataaacttaatgacgtttagtaaattcttgaaataaatggtatatacaaaaaaactcgcctttgttagtggagaagaggagcaggagagaaaagaactttgaaagaggagagataggcaggactttggggatagcttgggtcaaggttgggcccaagtgagaagaccgatcctgaactggagtgccaagtaccattagctttttcattatgaataggctgtggaaataaagctagtaatactgctggagaggttataaaaatattctgtgaagttttgaacatgatgacctgaagaattttataatttttaattagtgataatttctcattataaaattacacttttccattttctgtggataggtttaagaaaatctacgaagaaacgcagtgagtctccacctgctgagctccccagtttgaggcggagcacacgccaaaagaccacgggctcctgtgctagtaccaggtaatttgtttttttttttttatagtgagttcatttttattctgttgctcaatttcaactttcatcaaaatacttaactccataggttgttttttgttttgtttgttttgttttgttttttgacggagtcttgctcttgtcacccaggctggagtgcagtggcgcgatcttggctcactgcaacctgcgcctcccgggttcaggtggttctcctgccttagcctccctagtagctgggattacaggtgcctgccaccccacccagctaatttttttatttttagtagagatgcggtttcaccatgttggccaggctggtctccaactcccaacctcaagtgatccaccctcctcagcctctcacagtgctgggattacaggcgtgagccaccgtgcccgatgatttttaaaaaattatttaaatttttttttacttgagtaaagacatattctaacataactggtattatctttgtgaatttctccgcaatatttattta

SEQ ID NO: 99062 - DNA, 2116 bp, Homo sapiens
tagtttttattgtcagagccatagtttaggtttaagtcagtgattcttaagatttaattgttaagagactttggaaagcaatgttaactttgaagatttgatagtactacaatataaaaatctctaaccttcattttgaaagtgcgtatgttaatgcttatttcttctaagctttgacaaagcagttgtgcttgtgaatagggcatcaatattctggcttcctctggttccgaacaattaagtgttgtttttcttgtaatcttaattcttgttttgtgattacgagtgttagtgtcagtaatctttgggctaaagaacacccttatcttttaatcagatattttagtatccaaagtcacatctgcttttgttttgttcttttatttcgttttacagatttgaaccttctgaaaacctatgtttaatactggacttagtaggaacatattcatactttattttttgaaagcattatatatgacagttgtaattatgacaggctgatattaactgttttcttatctaacctcttagaagctgcagttcatcatctgctgtgatagttccacaaccagaggatccagacagagccaatacttcagaaagacaaaaaacggggcaggtgcctaagaaagacaattctcgaggagtgaagcgcagtgctagtccagactacaacaggaccaattctcctagctctgcaaaaaaaccaaaagcacttcagcatactgaatctccctcagaaacaaataagccacatagtaagtcaaagaagagacatttagaccaggagcaacaactgaaatctgcacaatcaccatcaacaagcaaggctcataccaggaagagtggggccactggcggttcacggagtcagaaaagaaaaaggacagagagttcttgtgtaaagagtggctccgggtctgaatcaactggtgcagaagagagatctgcgaaacctaccaagctggcttcaaaatcagccacctcagccaaagctgggtgtagcaccatcactgattcttcttctgctgcctctacttcctcctcgtcttctgctgtagcctcggcctcctccactgtaccaccaggtgccagagtgaaacaaggaaaagatcagaacaaggccaggcgttcccgttcagcgtccagtcccagccccagaagaagtagcagggaaaaggaacagagtaaaactggtggctcttcaaaatttgattgggctgctcgtttcagccctaaagttagccttcctaaaacaaaactgtctcttccagggtcttctaagtcagagacatcaaaacctggaccttctggattacaggccaaattagcaagtaagtttacaaaaaggtatttttctttaattaaagaaagtttctcttggtttgtcaaaagcaattatgctttaaagttaagggttttttccccccagtcttagataatcttagatgtattactgtctgtgtaattaagtacataacagcatgtagtaagtgctactacatttagttttgttgagacaggtaaggaatactaccttcctattattacgaaaccatcacattttagtgtctgtgtctttattggtcctcgcggcatctcctacttcactgatttcctaatatcaggatgggacataaagttggattttcttctataccacatacaaaattatcatttagttaggagttctttttagttatgagttgccatgatcagagatcaaatatatatatgtttttttagatggagtctcactctgtcgcctaggctggagtgcagtggcgcagtctcggctcactgcaacctccgcctcctgggcttaagcaatcctcttgccttggcctccagagtaactgggattacaagtgtgcacaccatgcctgggtaatttttgtgtttttagtagagatggggtttcactgtgttggccacgttggtctcaaacttctgacctcaagtgatctgctcacctcggcctcccaaagtgtggggattacaggtgtgagctaccatgcctggccaaatatatttttttatatgagatattcttgatgtgtagatacagtgaattaagttattactataaatatacctcaatgtaaattaaact

SEQ ID NO: 99063 - DNA, 1332 bp, Homo sapiens
gtacttgtatgatatcttaagaaatttatggcatccttacagattgagttagaattattttgtgagattttcagtgactcatttctaagttcttttgagatggtgtttggaataaaagccttaaacttttttttaacaagtaaatttggtattaatgaaacttttttctagattttcattggtatatgctcttatgtggaaagtggatatcagctatgaattacataaattgcatttgttacattaatatctcacccgaatggcagcagttttctggatatcaacatgtgtttgttttttattgcttatgtaaatctcatgtaaccattccccaaggtctaaaaaataatctaactgaaaacagttttttcatgttcctcaaacttgcttttagaatagtgctggcataaggatttgatttattgtaaatatgatgcaccatatcaatcatggaattatttgaatgttttttggaacttttgtggtaaattccatatttctccaggacttttttgtgttctttctgttgacaagtactttaaagttttagcaagtatcactatgttgatttcatgtaggtttatttattgtttagtgcttgaaatgattttctgtgtaaaatcagtttgagaattggttcgtctgtctctgcatttgctgtgtttacctgaattttaagtacaaattggaaatcggtatcagtgtgggaatcatcaattgtcttttccgtaaacttttaaagccattacagtcacattatgtattaaaagtgtgtttagatctaaagtctaaatttgctttttgttaaaatgtagcatatttgaatatctgcactaaaattgctgaaaaatgtgttactgcttaagcaaccttaacaacgctgtgcaattatgactactggtgataataaactcttcggtattgcggggcgggggtggttctgagaggcaatttctttttgccagattatttagtagaataataattaaaatttataaatatttggaaaaagggtagggtcaacaatgaattgtgggaagctttaagaaatatataaaaatatttcattttcagtattgtatttgcatctcagtttcctgatagatttctgttttgattttctgctgacaggtcacatttagggcaggcaaaacataagggatatagccctcctgagagtagaaaatctaattctaaggcacccaaagtgcagtctaatactacttctgaactgtcaaggggacacctttctaaaaggtaaatcttcatgttgcttatacattttcaaggcagaattatttgcattcaaatcattgcataatgttaaaactt

SEQ ID NO: 99064 - DNA, 1388 bp, Homo sapiens
cgtccaaggctcctttacctctgaatactgtgatgttctaattggctattccagattggacatcattattttatggagatttactttgcagcatttttgagcattaataatttataagtggacataataaaatagagctccattttgggaggccccatattgtcacttcatggtaccatctggttgtctattccttgttagccagggttgaaaactatagcgcatgggctgaatctggctcactgcctgtttttgtaaataaaattttgattgaagtatagccaccatgctcgtttgtttgagaattttctgtacctgtttttttgacatacagtattgcccaggaagctgaaaatatttactctcctttatggaaaatgtattaagtcccatgggctaaacagataggcagaagggacagttaagtatcaatattttatatttttaaaatatattttttaaacagtccttagaatatcacactttaaaataattttaggtaagatcagtgtgggcattgttgattttttttttttctttctttcttttttttttttcgagatggagtctcgccctgtcacccaggctggagtacagtgacacgatcgcggctcactgcaacctccgcctcctgggttcaagcaattcttctgcctcagcctcccaagtagctgagactacaggtgtgcgccaccatgcccggctcatttttgtagtttttattagagacggggtttcaccatcttggccaggctggtcttgaactcctgacctcatgacacatccgcctctgtctcccaaagtgctgggattacaggcatgagccaccgtgccctgctgggcattgctgaatttaagccagttttgtgagccttggttttctaaatgatttgaatactgtttactttttgtggtataatatagagagtttacatgctaagttcttaagttcattgaaggtattagtaagggcatgagaaataacacaggagtagaattaggtggatctaacataagctatataaaagtcaacagaacaatttatttgagttaaaaagaggagggctgctgccccagacctcacctttagtttcatatgggccggtttctgatgacaaatggaatgaatcataatttttaattgttttgggcatttatttttcacaaagttgtctagctttgaatgtatgtagttttctttcagaatgagttgtttaattatcaaggaatgcaacaagctatattttaaattttaaaatgaaataaagtagaaaacgtgatttaattaaaacatcagtctgcaacgatctttaagaaaataagaatgtagaggacctgaatgacataatttatatttcctgtagctgttaaattccacaccccaaaaa

SEQ ID NO: 99065 - DNA, 1082 bp, Homo sapiens
tcgttggaaacatctatggagagtacctggtagattactttgttttatgagactctgacctctttgaggacagggactagactgttacctatatttatgtgccctgttgggacttgcatatatttgttggtggcaaacctaacatcttttgaaatgagtagcttagtacaatggttctcaactctatcagaggcagtgctccctgtctataatgtatatcatataaatatttttattatgctcttttaatatcttcaaataaatgaagaaataaaatacctgcctacacacagtttagaaatattgatataatgtcttagcattttacaaagataaacaaaaggaaaatagttgataacaaaaataacatctcaataggtaaatgcttggacacagtgacacaaaattatagtgcatctgtatttggagtcactgaatgtgacagttacaacaatggacttaaatgccataagcagcattttcatcataggcattaaaaacggtgcctgactcttggtaaagctgccaaaaaaatagtataatcgcttgtcgttgcattcttggaaaatttaatatgtaagaactgtgcaaaacaaatctgagaaattgcaagcacgtttttcacctatgtcactgccacactgtcagggcttttcataaggttttcatatattaccaagactgtttgaaatacatggggcatgggacagttgggtctttttgttctgtatgttgctcatctttacctctaatccacacctgctaaatgggaatagcactgccgcttcccagtgtatgtttccagaatgcttcctaggggcagtatttttgctgtttagaaatactgctttactttaaattatagaatcatttgggctagtgtttcagtgtaactaaagataggaacattgatcagatgaatcaagcttctttttgtaatagaaatagaaaaacagtgcgttttacagggaacattagtgagttacttatttaaagtggtttaaagtgaactttccaccattaattattgaaaatcaatggctcttttaaaacatggattttccagcatttgaaataaaata

SEQ ID NO: 99066 - DNA, 1015 bp, Homo sapiens
atttctttcctgtctctttttttgtcctctcatttgttcagtcagaagcaagttcaaactgcttcttgtttgggaggaggagaatgttatggggagacatgatgtgatgcaaaaataatttaatgcctcttatgactgaatttgagccactttttaaaggtatttatactagaattggttgggcgcagtgtctcatgcctgtaatgtcagtactttgggaggctgaagcaggcagatcgtttgagcccaggagttcaagagcagcctgggcaaaatggcgaaaccctgtctctactaaaaatacagtaaattagccaggtgtggtcgtaagtgtctgtagtcccagctacttgggagggtgaagtgggaggatcacctgagctcaggaagttgaggctgcagtaagccaagattacaccgctgcactccagcctggactagagaccctgtctcaaaaaataaatgaatgaatgaatgaaagtaagtattctagaatcggctgggtaatttgtaacttgctcttttcagcaatagtaaatcttactgctctaattaggcagcctggagttttagctgtggagacctgtgtgcctgctgcattggtaatgctgaaactagtctgtcccatcaggccttgggatcaggaggcaagataatatggtgctgtattcaacaatggcatggttgccttggtctaaggagaagcagaggctacttttctgtagttggaagttagaaacatttgattcttagtagtacccgtgttaaattttttgggggggcctacaaagtaatagtttatatgttttctattagtaatttcctttgcactatgctttattttaatcaagtttggaattgagtcaaagtcacatcataagcatactggaaaacctataagaaattgtcagctgccatagattgtctcatatccctcactgaggatttgctttcattcttctgatactccaaaccacttttaaaaagctttcccagtcttggaatgccttcttaa

SEQ ID NO: 99067 - DNA, 1080 bp, Homo sapiens
gccaccgtgtctagccggattaggatgttttctagtgaaataatgaagccacactcaagaaggactcaggacaagctgtcagtgtaccaatcaacttaactttccttttcttgatttttgaaagaagtataccgcaaaaaaataaataaataaaatgccaaacttaattcctatctactgatttcagagactaaaacttgatagtttttactctatgcttaactacttaaaataccttgcaatttccttctttagtaattttgatcatgccattttccttttaaaatgcttgccttctgtattctagaccttatcttactgaaattctgccagtctttcaagatccattcaaaagtttccacatcaatgtagtttatactcttttccagtcttagaaatcttatacagatcccaaagcactgtaacattttggagatccccgggaactacagactcagtatctgtctggctgcctcctctctgttcatctgtccttacgttactgcttcttgctaccatgtcatgtccatccaggcagatctcaccatctctttgtacaccatgtttatttctttccctgtgccttaaggcttaacttttaggcctctcatcttctgaagctagatcaagccctctttcattttgaattattaaaaagattataccattttcatggaggtggcaataaataatgttcttcatggtttttgttgtgcacggcacctctccttaaaacagtagtcttgtggaatggcttcccatgcgttttgatgggtagttactctgttctaatacagttttactctgatcctgttagctattccttaacctttggtgaaagctaggggaatcgacgtactccctctttctgagcacagtgataagcctggtgtggtcacatgatcaagatgagaaaagttggaagatttagcttttttctttctggtgacaaagatgggaagatgtgaatctgaagttgccaactactgtgtatgtgccttatggaggaagatggacaggcagagaagagcaaagagtatgtgtgtgctaacgttctggcaagtttaaattcgttagtag

SEQ ID NO: 99068 - DNA, 2841 bp, Homo sapiens
tgcaaatgagatgagaagatgctggctcttctaaatatcattttgccgtcttggcttgattcttttgctcataataaaatgtcaagactgggagtaactttgaaggccttcttatcagcccccaggttgatatatttttgttttgttttgttgagatggagttttgctcttgtcacacaggctggagtgcagtggcatcatccgggctcactgcaacctcctccccctgggttctagcaattctcctgcctctcagcctcctgagtagctgggattacaggcacgggccaccacacctggctaatttttgtatttttagtaaagacgaggtttcactatgtcggccaggctggtcttgaactcctgacctcaggtgatccacccacttcagcctcccaaagtgctgggattacaggcatgagccactgcacctgacccagattgacttttgaaacccctatagagtgtactgttctagcaattatctaaactctcagaaacctttccagggagttttgggagtgagaggattgggattaattgggagagaacaattacagctatatatttattctcttcatgtgactcgtttagccttcctaagtaaaatgctgtcattgtagccttcgtttcctgaaaatggttgacttgccccataaaggtattcacagtgatacagtgattcaactaatgataataatagcagttacacaacagcattaatggagtgttttaagtttaaaaaattattacacattctttcagttgaaactcagaaattaaatatgtaatctctcttacaaatgtggaagcttgctcaactttgtatagctagtgtgtagtcaggacttgtttccagacctcttgactgtaaagtcagtgtaccttttcattatgccagagtgtttcattgcagcccactggatccgtatgatgagggagtgttagaagagggtataaactttagttttgaatttaagtagcacttttctctcctaggatttgtgctaggattcatttttgacccactctgtttttttctaaacctctgcattaagctgtcttctttgtgtaacctccttccagtgacctcttgtgcctttctcccaaatcaagatggtttctttttaaaaatagtttaaattcattcttaagataaatgaaagtagagtctgaggatatatttaatcccttttaattttacctctgctctccttttcacccatccttcatcactatccacagttgaactaggcatcttattcctcttctattatttttcttagcccctttcctctctaattttttggattgtagctgacctgttcctctcttttctgttctctttttcttctataggaaatcactcctttccactgcttctctgttgacttgctctcagggatactacctagccttttccagttctagcacaggtatttgtaggctaccacctccctcttggcaatgcagtagcgtttttattataccgtgtgctttttcttgtttttctcaagtggcagtggtaggattgaatttaattttatagcaactttaagattgctttagtggtagtgtcttcaaggttgatttaactatataaacagtgcatattgagaatagaaaattgggacgcttcaggaaaattaaagaaaacaattttaatcctaccactcagagataaccatggttaatatttctagtctatgttcttacagtcttttctatacgtgtagcttctttttgtttttttcaaaattccacagagatcaatatatgtatacttgcaacatacaaataatagggatgatgttatcactagatgtattttctggaattctgtaacattcttccatgaggtaatttaaagtggctccatgattttctttaatataaaagcccatgatttaaatttgggcctctaggttttttcctcagatttttgctgtaaaaaatattgcttatgcctatcatatttgaatgtgagctggttttatcaagtcgaattcttgaaaatgggtttacagaatctaagggtatgaatattttgaagacttttgtctttcagaaatcttgggccaatttaatacttctaatacttcatgagagtcctcattttgccaaatcctagtcaatagagcataccctttttaaaaagaaaagtttgtggggaaaaagaattccttggtttaaagttagcatttcttcgtttactatagagtggaaaaatttgctccgtgggccattttcatttattttctgagctgtttgttagcgtcttttgtctaattttggagatacttactcttttattagggccctttatgtgaaaggtgttgattcactaacatggacaaattttttttctgttttttttttatggtttattttaatttctacaacattttaaaatcagataattaagtctaccaactctgtttttcttcctttgccttctccatgctaagaataaatttttcctcagctttgttatggacccgtttttacatctgactagaatctgtctgaagtttttgaatgatgagaggaaatgcttgtatacagttgcctacttctcacccccatcaaaaaatttgcctgcaaagttttaataattatgtattactcagtaaaaactcaattgtgagaaatataggatatagccttctatttattatttttctttacatttttagagcagagatttttttaaacccccattagttatatagaaagaaatagagttgtgttttcacttaaaaaaactatttcaaaggattgggatgcagaaaagtacaaaaagaaaataagaactattcagagaaaagtctgtgttaactt

SEQ ID NO: 99069 - DNA, 3096 bp, Homo sapiens
attcacaacaatactgtgaagaagacatgacatacattgttaattctgtgtctaaggaatcctaggcttagaggctgtgatttgtacaaaggcaaacttctttaacacctattccgtcacaagacttgagccatcatcttttgacttgaggtgtagtgcctgtttaggcacaatactagaatggggaaacgaagacatatttctacctgtgctctgttttctttgaattgagaattttctggctattccgtgaaatctaagttaattttatatactgagtccgggaccacatggcttgaatatgttacacgtaccctgacattttgttaacacgttgatcagtcagacttcacagttcagtgagacattgcagcatgggtgaaggctgtaaaatcagatagtttgcagaaaatttccatgtcaccgtaagttcccctcatttcttttccatattgtattttgtacatctgataaattttgtttatttttttttcttttagtgaatggtagtgtctagaaagggtatgtcccttcaagagagaggtgccaatgtccaaccggcctaataacaatccaggggggtcactgcgacgttcacagaggaacactgccggggcccaaccacaagacgactcaataggaggaaggtatgtatttcatggtaatttgaaaaggaattgggaataaaagaaaaaatatttttaagcctccttgcgaggtccaaaacttgaatggttcattgcatatgggtaatttttcctgatttgtgagccaggtacttaaaagcaaactggaatccaaagcagttcctaaatttttccccagatatgctagactcaaagaagtagttcatagccactgacatgatcagacacctcatttagcatgtggtgtgtcatgttttgtttgccctttctcttcacttcgttaaatgtatgttacaacacatctttcaccattcgtggtctttttccttatgtgttgacttaatgatactttatggaaaagaggcctcatttgttttaagaacttgagttttaatactcagcttttgagcttttgtcctcatcatgccttttgacagcatagatattaacagggtagtgaggcactctgactttgttagtgaacgagttgtcttatgtttttagtggtctggtgtttctttttagttggagtagttacatatgaagtagtgtgaagaatcagatcagatgtgttttcttgaatgtaatactccaagtcagatttagccaaggactgtcacttcatgtaaaaaatactcagaactcttcttgcaaggcctagttctctaattttgggactaacattgattacgtttagcttgtgatggataattgttaaatttttttgtttttgagagtctcatcgctctgttacccaggctggagtgcagtggcactatttcagctcactgcaacctctgcttctgaggcttaaaaatccttccacctcagtcccccaagtagctgggattacaggtgtgcaccaccgcacccagctaatgttttttgagacacagagacaagattttgccacggtggccaagctggtctcaaactcctgacctcaagcgattcacccgcctcggcctcccaaagtgctgggattataggtgtgagtcactgcgctcagctgctgaattctaataggattatctcatacagcagtttgcggccataaccatgaatgcatattatctagtaaagtatttaaaaattttttaggccgggcgcggtggctcacacctgtaatcccagcactttgggaggccaaggtgggcggatcacgaggtcaggagatcgagaccatcctggctaacatggtgaaaccccgtctctaccaaaaatacaaaaaaatttagctgggcatggtggtgggcgcctgtagtcccagctactcgggaggctgaggcaggagaatggcgtgaacccgggaggcggagcttgcagtgagcgagatcacgccactgcactccagcctgggcgacagacagagcgagactccgtctcaaaaaaaaaaaatttttttttaatgtcaaatgtaaagaataaaagcacatcatggtgatgtcagactatttagtggttaagcatagggactttggactagggcagctttgcgtgtgatttctttttgttttgttttctttttttttttttttaaaacagttgctgtcgcccaggctggagtgcagcggcatgatcttggctcactgcaacctccacctcccgggttcaagcgattctcctgcctcagcctcccaagtagctgggatttcaggcacgcatcatcacacctggctaatttctgtatttttagtagagatggtgtttcaccatgttggtcaggctgatctcaaactcctgacctcaagtgatccattggccttggcctcagagtgctcggattataggtgttagccaccgcgcccagcctttgtgtgtgatttctgcctctgccattaaatagctatgtgtcttttgttaagagtttcaggaaacctcagtttcttagtccacagaatgggatagctatttcataggattattggtaaacttcagtattttagcatgttaagctcttatcacttatacttagtatatagagctctgttctgaaaatgtttgctcttttacattcaggttattctttggagcagccacactcaacttcatgtgactgattttaaaatattattcctcctgtaataaaagtgttacatgttcattttagattattttgaatatatagaaaactaaaaagaaaaacataattccacacttataacgtgtgctgttgacattggttactattgacatttcttctgtcttttaaaaaactgcgtgtagatgtacattatgtatgtgcatgtaagtaacttgtacctttagaacaactgcggttttatgcatattaatcctcaggttgcattgggactcttgcatgtgaactgacaatcattgtgggctatcaacagcgcattgcttctaaaatccacagtgtttcagcatggtcattttttctatatatcagtgttatgtagattaaaaaattttttttaatttatttttt

SEQ ID NO: 99070 - DNA, 1036 bp, Homo sapiens
ttgtccaacattttgtggactttagaataaaaatattcgtgaagtctatctgttttactgctgtagcacaagagtgcctgtttttctgtaaaacagccacccagcttcatatattttttcctttatatgaagcatgtattttcatttcttcccacctagggaaagcagcttagtctcaagggaatttgaccctgctctctacccttccaccccaggtccaaatgcatttgtgcccttcccccagtagatggcaacaagtaggctgatgtttaagaagattcagtagtcttaactttgtgatcagacctatttactaattatttctcaactgtcattagtaatgttagtgttgattttcacattctggcctcaaaatcctttcagaaaactagactgttaattgcagagttcatcttttttactctactcttcatcctgccttttgaaaagtgttgcctttccagttgctgctatgaactaagacttggggtatttcagcctttggtgtggtgctgtaagataatctccttctgcctcttctaaccatctagtattacttttcagctgcctgtatattaggccatgacattttttccaggtatcttgtcattacagaaagtaaggactactgaaaggaattactgaagagctaatacaccatcattttatatcttcattgtggtacatgttttaattgatactcagtttatttcttgaatcatttaaggaattggtaaacttatgtttgctggaataccagagtttctttctcttctataaaatgggtctactacctaactcatgtgtttactgatattcagccatagtgttacggttttgtttcttattactaaaaaagaaaatgaaggtgattcataattacagagttaacttctgagagtttactgtatctcaagaaacttagaactttttcatgattcctgctgagtttatttaaatttttaatgcaatagtaaaggatttgggaagttttccatatttcttcagacagttgtaaagttaggaatggcttaat

SEQ ID NO: 99071 - DNA, 1189 bp, Homo sapiens
attatgtgcatgtaatagttgataaagtacattgaggacctaaataagttttttttttgagattgagtttcgctgtgttgtccagattggagtgcagtggcgcaatcttggctcacttgtaacctctgcctcccgggttcaagcaatcctcctgcctcagcctcccgagtagccgggatacaggtgcctgccaccacacccagctaattttttgtatttttagtagagacaggtttcactctgttggccaggctggtcttgaactcctgacctcacgtgatacacccgccttggtctcccaaagtgctggtattacaagaatgaaccactgtgcctggccaatatgttttaatgcagtgctaaatgattagtgtttccaatttataatagtatacatcattgtagtttattctgtttgtttctttttagagagcatgtacatatttctataaatatggtgttattacccatacatggatttttgaaggctatttataagcctaagtgtccatcaacaagccttcaagacttgaagttacagcatttcagtgtgtattttaatcaacttgttggctgtcataaccaatgagttctaccctgacttcaaaactcctactcactctagccgtgggcagtgctctgaataaatagatgtaccttgtgctgtgttcttaaggtcagatgaacttaatttaaagattttatactggtaaacatgtgcgatgccctggaaacctaaagtgagttttcacagtagcccatctcttgaaattctctcttcagttgtaatttaagctactttgtgtccttagagagcaggttcatagagatcatatgaatgtcccctactttttttgattctcaaaaaccaagtgcttctagtagccttgtaaataggaaatatatgcaaatgctgtcaacttctcagaccccagtgtttcgtaattctgttttacatccttggctgcaatcagattgaactgtttcttcctctctgaacacacccagcaactttttagcatttttgctttggttttttgtctacttgaattgacaccccctctcacatcttgtatctattatttttattattatttttattttttgaggcagagttttgctttgccgcccaggctggagtgcagtggtgcgatcccgactcactgcagcctccacctccacctccttg

SEQ ID NO: 99072 - DNA, 1007 bp, Homo sapiens
tgtatataatcttagtgcttggtaatttttttttttttttttttttttttttttttttttttttgagacagagtctcgctctgttgcccagggtggagtgcaatggcgcgatcttggctcactgcaggctccgcctccagggttcatgccattctcttgcctcagcctcccgagtagctgggactacaggtgccagccaccacgcccagctaatttttttgtatttttagtagagatggggtttcaccttgttagccaggatggtcttgatttcctgacctcgtgatccacccgccttggactcccaaagtgctgggattacaggcgtgagccaccgcgcccggccagtgcttggtaattcttaacgtgtagtgtaatgtaagctttacttgtgtattttcttttggtacttgtgtatcatttcagcagctgtgttacagacttgaagacataacctcaaagcagttgttctctacctctctgctgggtttctctgtgcataatggatgcttgctgttatttgtaataaatagataagtataccgatgctagacctgtcccttgatttttctttttttttttttaagtaaaatttaactctgctaatgtcttgggttttttaaaaatgtagttctttaatatcctaacttactgatagttttaggttattggcaaaaagaggtttcctagactgaaataagtctgttcagtcatttttctctgaggccttttagattttggttgtttattgtgatttcagtgatttcattaaactgaattggatagaagaaaaaggaacttacccattattcaggcttacctgctttgtcttgagagtgcagaagctattggcagtagtcagtttcatggttatgcttgttcgtttgttgagacagagtctcacttttgtcacccaggctggagtgcagtggcgcgatctcggctcactgcaacctccaccttccaggttcaagtgattctcctgcctcagcctcccaaatactggg

SEQ ID NO: 99073 - DNA, 1093 bp, Homo sapiens
tgaccttgagctagtcacttaacctatctggtcttcatttattttatctgtaaaatgggagtgggtaatctctattttacctcactgggtggttgtgagacccaacagatgtaatgactgaaaaaaaacaacatgctaaataaattaattttagaaaattacatgagctgttttgaggtcatttttaaaagatacagcttctcattagtcgtggtggtccatggggcaggggagaattaatgtaaactaggttgaaggtacagagttatagaacttcataatttgaaattgctgcttaattggtagtagaatttgggtctcatttttgtctttttaaagttaccttctttttttggtatcagcatgccagatacttgtttgccatacattctactgaaaaaacttgttaatatgtttaaagaaacttcaaattcatttacgttttttattgacaaagtacctgttctggtttgtgactctaatgaaattgacttaatgtaagagattacaattagggaataatgcttctgaatcttggtcactgttttctttacagaacctagggaactttccccccttttaagtggatgggtagggatctttttgagcaaatgtgataccagttgctcctttatttttttgtttgctatttgatggactcaagtcaaaacagcaacctacttggttttttaatcttcactgaaatcattccttgcaattgcctgtttgacatggacttttccctcatttaaatcaagcaagcacccactatgtacagaaaaacatagaagataaaggatgtgaagaacaacttacaactcatgtcttcagatcacttcctcgaacaagtttctacctgtgatctttgtatttctgattaactgtacttgcttcgtttctgcattacagtattgcatttgttgacatgtgttgcttttgtttccctgattggactgtaggcttcctgagggcaaggatgatttcatgtcaatgtggtatgtgtgaaggtatactaataaacctgattggtctgggtgaggtggcactggaggtgaggacgtgggaggatcgcttgaggctaggagttgtagcc

SEQ ID NO: 99074 - DNA, 3147 bp, Homo sapiens
gcagaaggatttctaacttggggcgatcgtcccctcttccaagggtcttagggaaccctgatccgtgaaatttccagctccaggtcccgggtgacccgagggggaattagttcctgctaccacggaggggagggggtgaccccggcggagggataccaagtagatctccacagtccccttcctggtccctcgaagggatcgggcggagatcggaggctgctgagagagtcgagccgggaggcgtgggagggaggggcgatgtgatgggccgccagtaggcagcggtgccggtcccgcggacgagcccgtaaccggagcccgaggacaaagtagttccccgagggtgtcagagcaggcggggagggaggcggcacgggcggaggcgcacgccgggcgcggtgctgcggctcagctgataattgaaggaacccggagccgccgccgccgcgccgctggggggggtggggggagctagtggaagttactgccgcgccaccgagtccggaccggagactttggggcctaactaggtaattggggcgcagctctgggcggcgggggcaagccttgggggagggggccagctgaggggttgggggggcggggggaggagctggaacagaaagtcccaggaagcccggttgtgtcatcgccgcgattcggcccccgcttggcctgctcccggcgccggcggcggcggggccgcggaaggaccgggccgggggtggacgggagagacgctcgagggcggccgcggccggagggaccggggcctggcgggaggtaggggtcgctgggtccctcctccggcttcccgcaatgaggagggcccttcacagaaccggggtaaggcttgcgggtgttggggagctcggcggggaccaaggggggccggaagtgggctttggagcttggagggtgtctgggaagagagaaagtggggggccggaagtgcaggtggggggtgtgaagacggcaagggttccccggaaatgggacgaggggcccggaaatcgggaaaggggaggctccggggccgtggacggcccggaaatggaaactaggaagcagctccagtgacaacagttgtgggaagcgagggtcagagaagggagaggccagagagactttagaccgcagtaaggggtttcctgcccagggggacggcgagggacggttgagggagggcgagcccggagacggggtctgcgcggggcagttttttaagccgtgggaagttgaggctgagggaggatgatgacgaggggggcatgcagggaggcctaaagaagccgagaaacttgactgagaggaatagagtatccttttaaatagatcagaatggaaattggtggtaggtgggtttaactaggacttgggggagggaggtgggccaattgtcaccccaatcgtattagcattcagagcgagtcaggcgattaatttatttatatgtggattacataaaacctattatttacaacgtttgtccatcagttcagcccctctccttccttctccatagtgagtgggtttctagtacaggaacaagttagaggggagttcgaataacgaaggtagtaaaacctcaaatcctgtcttcctcggcgtctctcccttcctcagaataagaaatccttcatttcctagacggaaaaatgcggaaaaacataaaaacacatgtaaatcggggggaaatcacactttgaactcctggtgggggacaggagggaattggttaccttacgtggtgaggagataacggaaggggcagcttccaaacccttaagacaaatgttgtgtttttttgataatgctgttttactttgggggaggtttagcctaagcatcgagtctggtggtgggcatagtttaattgcttctttagttaattgggggagggaatgtgtttgtgtgtaaaggttgggccggtgcggggggaggcgggtacggttaatagcgcagtgaatccgttctaagtggacgtctaactgctctcctgctgtctcctttcctagtcgcggtcctcgatcttgcctgggctgccagatcacccgatctccgggctttactccgttttgtaggccctttagtgatgtgtttaactttatgttcctctcgagagtctcattaggtatttttggcatttcattttttaaagacctagcaagttgagtctcagagtctcctctttaaaaacaaaacaaaaaatacggggtagaaagttgaaagagctattgagtggggtaaaacgacgctcagaacaaaggtcctagttgtgttagaaaaaaaggcaagaggcctgtatatgaggcctgtgtgtgtcgcatttacaccccgggggggttgaggaatggaattagcagaggtttagagacaataaattgtagaggattttattgaggctgattttcatatttaccacatgcaaagtgatcaatattaagtgtaagttttaaagtatacagaatttctaattctttcttttgacacttcctgctgtgtgttcagccccagaaatgttgaactgctgtgactatctttgtgagattgagggagttttattttaagcttaagagtacataatatgattggggtttgtgggctttgtacatgtctgcctttctatgaatgtgccaatatccataagaattggaaaactgtaattaagattatcattgtttccattcaatccccagtttttctggagtgtgagcagtttttaagtctgttcagctgacatttatactacttagtttgagtctatgaacaggctttatttttctttttttttttcatttactttcaaaaagtttgagaacaattttggcagttaggttccagaaggtgctaaactaaagtagttacatttaaaaaacgaatgggatgctaggtagatcacggtaaaatcagtactttcacctggcaaagtaaatttgtagtaatgtatgattccatgtatgattcctttcccattgtaactttttttttttttaaagcagaatcttgctctgtcgcctaggctggagtgcagtggtgcagtgtaggcttaatgcaacctctgcctcctggttcaagcgattctcctgcctcagcctcctgagtagctgagattacaggcacgcgccaccacgcccggctaatttt

SEQ ID NO: 99075 - DNA, 1030 bp, Homo sapiens
cgcctgtaatgccaggagatagagaccatcctggctaacacggtgaaaccccatctcaactaaaaatacaaaaaattagccgggcgtggtggcgggcgcctgtaatcccagctactggggaggctgaggtaggagaatggtgtgaacccaggaggcggagcttgcagtgagctgagattgagccactgcactccagcctgggcgacagtgcgagacgctgcctcaaagaaaaaaaaaaaaagagtagttagaggaaggcatgcgcctaagttagacttgagagcaaagtctgaagaacaccaacaacagaattattctttaggaagccgaatgccagggagcactcctaaggataatttactaaaataaaaaggtaacaagatactcagcctggtgaggcttacaaatgagagaaatgaagcatacttgtaaaataccagaccttcaggggaaagaaaatgcaaaaaaagacaaatttttaaaggctgtaaaaattaaaacattctaacttacttgaggtagataaaaatagaaaatcatgtaagattagaacagattatatttttgaccactcatgttaggaggtgaagaaatgttaggatcataaatcttaaagccagccaggctcggtggctcaagtctataatcctagcaatttgggaggccgaggcagctggatcacctgaggtcaggagttggagaccactctggccaaaatggcgaaaccccgtctctattaaaaatacaaaaattagctgggtgtggtggcgcacgcctgtaatcccagttactcggggggctgaggcaggagaatcgcttgaacccaggagatgcggaggttgcagtgagctgagatcgcgccactgcactccagcctgggcaacagagggagactccctctcgataaataaacaaacaaatcttaaaacaaatggaaaaatcaataatccgtttaaaaaatgtacaaggccgggcgcggtggctcacgcctgtaatcccagcactttgggaggccgaggcaggcggatca

SEQ ID NO: 99076 - DNA, 1085 bp, Homo sapiens
cctgtaataattaatttctgaaatctagtcatattcttgtgcttgaaacccatttatctgtaagctttctggaagcacacagatacttcagttttgtcttacaaagaagtggttgagttgaaaagcttttattccctgtttttgtttttaaaagctgtatttaaaaccctagtcccagtagatgacaagagaatggtttttataagggcatttctaccaattacttactaggctgtctttgaacaacactgtcatctctagaatgtatgtagtccttaagatcttccagcattacatctccccaaacagagaggcagtgctgcttacaaatgaggctgtgacaatggcatttacaaatgacagtgccagttaccgtacaaaatgctttcccacgtcctgtcataggtgcctcacagcaaccatgcgaggtaggcatgagtattacaatgaaacctacacggaacattacatgatactaaacatgtgcaccatccatgtattttcttctggattgttctataattcgaatgcacggctgaataagtaaaaagagtattcctatcatgtaaagcaaaccacatatgtagaaggaaaaatcatatttttgcgtgatgtcatagatccaccctacaaaacaaaaaagaatatattcagtgtcatggagttgatacaatgaaagtgaagaacatgaagcaggcatttattgctgctgtacatgtttctacaagaatttatatgtcatttcataccaataaaatgtttcatttatccatttcttttcctttttttttttgttttttatattttttggttctcatttagccattttaaagggtgtgctgtacaccagtgttccccgtgcctacggaggactgcattcgttaagccacttggttgctttggaaggcatttgaagcaattcccagctgactcatggggagaaccttctggttcactcaaaggcccgcacaaggccagcagtgaaatgcgaatccaatgattttcttttttcacaagtgcaaacacgcatttttctaaaacctacaaaaacgattctgaagtttttagtgtgtatcaaaagaggc

SEQ ID NO: 99077 - DNA, 1037 bp, Homo sapiens
ctataaaaatacaaaaattaggcacctgtaatcccagctacttgagaggctgaggcagtagaattgcttgaacccgggagacggaggttacagtgagctgagatcatgccactgcactctagcctgggcaacaagaacaagactctgtctcaaaattaaaataaaataaaataaaataaaacaaaattatgtaatagtagtacatactttcctagatgtttcagtatataatatggcaaaacctcagccatcagatttgaccgaccaatattccacacacatctcttccattcacataaaatctaacaccttaacaataatttgcaatgttttccaccaaaagctgggagcctttatttaattaatacgaaaaacatctattacttatttgacagactcaaatgaaaagaaaatgcactttaacagggaaccagattttactttgaagctgtaggtttgaattggtgcttggatgagggttgccaagaatccagggttgccaagaatcccgggttccaaatccaagaactgaggtcaaacctgcaggaggggtggtgaaggatgcatgaggagggcagcttgtaggaactctcttctctctgaaaaagttgtgtcaacttgtgctgagagtcaaagctcctggtagagtcctgtctctcttgacctgctttacatccgactgggtttgaatttaaactagcagaaatattaaaacaggcaccaaagggagatggcaggatccagagttatttataaataaatcctaaaggtggattggagaaaacctatgggattaacttgacatgaaatttaggactactcctacaatttgcactatgttaaattgttcagtgaagttggatgtgctttttttaaaaaaaactgacatgagttatgtttgaagcttgggcatgtggagatgcttttacacatgcttatatttttagaggaaagaggacagtttttaaaaaaaaataataataataatgaatttggccgggaacagtggctcacgcctgtaatccgagcactttggg

SEQ ID NO: 99078 - DNA, 1022 bp, Homo sapiens
tgagctgggttagtatgagccagaccccctgaggctaatccactctggctgcactgaacaaattaacacttgcacccacaaaaactgagaaccagatcctctgctagggaccccaccaaggtgaagctacactgaaaggctgcctgaagccagatcttccttctttgacatctttcttgtcacctgtcagtatccatctctataagggagacagggtatgggctttggagtcaggactaactggggtcaaatcctagtttcccaattgaccatactaaatacaggccttagaaaatcaccttacttctctgagtctattcccaagattgtaatacctatatatgtgatggctgtaagatgaaacaggtttcatagaagcacttgctcctgggaaacagtaaggagtgttttcaaatctgtatggtgacaaagattaacctgaagatcagatgtgatactggagccactttgaccctgatggggaggtagagctgcacaaagaagatgaagatatttttccttttgatgttccatgaaattatttgttatatgtatttcagaaaaatcttggaaaatgtataccagtcatgaagatattgggtatgattttgaagatggccccaaagacaaaaagacactgaagccccacccaaacattgatggcggatgggcttggatgatggtgctctcctctttctttgtgcacatcctcatcatgggctcccagatggccctgggtgtcctcaacgtggaatggctggaagaattccaccagagccgcggcctgaccgcctgggtcagctccctcagcatgggcatcaccttgatagtgggtatgttcatgtgtgacctgtcgtaaaactgaatcgttatcaaatgacaattccccactgtaagtgatgttttatattgttgtaacattcgatattggatgttactagctactatttttcaattgtgataaaatatgcataacataaaatttaccattttaggccaggcacggtgactcacacctgtaa

SEQ ID NO: 99079 - DNA, 1108 bp, Homo sapiens
gcattctcttttctcctcattctggtccctgcttgctgttcctgagatctaaaactttttcttcctccattcagtggccagtgacaacctgatcccccaaataagagataaagaagaccctcaagagatgccccactctcccttgggctctatgccaggtaatcttggtttggtcaacctaaaagcttgcctttgtttctgtgtttactaagaggaaaagccattcggatcttctagagagggggctctcctcctgcctctcagcaatcttggcccagcttccagttcacccagcacttgggagcttgaacaggcaggagacccgacctctgaatggatacagagtccctgggggagggcaaaggaggcaagtctggaaaaggtagacttggatagggccacggatgatgatggacagagccccaccagtgcctgtaggtttggactccaaatgccacaaagcgcctgaaagggaaacattcacctgccacaaagggttgtggcaggaaccccaggggaaagcaagggaactgagtcaggctggactgtttgacagagccactcttctgaggccacttcaataaagtagtgctcaaaacggctctgtcaaaatgcaaagcaaatgaacaaaaacactgtgtggccctaatagtgaattgctgcagcagacatggatggtcctccttccaagcccccacctgactgtggggaattttcactttcaaccctggtcatttctatatcacttggagtttaagagttgatattatgaatataacttgaaaggtaataaattattccaaagatctaatgactgcttgccacctgcctcagtcacctattcctaagcaggccagcatttgagaccaatctcaatgcagtgtgtaaagaaaaaggtgacagcttcatgtgagatgagcctttatttgttatggcttcaagttctctgtctttctttgtgcagcaaaaactagcagagctttatatgtctttgctgttaacaggtgctagcaagcacaggctagctcctgctttcttcaaacaatccttatatacagaaatatataaggcatttagccttctccactatttctccaagtaaaataac

SEQ ID NO: 99080 - DNA, 1558 bp, Homo sapiens
cttggtactcagaatatagtgtttaagttatagattgtgtttgcttgtttatgtgtgtattcatatgcatgtttcaaagatggggaaaatctagccattatttagtggcagtttgtttttatatggtaattattctttgggagcattatccagcaaaaattgttgaggaccacggaagtatgatactgttaaaagatcacacactttatttggtaatacatttgagaaacaaaacatacattgtgtatcttgatcttaattaagttcctactttgtgatcttgtctcatgaactgtaacttgctctttacagtgtactgactattaacatgctagtcactgttgtctccctccacagtagattatatatcagctgtattgaggcactaggaagaaatacttggacaggtttctgtttacatgtctgtagttaaggcccgcttttaggtttatagaatttggagaggtagtgttagccagtggttaaaagcgcaggtgcagccagactgcctagattttgaaccctcattcctctgctgtgggctctataaccttaagttccttctgtctagcttgaattccttggatggtaatagtagaccatatctgagagggttgtaggacgattaaatgagttgctacatctgatgtgctgccgtgtatcagatgcctagacataagttttgtgatgctcatgataggcttttccaggggggagaaactttagaacttcagaaacaacctaggcagaatggttctttctgcaggtgggaacactgaggcccaccgtaactagagcagagtttggttcactttgagcagtaacaggtgtagctttctgcaaagtgaagtctcttttctagggttttatggcttattagccacaggactgaatctggagcctggttttcttcattctttgtccagtttacttgaattaagtatcatactttatgcagtaatgtcttcttttggaccttttcactaacatttacaaaggttgtattcaaaatatattaaatgttctttgtcatataattcttttttaaggtttaatatactaatattcataatatttgtgatgtagctggcaagtgatttgggaggcgtgtatgaagttagaagtcgaaatagacaaagaatcaaggaaaattaacaaaaattagttagcttgggggaacaaattaccgtttaggtccactaaatgttgggcaaacctcttaggtagtattgtccccaacatcattgatgggaaaccaaagtggagggtttgtccaggataacacaaacattgcacagttgagccagaatttgaactcaggtctgcctcacttcaaaatatgtgctccctgaaatagggtatgactccctcatgaaataattttattttccttgctgagcagttttgaattagtattttagaatggaggtttataaatagatccgaatttggattttaataggtttccaagcagtaaccacattacaatctaaaagagatggtttattataaatgctttcgttgtatagtcataatttgattagtggcttatagttta

SEQ ID NO: 99081 - DNA, 2447 bp, Homo sapiens
aaccttttaattaaaattgagtaccagagaggtccaaggttagagtgtctggtagctgctctggctttaacagttggctcgaatggcaaccaacactaatatctgcctttcaaaacttaaccaggacttgatttcaaatctagttacataagttgacttggagtccaggttagtgttttcctcagaaactagttctgcacccaacatgcagacatttttaatagacacagttttaaagtaatttttagaaaaaattttttaaattgatgacactgaaacccaatatgtaaaactgataagagtgaggtgtttgggctgaagagaagatagaccctcacctgctgcagatcttagaatgggcttaaaagccactatcagaatcatggctactgtcattttagtttgacaaaacttcagtgcctggattgctgttctcccactgttatggaacaagctcaccctgtctccccgctaccctctcaggacacctgcagaaaatctaattttaaacaatgtaacttccttttcaagccactatgagtctgagagattggccgtatggttaacaataaccccagcatttggggagatagaaaaatccaaaggatagatttttgaggcctgcacgaaaatgatcatctctgtttgttagagattacagagcgctgtcacgaatattttgtttagtcctcacattaacttgtgttagtaatattcttctgccaaaatagtaaaggaaaaataaaatgccatgttcaaaatttttgtagaggaaaataagtttttaatgtaagtaaatgtatccattgtacctcttcctgaatggttttaggcctctcactaaaacttaaatttttatgttcccttggatataagatgcttttgttgtgcattttagatactgctttgagattaaaaagcaagttttccagtttgactatattatgatgtcaacacttacctggaaagcaccactccataaagtgtggaatgttctttgagcaataaaagaaggtatgtggttattctgtaaacagcacttgggtttttcaccttctgcctgctttttcacccgatactttattacccatcagagcttgacgaaattacaaagtcatttttctcgccttatcatgcttcagactgttgcataaagtcttccagtgaaacattttctgacccttatccaaatttttcattctacacaacgcagttcaagaaacgtctccgctgaagtctgggaccttcagcacacagtgccctgtctgtacctattagtcttccatggatttaagtcttctgtatttgtgcctttctccccagctgtattctaagtcctgaaacacctagcgaatatgtaccacttatcattcatgccatttagttctcatcttttggtttatgagctgagtttaggctgtatgattgggaacttttttcctccaaaaacacaagcaagagcttttatatttgatcataccagtcagttggcaaatgaggtttggttacttcctctgaagttcagtgttgtttagcctcattatttcatcaggatcaaggcttcatatgccagttagtgtgttgatgtggaggagtggagtggaaagaatatgttgattggttaggaaaattctcagcagaaattatccttgggtagaatgttctatgtgatcatctacagggctgtgtacttgtgcattctgtgactctaaatactgctgctggaaaaagtctgtttacactaaataccaccatacgacagcctttgagcagtttaaaaagaaaccttccaatctcctactatggtggtttagctcaggctggttttgtggcatgtttgtgcttttgtgggcatttggccagaacagaaatagcaatgcttagaccttgaaggagagtgattttccaggtttacatctgatgctgtagaaataagtttaaggttataaattttgcaaataaaactttttttcagaatagttattcattggaatgactaaaaggaaaaactaaaaatcatttcaccactctcaggtatgactttagaaccatagcatttccaatctaccttaattctttgacacaaaaataattttatggaaggccttttccccatacttgaactttcaagttttctcatttgtttaggtattcttttaaaggaattatctctataaaagagcaggattcactgtttgcttttcttatttaccgaaatgtgggtgaggctgtgatgtttgcccatgatcatatggactatgtttacacagccttgtagcaagtgagagtaaatttaaccagaaggaaaatagatatttttaaaatgtggacattgattaaccttttgtattttaaaatacagtgctaatttgtctagaaatagctgaagttcccgttttctgaaactagttctaaagatatgataatttaactcttaatttgttagg

SEQ ID NO: 99082 - DNA, 1464 bp, Homo sapiens
aatccccttagtgggttatgactagtatttacaaggaagggaaggagtagggctaggatagaacaaaatagaataaagaatgtcagtataattttacatagtaagtataagtgctatttggtgactcttgttttctttttatgaatatgtgtgcatcatgggtcatgaggtcaaagtagtctgtacgccaccagtgatactataatgcagttaggtggcctggtggcctcgtggttatttaatgactgtacacaaaatacagattgaagagaggctttattggaaagctccagtactctcttccctgacctattcatacttttaataggaagtaaaggaaaacctgtgtgacttgctaatcagatttgtagttgacaggaatctggtaggggaagctgatgtatactggataacagcattaagatccaagtaaaaaaatttaaatgccatactacatactgagtctaaatcagaaggaattgaataggaataattgttcagtcctgctggcacgtcccaaaatgcagtaatacagcagaccccaacctttttggcatgagggaccagtttcgtggaagacagtttttccacggactagggctggtgggacatgcagggcaggggatggtttcaggatgaaactgtgccacctcagaccatcaagcattaggttctcataaggagtggacaacctagatccctcgaatgcacagttcgcaatagggttcacgctcctgtgagatccagtgctgctgctgatctgacagtaggcagagctcaggcagtaatgctctctcacccactgctcacctcctctgttactagcaggtcactggacccgtaccactccacagcccgggggctggggacccctgcagtagtatacaatggttgaagatggggcttcctatgcaacatgtacaaaagacttgggtcaattaaattgctcagtagaaagtgttttagctgtgtggtgtgactattaaaacttaacataatttaagatcacatttatgaaatatatggaaaggtagtctgcctggttagctgacacatggggagtatgggatccagtttggagcaccacactctgagaggagcagtgacaaataggaatgcctggagaataattcaggcggtcccctgattaattcccccaaggtttatctccctctgacaaaaccacagctggataaattttataggaatttggttgctgactatggtaattgtggtgcagattcaatgtgaatatatggttctcattcccagacaccacacaggttagtgtggagatggttatttacatattaacatgtcttattagactgttgaaaatgctttcagctctttcttcatgacatctctttcattttatcccaatcctggatgcctccatgcttaagacacaaggatacaggtctacttcagaatattcctacctgatacccatggaaatggttg

SEQ ID NO: 99083 - DNA, 1036 bp, Homo sapiens
atatagattctaagagaacttccttgggtaaggtaagtggtactgttttttgtttgttttttatttgttgttgttgttgttgttgttgttgttgttgttttgagatggagtctcgctcggttagccaggctggagtgtagtggcacgatctcagctcactgtaacctctacgttccatgttcgagcagttctcctgtcccagactccagagtagctgggactacaggtgcgtaccaccatgtccggctaatttttgtagttttagtagagacggggtttcactatattggtcaggctggtctcgaactccgcacctcaggtgatccaccagcctcagcctcccaaagtgctgggattacaggtgtgaaccaccgtgcccagctggtaagtggtattgtaaacgcaggattcaagtacatttctcattttattggtcaatggggatataaaaatatgaaaagtttagctccagaaactagaaacaaagtgacctcaagaagttagaggggacttttgactgaaccacattaacatctactaactcagagggtaatagcacataacttgacctccctctcacagttggacatcttcaactttaggaagcactcagcagtcctgatagccctacaggctttgcaccaggtggaggcagctaacagccagcaaagagcagaggtacccaagactggcctctagaggcagtcgggagagagcagaccccacagagtagacatgatacatgtctgctggaactgccctcagtggctattccttaatccttatcttaaaactgcaaattgatgaaaggataatgtgtatgtcccataaattaaaaatggttcatcttttgtctgtggctaaatatgttgtctactcattacattcattctattcatcagaatcgtactgaacacctaaatgctgggtcagattttaggcactggggatataatactcaataagatgaacaaggtctctgctctttcgtagcttccgttctaattaagaaagctggacagtaaataagtaaaca

SEQ ID NO: 99084 - DNA, 1011 bp, Homo sapiens
acatccatttgtaatctgaattttaaaccctgtgatcaggaatgctgattttcagccattcatcaataatgtatgaagcattttaagcaacagcaatgtcttagtcatatttatgttatgaaaagataattctaggtgtgatgtggagaatgcatccccattaggccccctgcaatccaaagaaaccagtcagtacacgatatattaatctaggcaagagttatgggaactttgatttgggtggtgatggtagacggggataaatggatggatttgggagtcagtgatgagttagctattggggcgaggtgaagaggggagagttgaagatgactcctaaatttctgacgtgtagtaacatcatcagtggtatcattacatgaaacggaacaaggcaggatatcaggcactagggcgagatcttgagttctattttagatgtattcgatttgaggtaccttgagacattacgagtggagacattttgagaaggctgcccagtggtactgataaggcctgggagaaaagaactggattagagataggaatctatgaggcatctgcatttaactgttaattaaagcagtgggtgtggatgagatcacttaagagtctagagaataagaagaggaagccctagtaccctgccttgcgggattccctgtgtttaaatggcctagccaaggtgaatgaggcaaaaaggagacagagaaggagcaaccagagagttaggagggaaaataaggatggtggtgagtcacggaggaccagaagaatggttttcagaggcgggtgtaatcagcaattccgaatcctgtggaaagttcaggtgtaattgttgggaatgaagtttttggtgtcgggaaaaagagaaaaaaagaattaacgcgggaagaaatgatctctcagcagagagagctttactttctgcagaaagggtgctactcaatagttgtctggccacgagagcacaccgaacaaaggagacagagttatttataacctgacgtg

SEQ ID NO: 99085 - DNA, 1033 bp, Homo sapiens
cttggaaatagttgcatatatacatgactgagcagccctgctccaagatttgtagtagatcattactgaaaggagcatgatgattcaaagatatgatgggctctattcatgcgtcattcctttccagcattttagtcaatgattgaggcaggtcatgggagacatacatatgagattttcatatgtatgtgagagcgtttagctaatacattggatgtccatcagaatccagagttactgccataatcttgaatgatgggctgatgagattaaattaaatagaaaaattgaagtcttcattgcagtgtcattcgccccagtttaagaataacatttggaaagacctgtctttaccaagcagtacctgtgaaagccaaagacattttgttcactgtaagctctctctgactcaattatacaatataattgcaaaaattcttagaaggtagccttgggctgcactaacatttgtaatggaggagtggtggtctggtgtcttctgcattgtaccattctggatagggctgaatgttagctctgcctttcttaggaggttaatcaaagaacctgaggggaggttttctggagaagatgacaatttagggaagataggcaggctgccctcaagagatttatgtggaagagaagttaaaatattgcctgatctgcagtacaaacccagggccagtagacagtgtagtgaagcaatgtttgtctcgtaaatttgtctaacaactatctgattctgaattcagctcatcctgcattactggacactggaaatatttaaggtaaagtcatgtgatttgataggaagcttagaaggttacataactgaataccatgagactatatgatcctctaagtactgcttaacgctgaggttttgtgaatctgtgcaaagtaatcttgaagtatatttctgatcataaatgcttcactttatataagtttttatagcctttatgttatgtctctttaatactctacttgggtctcctttgttggtttattagctataaatctttgattt

SEQ ID NO: 99086 - DNA, 1054 bp, Homo sapiens
tctctatcttgagcagaagtagaagctctttagtgactttatatctatcactaacaccttagctttgcactcacccattttctgctctcttcccttatttcctccacaccttttctgtgataagacttgtactttcccttctccctcatccctagctcatgccattccttatcctccatacttgcttgtcagaatctcttcattcttagggatcagcccagttgcctctttggtgatgtttccctcccacttgaggaagtgaacctttctccctgttttgtttctgccatagataaacatggttttcagtgtttgggtgtctgtgttgtgcacatgctggccttcctgtggtgtatgcatgttggtccccatgtgcacgcagacatagcgcccagctcctgagggcaaggatggagcttgcccactttgcttcttgttcataggtccatgggtctgtaatatagagaggtgatttgacaaattttgacgtgttatatgtttgttaaaatgaattgttttttctcctcttcccaactcctctctctaaaattaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgaggtaagaaatcaatttcttatttttaaaaaacagtaccctgtgcataattcttttccatacgttctctcttttggaacattgtaagattccttttgggctcttggctcagggttactgacctctgtcagcatgcctgggctgcctgcctgattagcagagcaaaggcaggaacccaggggtgtttcaggcttgggacagggttcttccctgtttcatcacattggacatggagtttcttagatattcattatgccatttcatttaggttgttttaaaaaacaactgctcattagagcactctagtactctaataattcactggcccttgactttcaa

SEQ ID NO: 99087 - DNA, 1027 bp, Homo sapiens
gtcctgcttggcccttcagctagagcagagtagcatcacagggcgtctacacctgggtttgctgtaggtggcacagcttgctcctcctgtctcagggcccatttgcatctcctgcccagccctggtaggcatttgacattgttgcccgagttaatacagttggatcatgctatgttaaatatttagtggatttaacagtgagaataatgatcctggataccatctgaatatttgcgatgcatatatggtaatgaagctaatgaagcgctgtggcatggccatgcctctttaactctttgtcatcagtgtgctttgttttaagccccagtgtttgtcagcctgagtgagtggatgtctgtacaggtgcttgaaagacaggtacatgttccagaggagaaaatgacagacgtatagccagattaaattttggaaaaggatgagagggtatggttcataagttgagtataatactgttaataaaataaagtaaaattttatttctgtcctactgtagagcagatagaactgcaatgttttcatttcatagctgatttcatgtatttttaataatgtatcaaattccaacagcaacaatttgtatttcctctgcaaagttggggatgtagtggaacatctaggttccttctcctttgtctgcctccacccgacctggacactgaatttaatatttatgtggaacttcaaagacatcaacttaaaagaaaagtgtgcccttaaggctggttcttagagattgccatttctgctcctgagctagtgcggggcccaggatgatctctctgtctgtggtttaggtataccctggaaagctagcatttcactccctctcctatgggcttgttagccttgtaacaagtggctgttcagaaatgccacttggagtccagttctccatttgttgatttcttgtgcagctttccgattgtaagattcactggaaagatccgtctgttttgtacagtagtgtaatgaagttctgatctctgaactactgtatcatgtgata

SEQ ID NO: 99088 - DNA, 1079 bp, Homo sapiens
ctactttccattaaagcccagcttcatacagaattattccatttttaatatagcagcagagtatattttcctctccttccatcactatgaaaggaaagcacatatagtgttcccaatgtaagcatcttatttgaagctgcttgttccatttgggtggaattcagatcccttagattgttaacatattgcagggttttgtttctcatatcagagtcagcgtgatcctgagacttagaaatggtggaaattatatgtggaatatagtcaacccattgttgtttttgtcaacacattgttcatgttaaaaatagtacactagtaaacttacaatttggaattacaaatgaagagataatttaatgtctatgaatgtgttaaagtcagatattcagtcataacaataagtacaatggccttattcgagttcatttgggagggtgaatgagcattttgatgtttggtcaggaaaatgtgttaatgattgtattcctaatagggcaaaaaagacgtggctcaaattttcaacaatattctcagaagacaaattggtacgagaactcctactgttgaatacatctgcacccaacagaatattttgttcatgttattgaaagggtatgtacaatgtaataaaatttgtattctcagttgaacataaaggaaggattgccttgggaaaaaaaacaggatgctgaatgtgggaagcattttctctgtagttagataatttttccatagattttgaacacatttccctccttgaaattcaacttgtgagctaaattgaatttgaaaatgccctacaggtgggaatttaaaattaggtgaattctgagcttttaaattcacaaatccagcatgactgaaggaaaaaataataattctctgtggtcttatttctgttctctaggatttaaaaaagttgaatttcattgaagtatcagttaagttatatattgaaagacatctcctttggacataatacgcacgctgtaaggcagtaaaagctgcctcttaaatggagcatggattctctacagctttactttgttgagtcagcaaagtacatgtttatgaag

SEQ ID NO: 99089 - DNA, 1564 bp, Homo sapiens
attgaaattaaataatatttatgattcaaccccacagtcacactagacaaatttcaggtgctcagtagctatatgtggccaatctcaccataatgaacagcacagatacagaacatggaaatttctgttagacctggtttagaactgggtaactgaaacaaaataatgatgccaaattatagaaatgaggaagcaggggggtgggggtgattttatggagggggatgagatttgatttgagacacgttgagtttatggtagccctttaacggaagttgtccagaggcaacagaaaatgcctaactaattcaggagtagacatggaggtggggttagtagtcatggtgggagccatgagattgtatgggctttcattagcaggctgtaggcaacaggtgaagacctcagccaggcaagaaatgggaacagtcagagagatagaaaggagaacatgaaaggttttattttggttttttacagcactgtcaggacacttgagtagaagactctatttagccaagagggaatctttgctggcccgttatttcactagtgtgttgggaaatggaatatgactagaggagaatgtgaggtggaaagaaagccagtgcatgcagcttgagaggaagtagaagagagcgatgtgtttgagggggcggaagagtccagtcagagggcttgtgcacatctgaaggggaaatgcctcttgcttggctgagaggtgtctctctaatggcggggaaggaagaagccagagacatggagatgagcatagggaaggctgtgtgcagagagctgatgaggggggtctgcctgctctgtggcccctgggctctctgatggggacactttgtgaagtcctcaggaggaggcttatcagcttggtagtgtttacatgtggctgagagtctccaagtactatcttgagtattgaattgaaacaacaaggtataaattctatatgtttgtagacctatttagatattctgaatttggggaaatattttgttttctgttttttgatttagcttttggtttttctgagtgtcaagagcaccatctgtaaaagctaacccctgtatggagtggtatgacccgaaatacttctcttgaaatctttcagcttaaataatgaacctttagtcacacagtcactcgtatggctatttttctttggtttaaggcggtcatcaccaaccagtgtgtgtttgcactctggagtcagtttacctgagcacatgctctgctccgactgaaataccttctgtaatctgcgatggtcatttagttaggatacatgtctgaaaactgtctttggcctgaaagtttgaactgttcagtgttggagttttgaaaaagcaatcatgtttggtttgtttgtttggttttttgtttttgcaggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccaca

SEQ ID NO: 99090 - DNA, 1131 bp, Homo sapiens
ttgccaggcgcagtggctcgtgcctgtaatcccagcactttaagaggctgaggcgggcggatgacctgaggtcgggagttcgagaccagcctcaccaacatggagaaaccccgtctctactaaaaatataaaatcagccgggcgtagtggcgcatgcctgtaatcacagctactcgggaggctgaggcaggagaatcgcttgaacccaggagacggaggttgtggtaacccgagaatcacaccattgcactccagcctgggcaacaaaagcgaaactccatctcaaaaaaaaaaaaaatgtatacacgcacacacacacacagcccaaagaaaatacatatatacacaccagtatttagcatactgatatgcagacgaccatgctcagaaaccatgaacactatcacagtgagaagtggccacctttcttctgagggttcattttcatgattatgaaaagcccctgaaataatgagcacacactttggtctctgggtgaaatatgtcccacctcagagtgaatgaatgccctaaagataggatgaaacctggggacctgatcattagggttttaccttgaatgagaatcaggtcataaggcccccagggatttattgaatgagaatcaggtcatagtatgagagctccccaggaatttatttcccaaaactcttaaagagggagttgaaagcctcaggtgaggacccagatatttgtatgtaggtgtacaaagcaaaacaaaatgaatttgagattataacatagagtgatcaatatgatgtcttaggtgtcaccacagttggtgggctaggactcatgcttataatgcatcggtggaagggtatgtcccattcagaagtagcagacctgccatgaagggcggtgtagcagcaccatgtgtcaaagagagattcccctgtgtggaaggacagccaggagcctgagggtggcagtactctggccacatgagggtgaaggaagaggattgagcagcagtggtgtgggagaatgcagcaagacccctgaccccgtcaggatgtggttgacatgcttctggcacagatggcaaaggtggctcagaggtgagagagatgtactgactatgtgctggaaatgggatttgcagtgagt

SEQ ID NO: 99091 - DNA, 1976 bp, Homo sapiens
tattcagcatcaggcactcttattgattcatgaggaacattactgctaatctgctgttaagtgaacggtttttcattttacccttttgtttttcagtccaggttggagatcgtagctgctgctgcttgcacactagggcacatgtgggctttctcttgatctttgtgtcatttcagaattcaaagactgtgctacgggagttctgaacatggctgggttcatgaaggcaaatgtatggatgagagtgtggtttaggaaagagggcactgatatcagattagacctatgtgtttgcacccatctttgttggcgatctgagtgcagtgtggcaagtgcacacctggcatccctgcgtcagatcgcgcaccttcaggtcgcgcaccttcgctgaaggaagatgacgcagagctttatctgaaatcagaggggagctatccaaaatgggagtttgggggcagctaaagttgacatgcgaataaattgatactgaaacttagcaacttcttaaaagtgtaaagaagcctcataagatcataaggaaaatgtatatatgcttttcacagctttctagaattttttgacatttgattttcttgagacttgtaaacctggatatgttgaagggtatttgttaattttacttttcaaagatactttaaaacagtagagctagcaatgacaccttgcatttcatttcaacactgcttcaaggtttcttttgtatataattcttagaatgctcatttcttttaaatggtttaatttgtacagcagaggaatgttattgtagtagtatgtaactattacctaatactgagtttttgcaaaaaacaatgaatgctcatatgtaattgaaatacttcagatcacatgaaaatgctgatttaacatttaagtatcacagcattaaaagaaaaagaaagtaaaccagtcctttgtattcagttacctaatggggtgccatcaataagctgcgatacagccctggagctcagtcagccacaccttcctgcatcctattggccttattcattttaaatgagttaatgaatctgccagatctgtgaatgatagagattatgctaaattaatgctgattctttgtgtgtgtgggaaatctctgtagagcaccttttctttcttagactaagtaacccagtacaatagttgtgaactgaataattaaaactttggcttctcttaggaaaagacgacttcctagtcataggtgtcctatggggaaatttattttttttaatgtcctgttccttaatgctgcaaattatcagtatttataaagtaactgattttgcaccacttttttgttactgtgaccacggcagaacaatgtcttctagactatatctatgtaaagttattagaatggtatctgttcattttagtgatatgaagatcacaactaacaactgacaaatcagagtttgccagttcaaattcagcatggctgcagctgattaagaaattgatatgattattctttgctagcctctcttactaatggaattatatactggccagtaaaatgggcctcccaattgctgtttcagcaggttttaaaccttcaggaacaccagttaggaaaatagctccagaaaatatagatatattttatttttattaaaatggcagtctacatcataattggcatttctcaagactgtctttaccagaatctgtgtgaaataaggcaatctagtctccttgaaaaaaaaatctcttggatgtttaggaaggaagacttggccgtgatgtggtgtcctggctttgtggtgtagtgctgtgtgtatggagttagtgtaaaaacatggattacaccaagtggaagaaacgtcttcttgccaagctcattcttagaacttacacatctagaacagcttccactttggcagtgaggtcgtagccttttaggtggaagaagtgagggtgcagcgtgtcagacacaacattcatgttac

SEQ ID NO: 99092 - DNA, 1044 bp, Homo sapiens
caaccccaggctctttctctggtgtctgcacctctgtggagggcacggaggtggccaggtcctagtcctgctgggccaccccttttcccagtcaccgactcaaggacttggaggccagaagggaccttagggatcatcatgctttactgatggggaaactgaggcccagagaggtctgccacctagaacctggcagacccagctcatcctcccttccgtttgtgaagctgggaagcgccttgcccaagaatcagctcatctcctcactggcagccccagaccctgacctgatgccccaccgtctcagtttctccatctgcgaaatgggtctcacagtccctgctcttcttgcttccgcaggcttttggggcatgtagcggacgggtaggcaagagggggccttacggagtgcgtgtatgaccagcctctctgactgtctgtctgtctctccgccttgctcagctggcccgagataacttcttccgctgtggtgtgctgtatgaggactccctgtcctcccaggtccggactcagatggagctggaagaggatgtgaaaatctacctcgacgagaactacgagcgcatcaacgtgcctgtgccccagtttggcggcggtgaccctgcagacatcatccatgacttccagcgggtgaggctggccagggcctgggggtggggggtgggagggtgtcccggggactcagggcaaggggagcagggatgaaaggagactcctcggagtacagcaggtgtctacggttaggcttaccagggtcttcaagacactgcttttctcctgttagcaacaatggttcttgctgagtatgaagcagccgaggctgattttctcctcagcctcctgccagctgcacgctggctgtcatggcagggccagtgcgttgtatcgaggggtagtacattcaccatcgagtgcattgcgtgtacagctcagcgggtctctgcagagtgggtctcatgcgtattcatgtaacccccatgggtcctgagacagggcatctctcgctggggtccaggctgtccc

SEQ ID NO: 99093 - DNA, 1726 bp, Homo sapiens
tttaaagatgaggaaacaggtgcagagaggttaacaccctggaggtcacacagcagggaggtggcagacatgggcaggctgactccagctttcgagctctccccatttctcactgtgctctttgggtgaatctgggtgaatggtgtcacttcctggccctcctgtggctcaggctgaggctggtggtctttgtgactcagccaggatgcagggctcactggggtttttctttttcctcccagggatcaacaagcgtggggccaagaactgcaatgccatccgccacttcgagaacaccttcgtggtggagacgctcatctgcggggtggtgtgaggccctcctcccccagaaccccctgccgtgttcctcttttcttctttccggctgctctctggccctcctccttccccctgcttagcttgtactttggacgcgtttctatagaggtgacatgtctctccattcctctccaaccctgcccacctccctgtaccagagctgtgatctctcggtggggggcccatctctgctgacctgggtgtggcggagggagaggcgatgctgcaaagtgttttctgtgtcccactgtcttgaagctgggcctgccaaagcctgggcccacagctgcaccggcagcccaaggggaaggaccggttgggggagccgggcatgtgaggccctgggcaaggggatggggctgtgggggcggggcggcatgggcttcagaagtatctgcacaattagaaaagtcctcagaagctttttcttggagggtacactttcttcactgtccctattcctagacctggggcttgagctgaggatgggacgatgtgcccagggagggacccaccagagcacaagagaaggtggctacctgggggtgtcccagggactctgtcagtgccttcagcccaccagcaggagcttggagtttggggagtggggatgagtccgtcaagcacaactgttctctgagtggaaccaaagaagcaaggagctaggacccccagtcctgccccccaggagcacaagcagggtcccctcagtcaaggcagtgggatgggcggctgaggaacggggcaggcaaggtcactgctcagtcacgtccacgggggacgagccgtgggttctgctgagtaggtggagctcattgctttctccaagcttggaactgttttgaaagataacacagagggaaagggagagccacctggtacttgtccaccctgcctcctctgttctgaaattccatccccctcagcttaggggaatgcacctttttccctttccttctcacttttgcatgtttttactgatcattcgatatgctaaccgttctcagccctgagccttggagaggagggctgtaacgccttcagtcagtctctggggatgaaactcttaaatgctttgtatattttctcaattagatctcttttcagaagtgtctatagaacaataaaaatcttttacttctgaccttgacttgagtgtggctggaggggagatgggtgtaggaggggtgctccgggcagggtcgaggagctggacctcgggagcagcaggcagggagaagcctgcagaccttgacatctggcccctaaagagctgggcatcctggattcagccaaggagtgtaggatatccccttcgtagcaccctggatctgagccaggtagagttcacactttccgggtgaggaggggaacagggctgggagag

SEQ ID NO: 99094 - DNA, 1063 bp, Homo sapiens
aaacaattgaaagccacttttctgggaaaaaaaacaaaaaacaaaaaaaaacgctgtttgcggcagccccaattccctaagcattatctggtgggagatgtgttgcagcgagacctcccaccagtaggtggcactgcgcgcaatgctcgcacctcccctcaacaccctttctctcagcaatggcgggtgatggtgggggtcctctctttgcagggctggccattctaatgcctgacctcaggtgcagaccagtgttccgttgcgcgggactcctgacctcgaggaggtttagagaaaacaatggtgttctctgtgtacccttccgcgagggctggggagtataccgccgcgcagaagacgcaggccaggggagaattcgcgccgggcggcaggcggggtggcgggcagcccctgggcgggcggggtcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccggtgagtgcggcccgtagccagcgcctggagggaggagccgccgccgcgccggcttttagctgagtcagggccggtgactgggcgcctcccggcggaacgccggcctgggcagcttcttgctgcccagggcccacccccgggccggggggctgggagtctgatcaggtcactgcgtgcttctctggcttgagggaatcgagccgggtcgaccgcctcggcatccctccccaatcacaccccagcgccaggacccgaggggcttcctgggccttcccctgaccccagaagggcttaccttttttctgtgcctcccattcttggccgtgtgaggtcgtccagccccagttcttgcccgcagggggccggggtgggatgggcccctgtgccattgaacagtaaggcaaacccccctgatcgggcagcctaactgctacagaagtgtttctggacgtggccgagctcca

SEQ ID NO: 99095 - DNA, 1333 bp, Homo sapiens
ctgctcctgggctcaagtgatccccccgccttgacctcccaaagtactgggattacgggtctgagccaccacaccttccgcttcccccgccccagtttcattatcaacagaaaacacaaaaagttgttgcttctgtttcacatatttaaagttttttatttgatgaaaatttggaatgtccttctggtggctctagatacttgattcctttacatctaaaccagcaacctggagttaattgtttatattcaaagaagaaaaatgttgatgattgaaaacagaaaagaaatgtgtaaactcaagaaaaagtgtaagttggtaaatttttatatttgtcatagagtaaaagtttgagtaaatattactgaggatttgatcattgatttgctgaaaagaattttttaaggaagtgtaatgataagtctatctcaaaataggattttggttatcttttacaggaatttgcactacacaaattgaatgcagttgttaatgacttctgggcagaaatttccgagtccgtagacaaaatgtaagaaattatttttataaatcagaataagatggatcaaatttaattgtgaatgtgggtcttgtggcttattgattcatttagaaatttgctgttaactgaattgtggcttgaatatttagatttgggatttttagggaaaaccacagtttgaactagacctgtacttcctaatttctttcagagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattataggtaattatcgtctatctggtaaggctttatcttgtcggcttctttcttgctgtagtgcacatagaagcttttttcctgaatttgatgttgccaaatttcattttaattggaagttcctaatctttctataataattttatgcaggctgagtttttagatctgcccttcaactgagtgctggttctcagtggttatgatgatcaccagtccagtgagcctactgttagaggaaaagattaaatcagattagtatgagtaacaagtggtaccagtttgtgtagttttttcgaatacaggaaaccattatttagtatctgcattgtgctaggcaccgtgctagtcactctgcataccatggtttattccacagctaccccatgaggaaggagctagccgttttacagatgagacaacttggattttgagatgataaagacatggttatta

SEQ ID NO: 99096 - DNA, 1365 bp, Homo sapiens
ggtgagttttgatcagtagaccagttctgtttgcatttatttatttaaaagtggggttcacccttcctctagttttgtagggcacattttttaagatgtcagtgagattcatgagggggtatacaaaacagaatttgggtaaggcttcctagcgtcttaatgaatatcgtaaacagtacctccagaaaatccaggactcataaatctccaagttatgacaaggctttagcaggaaatgaggctgagttttagttataacataaacctgggatatatttatgacatatatgcaaacctggtgaatgagaacatgaatctcatttgaaacctgggacatacatttttccccttcagttatataatctaaggaaaattccccaaatgttctaattttgaggttcctctctgatggggtaggggtaatgtttcctcacttagctacagttggttcaaaaagctcacattagggcctggtggacattttcaacaactggaattctttaaggtctattttgcattataacatccactgtgtttttttgtttgtctgtttgttttttggcagtttttctctgttgcccgggctggagtgcaatggcacgatcttggctcgctgcaacctccacctccctggttcaagtgattctcgtgcctcagcctcccaagtagctgggatgacaggtgcacactaccacacctggctaatttttgtgttgtagaaatggggttttgccatgttggccaggctggtcttaaactcctggcctcaagtgatccacttgcctcggcttcccaagattttgggattacagatgtgagccactgacccaacccactatgttcttattaactgtacctgaaccttcatggttccagctgaatcttgaatgtagtatattccaatttataaaagtcctctgcttccttcaagatatagacccatttaacccgggtcatctagtaggccaacaatcatttatgctagttaaaattatttttatttcttggggctatggtttgtaactaataaatcttgccctcgtcttcttacttatctttgaaagggaaagaaacaagccaatgaattatggagaggataattaatgtatatgtcattcctcttgggtgactgggttttttgtttttttgttttttttgtttttttgtttttttgttttttgttttgagacagtctcgctctgtctcccaggctggagtgcagtggcgcgatctcggctcactggaacctccacctcccgggttcacgccattctcctgcctcagcctcccgagtagctgggactacaggcgcccgccaccacacccggctaatttttttttttttgtatttttagtagagacggg

SEQ ID NO: 99097 - DNA, 1030 bp, Homo sapiens
agtttcattaatgcaaagaagtccgatatactactatgtgataattgctataataggccttttaaaatatcttcagtaatggcaaatgtttgttttttgaaagtgaagcagcagctatttgtagccagttcttttgaataagcagcttaatcgggtagagtaataaaattttgatcaaaatggagtaacaagatagaaactttaaaaataaattaaataagagacagggtcccattgtggtgctcaggctggcgttgaactcctgggctcatgtgatcctcctgcctcagcctgccgagtagctgggactgtgggtgagcactaccacacctggcagatagaaatgttttgaataatgtcaactggattggaattaatgtgtagttctccggtgtaaatattatgggagaacagtattcaaatgcataagttctagcatttcaaaatttgcttattgctttatagtcatcccataagtatatatgattataaatataggcattgccctttctgatagtttagcccaatttacaagataatcagttattttatttcctcaacagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcggtaggtagatgatgttattttagaaattattgttgatagggaatcagcaaagcaagttattcaaactgaaactttcataggcagtgaaaagaaaatctagtttagaaatagcaggtgatcttttgccaaatattttattttcatatttatgtatgaaccttggttgtgttttgtgttcatgaaatatctgcttttatcttaccacataatcctttgaagtcttgcatggggaagttgtattaattactctgccctttttaa

SEQ ID NO: 99098 - DNA, 1320 bp, Homo sapiens
ccctacttaatcattcccctattgttgaccacttattttgtttgtgttatttcgtgttcttaatttataataactttgattaatgtgtttattttgaagttgagttacttgctgcctaagggaacaagaaaatttaaattgagtttttaaaagaaaaattctaactttgttggataattttgttaaaacaatggcagatcataagagtagtaagagaaatgcttcaaaatggtaattttaatgtctcttgtcctggcccaacacaacacaatgtatgttaaatgaatgagtaacttccataatatatggtaagggagaaaataacaaattaaggagcacttaggtataacttatggataagatttaaagaagccaagattcattcaacaaccaatgttgaatactgctgattaccaggcacagcattaagagttataaatataatttgtatgaatttttttatggaagacagatgccatgtttagaaaaatttcatctagtgctgggtttagaaatagagtgctagactggatagtctgccctagtttgcctgtgcttatattttaaggttttctataatgttgattttgtctccttaagtaccttgtagatgaagtttttaattattgaataattgttctttatctccatttcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacaggtataagtacctttttctgcatcaaaactaattgaataatctttatttcattttggggacaggtagaatatttataggaagcatattctaagaataaattttgccactagctttcatagattgtaaagtcttattaggctgttgctctgttttgtactgtgctgggtgtagtaaggaaaaccgaagaaattgacccttctggaaagaaatagaagtgattatctcgtagggagggcctaccagacaacatgtgtactatttaatcaagtaaatttaaaaaaacaggtggggataggttggggctaccttttagatatttgggttagatatatctgggttagatatttagaaagtaaagaacattctcagctttttatgcttttattagaactaaatacacaaatttctatagtattagaaatttgcattctgtacaa

SEQ ID NO: 99099 - DNA, 1102 bp, Homo sapiens
ctttcacttaagcactcagaggccattgtagggttattaattggcctaatttcaatattgttgtgtctcagggaatagggagtcccaaggagaaggagagagatgggggaatgaccggtgtgtggagcagtcagaacacacacatttattgattgagtttgctgttttatatgggtgtggttcgtggtgtcccaaaacaactacaatggtaacatcaaagatcactgatgacagattaccataacagatataacgataattaaaaagttttaaatattgcaaggataactaaaatgtaacacaaggacaaagtgatcacatactattggagaagtggctccaatagacttccttgaagggcagtaaaacaaaggtatgcctatatttttctttatatcactacctctttccttattactaaaactatgctaagtcttgcagtcaggtattgtaagacctacaattttgattcttttttctttttcaagattctttgggctattgtagattttttgcattatataagtctgtgggtgttctgattgggattgtattgaatatcttcaatttggggcacattgaaatcccgataatattgaatcttgtaatccaggaatatggtgatctttttcatttacttaggttttttatttttttctcagtagtgttttgtagattcagtgcagaggttttacacatcttttcttaaattaatgttcttatatccctaagtataatttgttttttgatgctgttgtgaagtggtatttttaaatttctattttttttgttggtagtatatagaaatataattgatttttatatactaacattgaatcctatgaccttgataaaatcatttatagctttataaatgatttttttaagtaaattttttaaagtagatccttttacagaattctgtttattggcatcttggtcatctgcagttagagagcattttactccttcttttgtaatctttataccttttccctctcttttttttctatattggctagaattcccaatacttacagaagtgataagaggcagtgaaaaaaatctttaatttttttcaatcttagggggatagaatttt

SEQ ID NO: 99100 - DNA, 1006 bp, Homo sapiens
tttaaagctagtctttgtaatatagtctcattaaaaataaacaaaatttgaccaggcacgatggcttacgcctataatcccagcactctgggaggccgaggcaggcggatcacctgaggtcaggagttcaagaccagcttggccaacatggtgaaaccccgtctctacttaaaatacaaaaattagccgggcatggtggtacatacctgtaatcccagctactcgcgagactgaggcaggagaatcgcttgaacccaggaggtggaggctgcagtgagccgagatcgtaccactgcactccagcctgggcaaccaagcaacactctgtctcaaaaaccaaaaataaacaaaattatctggtaactgtcagaggtgcagcactgctcctcaggttatctcaacaccttggagaccttgggcaagatggagaagagaaaaagcaagtttaattaaaccaaagaatagaaaatctgctgtccaaattccccacttaaaatctgttgttgagctctgttaaaactgcaaataaaactttgacttgcttgtttgtataaactagctatttagtctttataaaagaaatacccaagatccatattttaaatctcagttcagtttgttcatgcttttaccacaaaataggacctctgactgtgtgtgtgagggtgtgcatatatgaatactttgccagtgatgaaacaattctgtatttgttgttgcaggatgcagtacggaattctgtatgtcatactgcaaccgttatagcaaactcttttatgcactgtgggacaaccagtgaccagtttcttaggtaaatatgcttgttgattttcactttggttcaaaatctttttcttttttttttttttttttttttttgtgcagtcttactctgtggcccaggccggagggcagtgatgcgatctcggctcactgcaacttccatctcctgggttcaggcgattctcctgcctcagcctcccaagtagctgggattacaggcgca

SEQ ID NO: 99101 - DNA, 1470 bp, Homo sapiens
gaatcagtagtaacttgagatccacaaagtaatttggaagggttcaaggtaaaattttaatgcttttaaccttagagttaaaaagctttaaggaattcatttgttttaacactaattaaaatacatcatctttttttacagagataatttggaatggttagccagagccactaactgggcaaaatttactgctacagccagtttgggtgtaattcataaggtaatatatattggtcagtgtatacaggcatcagaaaagaagtaatttttctggggttaagaaaaaataacagtttattataattcattaacaagtacactttgttaagtcagataagtcattttgtggagaaggctaaagtaaataagatactgaagtatttatatgtgtgtttgtttttaataaaaagtggaaatttgtttctataaagactgtgtaagccattgaaaggataaattgaaatgttatttgcatagtctgagatggatttgggcaaatgttataaaacaaagggaaaaaattgaagcatttgtgattttttttttttctaaccagagtgtaactgggtctctttaaaggcttgtcctcttgtttgagttatacaattatatgagagagagccccactacctccttctctcttagcaagtgaacattctggggaaaaggcagtaatcatagaaaacattgtcttttttcttcttactttctctttttgatgtctttgttatgacttacctttacagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatgtaagtattaaaatggaaaactaaatttccaaaactcaagaatccaggataacatatttgccacattattttagtgactggagattttgtagaatttgcgaatacccaaaacaactgtcatcttggattttttttttttaggtaatttcatttccttcttgataagctaaaattgtgtttctcactcctttaaaccctgcgtgtatttgtaaaacatgttgttttcccacactttcatcttaaaatgttacaactacaagtgaccttagttatcatctagtctaggccctaacattttactggaaattaaggcctaaagaagttgcagtctctcagaagttagaatccttgcttgttttgatctttgataattgtttaaaatgtaaatcttttggaaaagcttactaagtagccctgttcttattttaaggaaccttaaaatgtaattttacactaacttctatattggagtgagggccatcaggagagtagttaagtgagccagaaaaccttgccctcatgcataagtgaaaagattgaagccagggct

SEQ ID NO: 99102 - DNA, 1033 bp, Homo sapiens
tgctgggctggacacggtggctcacacctataatcccagaactttgggaggccaaggtgggtggatcacctgaggtcaggaagttacagaccagcctggccaacatgatgaaaccccatctctactaaaaatacaaaaattaggcaggcgtggtggcagccacctgtaatcccagctacttgagaggctaaggcaggagaatcacttgaacccaggaggtggagtttgcagtgagcccagatcacgccattgcactccagcctgggcgacaagagcgaaactacgtctgaaacaaaaactgcaattgctgagtttatcactgaccttttgattatcacatcctttgatcattcttactgagccaacctctgcatatttaatgtgaaactgtattttgaaattagaataaaaacttgtatgttaagtacagtgtaccaaatcaatggaatctatgttttttccttagatcgttagacacggtggcagtctgggccttggtttggcagccatgggaactgcacgtcaagatgtttatgatttgctaaaaacaaacctttatcaggatgatgcagtaacaggtaagcatttctttctaaagctaacaagcttaagtattaattaatgtaaatgtaattacattagtttctacctatattttgtagcctcttaaaattccgatggatttctctagttgaagaggaagtgaattttgctccatttgtcaaagttatcttttaaaacaagttttgtgatatataggctttctaaaatggtatatcctgtgtgtccactttcataactgacttttgcaaacaggaatttattagggtgatctgcttactccatactgcttggcgataatatagaaaaaatgttatctaaatgtctcctttgaaatcactgtaggatttgatggtacattctgtcaaagtttaaaaggaaaacaaccctaaatatgaatgtgcgaaccctaaatgtatgaatgtgcttccacataaagtatcctttttaccaggtggtttaaaaaaatgct

SEQ ID NO: 99103 - DNA, 1903 bp, Homo sapiens
atatggtgggtagttagtggcaggtaatactgtcctctataatcaataagaaccactgctatagtttattgataaaattattaattaatttgttcagttaccaggctccatctttcttccactcagcactcagtacccaggaatttaaataaggtaaaaatgtagaattagaagccaacttccttgcttgattgttaaaaggaagtggactgccataggagtggctgttgctgttgacttgactttatacttcctaaaaagtatgaagcagggcaggcatattgcatagcgtattgggaattaagagcagctacctccttctgtatttatgtgttttattgccccatttatttcaaaaactaccaaccacaaaagagttattgagctcatcatttcctatctgagaccagcttacttggtggatgccactatgcctattagactgtagaagttaactgtttgaaataagttgatgattaatgttaaattatttttcttaggacccaattcttcgaaggtctggaatgtatactgtagccatggcttattgtggctctggtaacaacaaagcaattcgacgcctgctacatgttgctgtaagtactctgacctttcttgggaatggggtggacggaaaagcttgcagatggacaataagtgtctaggtgactccagcatccacagcgcatgaccaccaccagtggtcttaggttgtgattctcatttactggacccaacaggccataacctagcactagattcacttagcttttcagaaggatatgggatgggataacagtcccatataaatggaagtccttaaagccattcaggtgcaacttctaaaatcctactgcaaggagcaccctcatttgtaagggataagaccttgtgagtatgtgtggccaccctaggatagagaaattcagtgaagaacaggaaccatttatttctttttacagccggtagagttagcttccacatacccctaatgggtgcagtggctcatgcctgtaatcccagctactctggaaagtgaagtggacagtgagctataattatgccaccgcactctagcctgtgcgacagggcaagaccctatctctaaaaaacaagcaaacaatcccccacccccacaccccgggacccctaaggaacatgatctattacaagagatgcactgcacaggaaagccaatgcacatgttttccaaaaggctttccactcatagttctcctaatccaaatgtagttatcagcaataagtaatattgcctggtcacacagtggacattccacgtgtcttaataggtttttatcatcgtggtgctgggaaaaggtaaaccaagggtacctttctatgcagaaagacttagaactattgttaactcctttttcccagagataatattttccacagtatttattaataattaataaataatttttttagcagtgcagtatgttctaaatgttcatattttgcaaaagccataatgcagctgaaatagtctttttctttttttttttttagcgactttgagacagggtttcgctctatcatccaggctggagcgcagtagcacaatcacagctcattgcagcctcaaactactgggctcaagtgatcctcctcctacctcagcttcccatgtagctagaactacaggcacacaccaccgtgcctgcctaattttttaactttttgtgtagacagggtctcgctgtgttgcctaggcagatctcgaactcctgggctcaagcaatcctcctgttttggcctctcaaaagtgctaggattacaggtgtgagccactgtgtctggccagttgaaatggtcttaagaagtagccctggggccgggcatggtggcgtacaccagtaatcccagcactttgggaggc

SEQ ID NO: 99104 - DNA, 1110 bp, Homo sapiens
gaaaagtaaccctgaatcttaaactttgtcaagctgtgaagacttctaagcccctgaattgaaatttttcaataactttttctaaactggggacagaaatttattcttcaaaaatacatgtggccaggtgcagtggcttatgcctgtaatcccagcactttgtgaggccaaggtgggaggatctcctgagccccagaagtttgagaccagactgggcaacatagggagaccctgtctctataaaaataaaaataaaaatacatgtgtctattttttgaatgtattcatttattgtatatgtttagaggtgtgcaacataatgttttgatatacctatcagtagtgaggtatacactcactgttgaatgatgctgacctctcatgtcagtttggtctagtggtagactacatagtataatataatcttaaacttttccccctaggtaagtgatgttaatgatgatgtcaggagggcagcagtagaatcacttgggttcattctattcaggtaataacttcaaacttcttattctatttatatttcattttttttggaaatgtagtagtcactaccgaaactaccaaacagtttagtcactaaacaaaaactaaatacctgaggagtatatctgggttcagagtgaggaccatttaatagcgagattagtactgttcatctgaaaaagaacaaagcatatcatgggattctgagaacctcttttagaagtagttatttctgttcattttttggtagcattctgcttattcatttaactttttaaatccaaataacacatccagtactcctcttcttgtatattggtagttcaaatggatattatctcttacacaggtttgtaaagtttttgaagggctttaatgaaagtgaaaggtaataggttttgtttaaatgccagagtgaaaatttttaaagattatcttttacttatagtcatggagatgtccttggcagtatgatatagttgtgtttaagaagtcatactcttggctgggcgcggtagctcatgcctgtaatcccagcactttgggaggccgaggaaggcggatcacgaagtcaggagttcgagatcaccctgactaacacggtga

SEQ ID NO: 99105 - DNA, 1089 bp, Homo sapiens
attatcagagaactagataattttagtatggaaagtatattcttccaggtatacccttagtatctcttgggttgtgtaaagcatcctactcatgtttgactcttaagttgttttgtttcctgtcagttaatgttttgtattgtcagtgactttatattttataacaatataaatcagtggcttggtgtttatattctgccacataggaagttgacggtcatttaaaactgtttttcttccatttttaatctgatggtgctttgctctctagttaacaaaattcatgtctgcccttttatttcctgtagctaacacaggttaagttcccagtttcagcagcagatgtctcccgtgagctgcttaggttttgctgagttttccactacatagtatagtcaaataagttatttatgtgcttgctacttctaagggaccattcttggttctcttttcataaaacgaatctttaagaagtgggaactggaaaaattttgtctaaaatttattttataaatgaaaattaaatataattgacctgtttaaagagctggagttaaaaatcctctctatgttctctaagttttagtttactgccatttccctagagtgagaattttttaaagtagaagaaaccagtattcacattttttttaaagataaggaaattgaattccaaaatgtttaataaatttccccactgtcataaagctaaatactgagattctaaacaggcttcatgatagaccagtgctttctccaccttgctttcagtcagagcaccatctttttgagtggctgtgataaaacagctttattcttaattttccttattaactttaatatttgagaagtgtctgtcctatatcctaagactggtacatgttttctgaagtgacatcatttactgtcgtagcatgctctccatcttttttcccccctttagatttcccttttaaaatgaatttgtggacatttggtcttataccatgttttaagagtttatttcttcataatttttaaaaacttcttttcaagtatacttattggatatgaatactaaaaacatgttagtaaacacatatttgtagt

SEQ ID NO: 99106 - DNA, 2912 bp, Homo sapiens
actagtagtagggaaacatacctaaagctttgatgatttaggaattaaatgtgtatgatatactcttcccagcagattatatatagccagtaaggaatcataacagatcaggatttatgtattagagccgcattctagcaaaggattctgccactgtgaaaatatatgccttgttcacttatacactgagattctccgtagccaatacatttcttaaggcaattatcctaaactgagttgcctgcagaaggacagcaatagagtcataggtcgagggacaaatatgggtgaacctgaaaaggaaaagctaaggtatgagttatcttcactgcagacccccttagtctaaatttgcacttataacaggagcattaaaatatatatcaaaagtagattgaattgtctaccatttacttagtgccttctatgtactcatcctcataagaattgtataaaatgcagatgagaatactggggcttgaagaaattaagtatttttcctaaatttaatcagctgtctggtaagtggcacaggttggactcattctgagatctaacagtgcaaaataatatactgaaaggatgaataaaaaattttgtgctggaagttcacttgagtcactggacaagcatacataggcaggcatgatctcacttaaagtttgtatccctgattaagatcccatgcttgtgcacgttaattaatatctctaagaaacctaatgtggttcaggtacccaagagcgattttatttgctttttcctccttctccaatagacctacctgtgctgagtagaagctcaatatcagtcatttaacaaacaggtctagttccaagttcttgttattttgtgtgatatccagctactatcctccctatcccttccatcaaaacagtttcctgatcagaggaaaattatgactgcattcaactaaatcagactataaatggcaatcttaactcacctccagatgtgatcactgttttgtgcacttatttttagctctgtgttccttttgttctgtatcatgccttatgcttttaagacctggaaggcaaggctaatgtttgttttgttttatttcattcttagcacaactttgcatataattagaaaccaaataaattttatgatgacagtggttctttttaaagcctgaaatttattgatttgactttatttcattcgaataccttaaaatttaaccagagtgctggattgttttcatttgtagctatataaaattattttcctcatggaataatcttgtccaaattaggaaaattagatattcttaatacttacatcttaggttaaagagatgatttgatatatgacataaaattctttatataatatattcttggcacatttacatctcattcatcatcttactcatcattatgtttgatgacaactgccagttctgctatacataactaacttgctcttcagttttgtcaccttcattttcagtgaggagaagcgtatctagtagaatgattgatgaagactgaatggttgaacttcggagcctcattggactctggtacatggcagggttaatcccatttcgaattccatgtttcttgaaaaacttagagttctctgccattggattccggaagtagatcttactggagcgttttctgagagtttttactgactttgtggcccggtaattgcaggtgatatatcggccaaatgcatcccgaaatgtcttattgaagagggtgtagaccaaaggattcactcctgaggaaacatagcctatccacacaaatatctccaggagcatttggagagtagtttggttacaggaatcacataaaactaaagttatatttgtaataaagaagggacaccacataagcaaaaagaggaaaaacacaatccctaggacctttgaggctctctgttcgttggaaatggtctgcactgactttttcccaattgtggatgttcttcgcataagtgtttcatcacctgagttgggcagagccttgtcctttcgagaaccatccagcattgccaccttttccggtgacgagcaaggtgtttcatccctttggaaaactgtagacacagtcaaccatgttaggcgttgaggtggcttgtttttgactaagtaagccttcttctgtaaagcatggatagtgagaaagtaggtgacaatcataattgcaagaggtgtgaagaaggcagccagtgagccaaagagcatgaaatcgccaaaacgttcctttgtcagcacacaagtgatattgtttgggttgtccacatcagtctctatccctttaatagggactggaatggcaatgcctaaggaagaggaaaacaagataaattgagtcattttatgacctgtaactcttcgattagatccttttggattgtatccttataactttatgcttgttggtgcattataattcctgggacccacaatgcaggatttgtcgaagcattcatcagtgaagatttgacaaacagaacctaagtgagcaaatctgtttttaaacggagattggttagtaatttcagatttataatgaaagctcccctaaagctatagtatatccatgatacagtggagaatgtcttcatttattctacatttctcataatctatttttgttttttaagctatctcagattaaggaagagaaattcagaagagaacctgcttttttcttattatccagtgtagttgatctagaggcacttcagagtacatttattcaatatctttactcagttttgtctttgaggttacagtttcatttaacagtttttccttttgatatgtgtgaatgtcttttaatcctttccatctaacttcttagggaaaactaaagttcattaaaaagtgctacttaaaatttgagtgtgtgtgaatcatgatgttg

SEQ ID NO: 99107 - DNA, 1022 bp, Homo sapiens
tgtttatatgtccgcctttcttgaatgcaaagattctttttcttgatcatctgtgtattcttagtacctagcacattataaacactcaataaaaatgtggtcaatttataaattgatggtatccagccttaatctagatgccatttataccagcaggctgcttaccttattagcttgatcacatttcacagtttcaaatattttaattattcttaaggatccatttcttcaactttttttccctttctctgtccaactctcccaccccaccccaatatacacatacctcacactctcccttgccctctccctcattgcagtgagcttaccaaatgtgagtcatctggcataaatgactttattatagttttcctcctctgcacttcaaattttaattttcacccattgtctcccattccctttctgtagctgcttttggggggctggttctgctctgtcggcatctgccccctcatctagccttttctcactgtttttaaatctcttcattctgaatagactttttcttgaccctgttttcttcccataccagaggagtaacacagcttgcttttacctccaaactttttcaaagagatcaagcccttatatcatcatttcaggaatatgaaggtcaatctcattgttttgctttcttgctgtttttgccccagtgcccctactcagattagggaggagtaatttaagtattccaggtctcttaattttttgcctctttgaaatatttttacaaggaagaagagaatctgctggtcaaaccattgtaatttttgcaaatctatttgtttttctgatactaacatataagagttttgaatgatttacgcatacttcatgataagaagtatagctttgagtattatagatgagtacagggccgtaagacgatttagaagaaaaaggatttcttttatacataatttctgaacatcggtatgttttctttgcatctctcttaaaactttgaattaaacatactcaaaacacttaagtgcagtgac

SEQ ID NO: 99108 - DNA, 1003 bp, Homo sapiens
ttgtctttctacctgctgtagcaaaagtgcatgcatctgattcagcttaaaactttaagctgtactttccgggggtgagggaggatgggctgagaacagttaactctgtttaactttcaattgaatttgtcataaaagtatgttttttactaacgttgaattttaactgctgtttattttatatacggtacaggaaaataacctgtatgcattgcatgcctgggttttttgttggtttgggtatttttttgtttgtttttgctttcttttgaattagtacaaaaacctgaggagttttactagaaaccccgtatcttgatgaggcagacttattttatctgaaacctgcttaacctttgggcagctttttagtttgggaagtcaggttacactatttgtccggaaaataattagcatcagtccataaatctgggacataaaatgtttccctttggaggatgtaaaagactatttttaaaggcattccaagtgggctgttcctatagtttacagaggtactcagttcatgaacttattgcagcaggacaaatcataaatacttcttatgtccaaaaagaacataattttcaaatatacatttatctcagaaattctaatgcttctgtctttatcttccagaaaagaaagacatagttcagttcaaattattgtttaaaagtttctgttttgttttttacttttttcactacatttgagcatatgagttatcctggggttcagtgtctaatatgatagtgttttaaatgttttaagcattttaatgcttacagaattttttcctggtttttaaaatttccactttacaaaaagaagtgcctttaattcattgcttttctcctccatttcagaattgggtaggctaacattttactgcataaatgaataactgccatttttctcttactgctatacatttgtttcatctctgattagacttgcatctcaactaaatcatatttaatttgcatgcagtactctacca

SEQ ID NO: 99109 - DNA, 1080 bp, Homo sapiens
atattaaaatgtctatcaattatttaagacataaatatgaagacatttcacatattttatgttaacatatgttgggttttctgctaacttgtattgctaaggatatgttgggtaccagcattttaaatatacacttaaagttttcagctgctggatacctatttttctatagaatacatggaatctattaaacaggtaaatctttgttacctgtttttgtattttgtttgttagctcactttaattctatggtactttgccttttaagattccttaactatttagctgataatttaagtatctaccatggtactttgcatataatagatgtttgatatttatggactcaaagattttaaagctaaaattcacttctgcataattctttcaatatcatgtattgaatgacgtattaaattttatggtagtctgaaataagcattttgacattttctgtgtgcctagcaaagcacagtttgaagagtatgattttacatcttaagctactattatgcacatggagatgagagctagaatcatatgcctgtacagtatttatcaaatatgcatatatatttctacataatactttcttttaagctttattcagaattagggttatgttctctattatagtaagatttcttaattatttttcatggtttcatgcagcattagattatttaaaagattacaaatttataaaacagggagatagaaagactgttaattattagaaagtctaattaaagcagtagaactttactcattactgcttgtcctgccacataattttcttgatttattttaaagcccaggtaaatgttgatttaaaatggaaggtgtaaacctgttactatctgataatagttttagatatctttctgttattacttataaaattgtaatgtgtaaaacctgggtataatagttggaatagcaggggttttttaccttctaatatggattctagtttaataaattttacttctgtaacttaaaatatttttatcttcatataagtaaatataattctaagaaactatatctgccacaagtaatcattttgcttaggcagtt

SEQ ID NO: 99110 - DNA, 1027 bp, Homo sapiens
agttccaattttaaactggggtttagtgatttaaattgggatttagtaattcaaagaccttatcgttaacccagcgcatatctgtcccggaagtgtcctagttattgctttgaggaaaaaaagtatcagtgtagaaaagttaaagtataggcctatttactataatttatagataatatattcagaatctataaatatcactaacttgaatgactttttaaatgattttattagatagcttaggagggagaaaaatagtttacaaaaaatattttttgctctttaaaactgctgatcaaccatagagaatgatataaaacaagggactgtttacttgccgtatctttaaatagtccaagttcatcttttatttcaagaaaagtaaagattaaatgagtgtccattctctaatagtatatcatagttctgtggtttgatggcacaaacaaagtgaaatacttaccaaacattattgtcaagagggcaattggcatcacaaacaatccaaccagcaaatcagccaccgccaaggacattagaaagtaattagtagcatactgcagcttcttctccagtgaaacagccagaataacaagggtatttccaccaattgtgggtattatcaccatgagtatcagaagagctgcccagtgcagtttatttccctgttcctcaacaatctgtttcatttcctctggtattgattctgtctgtaatccagaccagttagaagagataacgtgaacaaaggtgctctgcaaaatgtgctcaggaattgtgctttgaagttcagacactctgtaagagagagccatttgctgtttttctgtgattcaatcccgttccgaacagtggtcagcatggttagtagctaagctgctcatctgtttttttaaggcattgtaaccatgccaaacactcaaaagccaaagttgacaccttcctttaaaaaaaaaaattcaagttctctaaaatgagcgcatacacacatctgtccatgtttgtaggtaagatatccaagtattta

SEQ ID NO: 99111 - DNA, 1899 bp, Homo sapiens
ttacttacagaagaatagaaaagtcgaaacacaatagttcagaatagaacttttagtatgcgctggccacccacctagaaacactcaaagcccaacaagggtctaaataaatgttttaccagctagggatccttatatgtaattagctttgtcttatcaggtttgtgagtactgatataaatgtcattttagatttcctttagtttgagagaaggaaaaaaaaaggtattactaggatccaaataattgtgtttagtaatttcatctctcatggtatgtctttgcaacaattgtgttctaaatttaatcactaaatttgccaaattcaaaccagttctttttttgttttaagtagtgtttatttttttaaccttcccagttgccttgagaagaaagggaaaccaaaaggaagattagaccatttatttgttcatcaaatgtacaaatcacgtttttaaaaactctcctttagcattagtaaatttttcattttgatttttaaaccgctgaatagaaatgaaagattatgatagcagaattcttgaagattaaaaaaaaaaacctttagattaattccatatgtgtttattaaatgcttacctctggtttcgttgttattttgctgagcatgtcatcttatctgttcactagacttgcttgctgctgtgactgaaatcctcctcccattgacttattctgagcctccagcacaggcggttgaaagcagtgaaacaaatacgttgtatagctgcaagcatgccaaggaggttatttcctctttgatacattcatttttagagagtagcagcattcattgtaattcataaaaccactgttaagcatgttgaaccagttcatggcccttattcaagttatatttttaagagctctctttaatatttggggggactgtaataaacttgatcattttagcttcagatagttttgtttggggttaagcctgagctgtttttcacatttgagaaaaaataagatataatctagctattttagaggtttcattctttgaagattctgccgttttaaaagcctatagtgatttctacagttctgatttctagcagtgaaacaagattcttatctagcttttgtgcctttgctgtggaacaccattaatttgctctggttgcaaccttatatagaagagcacagaaaggcctgaattctacatgtatacataggttttagcagaaacttttttactgcttatttttaaacagatgatctctgggtttaggagtggttcacagctttttttccccatagactttacgttggagaaaatacaagtaatgaaaatacgtttttgccttatttcagaaaattggtgtttaaatcttaatagttatgctatttaagttttctgtaaccataagactagcttagtattagaacctcagcattctcaaggtttccttttaaaagatcattatagatgcatattttaaaattaattacttataaatcagtgatgacatttgtgcccttttcttgtttcaaatttgtattcctttgctcatgttgaatgttattggaaaatacttagttcattttagctctgctgagcacttcagattttattcagtatttgctgcttttttaaaaactcaaaatttactatattagaaaaaatacttgtgaagaattctagatgaaataatattcaagagaaatcagatgttttttaatgtaccagaatttctattcaggaatatgaaaatattttaaggcaaggtgcggtggctcattcctgtaattccagcactttggtagaccaagacaggtggattgcttgagtctagaagagaccagcttgggcaacatggcaaaaccccatctctacaaaaaaaaccacataaattagccaagggtggtggt

SEQ ID NO: 99112 - DNA, 1048 bp, Homo sapiens
agcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgaggtcccgccactgcactccagcctgggcgacagagcgagactccgtctcaaaaaaaaaaaaaaaaaaaaaaaaaagaaagtttttttgcccttttagagttgcctgctgaaacattgaaataaacatataagaatattatggttttactgtactcttgaaaagattgaatgtctaaactaatttaataaagaatttctcatttcttgtcttaacacttgttttttctaaagaatgtgtcagagttggaactgttgttagattgagacactgtcaggttttttatatgcttttgagtttatagccttcacagcctatttcagtctttattgcaattaactaggtaaagttctgcattaggctcctggtatttatgttctcaggcaaaattttttctaaacctcatggaattgttagtgccttttgggaagcaaaacttaagtctaacttctatcccctttcagaaaacttttctactaaagaaaagaacttgagttttgtggttggtttaagaatagtatatatgttatattttatttactcttttataacaagtaaaaatgacaaaataaatgaaatgttgacagattttaggataagctctttcctgtgagtcagttttccctggaatatcctgcccttgcagccaaggggtaacttgataagtatcctgcatgccattagttccctaacaagttgatgacgaaattctggaggtctgaaccctaaatataaccagctttctaggtttaatattcagcttgttttatattttgataaacctttggacatcaaatgttagtagccaaagttctggttctgatccaaagccagtttctggttatgcatc

SEQ ID NO: 99113 - DNA, 1004 bp, Homo sapiens
aatctttttattgaagtttaatatacattcaaaaacatgcacaaaatcattagcccacagcttgatgaattttcacaactgcatacacctgtgtaaccagtacccaattcaagatcataacattaccagccttccagaagctcttcttacattctcttctagttattaccctagtcctgctgctcttcaaggatagccactgtgccagccaggatcatcttttaaaagatggggtcaggtataccattagtcaagtttgtcctattttttatcttgttgcaaatatggagagaatgaaaaataatttctcttcttaccaacacaaaaataattgctaaagcaaaaatgcagaagtcagaatttcttcattatcaaggcttctttatcagtttattattcaactaaagtgatactgggggatttaaatctttcatgtaacttaggaaatgtccaggaattactataaatgacttttgtcttctggaacaaaatgcaaagtaaccaagaaataggaaaatagatgtagagcagtgtgctacccccaacatggctgttcctgccatggaggaggtaccagagaataactggaatccagacctatggctgaggactcacttatactgagaaaggagtcccctttctgtacatatattctctgaatattgaagatcagatttcttctatcaataattagaactctatgaaagatttttaattctgcaatttatgttttaaatgctcattgtttcctataactttttcaaaaacaacttggttaaaactcttctgtcttaacttaaaatagattacctataacagtggcttcgctttctgtttcttatcagaacccctgaacagtgcccaagtgttgtctctttgttgtcagagagttacaaccctcatgtgcgctacggagctgcaatggccttggggatatgctgtgctggtacaggaaacaaggtaaagcccacagccaatggggtcagttctttcttggcgccaga

SEQ ID NO: 99114 - DNA, 1053 bp, Homo sapiens
gtaatcccagctactctggaggctgagtcaggagaatttcttaaacccaggaggcaggggttgcagtgagccaagatcgcgccattgcactccagtctgggtgacaagagttgaagctacatctcaaaaaaaaaaaaaaaaaaaaaaaaaaaattgtaccattgtacaaaaatattttttctttatgttctgtaaggttttttctgttttcaaaatgatttatttatattttttaaacttttttgtaaaaaactaagacacacatacattatactaggcctacacagggccagtatcatcaataagtcacttaggcaatagtaatttttcaactccattataatgggactaccatcatatatgcagtgtgtcacttcccagaatgtcgttacatggcatgtgactataaattgaaagttcagccatatcaactttatttaaaagttgtgtgtttttttaaattctttcaggaagccattaatttgctagaaccaatgacaaacgaccccgtgaactacgtgaggcaaggggcactcatagcttcagctctcatcatgatccagcagactgaaatcacttgtccaaaggtgagcaaacaaagaaattccctggaagagagatggtttggtcttttctttagtaacttatcgtcttttgaggacgttttttagttcaaatatggtaaacactgaaagtaaagtaaaagtaaagagagcattttagagtataagagaatggggaaactttaaatatgtaatgctctttaaatgtattttttagacttaatggtccctttgttaatttaagtatataaccatgcttgaaaaattagaactcttggggtgttaaaaccgtaaaatgaactctttttttgcctttcactgtccttttaaaatgtattcagtgggataactttttcctctgataatataggatgcaaacttaggcagtccatgccttttttgatctgtccttctaaagtaatttttaaaaagcctgcagtcactttgtatcgtacataccatcttagtttagaaatgagtacatccacat

SEQ ID NO: 99115 - DNA, 2531 bp, Homo sapiens
tgggaggctgaggcaggagaatcacttgaacctgggaggcggaggttgcagtgagccgagatcacaccactgcactccagcttgggcgacacagtgaggctgtctcaaggaggggaaaaaaaaaaaagtatatatgtctatatagatatatacagatatatatacacatatatagacatatatatagagacatatagagacatatatatatgtgcgtatgtgtgtttatagccctttatctaccattacagaatccagaaagctctgaaaactcagaggtttgtttgtttttcaagactcatttggatgcaattattaattcattatcatttatcctacttagtataaatattcatatattgtgctacttcagaaataatttatttgattatgggatatcataatatatagagcagtactacactgggagtattgtataatatatggatatgtatcatgttagccttctaaattctgaattccaaaatacatctcacctcaaggatttcatggaaggaattacagacatatatttgaagtcataagcacaaatataatttcacagacaaaaaaaacacctccaaaactgatccttgatgtacagctacatttccataaccaggaagatagaaaaatagaaaggaggagtaacactcagatgataagtaccaacagaaacaacgctaaggaactttattgctttctccctgatatctaagagtgggcttttttccagcagtatagggtatacaagtaaaaacatgatgaatgtttaaaatgcagctttttgagaaggtagattttaaatactcctacatagtacaatgcatggatcacagcgttgcataaaattttaattgtctttttttgtgagattgttgtgatataaaatggaaagctaatatgatttttctcctggaaattctactttttgttttttttggtggggggagaccatactattcataacaatgaaattgagttagaaaatcttaatcctcaccctgattaccattaattgcttgtgatagcaagcaaaccaattgttttgcttgtctttttagtcttcatatctgtaactagatgtgaatagagggagtagaccagatggtctcaaagctgacttcgaaatttaatgtatgtcctaatctatcaaaataattctttaccaagaattacaataatgaaaattaagttactgatacataagaaataaaatgtgagaaaaaaatttaaaatgataaaaactagctttttaaagcattctatttaatattagttagataagcctattgtatagttggactgatttttttatccatttgtcagttttactgaatgcttttctattgttttgggtacaattttaaatttaaattttccctataatgtacattcagtgctttgttctatgtttctttttataactttgtgaaatacttcttaagcctttagcacataaaatttccatactgtataaggtaatgtaaatgttcatctaaaataagttcagaatcaaaggaacttgacttgtcgaaccagaataaaagcgtcaaacatgagaattttttttttttttttttttttttttgagatggagttttgctcttgtcgcccaggctggagtgcagtggcacgatctcggttcactgcaacctttgcctcctggattcaagcgattctcctgcctcagcctcctgagtagctgggattataggcgcctgccaccatgcccagctcattttttgtatttttagtagagacagggcttcgccatattgggcaggccggtctcaaactcctgacctcaggtgattcacctgcctcggtctcccccaaagtgctgggattacagtcatgacccacctcacccggccacgtgagaatttttttaagtagaggggaatttagtgatgatttaatcatgctaggttttatagttaaagaaatcctgagaagtaagtgacttaagtggttgtgtgctgggtagtggcagagttagttcattgtttccccactatattctgttgctgcctgtgaataaaaaatgagaaccatgttcaaggaatattattttgttagtagcatttagattgcagagataataggagggattggtaggattcttcccccatatggtgaaacagtcatgcttattgaactatgaaatgccctttatacattacacgacgtatatgttacctcatataatcctataatagccatgtaaggtaggtgctaacatccctgtagagatgaagatactgaggttcataaaaggtagtaacttacccaaacagcttataagaacagcttataagccagggttgtgtgattctattattctgccactgtatcacattgtggcctcccagaccaagacaaatgaaaagggggaaaagattctgaaagaatatgtaatgcagataaagtcattatattaggaaactcaaatttgatattttctgcttttggcagatttggggagctccatgattatgtgcttcttgaacaagccgacttcttcctgg

SEQ ID NO: 99116 - DNA, 1050 bp, Homo sapiens
cttcatgcaaaagatacctcacacagctttggtgaagggtaatttactttaaggtggaactgaaggaccatgctttttaggaaacccgcaaggttggtggtaaacagaatagctataattcaaaatgcaatgaaagccttagtgtttgcttggactttttaggcctgctgactaacagtggtaatgtatgaaatcgcattcaacattcctttgaccttgaaacatccactgtggaatgaggattcaagacagagctggtgctcccacactaaaaagtcataacacccgtgattgcaaccacggaactgctctgccttcaagtctggtccatatccctctcttgagcattacgaaactcagaactaactcattatcattggagcaatattattccctgttctaaaatggtaccgcaaatgagtagacttagactataattctttctcttgctccttcaggtgaatcagttcagacagctgtattccaaagtcatcaatgataagcatgatgatgtcatggccaagtttggcgctattctggcccagggcatactggatgcaggtaaatgtttttaagtcttcaagatttatttatttaaactaaatctaataaaataactatctgctctaactatatgacataatggaaattgagtctgaggcaaattattcctggagaaaatttggagcctgcagttcacagagatcatgtacatttaagagtacaggccgggcgcaatggttcatgcctataatcccagcactttgggaggccgaggtgggtggatcacctgaggttgggagttcgagaccagcctgaccaacatggagaaaccccatctctactaaaaatataaaattagctgggcgtggtggcacatgcctgtaatcctagctacttgggaggctgaggcaggagtatcacttgaacccaggaagtggaggttgcagtgagtcgagatcgcgccattgcactccagccggggcaacaagagcaaaactcggtctccaaaaacaaaaaaaccaaaaaaaagtacaggctgttggccag

SEQ ID NO: 99117 - DNA, 1565 bp, Homo sapiens
tcagctatgtttcagaccctcctttgggtctgaaacaaagtcagcttttacaccagtattgcccagcttttcacctttgttttcagcaagacccatgaaggagaataatataggctaaccactcacccactgtgtattagcattgtaagacatatagtccagagaggatatctacaaccagcgctgaaggaaattgttctattttccattgctttcctgtaaagcaaaaaggctatagcacccaaatctcaatcttggaagtacatgagagcaaattcatatccaaggtaggctacagatcaaaaaaaagggaagagttatattggacacaagcctccaagaactaaagattcacttgatgacaagagtagtaaattatttcagtaaatgtcctgcttagttttcccatttattctttgatttatatatatttatatatatatatatatatatatatatatatatatatatatatatatatatatatatgtaatacagctaggaaatagaatagtgttgtaggactgagttctctagggcttgcatgtttgtatgtcagtaagggattacaacagtttaccctgctcatttccccaggtttctactgctgtattatctataactgccaaggctaaaaagaaggaaaaagaaaaggaaaaaaaggaggaggagaaaatggaagtggtaggtataaattggtggtcatatggattgaagtatctctgtctctgtcatggtcgagattcttccttagttgaatattattctaccttgctcttggcttccttcaaacaattatcctgttgccagcatgtagaatcatcaaactgtacttgaaagagactcgaaaatatatccatttgtgggaagaatagaagggtacaaatcagtaaaaagttcctggagcaaatgacaactaaaataggttttgaagggcaaagtaggtttttcacagacaagatgatgaggtaggagaaagaaaaaccctttcaagcaaagggattatcacttgtttaggtagacctttttctgatctctgctggtagaaaaacctttttaatcctttaaaaccaagtcaaataccattctcattcctaagcagagttacttttccctcctctgagtctgatagcactttagttgtacttccattactaccgaccactacctcttgtaccttatagctgctcagtcaacttcagatgttactcagttctgtggaacagaaatgaacttctgttgaactttttttaaattttattttataggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccagtaagttaccagtgactcttagctgtatataccagtgggatattaatccataggacaatagaatattgatagagaatgataaatctccaaagcattggagcaagctcactagttctaagaaattatttaacaaaagagagaatgttcttt

SEQ ID NO: 99118 - DNA, 1083 bp, Homo sapiens
agactgcttctcaaacttcagtgtgcatcagattgactgggatcttgttagaatgcagattctgcagatctagggtggggccagcttttctgcatttttaacaagctccagatgataatgatgcttctggcccaggaccatatcttgagtaggaaggaattaggatactatatttggacagtaaacattcttcctgcagtgagactgaggctggtagtcaaggccatggctgggaaataactattcttaaattgggatgcatcatccaagtagaacagcatcacatgttataccatctagagctactgggttaagtttgcaaatacttcgtatagatcacagttatctttatcccagtaaagttctactccagtttttcacttccaaatcatttaagtagttttaaagtaccatttaacaagtatttactctagattgtggagcacgcttgaaatatgagtgtacgcttctgcacgcccctgtgtttccagctctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggtgcgtgtgcaacaaaattatgaagggaaacttctttgtcaatacttcacaaatgttttttgcaaggacatcatctcacgtttttccttccttttgtgtttaatccttatttacctaaacagtattaaaacttccccgtttcaacctttttctgcatatataaccacaaattcctttttctttcctctttgactcgtactctactcacgttattcaaagtggctggtctgcaaactatttttataggtccataaggagataggaagcttactccagaatctgtctgctcaacgcttctttcatcaagaaagtcttccccaaaacatcagctgaactgcagtttgcttagtgatagagctgatttacattctgatgtaagcttcttgttgtggatcagttatagttgtggactggcactggcccataggtgacactt

SEQ ID NO: 99119 - DNA, 1516 bp, Homo sapiens
ggctgattttgtatttttagtagtgacagggtttctccatgttggtcaggccggtctcaagttctggacctcagctgatccgcgaacctcggcctcccaaagtgctgggattacaggtgtgagccaccacgcccggccaattcattctactctttaaaaaaaataaggacagtatcatttgttatatttaaaggtctggttgcaaatctagcatgctgtgtgttagatactgactagcaatttaggaaagatttgcagaaatctcagataaatattaaggtagaaacctgccattagtaggaaaatatatttatacctcaggaagactattagtttgggccttagagaaaggcagatttatactaaccttcctattttctaaacttacttttgaaaattatctttcagccttgatagtttcctaagctttacccaacttgcacagtacagcgtaggctatcatgatcactcagtctgtctgagaattgaggtgactcacgttagctcccatcaagcctttggcaatacctcatggaaaacccttgattacagctttcaaggcagttaattacaaaatgacttagaggtttatagctggaaactggaatcttgttagttttcaaaggggtaaaatattcagtccattaggagtttggaaactataatctgtcgtggcacaaactggtatattaggactgcagaggcagggttggggcctagttttagatttcaacagttaatagtaaagaggaaaaaaaagaatgtcttgaaattaagaatgaccctagctactactgttctttcttccctttcccaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaatcccaagagccagagtcttgatttgctaggatgagtatgcacgactttcatattgatgaaaaagtcaaactattcttaaattatagaccatgaaaataatggaagggaaaaaaatcaaaccttgctcatcacccccaagaattctctacagttttgttgtggttgtgggttgttgtttaatatggggtctaatcagccagggcaacatggtgagacccccatctctacaaaaaaattgaaaaattagctgggtaggccaggcagggtggctcacgcctataatcccagcactttggaaggccaaggtgggcagattgcttgagccaaggagtttgagaccagcctgggcaacatggcaaaaactcacctctacaaaaaaaaaaaaaaaattagacatgcacagtgg

SEQ ID NO: 99120 - DNA, 1561 bp, Homo sapiens
gttgcacgctgtgggtcagcaggtccaaagggtgacttcagtatatttacgtgtccaagagttctctggccccaagtctttgttctgtgcctgattctttccatttcaaagaccttaaatgttttgtgtgttctttatagtgcccagattagatattgcaaaggtgtgggaaaccagggttggtgtgcaggaatcgcaggctcaggagcttgaatcctgtgggatctctatttttctatcctttaccactgaaaaggagtatatgggagatctgtggtgttgagtgggttgtgagaattttgggtgttgaaatttacaacgaggtatgtagtctgatgtcttctccacagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggtgggtttacctggtgatgcgggtgggtctgagtggtgtgttaaggaacagtgtttgctgtcattgtccacatgggcatggatttcatatgtggctgtgctgtcataatgcttacgaggtacaggcatcctctctcctggtgagtgattttctactgtattcccagcagtttatattctaatttctatggagatttaataatttctgtaatcaaagctatattcctaaatacctcaagtttttgaaacctcatcaaaataaagtttatttggcaacttagtatgtaggcgtgtatgtctaagagaacatatatttcagctgcatattagaccctatattagaacataaatttatttacttatttattgtagagaaagggtcttgctatgttgcccaggctggtcttgaactcctgggctcaaacagtcgtctcaccttggcctcccaaagtgctgggattacaggcgtgagccactgtgtctggccagaacacacatttaaacttaggtagtggaaaagagtacgtctctttgtggaaagcccttttgagtgataggttgaatttagcatctgtagtcctttcccagatggggctggagatgggaagagaggagaaggctgaaatgtgaagctgctgcggtggctgagctttgagtgcagagtaaatgacagaagggcagcagaggcaagctggcatttgaccccgtgcattaatgactgccctatggaccaaggtgaacacatgagaatgtcagaacaccaacggtggggacagtggtggagggagcagcaggaccatacattgtggtagccgttgttggaaggctcttcctcaggttatcactcttgcagggaagatcacaggagattttcattttctgtttgtatttctgtttaagtctgggggtcaaaagagggctcatggtataggtcaactgagatgtgtttgtaagaacaggcttagtctatgtacgagactgtgaaggccatgattagtagagccagtgtgggagcaaagccccacattcacctcctctggt

SEQ ID NO: 99121 - DNA, 1031 bp, Homo sapiens
ttagcacaagaaaggaaaggagtgacttggaagcttttgtttccaacaccataaagaaatgcctgttaatctttagaaaccgctcctgctggaggcatggtaatgcagacagatacttatttatatctgaaaagtagaagcaatgtgtctaggtaataatggggaagctagttaaataaatgtgatagacaacatgaggttttgtcctgccattaaaaatgtttatgaagaattttaaggacatgagaaaatggcaataataaagttaaaaagcagcatattgaactgtatatatagttgtctgatcttcctgacatagtctcattaagggggaaatttagggtggatggtagaattctagagacaatgcacctgccaggttagataggggatgccagcgacacgactgggacagaaggagcctcagagagaggatggggtgagcagatagactgggcattgatctggagacctcaaacaagtgttttcccttcttctaggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggtaaatgtcagcttttaactcttgtgtcagatcctgggtgacattgtggttttaccttctgtatgctgggggcttctgaatgatgctttaaaaaaactaaaatttgcttacattagtattatttttagttataaccataatttgtttagtcagtctcctattggatggttagttaggtttggtttttgccatcctatactagcagtggtttgcaacttctacatacattaaatctggaagagttatagtaattaacactttgtaatagcaaaaactaggaacaacccaattgtacaccaacaggagcatgcataaatacattgtattatattcacacaatggaatattatacatcaatgagaatgaatgaactaa

SEQ ID NO: 99122 - DNA, 1029 bp, Homo sapiens
ggttggggatcagtaggagtggatggaaactttattctccttttttaaaagcactgccatagtggaaattgtgtggtctaaagcagggacactttttttccccctaactttttacttggaataattgcaaaactgcaaaagtagcacaaaggacattggtatacccttcacccagagtcacccgctgctagcattggccccttcctttgttgtgtctctacacacaagtgaacacgcacacatatgcacaaaatctgttttctgaactatttgaggataaattatatatattatgactctttactcctaaatacttcagtgtgtatttcttaaggttaggaatattctctcatataactatacagttaccaacttcagtaaatttaacattgatacagccttcttatctaccgtccattttccaattttggtagttgagtcaataatgtccttcactgcatttcccgtcctctggtcatctagggtcaattgtcacattgagttggcacagctcttagcctcttctaatcttgaacatttcctcagcctttctttgagttacatgacattaacatgttagaagaatataattttccccctttaaaaaaaatagaacattttgctgggtgcggtggctcacacctgtaatattccagcactttgggaggccaaggcgggtggatcacgaggtcaggagttccagaccagcctggccaacatggtgaaaccccatctctactaaacatacaaaaattagccaagcgtggtggtgggcacctgtagtcccagctacttgggaggctgaggcaggagaatcgcttgaacccgggaggcagaggttgcagtgagctgagattgtgccattgcactccagcctgggggacaagagcaagacttagtctcaaaaaaaaaaaaaaaaaatagaacatttctccttttgtgtttgatatttccttataattagattcgggttatgcatccctgaatcacctaggccaaatacgacgtcggtgatcgtgtgtcctcctt

SEQ ID NO: 99123 - DNA, 1071 bp, Homo sapiens
aagtgccaggtgaggtcagccgtggacatttacttgctggttgccatgtaagtgccaatcgtatgctcagcaatttccttctatacaaagtgctcagatctaagagttgctcatatatttactcaacaaatatttgagggcctcgaaataacactattgtaggaactaatggggaagggatgcaaaagaaatctaaaagagtatctgtggtttaaaatacctccaagaatttccagcctagatagggaagatcacagtgattctgacaacagcagctcccgcctgctggcagtgccgggtgccaggcactgttctaggcgccttatgggtgttcagtcatctcctcttcttagcagccctgtggtaggtgctatttttattcacatttcacagatgaagagacagagagaaaataggtcacttgccaagttcacacagctaataagtaactgtgatggggctgggattcaaatccaggtggtctgactcagtggtccatgctcctaaccactgccctatattaccttcttgtgagacatacatgaatgcaaaatagcaaataacagaaaataaatatgtgatcacagattcataaaggtgatagacacaggaagtgccacagaaattccaagtactccaggaatactgggagatggctggcgtggggtaaagaggaagtgagatgagttgaggaagggaagggtgtggccagcaggggtggcatcctctgggggagacagcacaagcataagctttatcctttgcctctccactgcactcacatcaacccccccaagaaacccatgttagtgatctagtgtgtgcatgcgctttcatacttaaaagatgcacacacagagtacacggaggtatgtactacacacagatccatatatacttttgtcagtatttgtttttcaaaatgagataacatagagatagaaatacacatacttctacaccatgttgcctttttctcttgttaatgtttcttgaaagtccttctgagttaggcagtgtagcaagttgatactttttaatgctatgaatgtataattttctagatttttt

SEQ ID NO: 99124 - DNA, 1049 bp, Homo sapiens
ccagaagcagaacggtgctgccctttttgctgagtcttgttacttattggctgtaaacgttcttgagatgagcagacctgttctagagttccctatcccccataaggcctgtgtatgactgactggctgttctatatggtgccttgatctcacagagagagaagttctgagaactgtgattaggagagactttaaagagccttctggaacctccgcacaactaagcagtggaggctccctagctccctagcttcctgaagaggctggttggccttgtccctttggtcttcatggagaggttgggagcagaggcagactgcccctgagcccccttggaatataagcctgcaagttgctgtgattggccgaggccttcttgtttcatgacagctacacattctggggagccacgccttgggagcttgtgtcagggtgtccatggcattcaccccatgtctcctgaaacaggaggaccatgacatcatggaagccgatctggacaaagacgaactgatccagccccagctcggagaactctcaggagagaagcttctgaccacggagtacctgggggtaagtgccacacaaagggtggggatcctgaaacagaaaggccagatggacattgatggatttcgtgttttcagtgacacagagggtttagtttggtttgttaccatactgtatttatgagaaggtccatgttagccagtctgctctcagtggccctgaaatgcactgtggccctagctacctgtcacaagtagacaggtgtacggattggggaaagatataactagaaggcatatgccaggggcctttggaacatcagaagatatgcctggccccagtagcaattgcctaccatcccactttttaatttctgcatgccttatgtattggaagggaatactgaggtagacttggaagtccttggcgcagaggtgttggctgaaaccatcatagcccatgaggttacccactgaagcacagtgtggagagagagtgggggctgagcaaggaggggcattccagcagtcaggagtggg

SEQ ID NO: 99125 - DNA, 1078 bp, Homo sapiens
ttgacttctaggtcagctctctaatagatatttctccagcccttttttctctttccttccaccagatcatgaccaacacggggaagacaaggcggaaggggctggctaatgtgcagtggagcggggatgagcccctgcaaaggcccgtcacccccggcggccacagaaacgggtacccagtgtaagtcagggctaaaggaagcgggaattgactttcttaagctttgttttgattacagtgtaagatgtatgtatttttaaaattcaaaataaagcattcattttgaaaagcatttatctctttatttttgggggatttttggagggaaagaggttgagtccttctcccttcccccaggatttttttattccagaaggagaagtggttggattacaggatctccagggccacttcagaagacaaatgttggccagagtaatttcaaaagaagggacctgaaaggaatcgggctctctccagaaggactcctgtcgtgccttttctgtggcctctcgtcacagcaccaagccctgtgttgggattggaatgttacagtttaagactcgaaatcaatttattttagatgactttttggaacaactggatgctgttttagctgccgagccttattcatcttccatagccttgctcgtaccccatttatagaaatgaaattttagtctcgttacgtagagcctctggtctccctgggggcctagaccccttgtgggctaaggagccccagatcagacagtccagtgggcggtagagaagccacttctgtggtctgggtggcctctcttttcctgtctagagagaatattacagcaaaatattacagagagcaggctaaaaacctccatatattcattcaacaaataatggccgtgtaatttttaaaagaatataccgtgttttacttagttatcccctgaaactgggcactttattttttccagtcttactctattgcaattttgtaatgaacaaccaggcaacggaattgagcaacaaaactcagaaatgcctgccctcatggagctctgtgctgccacggacaccagggacaccaggcaa

SEQ ID NO: 99126 - DNA, 1081 bp, Homo sapiens
tgcaaggatgctgcctaggagactgtaatttcccagagattcccagtgattctcaaagtgtaggcaggtttgggaaccaccggttttcagccctccaatccctgctctcttggtgggccttgagccagggccagaggagggccactgcgtcattgaacctgggcaggaggaggacagaatggggaagcggcaatggaagcaattggggccagaaaggaacgagttaaggaagttaaaatttcccactgaaataggtggcagttgaggaagcagaagtgggtttagagcttgaggaatggaagagggtgtccacagcctctgtgcaggatctgagaaggccagggaggaacgatgaggcatgtcgagggccaggcaaaggtgctccctggaaacccagctgtgtggttccaggcacggatcgctcagggctcctctggttgtgagagacagcagcccgacccaaggtggctccagccagagggatttgttggctcatataacaggatcccctctccctccacagcctctctctctggacagttgcccagcccctagctcttccctaaggtctgcggacttcttcatgaagagcaggagaaacacaggctcgcaaatgggctgaggcatttgtcacctcatctcagggacctcagagaaaagagaggtttttccctgtctcggcctccatatacagatgtctagggaaggactctcactagtctcacttcagtcatgtccccaacctaggccaatgatcacgttgcgggggggcgggggtaccacagtgggccaggcctgggttatgcattcccttctgtggttgggacaagtcctgagatttgcagccccatgagaacagcctggagtgggcagatccgtcaaaggaagctgctgttatcaagaaaacctggttccagaggctcactcagcagctgcagagatgcctgggcctggtctcccactcatgccaagcccctgggactctcagatcatccaaaacagagccctagatgagagtcccagaaggctggagaatcaggtgagaggtgctgggaaatgcctccacatgtgctcctgatca

SEQ ID NO: 99127 - DNA, 1321 bp, Homo sapiens
gttttgagtgataagtgaaaaaagaaaggagatagggctgggccaacaggccttcccttggtggtggggagccctcagaggtgggaggaaccccagaggtgaagagagggacatggtgggggcacaaaaaaagcttccagagccacaggcctgggcgagtcctgacatggagcccagtctcatacggcctctttccctagtggctggctttgctcctggccctaggtagcccaacagctgggcaaggggtccgtctggtcaggggaaaggtgcaggggcagaaggtagcagagggagaaaaggacaccctgtctgcctctggccccaaagacaagtccgaatggggccagagggaaatggctgggccttggggtgccccagggtcttggaggggaccgggtgttcaggtttcgcacaagtacaggagggaccggcgaccgccctccccccgccccgggaggctccgccagggacaggcgtccccgggattggaggtgacccccgtgggttccgaagccccgcctcggccatgcactgtctactaggcgcgcttggggagcctaggggccgtctcggagaaatggggtggtccccgccaggcggcggcggggcgggccctgggcgccgaaggggttaaggcacctgggccaccgcccctgccggcccctcctcccgcggccgggaagaggaaagtcgcggcgggggcgcggcccggtctccgtccccacccgcccgccgtcccgccggcccgagccgtggcgcccagagctgcgagccgctcgcccctccgccgctccggcccgggccgccatgtcgctgtggtgagtggggctgggggccgtcgggggcctgggcgggggcgtgggcccggggctccccctcctccgtggccacagacgggcgccgggactcccgggataggagatgcccccgcgcgcgccgcgccggcctcagtttcccgggggcggatgggcgggcgggcgcggcggcggcggcgggagatgttcgcggtacgcggccccggacccgtgggggacgtcgaggggtctcggggcgccgcgctcagctccccggccccgcggccctggacaccgctccaggaccctggcggctgggaccccaggtcttgccggcagctgggtcccctctcccttccagacccctgagggccccctgcgtccgggccactctcctcctctcggggcttccttccgcgggacctcggaccgccgcccgcccggcccctctccgcccctcccgggctttccctacgaatggagcggacccggcaggtggagcgcccgcagcccagggcctcgcc

SEQ ID NO: 99128 - DNA, 1024 bp, Homo sapiens
ctctggctctgagtcacctaatgataccgatacctactgctgtgggtaggtacaccgcagggaaatgaaaggcattggggttccaggcgtggggaacagggcagaggtttccacctgaggccctcctgttaaggtgacagcattcccctaactgtgcacccgctgcctggtactttatatagcactccaatcctgtgttttagccccatttgggggaagaagaaatcgtggctcagagtggttgtaaaccactcattcagcttgtaagcgtcagggcctgattccacagtgctccttgaggagagggcagggtgggagaaagaaagggcagggtgggagaggaagcgggaccctaccctgacagcttagggactccgggactgagcctgtgcccaggtccacttgcccgtctgggaccacccagcctcccaaggggggcgccaggagagccctgggctcatcttttctctctcctctgtactgtccgctctcccccacaggaagaaaaccgtctaccggagtctgtgcctggccctggccctgctcgtggccgtgacggtgttccaacgcagtctcacccctggtcagtttctgcaggagcctccgccacccaccctggagccacagaaggcccagaagccaaatggacagctggtgaaccccaacaacttctggaagaacccgaaagatgtggctgcgcccacgcccatggcctctcaggggccccaggcctgggacgtgaccaccactaactgctcagccaatatcaacttgacccaccagccctggttccaggtcctggagccgcagttccggcagtttctcttctaccgccactgccgctacttccccatgctgctgaaccacccggagaagtgcaggggcgatgtctacctgctggtggttgtcaagtcggtcatcacgcagcacgaccgccgcgaggccatccgccagacctggggccgcgagcggcagtccgcgggtgggggccgaggcgccgtgcgcaccctcttcctgctgggca

SEQ ID NO: 99129 - DNA, 1393 bp, Homo sapiens
cttcttcaacctgaccctcaaggagatccacttcctcaagtggctggacatctactgcccccacgtccccttcattttcaaaggcgacgatgacgtcttcgtcaaccccaccaacctgctagaatttctggctgaccggcagccacaggaaaacctgttcgtgggcgatgtcctgcagcacgctcggcccattcgcaggaaagacaacaaatactacatcccgggggccctgtacggcaaggccagctatccgccgtatgcaggcggcggtggcttcctcatggccggcagcctggcccggcgcctgcaccatgcctgcgacaccctggagctctacccgatcgacgacgtctttctgggcatgtgcctggaggtgctgggcgtgcagcccacggcccacgagggcttcaagactttcggcatctcccggaaccgcaacagccgcatgaacaaggagccgtgctttttccgcgccatgctcgtggtgcacaagctgctgccccctgagctgctcgccatgtgggggctggtgcacagcaatctcacctgctcccgcaagctccaggtgctctgaccccagccgggctactaggacaggccagggcacttgctcctgagcccccatggtattggggctggagccacagtgcccaggcctagcctttggtccccaaggggaggtggagggttgaggcctacgtgccactgggtgtggtggggtgcaggtagccagaaagggacctccctgtgtggataattctaggaaactgaggcccaggaacggttggagctgcccagtctggaggccctctctgaggagcgaggcgccaggccctggcagccctcctgacctgggtccgttgctggccccctcagatgtggtgggaggtcctggtgacctctggaggaacgctgtgctcaggtacctgggctaggcctggcctgatgggtctgtggccgcccctcgtcttcacagggaagagtcttctgtgaaatgcctcagtctccccagaggccgggcggccctggcaggagaaactcaaccctgtgcgggctcacaggcaccccccagtccacaccctggtctcctgggagagagggcccagccggctctccgcagccccaggcctgcctggagacgggccgcctctgccacagggcctccactcctggctgtgtcctgtaaggtctggaagggcgaccgctctgactacctcagcgcccctcagaatctccctggggctgcagccctaccccaccccgacacagggcagaagagcagcgctcctggccccccgaagtcccagagctgctgacccccaccccaggcaagtctctcccgcagcccccacacccccaggcctggctccctggctggaaagcagccggtttg

SEQ ID NO: 99130 - DNA, 7772 bp, Homo sapiens
ctgggcttggtaccgccacccactgtaggagccccaaatgatttaataagttaatgcttggagcctcctatgtgtaaggttctgaataatttacacatagcaattcatgatccttaaacatgtaaggatgatactattaccattttcagatgagaaagttggggcttgggaaagtatgaggtgtaagaattcagagggtctggttcagaggtatttttaagtgttcaaaagagttccttatgtctgggtattcaccttatgataggggctctgacttaagacaacataacagaagcctggagtttaacatgctaatgtgtctagtgcatgtggtcttgaaccagaggcattgccagagtctaacatctcattgggaccatggttatctttttgggtgtggggctggacttactggtttggttttcatttattctcaaggtcgtcatacctcagaagaaaggcaagaaggctgctgcaacctcagcaaagaaggtggtcgtttccccaacaaaaaaggttgcagttgccacaccagccaagaaagcagctgtcactccaggcaaaaaggcagcagcaacacctgccaagaagacagttacaccagccaaagcagttaccacacctggcaagaagggagccacaccaggcaaagcattggtagcaactcctggtaagaagggtgctgccatcccagccaagggggcaaagaatggcaagaatgccaagaaggaagacagtgatgaagaggaggatgatgacagtgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgacgatgacgatgaggaagatggtaaggagttgtcttggtagttactgggcttctgattacaaggtatcttgagattctgggatcaacatattccttccacgacaacctggagatgagattagaatccttgtgggaattctctgggttgttgtggtgtgctagacttaattacccatgaatgatttttgtgcctcttgagaaaatttcaatagcacattctattagtgttttttataatgtaggattttgtttctaagtgattttttttttttttaaatttttttgagatggagcttttgctgtttcccaggctggagtgcaatggcgcgctatctcggctcactgcagcctccatctcctgggttcaagcagttctgcctcagcctcccgagtagctgggattacaggtgcccaccaccacaccctactaatttttgtatttttagtagagacgacatttcaccatgttggccaggctggtctcgaacttttgacctcaggtgatccacccaccttggtctcccaaagtgctaggattacaggcgtgagccactgcgcccggccccaagtgatctattcttgccatgactgttaactaaacatggtgacaggattgcattttctttacattagatttgaaaaccgatgttggttttgggagattgctgcaatttttaggtgacttctctttcagactctgaagaagaagctatggagactacaccagccaaaggaaagaaagctgcaaaagttgttcctgtgaaagccaagaacgtggctgaggatgaagatgaagaagaggatgatgaggacgaggatgacgacgacgacgaagatgatgaagatgatgatgatgaagatgatgaggaggaggaagaagaggaggaggaaggtacttaaattagattctgacatacgacatgagttatgtttaaaggaggcacttaagtgtttgtggctactgatgtgtgatacattgtttgacatcttgtccagagcctgtcaaagaagcacctggaaaacgaaagaaggaaatggccaaacagaaagcagctcctgaagccaagaaacagaaagtggaaggtaacttgcagaattaggggatatgggggagataaacagcacaaatgatgaataacaaagggacttaatactgaaacctgatgttacattgtagtgtgctgatgtgctgtgtatagaaattttgctttggaaactaactttttaccacactacaagtagactgagttgagctttttttgtgcaggcacagaaccgactacggctttcaatctctttgttggaaacctaaactttaacaaatctgctcctgaattaaaaactggtatcagcgatgtttttgctaaaaatgatcttgctgttgtggatgtcagaattggtatgactaggtaagtgcttcactgcacgttacatacacgtgggtctgttaatgcttttccttcccctgttagcacagttactttagcctgctactgttaaacatgaatactgtaaacatcttcaaggattagcattagtgaactaagttagaattaaactgtagatcccctaagttgcaatttccataatcagtcgtaacttggtatagcacagaataatttttagtaagtttttttgttgtttttgttatgtattgagacggacgctggcttttgctcaggctggagtacagtggcgcaatcttggctcactgcaacctctgcctcccgggttcaagcgattctcctgcctaagcctcccaagtagctgggattacgggtgcacttcaccatgcctggctaatttttgtatttttagttgagatggcatttcaccatgttggtcaggctggttttgaactcctgacctcaagtgatccacccacctcggcctctcgaagtgctgggattacaggcgtgagccaccctgccagtaagttttaataatttggtgttaggtgggagaatcgcttgaacctgggaggcagaggttgcagtgagccaagttcgcgccactgtactccagcctgggcaacagattgagacaccgtctcaatttaaaataatgtttattttcttggaagtacctgaaactattagacctgtctagtcatcatagtgaatacttttatccagacaggattctcctgtattagtgcttataggtgttcttttgtcagctgctactgtgaattcttataagcaatttagctccatgatgaagacctcaaacgtgaatgtgcatgtcatatcttcatgctgagaccttgttctgtagctgcagtttgcagagccttgactttgttttgctaatactaggggtgctttttaaaatgtgatctttgtttgcaccatcacatttgtctagaatacatattgtggattttgatttgtgttttcacctgttgtaattttgccctcctctccaccttgaaggaaatttggttatgtggattttgaatctgctgaagacctggagaaagcgttggaactcactggtttgaaagtctttggcaatgaaattaaactagagaaaccaaaaggaaaagacagtaagaaaggtatgtaaggctttatgagattatgcaatgaactcaggagctagactgctagggaaaatgctttgtaacccatttcccttggtttcctcttatttttttaaatcatttttttcctttggtttcctcttaatgtgggaattaaatgagctacagtgtttacaagagtacttggcactgcttgtcagtgttatagtgtaaattcctgagttaggcaagcaagagcacttttatacagaacaagaattattagatgcacctaaattaacgtaaagggatctttcttcactgaaactagattaggtccctaattactccctatatacagttgtaatgttttgaattggtacattcactttttttgttatgcgcgtctactctaggttgaactccagtgtacctaacagagagtttgacatcagctgtgacaacatggagggaccacttgtgtgttgacactgctatatctccatatttagcaccgagccttgtacattataggatctcaaattatttgttgaatagagctatgtgtgtttttcccctctttttgttgttgccccccacctttggtttttcaggccacagagctcatttttgtttttttaatctagagcgagatgcgagaacacttttggctaaaaatctcccttacaaagtcactcaggatgaattgaaagaagtgtttgaagatgctgcggagatcagattagtcagcaaggatgggaaaagtaaagggtatgttctgtctattgaaatgtaagggttttattaacattaatgcactttcctgctttataaaagaaatattggtttgatttccttaggcgtgtaatcttggacagtttaacctgtaagtttgtgcctcagtaacccatctgtaccatggggataatgtactcatagggtgattttaaaagacaagctaatacttacaaagaagcaagaaatgtgcctatcttacaataaatactttgtaagtagtagcagttctttcagtgaggtgaggttactatgaaaaaattccaagtatttgtaaaactagtgggaagtaagagggaagctcgagttttgattgaaaagtggcataaaactaagggcatttattgtactcagatctgaagcaagttctgtgttgctgaggtaaaagcatttgtgttaatatggttttaaaaaccatgagttcttctccctccattgcaggattgcttatattgaatttaagacagaagctgatgcagagaaaacctttgaagaaaagcagggaacagagatcgatgggcgatctatttccctgtactatactggagagaaaggtcaaaatcaagactatagaggtggaaagaatagcacttggagtggtaagaaattaggcttgttacaaggtttcagaattggtggagggaactcctttgtgtctttgtatttcataagtttataaatactttttaatcaaagttactcaaatgtaggtgaagatcaaggacatgataccccaagtcatactcttatttggaatagtaatttccaatcttgaatgagagctctaaaatcattttgcattggaatacagtaggcaaatcaagcttcctttgtaggcatgttttatactttaaatgacttgaccatgtgcgttttgaactcagatgattctaggaaaacagaccagtcatcagcctatgtaagaacaaccagcaggacattgcaacacgtactaggtacttaatatgttgagtaacagaaatggatttagcttacgtcatgagtatttgtatattaactcaagcactgaaattcttaggaataagatattactgttgtgaccgaagctgggaaccactgtttcagagtcttaggaatgtggcatctctatttgcaggtgaatcaaaaactctggttttaagcaacctctcctacagtgcaacagaagaaactcttcaggaagtatttgagaaagcaacttttatcaaagtaccccagaaccaaaatggcaaatctaaagggtaagataatacctttgtatcatcagttataggctatatatgtcttagaggtctaaaggaacgtaaggtcatgtgatcctgtcagaaaagccaaataattttagctacgtaaatgagtgtaaaataaagatcatcatttaggtaccaacttgagagaaggggcttggcagcatcatgtgacagtgaaggagcatgtgcctggtaacttactctaagcattaactgttcatcctcaggtatgcatttatagagtttgcttcattcgaagacgctaaagaagctttaaattcctgtaataaaagggaaattgagggcagagcaatcaggctggagttgcaaggacccaggggatcacctaatgccagaagccgtaagttcacctggttagggtgctgtggttgggggtagcactctcggtgctttgtttattttttgcacaaattctgtgtttcctgttgctactgagtgaacaataactggatatgatgactgattacctgagaaataattgatgaaatctcaagaaaattcctctagatagtcaagttctgatccagctgtgtcaactcagagtagcaagtttgcccatgatttcctgccccatccactgggccccacctgcttgggttgcttctcccactttccatagaagatctggggcaggatatcaactatgcaatggcaattaaaaaatgtaaacccagaatagcctttactttaattaaggactagttggcttagttgcttttaactgctttttcactataacaagtattcttggctagtagtcatactaggcattgtgcaaattcagtgttacgaactgtgacttcacataaagtcacatttttttttccttcccagagccatccaaaactctgtttgtcaaaggcctgtctgaggataccactgaagagacattaaaggagtcatttgacggctccgttcgggcaaggatagttactgaccgggaaactgggtcctccaaagggtaagggaaggaagcgtgagtgctgcttccacttgaaggggtttttgttctgtgcagaccttgagtctaatgtgtcttctcattgagctcctttctgtctatcagtggcagtttatggattcgcacgagaagaagagagaattcacagaactagcattattttaccttctgtctttacagaggtatatttagctgtattgtgagacattctggggttcaagctgtcacaccagttagttttccatagagagctactctgtcactggtatcttttcccaaataaacaaggctactttctgtgggatggctccccagcatgtacagttaacttgggacatgtgtagtaggtgctttttataatgggcaatttcatttggtgttctaggtttggttttgtagacttcaacagtgaggaggatgccaaagctgccaaggaggccatggaagacggtgaaattgatggaaataaagttaccttggactgggccaaacctaagggtgaaggtggcttcgggggtcgtggtggaggcagaggcggctttggaggacgaggtggtggtagaggaggccgaggaggatttggtggcagaggccggggaggctttggaggtaaggcacgcagagataatgacaccacatagcatgtgctcttcagaccctgtgccctgtcacggttcctaatcactggggaggaggagctttgtacccattcttttaacagtgtcttgccttcctcctgtagggcgaggaggcttccgaggaggcagaggaggaggaggtgaccacaagccacaaggaaagaagacgaagtttgaatagcttctgtccctctgctttcccttttccatttgaaagaaaggactctggggtttttactgttacctgatcaatgacagagccttctgaggacattccaagacagtatacagtcctgtggtctccttggaaatccgtctagttaacatttcaagggcaataccgtgttggttttgactggatattcatataaactttttaaagagttgagtgatagagctaacccttatctgtaagttttgaatttatattgtttcatcccatgtacaaaaccattttttcctacaaatagtttgggttttgttgttgtttcttttttttgttttgtttttgttttttttttttttgcgttcgtggggttgtaaaagaaaagaaagcagaatgttttatcatggtttttgcttcagcggctttaggacaaattaaaagtcaactctggtgccagacgtgttacttcctaaagagtgtttcccctggaatgtcactggagagcatggcaaagccagctct

SEQ ID NO: 99131 - DNA, 2273 bp, Homo sapiens
agggccaacgggaactccgcggtccctgaacttccggtgctggcggactcctcgctccagggccaccaggagccgcggcgtgagtgcgtgccgggaccgagcgcggggtctctgaggaactccaaggctgcccaagcctacggacccagccacattggcgaaccggagaccgcccgattccaccacccccgcgctcccctcacagccggcgccaaaaacgccagtcccacgacgcaggccgggacccgcgcgcccacggcccaatcagcgcggaccttgcacaaagcgagccccgcccccacggcgccgttgccagcccctccccctcccgtggccgcctcggcccgcctactccccgccccgcgccgttcacggttagaggctcgcgattggctcatggggacggccgcgagctttggttggtcggcgcggagtcacgagggcgccgtcgtcgcctttccacaggcgattactgggcaggctcagtctttcgcctcagtctcgagctctcgctggccttcgggtgtacgtgctccgggatcttcagcacccgcggccgccatcgccgtcgcttggcttcttctggactcatctgcgccacttgtccgcttcacactccgccgccatcatggtgaagctcgcgaaggtaaacggccttgagcgcgagcgcagacgtgtaggcctgctttccgaggggcgagcgcggcgccgcggggaggagggcctgcgcgcagtcccgggcgcgttctagggcgccatgctgcgggaagtctcgcgcgattagtggggaggtctcgcggcttctggctacttggtggcgaggtgaagagcttctgcaggtgctgggggcggcgaacgcggcgggaaagacagagtcactgagcgcggggagggggcgctgggcctcggggtggagagatgagaccaaacttttgcgacgcgtacgagctgggactcgactcctgacgcacgtgcccgggagcgcggcctgccacgtgggccgcgccgcgtgggtcctggaatctccagagggaccgggtgccttgggccgggaaatggcggtatcggccctagtcggagtcccggctgcgctcggatgtctccgccccggcctggcaagccgacacgtggtgggccccggaaggtggctctgccgcgtgccttttgcgctgtgtttcgggcacgtggtggcctaccaggtacccccacgtggccgcgccgcctctttaaggggcggggttgtctcgctgggaaaggcataagcttcatgagaaaatcaaggtagtcatttttttaagtgccttaatgatcttcaccgttaatttggattcagatgagggtggtagaataaagtaccgggatttgtagtattaaaacacggttgtgcttaactaaggtaacgggaggagaaatcatttcctcaggttgactttttaccttagggcaggttttctgttggtaaagcctgggaggaaaaatgtgggcggttgagagtagtccctcttgcattgccatcaggagtagtttctatgttagttgtggtgtttggcactatgagaaatggatctgaggacggagatgatggcgtatgaacactaatggcaaaatatgaatggcctgaaatgtcgaggtggaggtgtaatgatctatttgtgtccattttaggcaggtaaaaatcaaggtgaccccaagaaaatggctcctcctccaaaggaggtagaagaagatagtgaagatgaggaaatgtcagaagatgaagaagatgatagcagtggagaagaggtaattttatccaacttaatgcagaattatgttaaaactacaaaatggagagttaagacatgaaattggatatctgtggcaaaaataagattttattcaggtatgtcttattgtagtggttgagtgtttcacaagctcttcattgacatgtcaagatgtcatttggctaagtatttgaatgtgagtgtaagacgagatctgggaatttcttttacatgttcctctgcagggcttggagtgtgatttgttgtgttaaatcattacatttttccagtttcaacatgttagcctcacccccacatgtagagctgggcattgtattcagagctgaggataaccttaccagattcctttcctagcctccaattaaaattaattggtctccattccattatatataaactttgtaatactactcactgtgttttatagttatctctggtgtagactgagggctgccacctctctttgtgttaccattgaccctcttt

SEQ ID NO: 99132 - DNA, 1031 bp, Homo sapiens
taaccgtgaacggcgcggggcggggagtaggcgggccgaggcggccacgggagggggaggggctggcaacggcgccgtgggggcggggctcgctttgtgcaaggtccgcgctgattgggccgtgggcgcgcgggtcccggcctgcgtcgtgggactggcgtttttggcgccggctgtgaggggagcgcgggggtggtggaatcgggcggtctccggttcgccaatgtggctgggtccgtaggcttgggcagccttggagttcctcagagaccccgcgctcggtcccggcacgcactcacgccgcggctcctggtggccctggagcgaggagtccgccagcaccggaagttcagggaccgcggagttcccgttggcccttttggaggcacagcttatccctgcttgcccgcgagcatggggccggaggcaccccccggctgcaggcagtctcctgagagctgttaataaaggcagtcgcgggtctgtgcgaggttttctgtgagaaatgcacgaacctcccctaccccacagaacctcaagcgggagatatttctcgacatggggaacggcctcggagaagtaactttctggcctcacagggcagggagaggggcctgggagggccgaccgcagagccgggcctttgaccgcccacaggttccctggttattatttgggtcgaatgcgccaattaaggtggtggctgcgaagtcagtgtcaccagatggcccgggagcaggtcgagagccaccggcagggttccccggcggcagggcgaaggaggccgccagtgacttccacggttagctttgtgggtgggtctcactcgatgccgggcttagcaaaccagagcatttccctccgtccagggcctgccggggatccatcccatccataggtccagctatggatccatccatacctcattgttcctacagaaccaggatatctgcagctacggctgtacttgttaaaaatcacctcaggccgggcgcggtggctcagatccgcaatcccagcattttgggagg

SEQ ID NO: 99133 - DNA, 1044 bp, Homo sapiens
atagtggttactggtgcatttctggcttcgagctgggcctctgggctgtttcctgtccccatatctctgtgtcctgtgacccatgacacatggcagagtgtgtcattctaaaccctgccacagctttagaatggctgcaagcagttcccccacagcctgctaagaatactttacaacacctgggctgcaaagcgctggcttcctacagacgcaaatccacatacaggtggcctgattttccaaatcccaagtcagaacacctggtccgaccagggagctgtatttatggggcggaaggggcgagctgtttgcagtgagtctttgccggactcccccgtttctggccttcgtgcatttggccacctgggggagcccctgtgcccttcagtcggagggtagaggggccgtgtgggaggggaggggtgccaggagtccagaggggtttgcaggctgacggggcatccttctggagccaggccaggagttaacccatctgctgccagcccccagccctcacgtcccagggctctgggtggagatgcccagggtggggtaaggtcgaggggattcgtcctccttgagaccagtggcagcagacagaacacggtgttccgtacaaatggtcgaggccctcaaaacgcgcctgccccttgcttggaagagtaatgcgctgagctgtgtgggaatgtgtgtggctgcttgggtcactgggactcccagatcagcccaaatgcctgaggacttatgaagccctctgcaaacctctcactgtggctgaaagcactggtgccagagtccattgggcaaatctcagccccctgggtgtgcagcagctgcctggatgtgtgcctctaagtcctcacaggacccagaggccaattccacgttaccaacctcactttatgcctgaggaaaccaaggccatccagctggtacacagtgaggcctctttgcacccagggtgccctatgccagcctttgttcccagcctccccacttccactctcagagggaaggcagaaagaaggcccaggcagaaagaag

SEQ ID NO: 99134 - DNA, 1015 bp, Homo sapiens
cctcaggtgatccacccgccttggtctcccaaagtgctgggattgcaggcgtgagccaccgtggcccgccactctatttctttttgtaaaggtgggaatagaatgagaaaaaaggtactttgcagactctgaacagctctgtagatattatttattatggtgaaaccatttgagaccaattacagagcaacacatcaaggatcatagaacaataccaggaaaattgcacacatatgtgctaaggagacccccaggacaaacactttgagccaagttctgctgtggtggcagtgcatttgggtggcatctctatgccctgcattccctgcacaagatcaatgcctcagagccagcaggggggcggggggttggcctcacatgaccttgaggacgttttggctcagagacaggatcacacagctcacagacaaggccaggtttggaattcaggtcttttggcctcagaatatgggcgtttttcactctgtggccgcagtaggccagttttcaagccagagacatggagacatgggagcagatgtgagccacgcaagtggatgaagcacgagccacttgccgtggggaagggtagctatgcgtccgtgcacccgtcagcacatgcgcattgagcacctgcctccactggaggaagtgaacattctgggggccatggaagggagagggatgggttcctcagggcttttgtggctgggaccaaggggctgactccctcaaccttgttagaggctgccaagggcctgctttttggcacaagctgacctctgctattcatcaacgccagttagtggatcctggggctccagttgaggggggcagaaagacacagaggtgggggaaggaggacaaaggggcctcccttgggtcacccaaggtgccaggggactcggagtaggagacggagcctggcagggtgggtcaggcctgcgtgtgggtgggcctggtggatgaaggcagcggaacagtgggagggagcagggatgtcctgatgaataga

SEQ ID NO: 99135 - DNA, 1050 bp, Homo sapiens
gccctcgagtgggacagcccgcgggccccgcacggcatagcggtcccctcattctaggtttctagttagggtctgtcccgagcggtcactgccgtcgcgacagcctcagggcagcctcctccaggggcctgccgggccatcgagtctacccttctcccaccccactgctggactgcgatgggcacatgaacattacagagttcctcgggaaaaatcatcgtctctggagccagttgggctaatctttggggactacctgaaatttgggggaccatttagagaaccatgcggagccccgagaaaggggagcatcaaaacgccacactcaagatggcgccgggctcggcaagcgtggcgtgacgtagcgatctagctcacgtgggcgatccgagaacaacaggctacgctggccttatcgccaccgcacttagctgtcgaactaagaaatcggttgtgtgggaaaaaggaccagaataggtggaaagatagtccagaaatttacctgtgccacacacaagatggcgagacgtagggttcgtccctgtgctgccaaaagggggcgcccgacacggaaggcgggactccggagacacgagcgcacattggccgagagtggcgggcgaacacaaagttgacgctttgcgtccttccattggcagtttcttccgtctgtctctcggttgcagccgagctgggaatggggaaaacccggagtgtgggatcgtggagggcggacgatgccaagtccagcagagcttgcgctcggggctagaagagagactgagtctcccttctcagtttcattaggtaatgggcgacatggctccgtctccacagcggggctttgctgagcttagcacgcagtctcccggcggggaggaggcgcgcagtgccgggcgccactccgtctccagtacgcgttaggcccgcgttcccaggtgcccgtctggccgctggactgttggcctttccggagcgagttttactttaggaagaagcccgggatcccggtagtttagcctgaagaaacgtggggcagatgctgggcag

SEQ ID NO: 99136 - DNA, 7341 bp, Homo sapiens
agcagccccagcaaaacagctgcgggagcgcgcgtccggaacgcgctcgcgcacccctcccccgcgccctcggccctgctgagacccggcaaactccggccttgaatgacagtgcgatcggcgactgcgcagcgcgggacgcgccggggcactgccgctttaagcacgcttgtccattgttcggaatcgagccaatgagcgagcgcccgctccctgcgctcagccaatagcggccgggcatgggaagccgagcgccgcccactaatctatattaaagcttctggcgccgcgtgagtcccccactggctgctctgaaaagccatctttgcattgttcctcatccgcctccttgctcgccgcagccgcctccgccgcgcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggtgaggctggacgccgcccgccccctcggggtccgcgcgccgccgctcgggcggtgtttggcgcgcagcagctggactgtctcaagcccgctgttgctccctctcgcggggaaacggcccgcccccggcgcggtgccctcaggcagcccactctttgtgtggtgcgggggagggggcgggaaccgccgcgggcagacgtgatgcccgtcggggagtgggccgggcgccctcgggggccgagggctaggcgcggaggccggctcacggccctcgaaactcgtctgtggccggtatgagtggcggcgggaggagaagagcctggctgggggtcgtcggcccgccgggcgcacggaaataactttgaaactcaagcgcgttgggaatcggaagtgctggggggcgcgtgttggggcgcgggccggccgcgggaagtggcggcgagcgcccgccggccgcgctgctctttgttcggcgccaggccggcggtttcgcgccctgcagcggacctgaggtggtttgtctagactaagtcccgataaggcggatggggcgacgggctggctggccgcgacgtcggccgtcccggcggaggtgtgacgggcttatccgctttgggcgctctgggaggcgggggtgggcgcccttcgaggtgagtgcgccgggagcggccgcccagcttcagtcatgcacccgcggtgccgggcttggctgaggaggcgagagcccacgcgccgcagggaggaaagagaaagtgaagcgcggcgctggggcgacgatgggcgccccccgcggctgcccgggagcaccgtgtgcgccgcagctcggggcgacgcgggccaacacggcggccgcgacaggccaatggtagggtcgaactgggggggcgcccgggccccgtggcgggttcactgccctcggctatgaggtcctgcgcggctggtgcggctccgctcctgttgtcggcgccgcctcggtcccactgcccgccctgggtagcgtctccgcccttggcgggagcggggcgctctcagactgactggctctttcttaatatttcggccctcgtccgcgcccgtcgtgcccctgcagggattggcgcgagtcaccttggcgtctccttaacccttgtgtccctggcgtcatctctgactctcccaggggcgacttcttggcagagcggagctcggggcccggatctccacaggggctctcagtgaccccttctggactcagtccgggaatgagtttgtggggtgagaacaccgtccccagtgcggggcctggctgttcgattttctccgaagcaccaaaaggtgacttcccgcgagggcgatgagtagtagcccgagaggcgcatccccgacagtctcggacctacgcagcccggtggactttggggcgacctcccgtgggacttggcccgccgaatgcagacattcgggcctgccggggtggcggcagtggggcgtcgagtcgagagcccggccgaccgacgcgcgacccgcgcgcgtgccactgcaagctctgcctgccggccgggagtctccaaggcaagggacgcactcggcggccccgggccacgtgctccctgcgcgcggtgcgtgccgaggcccgcgcgcaaagcccgccgggcgggggatgcgcgcctgcgcgccgcgacctccctgcccccactgctccccggggcttcggccgccagggggcgagagcgggcggagccggggtccgcggagcggagcggggcgggccggactgagagggccgacaggtggcccggagccgctcgccggacagcggccgaggggttcccgcaggcccggacgccggacctctgttggtattggtggccgtgtcgtgtggaaaaagttaccgggcgcccggggccgcgctgccttttggatcccgggcggagtcccacccccgaggtgctgtcgggatccctagccgccgcggggaggccgggagttggtggctccggcggcaggccccggcctggggcaccgccaagcagcggtttgcggcctctaggaacagcggtcggatttggggggtcggtgtgctttggcttttttagatacctgtcctggccggggcggtgcggcctcgcgggccttccaggctggcgcgcctgtggggctctccccgagcgcaggcccctctctctttgccttatttatttttggaacataacctgccgcctttctagacggctcgaggggcgggctctttgcacttggaagcaggctgatgggcgtgagtgtccggggctcgtccacccggccggacgggctgggggctgtggcgccacatggctcctttttcctgggaagcgccagggggcagtgggaaccgccaccggggccgctgtagcgggccttaaaggatgggaaaccttgatcacagatgccccccgccggccttccttccaccagaccagtgggagagggaccgcaggggcatcaggcctttctcaacatgcgactcttaatttgggacggacagaacagccgtacagaccagtagttctcagcgcctttgcttaccctgggttgctcagaagacttactggttactggttccttcttcccttttgaaggacttaaaggagaagaaggaagttgtggaagaggcagaaaatggaagagacgcccctgctaacgggaatgctgtgagtgtctgctttgctcctgagccctggcagctaccgccccacaaaatttttcctgttctactttaaacatacctatatatgtgtgtgtatgtgtatatgtatagctttgcacagtggcagtatcgtagccaatgagctttacccgaggcgcgattattgctagttaaatatttataaaaacctttcgagcagcgcctgaacaagaataggttcagaggagactccggtagtctgagtttgggcttggcccagggtggggaaaagcccttgtcctggggcagttaatgtgcaggtttcatgatggagcctggagggtgttgactggagaagggtctctggggtgggcttggcttggctgggctgtagatgcagccgccagcctctggtgggaggccgggcatcaggagcaacgctctgtccagcctggggccagctggtaatgacatggcctgttttctgtcgaggagaatgaggaaaatggggagcaggaggctgacaatgaggtagacgaagaagaggaagaaggtggggaggaagaggaggaggaagaagaaggtgatggtgagtagccttgtctatcttccccttttcaggtactttttcctggccttgtctggcagaaggggaaggaaggaattggggctcctgggagtgggacaatggtacttggggccagtggaccacatggccctgggcacccacctgtagagtcagggaaggtctccctgacatggagttgtgcccatgcccactcacactcactcgcacacctgaaagtttctttcgtgcagctctgaaagccactgatctattgggctggccttttggggtgcagctgcttgggcctctctcctctggagagtcccacctgtgtagtgggcgtgggtgccctgattgggcccagttgcaggcagtagaggcagggcagggaccttgcagtccactacatgttcctcgggatttccccaggagccacagtaggagggaagtgtggtttacctggcctttgattctctccaggtgaggaagaggatggagatgaagatgaggaagctgagtcagctacgggcaagcgggcagctgaagatgatgaggtgggttctggcttgagaagaaggggggtttggcatctgggtctccccacctgcctttagctgaggtgctcaagctgcggagggactgtttctgactttgtaggtggccactgtgtggtcctgaatcttaagaacaggaaggaaacagggctgggctcaacttcccagaggccttgggctgtggagctgggggtccctggttcttgctctgccagcaggagctgaggcagtgggctggatagggctcctggggttggaggggcctttgacagtctttctctgcttaggatgacgatgtcgataccaagaagcagaagaccgacgaggatgactagacagcaaaaaaggaaaagttaaactaaaaaaaaaaaggccgccgtgacctattcaccctccacttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctgagttgttctaacaaagctgtctcaagcctggtttttctgtttcagtttcttcagaccttccagggcacaaggataggagggggaggatcctggggacagtgggttgacattttgggaggcagttggatgtgtcctgtgatgggcagcagagtctggtgggtgggcagggactgagctgcagttggctgggggggctgctcactggggcagtcagtgattgccccaagaagccttaactggggaggaggacttcatcactgggtgccacatggggaccctggtgccctgggggtgggggtttgcagtcctagacactggaaacgggccacacgggactgccattatgtggagcgcagggtgctggtggtataggccaagagggaacttgccaagcctcccaggatgagcgtccaagtggtggctgcctctgcaggcctcacaggtttagctccatgacgtggctccccctgctggtggcacgtggtaccccccggcctcttagaatgccggggttttggtttggcactggtgcagcctggcagtcatccaacctttggtctccaggtcccttaggttagttgggcaggcccaccctgccccttgaacacagttggagaagttactgtgccgtttggatattcatacacgggctgtgagcagtgggtcaggatagccaactggaggaagtgccaccagctcgtgccctcagaggtggaggtaaggattagagctcacctagaaccttctgggatcctccaatgagagctgcaggggcaggggccggtataggcactgctagtgggcctgttgcccaggtaggacctgaggaagccatccagtggtatctgcaggaaaactcccaggagcagactgaagtgtctgcagaggcctggcctgggttaaggggagatgctgggaaggagggaaatgtgtgcattgaagagagcaagagagaccagttccctctacctgccccttgacaccgtgtccaccccattccatgcccccccgacctttgtgtttcacaccaggcaccagagttctggggggacctttcccttctctggctggagcttagtcactctcatggggctgctcaggccgcttgttcagcatgtccccaggcagctgccaccaggatcgggggcaggttgaggccttggtaggagggaccctctgacctgtatctaccccacaccccctgcacagcctgggtatctgcatcctggctcatccagggaagaaagggagggtctggagccaaaacgctggctcctctctgttctgccgcccaaggcgactcagtactgcagtgttcccaagctcggcgcccaggagggtgtctctaaggcaggagtgcaggcgaaggccgtgaaggaaggccacacagggcaggtagcgcttggagctgagagcagatctaacccagctccctcaggctgcagtcctgctcgggaccactaccgcaaggcccctgaaaggggagaagctgtgccctggtccgcacacagacacggcaggcatgttagcatgaggcaagtaactgaaccttgtgggcttcaatcccctcctctgcaaaatgggaacaataggatgaggcatgagccagggcccagggctgccttgctagggtccccctgagacacccatatcagcagagcttactgcctctgctgtctgagctgcctcatcccaccaaaggtttggcctggaacagcatttgctggttctagcagaacacacttacccctagtcctgagcctagcacacaattaaccactgcctgaggatatacctcagggcccagagtcaccttgataccactcccaaagtccccgaatgacctcccactggagcccaggttaaaagattatcaaggaatgggcgccccctggtggacacagaggaactgtaaagcgtgccgctgaattctgtccaggaaagacccttcagtgggccctggtcccaaggtaggcaacgccagtcaccctccacctgactcccgcaacaagacctttctccctctctgttgctggaacccca

SEQ ID NO: 99137 - DNA, 1050 bp, Homo sapiens
gtttcaaaaaaaaaaaacagagggggccactacaaagcaatttgagagttctgtgcttgtgggtgaagtttatggactgtggcattcactatagagtgatcttcatgagttgtttccttggggtacatctgatatttgtttctttaggtattttatcttggttggtcagatcctgttggtaaattttaaattttgcactattcgttttctgtccctttcttgcagtctctaggtgtgtgcagtcttaggattctcatagataaaagtaacttctctaggtttctgcttcttcctttagatgtctttttgactctcctcacattcttatgtgcttccatggcaatgagcagtttgacaaactttttaaaaagtaaacaagagttggtgggagtaaacatgagacacctagaatacaaagtgggagtcactttcagtgccttatttttccttagtcatatttgatcagaaattggatgaaccttcgggatgctgagacagggaagatactctggcaaggaacagaagacctgtctgtccctggtgtggagcatgaaggtactttccaaccctttatctacacagggctgtgaccaatgccagactagcacctgagcataagagagctaagttaacacatacctaataggcgggtgagcccctgaagacacagcatgttaatccatgtgttgttgacagtttcagttactttctttttttttttttttttttttttttgagacacagtcttgctctatcacccaggctggatggaatgcagtggtgtgatcttggctcactgcaacctctgcttcccaggttccagcgattttcatgcctcagcctcccgagtagctgggactacaggcgtgcgccaccacatctggctaatttttgtattttgagtagagatggggtttcaccatgttggccatcctggtctcgaactccggacatcaagtgatctgcccgcctcagcctcccaaagtgctgggattacaggtgtgagccaccacgcccagccagttactttcttaacagttctttctctca

SEQ ID NO: 99138 - DNA, 1188 bp, Homo sapiens
tcactgcaacctccgcctcctctgttcaagcgattctcctgcctcagcctcctgattagctgggactacaggcgcacaccaccacgcccagctaattcttgtatttttagtagaaacggggtttcaccatgttggccaagatggtcttgatctcttgacctcgtgatccgcccgcctcggcctccaaaagtgctgcaattacaggcgtgagccacgacgcccagccgagacttttctcgtatagcagcaaaacctagacagaatctctccagagggtaaaatatagtgttattacacacatgatgattccagtcagctgtgttgtttagggttcttcactgcaagctattcaaacaatgggaaagggtatctgaggcttttggagctgcctggaagttgaaggacagggtctgtagcaaagaccacacagtaggaaagggcaggttggcatgcccctgctgcccccaccctgaagaacttccaactccctcgaaagtcctgtagcttcaggaccccagaactgggtagcacgtgtccaaggctaggccttcttgtgctcacccctgattatgccagggctgggagaaaaggatctggcctttctagctgctgtagtgcaaagcagtcactgccttccacaaggtagagactctcttctttgggaagagagtctgatcacaagatagcaaaaaaagaaaaccaaaaaaaagacacatgtaaactatatctatattatacatatatttatctgcagctcagtctcttcgcaaatattaacgatcttttgcagacagcctctgtgcttgcataatgttaattttcttttcctttaatggtttgtcaattgttttttaaaacaaaacaaaaaaaaccttagcactctcttcttaaagttagtctttatttttattaagttgtatgtgttcatcatttaaagaatcatagtcagccgggcaaggtggctcacacctgtaatcgcagcactttgggaggccaaggcaagcggatcacctgaggtcgggagtttgagaccagcctgaacaacatggagaaaccccatctccagttaaaaatacaaaaattagccgggcatggtggtgcatgcctgtaatcccagctactcaggaggctgaggcaggagaattgcttgaacccaggaggtggagattgcagtgagccaagatcatg

SEQ ID NO: 99139 - DNA, 1045 bp, Homo sapiens
tcagttggccagactggtctcaaactccccctgacctcagatgatccacccttctcagccttccaaagtactgggataataggcatgagccaccatgccccgccagctttcatttttttaagagttataatttgaaggagttgagtttcttcccaatactatagcattttttaaaaactgggtgaaattcaggaatctgaatgtagattttgacaggattcaaggcaatatccctgtgcctccaaataacctgaaagaaacagtggcccttttgggaacatgcccttgggaaaaggccttgtattatttcttcctcagtcaggaggtgctgggaagcaaataaaagtgcaaagggagcctctaagaatctctttggatatgtctcttctagcttgtttctgaccagttccaggcacataactgtacatgtcagtaggataatgggctgactagaaaaaagaaaggtttgcgttattgtttgactttgctagggagaagactgtgttatgtttcaaatactgatctttttctcattactaaattacttgcctccactgtttcccaggccagtttgaattttgattgtatactttccaagcatagtaactttgccagcacaagagtattatttcacggggatatcaccactgattacaatgctgcatattatgtttcaaggatactgaaacctgggttctcagagatccatttatattttctcatcttatcccccataaatgggaaaatcactgggaaattattgggtggagaaatgcatttaaatgaccgtgaattagaattggtccttaagaaggaactaaaggcagaatgctctgtataaccaacactaaggcagaagcataagagggctctgacataagtggtatttaagaattaatgaagaaagtgggagtaagagaaggaaatgagttcagaaaggaaacaaggaggagagagtttgagaggggagagatcataaaggcaaagtgtgaaaagatagagaacaggaagaaaaaagccacaaccaaaaactatgaaaacagag

SEQ ID NO: 99140 - DNA, 1055 bp, Homo sapiens
ttatttttcttatttgtagatgttctttacatattgtaatatcaatcctttgcctattatgtattttgcaaatattttctttcaatgtattgtctccttttttgttgaacagaatttttaaattgtcatttcaaatttattttatttcatttgtttgagacggagtcttggtctgttgcccaagttggaatgcagtggcgcaatcttggctcactgcaacctccgcctcccaggttcaagcaattctcctgcctcagcctcctgagtagctgggattacaggtgcatgccaccatgcccagctaatttttgtatttttaatagagatggggtttcaccatgttggccaagctgttctcaaacacctgacctcatgatctgcctgcctctgcctcccaaagtgctgggattacaggcatgagccaccgtgcctggcctcaaatttattaatatttgccatctggcttttgcattttgtatcttgtttaaaaagatctttcttatcccaagattaactaaatatcctatcttttcttctcttttcaatgtttagctctttaatccacctggaacgtatttacacatttggtatgtggtagacatctaagtacttctgctgtttggatagccaatagttccagtactatttactaagtagttagtccatcttttcctcactgttttgaaatgccatccttgtcatatactaaattttcataagacataggtttttttttggattatttctgtttcattgatctatttgtctcttcttgtacctatacacatttgattgaattattatagctttataatatgatttagtatagtttacaatagaatggtctgtgactaacataatatgtgtgtttaaggtccctacaaatatgtgccccttttgttcacatggaagcttgcccatatgcccatagtagatagaaacatgaggacttggctgggcatggtgactcacacctgtaatcccagcactttgggaggcctaggtgggaggattgctcaaggccaggagttcaagaccaacctggccaacatagc

SEQ ID NO: 99141 - DNA, 1035 bp, Homo sapiens
cagaatcttgagaagatttgaactccttccaatgcttaatgctttgtatgtgtgtgtgagagaaaagcagttcgttgggcatgctgtatagaaagtaaaacattcctgagagagagaaattaaatttggggctttaataatcttgtttattttttcccgaagaaccagagttggtagagaccccaggggccaagtaatcaaatagtacagaataaacagccatggcatctttgacacatgctcacccgtcctctgtttgaacactacagtgattggtagacagtttggtctgtggtgaactttttttttcctcttcagcttgcggaaggagctaatgctgcttatttgcagttgttgaacctgtttgcctatgggacatacccagattacataggtgagttggtgaagatccttcaaaagacttgtgttaattatgttgctcagtttggaagaccatcaaggtttgagatataaagcatggggtagtggggagacttcttgacctggctgcctcccattttgctgtgcccggtgggtgacctcacaaagggaatgttccttctcaccttttatattctagtgggtcaaatggggcctgtgtgtgctcatccacaaatgtagcccttgtttgttttccagatgagattcttgaggactggtgtttgtagggctcttggagtgctgtgaagtgcagaatacccacctgtagaatgtttcaacattttaaatattatcaaaataataccagcatattgaagaaaatttggaaaatagactttttaaaagtcactcataggctgggcgcggtggctcatgcctgtaatcccagcactttgggaggccgaggcaggcagatcacttgaggtgaggagttttacaccagcctggccaacatggtgaaaccctgtctctactaaaaatacaaaaattagctcggcgtggtggtgggcgcctgtaatcccagccactccggaggctgaggcagcagaattgcttgaacctgggagatagagactgtagtaagctgagattgca

SEQ ID NO: 99142 - DNA, 1040 bp, Homo sapiens
cctccccatccctctcctcctctcttctagtagcttgtacctttcttctggtagttctgccttggatttgtagctatggaaacatctgattgtaagaccgaggacaagtccagggccatgaagttgcacacctccaggtggttggtggccctggagttgtgccatgcagcagccctggcaaagcccatcttgttcatccttgattcttctcagtacagagcattgcacacaacagatgctcgatgaagatatgtttaatttaattgaatgtcacaaggggcacaaatagtactccattaagataattgccacatcattttgcttgtttgctttttaggagactaaactctgtgtttgtagaaactgagtcttttcttctttggaagtacatagtcttccaaagaagacaggaatatttgtcaaatgaataagtgcaaagtcatgatagtgattcagtagtagatttggtttggggagttggtgagcttattccataaaagaaatcctaattttattttgtgtcttgatttttgtggtgggtgggactgagcagccaacaaggagagcctgccagaactgagcacagctcagcagaacaagctgaagcatcttaccatcgtgagcttggcatcaagaatgaaggtacggtactgagccttctcttgtcttcctccttaccccaagtcagctgtctcattgacatcaatgaaggaagtcccagctgcacataggagagtcacatcataaatgcataaaatttgcttgacagaggaaaagataaaatggtgtagaaaagtactccccattccatacaggaaaagtatgcccagaagtgattgactcagcaggtcttagtcctggcatgctgtggtgccgcatgtggcatgatcattttgccatattaaggggagactgctgttaaagatatacatttttcaaatagcaaggcatctcaaggcaagttaacagcttaatctgttgctcagtacacagtgaactatgcccatgctggaggaaaaacttgctatgtcggacttgct

SEQ ID NO: 99143 - DNA, 1025 bp, Homo sapiens
aatcttattttccccctggctgatcacttgccctccataacgttgagacaagagtataaatgtttttgttgcatctgacaagataaatctggtgaatatgaagtccgagaagttggtttaaaatgttcacgaccagggctgggcacggtggctcacgcctgtaatctcagcaatttgggaggctgaggagggcggatcacctgaggtcgggggtttgagacaagcctggccaacagggtgaaacctcatccctaccaaaaatacaaaaattagccaggtgtggtggtgcatgcctgtgatcccaggtactggggagtctgaggcaggagaatcgcttgaacccgggaggcagaggttgcagtaagccgagatcgtgccactgcagtccagcctgggcgacagagtgagactctgtctcaaaaacaaaacaaacaaaaaaattttcatggccagtatggggcagtggaaagctccagacttctatctcataggggcctgaggggcctggtcctaccacgggaggcccctcacgggaggtgacgtggaggattctaggtcagcagcaagagaaatagcccgatccatagtgggggcaaaagaagtggcaaccaagatgtagacctgaaagcgatgcttgagcagacctcttgatgacaggccatgcctggtttgttcacagaggtaccacaggacccggatctctgccaagtaccttatatacatcttctcaataatttacgaggtaacaatcactatccccatttcacagatgagaaaactgaggcttgacccaaggaaaggctgtcaggtgctagaggtgggttttcaacctctctgaaccacaggacctattacctctatacagagtggaaaccaacaaaatgccagttggacagatggacggacagtggatgccaggatgggtgctgctgaacgggaacggggacaggtcttttttgctggatatcctttggtgacttttgaattctgcactgagtgcttctttctaaaataaatacataaaa

SEQ ID NO: 99144 - DNA, 1091 bp, Homo sapiens
ccatcttggcctcccaaagtgctggcattataggagtgagccactgtgcctggccacgtagtcatttttcactcctaagagtgacctcttcttattaaatgacaatgttagtaaatatatattcacaatgtgctcaggcactgttctaagtactttacatgcattgactcatttaaatctcatatcaacctcatgaggtgatatgactatcattatctacatttcacaggcaaggaaaacagagaggcagagaggttgagtaacttgtccaaggtcacacacagtgagtaactggtagagttggatttgaacccagcagtttggctccctctgtcctaagtgctatgctgaattgctgctgtattggatttgcaacacaagaaatccctttttgttataccagcttcatatgaggctggtctctggcaggcagtaaggtacagaagaaagtaaaatcttgtacctccctcttcagtgaattccccaacaaaacaaaggtacaagcattctgggttttgtgaattgaatgccattctttttttctcttttaaagcgtaaaaattattagatgccacttgtagctggtgagatgtgtctgtgattaaaagagaaatttcaaaaccagaaaaaaatatgcaagatagaagacaggagaaagaaaagataaaataggatgatgacagaatataaaaattaagacagatttaaagctaaaaacgtgggaataaaaatgtagaaagaatagggcaacactgtaaatcagggaattttctaaaatccactttaatttcttattttttttttagagtcttgctctgtctcccaggctgaagtgcaatggcacaatctcagctcactgcaatctctgcctcccgggttcaagcataaaatccacttttaaagtagcatttatgaaattaaaaaagaaaataggaaagcactagaaaacaaaacaaaaaaattaaacctaaaaagttaagcataatatgttgataacatcccaataaaataaaattaacaggtaaaatatttaaaaagatgacattttaaataggaaccagaaggtaaaagagaaattaagctaagacctc

SEQ ID NO: 99145 - DNA, 1045 bp, Homo sapiens
gttgtcttgcatattagaaatagagtttataggaaaccctaagttgtctgggctgtgtgtttcaggccagataaggatagtttcttccaggacattcttcagggcttggtctagtctttgttaattgtctcaaagaaagagctccactatccctggaggaaggcagttttctaatctctcatctttctggaaggttttctttgtaataagatgtggcaattaaaatgtgccttattctttctaagattcttttaacgtcactaccatctgaagtaatatgaaatacatgtgtatgggtttgccaagattgcagtttccgtgggaatcataacattggatttaatcacatctgggttaatgaagcgtgcacaaaggctctgcatgaatataggttttatatttaatgtgcatctggaggcagcaaggtcttagtgatgtagtttccctgtaagtgacaagttgaacacttgctagctgaaggtttaaggtaatcccaaggctaggaactttgccacggaactgaggtcctgcaccttgaccctcagtttagaaggcatgcgtaagcactgggaatctggagctctttagtggagctggaggcccagcttatttccctggagtctgtagactttgggtttgttttgtctccatgagaagcagggattacagtgctggtgttttgacttctttttttgaagtggtagggagaagaagtacaccaggtctgtcatagttgtactttggtgttttgggaatgattttggtcatttttctttttctttctttcttttttttttgagacagagtttcgctcttgttgcccaggctggagtgcaatggcacgatctctgctcactgtgcgcgacctctgcctcttgggttcaagcgattctcctgcctcagcctcccaagtagctgggattaaaagcatgtgccaccacgcccagctagttttgtatttttagtagagacagggtttgtccattttggccaggctggtctccaactcccgatctcaggtgatccacctgcctcggcttcccaa

SEQ ID NO: 99146 - DNA, 1049 bp, Homo sapiens
gccagagtaatcccatggaattgggaggatggtctttggtccaggcaattcctgtttttctcaggaagaatgacttcttgtttatcagtatgtggttatttattttatgctgtcttattttaatactgtctagcttccaaccttgccttagatagagtagctatgtctgtcatagaaactggattcagccatagattgtaggacctatcttgtatacacctaggtccttaaagcttttgtttatatctcaggtgaggtcatcagaaggaagaactgaagaggtaagagcccagctggggtattaaagtaagagaaagaatataatgaggtattgtcagttttaacatgaagcctctattttgtggaatttttaaaaattatgaaacaatttgaaacacacaaaagtagagagaatagtgcattgagagaatagtgcataacccaaatttagtattttttgtacatttgccgtgtttatctttcttttgctgaaatattttaaagaaatcctgacatcatttatgtacatatcttaactatgcaatgtgaacattttcacatgtagtcaaaatgctgttatcacatctaatataaaatggattattctttactactatacataagactgtggaggctttctattttaaagtcctttgaacatgctgagattgttcctccttttctgtctttatacttgtcatactgtctgtctagaaggctctagtctgtgacctccacatggtggccttagtgacagtattatttcctcaataaaggctttcctgatgactgaactaaagtagtgtccctttcccccaccctgttggccactgcctccctgctctgtgtcactgcctgtgtgcttgtgtattgtctgtctcctcccctagattgtaagcgccatgagagtagggacctggtctgtcatggttattgctctatggccagggcctgaagcaagcctagcctattgtaaggaagcaaaggtttagaaacaagtcagctattagattaataaagattccaaaatttgcttaatattttataac

SEQ ID NO: 99147 - DNA, 1001 bp, Homo sapiens
gtcctggagttggaggctatggtaggtaagtcatgatcatgccattgtgctccagcctgggcaacagagtgagaccctgtctctctctcttttttttttttttttaaagagtaaaatcagctggagaatacttggggatgaattaaagatgaggggaatagatgtgatgttacagtggaatgcccagccacttagaagggagagatgatattcataacattaatactgggggtgatgagagaactttagctctgcaggcattaattaattaattactgcaacaaatgtttcttgacttcttactcagtgccaagcgtataccagtgagcaagttaggcaagtcactggggaggtaaggaaaaacaactaaagaaaaagagaagaaattatagactgatcattgctaataaagaaatgggaagggtgagagagaataattagagagagcctctttagtagggtcgttagggaaagcctctgtgagatgatctgtgggttatctgagatgagaatgaatcagccaattgaagaattaggagaagaacataggtggatagctcagctagtagaacagcagcaagcagaagaaggcttggtgtttctgagaaatgagaaggaagcctgttggaacattgtgagcaaagggagttatattatgggacaagtggagagttaggcagcagccaagtcatgtagggtctctaggctatgctggagaattggattttgttcaaagagcagcaggaagtcactgaaggctcttaagcaggggaagaaaataatctgtttcatgctttgaacatacctctctgggaattgtgagatgaatagagtggaagctgagaggccactcaggaaggtatcaaagtaaaccaggtcagaaaacatggagatgggaacaagaaagtggcagtaaagatggagaggagtggatggatggatggatgtggggctagaactgatgtgacatggtgatggatgagatatggaaggtgaggcag

SEQ ID NO: 99148 - DNA, 1010 bp, Homo sapiens
tgactgtttcttcaagaatataccagttgaaggaacttgattgtattaggagccctcatgtatgaaagacacagatttttaagcatgaaaatgtcactcaatgtagtaagttcatcctgagagacagctgggaactgggtatattcagacctcttgtctcttgtgcatgcttaagtttgctcttattgattggtgtgataaggggaactacagcattttgaaaattttgctgcttcctctcttccctgataacacagtatagaatttccctaagttaaatccctattgggttggctcctagcaagtgtgggacctaggacagaagtagaaaagaaggcacacataccttaaatcaaatattgaaaagttagacatcaaaaccaccatcaagtaaaatatattattctatatattccatgtaggaatagacaaagtctattccttgccaaatacaccttcatatacctgagttcaaatgtagaattctcagatttcttgcagctccatgctgaaacatggcttcacctctggcttgcccctcttcccttctcagtgctagctccctgtccccttgtgattcccttgcattcagtgagggccctttcatgcccaaacgtgggcatcctatcccatgtatctaagctatgtccatacccattagaaatacctgccattgagtggaggcacccccattgagggggtgcctccggtggtggggaagtgcctgtatatgtcctggaggtaggctttgggctgcttattttagggaagcacatccatttggccctgtgaactccttgtctgatggggagggttgtggctggagcagggccagagcagaggtcctatggttcctgcaagctaaattcaagtaatttacatctgcaaatgatgtatctccatggtgtaacctggcttgttaaagaaagctaagacacaaaagcaaaaggtggtgatgttttaaaagctcatagttgttctcttacttaaaattgtattcttactacgtc

SEQ ID NO: 99149 - DNA, 1720 bp, Homo sapiens
aggccaagtaacctggcatcctttctgcccttggacccaggcaagagatggccaaaataagcaaacatatgaataagtaagtctgttgcattgttttccttgtttctcaccccctttattgataagacagtcagcacagcctttcctgtgctgttagaagtgctcttgcttcaggcaggaagtctaagacgatggggtagattgttaaccaaagcttgggggtaggttgagggttaaagtgtttgctgttgttgaggtctggaggaaaggtttgggacttgagcattcttgtttctgccttggtgccttttttcttggacaaaaatcagtacctcttttaaaactgaatacaacaaagttgtgtttctccctagaggcctaattttatgaatttctaggtcataaaattagcttagtgctacctacttctacaaactgttatctgtttaactagctcctacagaggggctgctggctgcctctgaagctttcagaagatttgaaatgtagagggtagccccgggttccttattattttgtttctgtggagctcccgagagtcttcacagtggctgcctgacaattgctttttgtgttaacgtcagccccattaggtacatctctcaggcctcattagttagaatatttcacagcttcttattctgaagtgggggagttctgttgtccttagcccacctgtgatagttgttggtgacagggtcaaagtagggagaagagaatattcggactgtcatcaagaatccctgacgtctagaatataaacatctccaaacatactggccaattgtcttacaggtttgttagtacaaaagcatattgttatcaaaggaatctgtagtcactagcgtgagccaatgtggattaattggattattcatctttgcttctttctgcttgtcgtgctcactcctcttgggtatgtaaactacagggcttttggggttttagaaaaacaacagttcttttcgttgtagtagtaaatagtcaatttatttcacagcatgatttttggcaaaatagatagctgtatgagtatcaagctgtgaggcaataatgaaaaataatttactcttatataactcttcgaagttcagattcttccacatttttactgtctccttatactttttattacagacatctaatgaaagatagttgaggggcaaatgatagtttcttcctttgtcaattggaatattaaggtactgtgagagtgactggtttgaggactgagagtttttggcagaaccagggatagaatccagatctcttgacttacagcttaatatccttttcctcagattttcaaagtggagatcatgtccccaaatggttaggaagcattgatcctgacagttctgcctggagcagttcaaggtacccagtggcttctcatctaccattcatcctgccctgtgttagattctagagatacaaactagaataggtcacaggctttgcgcttaaggagttcataggctggttgggaagagaatggaaacaattatggtacggtttgcaggatggaaacagaaataccacactgttatgggagaaacaaactctatttgaaagaattggggaagacttcatagaggttacattagagctaaggtttaaaggatgggaatagagaaagagagaggatttgttttatttcaagatgagaatgatttggcaagagaggattgtgaaaatt

SEQ ID NO: 99150 - DNA, 1066 bp, Homo sapiens
gtcgcaattttgggcagaggtaaagggcttttgcagatgttattgaagtccctaatcagctgactttaagttaaccgtaagagagattatctttgtggacctgacctcatcaggtgagccctttaaaatagcatccaggagttagagatttttcttgctgcccttgaagaaacaaactgccaggagttttatagctccaagaaaacaaattttgccgacagccacccaggcttccgttaggaccctaatcgttaaaccatagatgagatagcagccccagctgacaaacatcttgattacagccttgagatcaccactagagaacccagctaagccataccgagatactcgacccacagaagttgtaagataataaatgtgtcttgttttaaactgctaagtttgtggtaggtttttgtgtcgcatagaaaactgacatactagtgagactctgtttcctcatcttggttagtgttgtatgtgggcattgtttattttgtaaaaattcatcatattatgcatttatgatttgtgtatttttctatatgtaattaaaaatgagttatattacccaaaagtgtttactttaaaacaggagaaaaattaatggcattcctctgtatttcctttaaccagtacacaaatataatcaaatagttatgttgtaattgcaatggttagtttgaacacaagcagatttggtcacaaaattaagttaaatatttcttcccataagtgaactcaccctctgtccttgctctcattgacatgtcacttatattttacatctcctcctccatggtttcactatgagagtggtagagtcttgaagctggagatgtaatgatttttcactttcttatttcaaaattgatgaaactggaatgtgcctcaagttaagtattgagtagcaaagccagtacctcggttcttgacggctctaattctgtgcccatttcctcttatcatagagcttctggaatccaaaggaaatacaagcattttggtagtggttatgtcatagatgtagtttgatctgggtggagggtactgagtgggggagtaa

SEQ ID NO: 99151 - DNA, 1033 bp, Homo sapiens
atgactttatgtgaaatgtgaattagaaatgatgttgggttatatacagttactcagaaataaagtctccatggtggagaaggaactacctcattaaggacatgcttctttccctcaccactccttattcttcaaggtgctgatgctgtaccacacttgggcccaaacaaggttaaaacggcaacagccctttggtttataaagctaaacaacttttctttctttgtaaaagaaaacaacttctttagacagatatatttttttaaaattaggtcattacttattcagagatcataggaaatttgcttccagagtcatcctgttcagctacggggcgggctgggttggggggccgctatgccgagatgaaggaaagtcggccttggcttcagaggtggatgcatgttgctttctctggagtcatctcagctgagaggcagcttctccatccttgcctggtctagttttaggtggcttattctagagacaggcattcatgttgtcatgatccactagaagctcgaggctggaatcttaggtgtggaagtgatagtaggcctcttgaagggagagaaggcactaccacaccactgagtgaatgtttgaattcacagttcctggaaagtgggtatgtttagtatagagatgctctttgggaaagagcagattattttgcttctcagaggggtaatcaattactataattatttattgaagagtaatgtactactatcattattgttcaaactgcccctgatctgaccagtggtagccccccaagttgatctctgtgccatttggacatgtcctcatcgttctttgaacacttgtttatttcctggtgatgttcccacctcatcctgtaactttctctttgctatccctcgaatcagccattttttctaagactccctagttccttttaatggagatatccagactctcccaagccctcttaatgaacagaaactaggaaagacatgtatgtatctcccctccttccctcctttcttccttcctgccttcctatcag

SEQ ID NO: 99152 - DNA, 1026 bp, Homo sapiens
gggaagagtcaaatgtagttgcaaggttttcagcttgagtggcctggaagaagtagtagtggtgtttgaagaaagagaagaacaggaaagggaaatgctttgaggggaaggaccagagtgcttttgatgttttgagtttcaggtggcagtggccttcatggagtttgtgttgcactgggaaagatataataatattaaataaaatactacatgtagcatactcaatggtgatatgtgctgaagagaaaaaaaataaggaaaggaaatatgattttgggggataaggattgagattttaaatagggtgatgaaagaagacctcattgagagcatgactttgggaagaaacaaaggaagagaggaagctgtccttatggagatcttggggaatggcagtgcgttcctagtgtgctcaaggaatagcaaaggggctgaggtagagaattgtcagagacgaggtcggagggatccggggtgggggtgcagtcaggtagagcctttacatcataggtaggattctgtttctggctctgattgaagtggtaaggcttagagtggtaggagtagagaactgacatatcacttatgtttcataggctcactctgttatgttgggaatagactgaaaggaggcaagggtagaagcagggagaccccttacatggctattgcttacttccaggatggagatgatggagactaaaccaggatggtggcaatgaaggtagagctgacaagatcagctgacagttgggatgtggggtgtgtgtgtgtgtgtgtgtgtgtgtgtgtgtgtgttgctgtgtgtttgagagaaggggaggttgaggtggggtggggaaggaagtcgaatgattgattgataaggactgcacagggattttgggctgagtaattggaagaatggagagagattgttcattctttggctgttaactagataaaaggtacgtttggattagctaccctaagcaaacgaagttcccaacaaatacgcccttgaaaatgtctgtaaatatgtctttt

SEQ ID NO: 99153 - DNA, 1043 bp, Homo sapiens
tgtctgagttcaggaccttgcaattatttttgacccttccttccccttccccttgcttcaggttgttcttcaggatgtaaaggctcccaactgagtgtactgttattattaaatccttcactttacttaagctcctaccatgttccaggcacctgtgctaagagtttttcatttattatcttagttcccacaatagttttgtgatattagacactcttgtccccattttaaagataatgaaattgagattcaaagaaactgcttttccaaggtggcattgcaggtaagtgcagagccatgactcaagccagttgtgttgtccctagagtttgtgctctgaatcactccactctgctttcacacttcactgacttgacagtaaagtcccaactcattaagttggcatttagggctcttgacatcttgatcttcctttctccctcttgttgtatattttcacgattatttgccattcctaaaggagaatttgcattttcttatctctttgcttttccatatgttctttctcagcttagatacctctttttcatgtgtacctgtcagaatcctgaaggagacagggcagtgtagtggaataagccagggctccggagtccagtggatctgctttctgctttccctcatagtcctggtctcttctacaaagggctggaccagttcacattcacactagatatgtactgctgtgtgttcttgctagcatttggtattatcagaatttttgggttttgcccatctgtgggtttgtagtgatatctcattgtggctttaatttgcatttctctgactaataaggcagagcacctttccatctttattgctacatggcatctctattttgtgaagtattttaagccttttcttccatttttctattggattatttgtcttttattgatctatagtagttctttatatattctggatatgagctcctctgtggcttgccttttaaaatttcttttattatatcttagaataaaaagaagttttaatagagttgaatttatcattatttttct

SEQ ID NO: 99154 - DNA, 1004 bp, Homo sapiens
gagaagcccctttatgatacttcctgtgtcctttagacaagacactagtagccattgatagctttcttgttttcccagtatgacaggaggttccagggttgtcttgtccatttcctgctccagatttgaattagccatttctctaaggagtcccacacctttactttttttgtttgttttgagacggagtcttgctctgttgcctaggctgaagtgcagtggtgcagtcttggctcactgcaacttttgcctccgggttcaagttattctcctgcctcagcctccccaagtagctgggactacaagcacatgccaccatgcctggctaatttttgtatttttggtagagacagggtttcgccatgctggccaggctggtctcgaactcctgacctcagatgatccgcccaccttgtcctcccaaagtgctgggattgcaagcatgagccaccgtgcccggcctcacatccttacttttaaccagtatgcaatatgagatggttagagagtacacaggttttgagtcctgtgatctcataatgatcttttccccccataccttttgttcttttcttatgtgttttaggataataacatagaataaaatgctttaaagaagtaacacattaatttatattttaattgcacagttttgaatgacttaatttattaagtcctattacctcaggagtctccagcccctgggccatggactggtactggtctgtggcctgttaggaactggaccacacagcaggaggtgagcagtgggcaagtgagcattaccgcttgagccccgcctcctgtcagatcagcaggggcattagattctcgtaggagcatgaactctactatgaactgtgcatgcaagagatctaggttgcatgctccttatgagaatctaatgcttgatggtctgagatggagcagtttcatcccgtaacagccccctacttctggtctgtggaaaaattgtcttccacaaaaccagtccctggcactga

SEQ ID NO: 99155 - DNA, 1080 bp, Homo sapiens
cgctctgtcacccagactggatggagtgcagtggtgccatctcggctcgctgcaagctccgcctcctgggttcacaccattctcctgcctcagcctcccaagtagctgggactacaggcacccgccacaactcctggctaatttttttatatttttagtagagacagagtttcaccgtgttagccaggatggtctcaatctcctgacctcatgatccgcccgcctcagcctcccaaaagtgctgggattacaggcttgagccaccgcgcctggccaataaagctttatatttttataagaacattttataaactcttgttcacacttaattttgttttttttccacttcatcttgtattcttgtggtttccttggtttcctttaggaacactgtggcatactttgttgagttcttttatcattccctaacttactaattgttcctatatggtgagggtttatgaagcagcatggtactacttctggtattcagggcctttggggagaggggatgaaaatgtagatcagaaatatgagaagtggataaggcattaatttggggcatcctgaagagctgagtgtcagcctggctttgctggattgattatgtgcattaggtggtctgtgcttctggaaaataaagatccttttttgaactacatgattagtgtccaataccgttagcttctgaatatgcagtttcttccttagaaaagaaaaatctgctcttttttttttttcctctctcagtgatttagcagaatttttctgttttctttaggtagttaaaccagagagcaatgacaaagaaacagaagctgcgtatgaatcagatatccccgaggagctctgtggacaccatctcccgcaacagtccctgaaaagctataatgacagtcctgatgtcattgtagaggctcagtttgatggcagcgactcagaagatggacatggcatcacacaaaatgtgctggttgatggtgttaagaaactctcagtttgtgtttctgagaaaggtgagtactagactattgtcttactttttttttaagtacactgattaagtattggaattccctc

SEQ ID NO: 99156 - DNA, 1068 bp, Homo sapiens
gccttgcctacctttgcacttccaaatacatgagctaatttgtcacctttgatgtgtaagtcagttggagttgaattttctgtcatttcagccaagagcaactaagcagatacaaaggcactgatagacttcatgttttatataaggcttttgagtttctgatgggcattgtcatgaacaaattttgtaattgagggagagggcttctttgtggtaaaagatgatgtgaacaacctctagttccactctgctgcttgcttgccaggtaacttggacaaatcaattttcttcttagatcccaaggttttcatggggctggaggccattatccttcagcaaacttcacgtaagtgaggattatgctattttacaactttaaaaataggggcctgagtgggtttatacacacaccaggctttatgttacttgctggggaaagaaaagtgaatacaaagtaaaatctggatactagtcttcgggtgcacttagtccttaagaggagagaccataacagatgtgctctggatcttgcctgctgtagctccttcagtgggaagtccccttactgaactggtaaatacagtctgctcttgtccccagggccttgcttagaccatgagtagactcctgtcccaaggaaaaccaacacattgactggccagtgatccactagatatttttcttcatggcttgagagctctggagctgagatgtcacatggagttagggctggaaacaaagttgttagggaacagaggctctagcaactgtagacagtggcatgtagacaagaggaacagatttgcaggcagaaggagggaccattcagagaggaagggggacaaggtaaaaggaggtatggtagaaaaagggagagaaaaaaagaggacaatgtatttcctgggccttgaagggtgagtagggcttgccaagtgaaagaggatgaagaatattcttggtatgaacagggtcacagagctggatgataggtagagtaatacctatagtgggattagtacaggatgcacagtggggagtctggaaaggaggctagaaaaaaaatgggct

SEQ ID NO: 99157 - DNA, 1059 bp, Homo sapiens
aatacctggagctgtacttccctgctggagtcccacatgtctttataagacacaggtcatggtaataaaagcactttgatttaattcatccatgtattgcataatttttcttggatatgtatgcctactaggtacttcttacaacttaaatatagattactaagtcacagatcatcactgagaggcacttattttgacctagaaaaactgctggttcctgctagttgatcaaattataacctgctgacctctcccaagtgtaattcagttctgcagataaacaacattgactatatctttggtgtttttaggtggtttacatcttggagaaaaaacattctcgagcagcaaccggcttcctcaaactcttggctgataagaacagcgaactgtttaggaaatacgccctgttttctccctcagaccaccgagtgcctagaatttatgtgcctctcaaggactgtccccaggactttgtggcacggcctaaagattatgccaacacactgttcatctgccgcattgtggactggaaggaggactgcaattttgccctggggtaggtgatctctggtaggaaaaaccacaggtcacaggcagaactcagtttaggtggtctttaggtaaactttttgtgtattttaattattatttctttattgaagcacggtttctggtgtattttggtcctgattcttcagaagtcactcttagctgccacctcaactgattgcctgtatgttccttgaattaccaggcagtcacattcttgtttttgttttttggcgtaaaacatgaacattccgagcctctacttatttagttatgtcatgtgtcctatttgtacttgtgtaccacagataattcattgcatcaaacaaccagtcctctccttgcagatgctagtgttaaaccatgcaaagtctaggcatattcaggagaccccaggctcctttgctttaaaatatgaacatgaaggtatatttaaatggcattctttttcggtattgattttgcctgtggcattaaaaactaccctattgtaagaaggaaaagggt

SEQ ID NO: 99158 - DNA, 1024 bp, Homo sapiens
tgttttctaacttctttgcaatgaacgtatattacttttgtgtttagataaaatattttaaaattttaaagattaaaaactggtagagttgtgaaataggaacatcagaattaatctagtaagcatgacttaacgtacaggcactctgaaactaatgatttaatagcacactggattgatcataatatcaattttgacttctctgtgaagaacaattggaggggtcctaaggaaagccttctggctctgtttctcaagtcagaatgtcaaataaaaaaaggtgaaattacactgtagttaccgatttaacaggagaagagcattactgtgtcttctgctttcccattgccagtgatttacggatgatcatgtttctactggtggaagggcaggagattttaaactttcccactactttacttttagagaggagacaggtacctatgttccatttgtttgctaacccagttattccgtttctgttctatccataggcagctggctaagagtcttgggcaggctggtgaaattgagcctgaaacagaaggaatactaacagagtatggcgtggatttctctgatttctcttcagaagttctagaatgtcttcctcaaggcctgccatggacaattccaccagaggagttcagcaagagaagggatttaaggtaagcacctgaaaccctttaagaacgtatatctccctttctgccttaactttcctaggggctaggcttagatgttttcatctttccacgaacattcaagttcagttcagttgggaataggtgcttctgtaccacagttggcaaattatggcccacaggctaaatctagcctactacctgtttatgtacaacccatgagctaagaatggtttttacatttttaaatggttggaaaaaattaaaacaagaataatgttttatgaaaattatatgaaattcagatttctgcgaccataaagttgcattggaacatggccatgcttattcattatctatgttgcttatggctgtttttt

SEQ ID NO: 99159 - DNA, 1010 bp, Homo sapiens
gcgaaagccagattatagtcaactgaggaggtgaaaaagtggggatcctaaacgtaaacatctcttttaaggaggtttgctttgcagaggaagtgagagggagcttgaaagaagcagggtcctgaagatatttgtgcaaattggagagatttgagcttgctggcaagtggtgggtgaggagccagtgggcgacatacacatttttggactcctttttggaaattgccttcagagcctgaggcacattttcaacaatgggaaatcttcatctttcgagggtggatttaatttttggaagcagccaagttaattcagagccaagggtggtaaatcaggtgggtgatcaagctggataacacaacttcaaaaaaaattataattataaagtagtaacactgattttcttgtgaagctcatgaattggcttagaaagtaatccttaaaaaatcacaagaaccatttgagcagttgtagcattctctgaatagtaggtgtatggatttgtaactttgaggacactcatttgtgtggaagttctattatatatgaagaaattggcctagttacattgtgtttactcctagtgctcaaatgtaaagttgccatgtagtctttttgcctgagaggtgacttagtggagttataagtttatatatgggagaatcaagagtttcaaattgtgattgtttaaacagttctgtggtcttacagatgtaattagaattcctaggataggagtgttcccacaagcataacagtactttaaatgtgtgttcagttatccctttctatagtcatatttcatcgtttctttttgaaatagagttattttgaaaatattaagtcgctactctaatcttgaatgtctgtcagacctgagacagagctgggcacatagtaggcactcaccgaacatccctctcctgtcttctctaccctagtgtttgttatataccaggggtcacactaagagaaaaatcagttcatagctagtagatcatcttccatgg

SEQ ID NO: 99160 - DNA, 1073 bp, Homo sapiens
acctcaggtgatctgcccgcctcggcctcccaaagtgctgggattacaggcgtgagccaccgtgcctggccccaaaagggtttttgagagcaggatattcacatgatctctaagtctcattctgtaggtttcttattatttacaaagggtaaaaggtagccttaacatacacagttctagctattagcaccttaaccaagtaatccaacctggcagcctaacattttgtgccttctgaaggtatgcacatcatcacctgtgaaaatttgaggccagaatgttcaccatgaatctagtcaagcctttttacccaactttccatttataggaaatacagaggagatgaattttgtcacatttgatttatttctgtctatccctttcttcctccttctgtgaggaaacaatctaataaatccagaacataagacgctttacaagacaactgacctggactcttcagaataaaaaagcaatgttatatttgaaaaacaaaagatagttgagcaagaaacaggctaaagagacataactaccaaatacattgtggaaactttgattagatcctggatcaggaggaaaactaaaagcaaaagagactttttaggaacagtcaaagacatttaaacgtggtctatgaattgggtgatatgaaagtattaatcttgactgtggtgttagtgttgtggttctatggaagaatgcccttagttttggacaatgcatgttaaagtatggagagggaaagtatcaccatctctgtgacatacttcttggtaattcagatgtcaaaaataaacacacaaaacaaccagctagacacaggaagggagggatggaaggaggaaaaaagataaagccaatatggaaaaatgttgaaatttgatgaatcttgatgaagggtatatggatgttcattttactattctttcaactttcctgaaagtttaacattcttcaaatgaaaattaaggggaagaaaatgaatttgaacatattttctgggtttaaaccatggctttcctggcccatcccttgatctctggctcccacagtcccagacccgtcctgtc

SEQ ID NO: 99161 - DNA, 1033 bp, Homo sapiens
ttgtgtaatgcttagacacaattgcttcatttgttttgtccattttcatagttgataatagcagacggatacatctactacctgttcctctgtctcagctggcctggaaccctgcaccttgcagggtctccagggagcaggcacatgtcctgccgtactcactgcatacactgtggttttatgtctagggcccaagtgtgtcagcagaggtttcataaaggaagtggtcaaagatatgataggaaagatagattggggacaaactcgggacaaattttcagaccaaatagtgttttttgtttgttggacaatggaaaggcaagcagatgttgttcagcaagagagcattcaaaaagaggaaaataatttagcattgcaaggaaaaggagagaaactagaggctggggaatgagtcagagaaatattgcaatagttgtggacctggactagatggtagcaaaatcaatagggggggttggagtgggaaggacagatgtgagaaagggataatgacagaagaatctatggaaatgaatgttggggttgagggagaggagtccaagatggtgccaaggtttcaacctggatgactgggagatggaacccataagttagaaatgggaatcaggagtacaagctggtttgggagagagtatgttggcatggagttgtctgtctgatgttatttatgttagttgctgcaaattctttgtaggggagctgaggtgtgtataaacaagctaaatagatgcagtccgtggaactatatacaaagagcccgggaggagaggaagcaatgcaccaaaatgcagtgatttcattcgaatgatgggatcataagtgattttttttcctttctctagttcccaaatttttataatgtggcaataatagttgtataatgaaaaaattttgtaatacaaaaatattatgaggtgccagaaatcacaggccgctcagtagcctactgcaccaggtgatcagataccttccatccacttagtttttcttgcattcctgaggagcagtttgg

SEQ ID NO: 99162 - DNA, 1023 bp, Homo sapiens
gctgcttcccttaacacacgcacagtgggggctggtcactgcaggctctgctgatctcctgtgccctttcctgcctccaggcctctgcctgctcctttccctctgcttacaaggtcttgcctccctgcctccttctgtcagatgaaatcgccttctaagaacaacataaacctccgcagaactttcctttcctcctagcagaatgcattgtttctgtttctcctaccagcaagtattcttcatgtcttggatatagcaataaccatcattacttctggatttaattcccttttttgcttatttcctaagagcagggtgttccttggatatctctacttcctgagtaccttggatatctctacttcctggttgctaccctgcattttaaaattgtttggtctagtcagatctagccaggcaacctattgcataccttcagtgtttcactcctttttctggttcttgccttgcccctttatttccatgtacttctgtccttgttttgtgggttgcctgtgggtttatatcctgacatataagtctcatccactttctctcctaaaataagtctgtttctttggaattgggcatacctttcccttattccattcaagtgtttcactccatctgtcatgtctcagtggtacctataagatcactgggtttatcttatgttcatgctgctgttacttcagctctgtgaattggcccacgtgaggctcacttccttcctcttatttccttgccaggtgtcttgcgtggtctgcactgctcttcccttttcatccctacaggcttccacagcaactcatgtcttcattttatcttgtcatttcctccacctccctcctgcctgtatccttgctattttcaaattcaataagtgctgattttctgataaaattaacttcctgaatgaaccctaacatggtagtaaaacaaaatttgtgatctaaaagccaaatgttttttccctttagttatattggcaaatagtcttactagttaagaaatgcctttaaa

SEQ ID NO: 99163 - DNA, 1044 bp, Homo sapiens
agcttggcaggcacaagtggcgccggcccgcaaccttggacagcagcagctgtgcgctctgattcctttgaaccgctgctctgacctttcttcctactcggttttgtttcttaaaggactgtgtccaggaacttttctgctgttttcactttactttgcctataaaggtcttctgaaaagctggatgagctgtgtttccgccctccagattctctgctttctcacttggcacaatcatttctcccagcttcatcacacaggggaaggggggctggggttccagttcatttcccatctatagggaatgtggcactgatttcattcagatctgtaagtgactgatgccagaactgcaatcttagctccttatctaaactctaattgggggattaacccatggagtaggacagtatacagtgtaacaggtcttgggtccaaataccacctcactgactttaaatgaaattctttttgttgagattttgctcacagtaataagtatttggttattcttgttaacaatagggtataatcaggtggaaatataaatttaggtagtgtccatttaaatatcaggaaaaaactttttgacaaaagatgattccgttagataggggacacctgcccacctgaattttggtctgtctttctcagaaggacacaacatttgctcagttaatgcctctcaactgtcttctctgggagataaatataatgtaattgcaaagtttaaagtaattttagaaaataagcaaattaagctttaaaagtaaaagaaaacctaaacagttgaaacctaaacctaaattttctgcctattggcccaagcattcatgttattttaggtgcgaaacagctcaagtgaaagttcgcccataaatctctacgatattttattggtactgctttataatagagatcaaagattgggattggaagcctgtcttaatgtagagtccaaagagttttaagatgtttctttctgacaccagcaggttgtcagagtgttgatgttttgttaacgtcaaactgtgtagcaaagag

SEQ ID NO: 99164 - DNA, 1030 bp, Homo sapiens
actttgggaggccgaagcgggcagattgcttgaccccaggagttcgagatcagcttgggcaacatattgaaaccctgtctctactaaaaacacaaaaattagccagatgtggtggcatgcgcctgtagtcccagctactcaggaggttcaggtgggaggatcacctaagcctgggaagtcaaggctgcagtgagccatgatcacgccacgcaatcccagcactttgggaggctgaggcaagaggattgcacagcctgggcaacataatgagaccttgtgtggatgaaaaaaaataaaaaacagacaccagagagtgagctctctcatctccccaaaatacccaagtctaaactatagtttgtgtgtcagttgttccttcaagtaaaaatggtgttccataaaatgagcaatcagttcacttcacaactcagttatgtaattgcttttcctcaagaccaccagcgtacctctacatgcagcaaaagtgaaaaagacaagcaatcaagggttgagacatcataaaattaataatttttactcctctgtccagagcattcggttgttcgatacgagtatgaggtattggagtgcaatagccacaggtgtgcttgtcggatttgcaccaaggcagccactttacccacgagggcttttgtgccaccagtgtaaatgtcagcacgtggaaaggacaaacactgccttagtatttttatgaaaatagttttaacctcctggattcctggaagggtctcagggatccctaggggtacatggaccataccttgagaaccaaatggacagttggtggaaagtttggggtagattaatatacatagcacacagaaaaaccaagcaaataaaaagacagttattaattccagtgagaataaaaagttgtatagaaaagaaaagtaacacttagtatttatgtaatcataatagtagattgataaaatgaattctgatcattgtcatgtattaggaggattaaggactagaatagttacgtgggcatggtgggggagggagt

SEQ ID NO: 99165 - DNA, 1078 bp, Homo sapiens
gacagatgcttgctacagtaacttcagatcctgtggcctccgaatactccctggcaatactccctggcaatccttatgctctgcccaggtcaactgtttttcctattctccaaaggagcaatttcaaaccttcatcactttcctcaaactccttcccccatcacactccccattctttgcagataatttgtgtcctaattttcaggaaagaacctaaaaaatcatactaggacattctaaatcccccctgcccaatccacagatcttactgttatcgctgcccatcttccttcctcttgcagccaagaaaggggttccacttttgtgttggatccaatcccttgtcatctcagagaccttgaatctgcagttctctctgtctctcttaatgtcttctactccaccatccatagtgccttcttcctgtcagcattgaaacaagtctctgtcatctttaaatatactcccttcaaacaccttcagtacactctcacatcctctcatcctttcccattccatttcatgaatcttgcctcttccctagcactgtctaatttgctaaaagagttgtattcactcatgattgccatttcctggctttctattcgtttttcaacctgtcaccccgatctctgcccccagcactccctgcaagagtcttttctgatagatccaaaggattccttgtttgggaatgttctctgttacttgacctcttagaaggatttaacgctgctgactatgccctccttgaggcatgttctctctttggcttctataatgtcagaactcagaactccatagccactccccagtttctgttgtccagctcttaaatacaggtgtttctcaggattctatccagggctctcttatcccttcaggttacaatcttgcttataaacttcagaactgtatgttcagcagcctactggccatctccactagatgcctcccaggtatgttagaatccgcaatctcagattgaactcaaactcttctcccaaacctgtttttcttccttgtcagggtgagtagcaatagcatctgccctgcagcctgagccagagaatcctga

SEQ ID NO: 99166 - DNA, 1106 bp, Homo sapiens
ccgccctccaccccacccaccctaccccttcctgtggacaaagagagggcagagctggggcctcagtgccacgtggggtgggcacatgaagatgtcagggaagcccagaatgttctggggggggtgggggacacattcattgaaaccgctctgaacctaggtcataaaactgtgtgtcaatattttaaaagtcacagaatgaatgcagagctctgccaaactcaacatgctgtgttccagggggtgataagacgagcgttagttcagtggaaaaaaaaacaagacaaaaggagttttcttttaatcttctgtgtttcatgtttatactgaggcaggctgcccttgcaggagagaattcattcatcatgcaaccaacagatgagtcccagtgacattgtcacctgtcacctgtgttggatttaagtgataaccatatacaggcagtaagaatgtatcgaggcaaatgtagcctgtcccattaggccagcagaagccatcttgggtttcttctgccaagttcatacacctctggttcaacagtgataagctgaagggaagttgcaggagccataactgccactcctagtcctttattactagggggctgtgcttccacccctgaaaataagtcttgtttggcactcaacgttttctgtggagcaaacaagcaagtcatgtctctgaaatacctcatttgttcccccaaacatttcaccagctcctccatgtgctgctcagctctgggatacatagatgggcacggctaggtgttcccctcccttccccacccaacagcctatggtctgcagaggaaaactagcctccagagaaggacagtctggattcactgttgagatgtggtttagaatcagcccacaggaccatggagccagggagggagatgtgtgaactgaacctgtacagccccacgagttgctgagtggagaaggtgggcttgggtgcggggagcagagggggcagagtggaaatccagggtggcctaagagtctgggtgcctgtcacccatgaggaggccccaaagagtcccttgggaacagaggcactgatctccttgtggccagtaagtgagcagggctgaggcaagg

SEQ ID NO: 99167 - DNA, 1047 bp, Homo sapiens
ctgagggcccaaatgtggccatctagcctctggggacttccttcctttggagctagaaaaacaggtgcagaatgtgtctggctacagcaggggcccgcccactcacctatagaaaggccctgccatggactgagcctcccagcctaggaaacctggctctggcctcccctgcaggcatatgatgtttggctccagaggccttctcctctgggcttttccatgcctgtgaactgggccccattcatttctctgtggtttcatgggaacgtccaatgcattcaggaggttgcagtgcgcgcaggaggagaggggtcagcgagaggcccgagctgtgactggtgggccacccagaggccacggcaccctctgctggagactggcagcagggtgcatggccagctgtgggtgggggtccatcagtcaagcagctgcactttctccccatccccctccccgacccaggcaaggtgctctgcctgcggctccctttctccaggcctccactttccagctcccaggcacccagccccacccggcctggcctggaacagagctgccaccaagatctcttccactttccctccccagcagcctgcaattcagtgctccgtagacccctgcctcccagggctctgcggtttccaccacactacactcaatttccagctgctaagaacacagcaggttctacgtaaaggtggccatcacctgcaccccatgggttgcccagccatggagaagaggccatggttgggtacacagcttctgagacaggcccagcagctgccttcatggcctcggcagagcccagggctctggagcttacaggcagcgtgtgcccaagtgtggaaaatttggtctgcagaagaaatgaggctgaaattggctgggagcaattcttatcaaagccacgttagcagttttcagcaagagctaattgaacaagctctgtgagtggcctcattccattagcaggagcctcccacagagcgtgacaagggccctggtggctgagggcagaagaggctgtttctgtcccacatttgc

SEQ ID NO: 99168 - DNA, 1046 bp, Homo sapiens
tgctgcagaagctgcatggagcccacagccagccctggacacagccgggaggagggcgctgacctcgaagggccgctttctgctgccctgggagctgggtgcttggggtcctaatctgtcggcgggggtgcagcgccatgcagcccatcccccagccatagctcttcccagccccccaggctcccactctcatgcctcaccccctcttcccaggctatagggagcgactagacatggcgcccgataccctgcagaaacaggcggaccactgtaacgaccgccgcatggcgtccaagcgcgtgcaggagctcagtaccagtctcttctttgctgttctggtcaaggtgagccctccagcctggtgcccctcacctccctctggctcccgaccctcctgggcacctgctcaccaggaggcctcgaggagcccagggcagtgccaggaggtgccatggctgcagcactgtccctgcaggagagtggccccctggagtcagaagccatggtgatgggcatcctgaagcaagccttcgacgtgctggtgctgcgctacggcgtgcagaagcgcatctactgcaacgtgagtgccctgggagagcccgggggcgggcagggcagcccaagccatcccgcactggaggggcacaggctgtgatgggtcacactccacccctcgctcccccagccctagcacaaagcccacctgatgggccttgctgagacgcccagctctcccacctgggatggtggctccaggcccagggtcaggcctggcccccttccccaaggacccaggaaccagagagcaggcccctccatggccagtacagctcggcagggtgtgcaggctttggggactgtgtttataggaacgtgaaggaatgaaaggccagcgaatggtccgtggccgctttggaaactgtgtcccctgaagacaaggaagagagctgtccctggctcggctcctgccctgagtgactgttgactcacagttctctctccaaggggacatgggcctgtcctaatgctgccttaggggcttggct

SEQ ID NO: 99169 - DNA, 1053 bp, Homo sapiens
cactctgtacctgccttccccaaacctcttttgtcacagctctcagaccctgttcagtcttctctcagggaagtggggggagccaggagcctggatggctgcagagtgcactggtgacatgcctttgggattccagggctggacagacaaccggctgaagtggaatgctgaagaatttggaaacatcagtgtcctgcgcctccccccggacatggtgtggctcccagagattgtgctggagaacaagttgagccaagccctccctgacctcccctctgtcaccctgcctcctttccttaagcctcctctgcctcccccaactctgccagtcgtgagtggccagagctcactatggttcttgtccctgtcccccagcaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcaggtgtgcccttttctccagccacccctcaccccaaagcaccctgccagaggccaaagaaggtgactgaagcaccctcagacagaggcccctgccctgtctggattagtgctgccctccccacaatggtcctcccttaccagcccttccccactctgtggccccagccactggccgagtgtcactctctgcccattgccctccccagttccctcaagtatacggccaaagagatcaccctgagcctgaaacaggatgccaaggagaaccgcacctaccccgtggagtggatcatcattgatcctgaaggcttcacaggtgctgggaacagccgccagtgggtgggcaggtccctcagacacacacagacacactggccctgtccaccccagagacacacacgtgcacacacacacacacttaggacaccaatacacagctcctcacacacgcagctagacacagaagggcagacacatatccgcccacagaggagcacacagacactcacacttcctgaatgca

SEQ ID NO: 99170 - DNA, 1512 bp, Homo sapiens
gaactcgggctcaagagatccacccaccttgcctcctaaagtgctgggattacaggcatgagccaccacccccagcctcatatgttatttctactctaacaattctgtgaaggggatcttgttgtctccttttacagatgaggaaagtgagactctgaggttaactaattcccgacacaaaggaagggctatcccaggtttgttgtgtaaccttggttcaagcacctcttgagaaaaattaaacttgccctctttttttttcttacctcttctacgattgaagaacctgggtcattttaattactttgaattattaactattgtattgagccagaatcttttaacatctgccctctagcattgcaggaaaaaaaaagaaaaacaagctttctttcatttgaaattagcagttgaaaacagcactcctgcccctagttttatttttttatgttgtttttcattcagaaattctgcggtgtttaggccattgctgcatatttggagtctttaccacattgctctctctagtaatctgcactttttaccacattgctcttaaggacatgttccagtttgccagaatccttccagatgtccagtggctggagctgagtacagtagtatataatctaatgggctcatattaaagattagctctaatctccgttactgtatggactcaacttctctgaatgaaacctttgattgtaattgcttttgtggagaaggggtagacctatcaagtccttagatctcattgccattgatcctattgataacgtaaaaccgtaagatgctttcacaaaaactgcagtcctgacttaaacatagttttcagatctacacaactgtacttgattttgtccgtattctacatcatttgctttttattctatatcgttaactttgggcccattcctaactattgtctaaaccacttatttggcactcattgctttgattctatagacccattcattaaacggagatttttttttatgccactgtctgatggtgagggtataaagatgaattgaaccaaggtcctgcccacaaggtattggtctagttcagagggtgaggaaatacgtgggcagaagcttagcaagctaactaaagtgcctctcagtctggacagtctcagagttgctaactgcctgagtttagggagcactgatttttcagtctgagttgtatcttgactcaaatccagcttgaagctgggaagagtagcttgtaagatttgccttaaatgtaggcttagagggcagagtggttggttagttccactctcaggtaataaaagcaccagatataggtccattagggttcccatttactgtcttagaaaggagccctaagtggtccagggatcacaggagcattgtttcttctctgacaattatttttgtttcctggtagtgatcagcagcaaaccactaaaaagaaaggaaggtatatacttttcttgggtctagcaaaaacaagatgctgggatgactgtacccctct

SEQ ID NO: 99171 - DNA, 1117 bp, Homo sapiens
aaaataaatggctttcttattgtctttgcaaactcaccttccatttatctttttgtctggatccggtgattttaggtgtacctgaaagccttggggtagtttcactgctcatgaaagggtaatccctaaagttcgtttgactctgtgcttatgaagcaagaacacatttattctttctttcagtcatttatttttccttttggtttaccatttattcagcatcttctagtgccgcatgttaaggcaacatcttgccctgggtgctggagataccgagatgaaataagacactgctctaagggaactctctctctagtagggaaagcagacatgggaggaatggtgtgacagaccgaaggggtggtgtttgcaaatggcaccgatacggcaacatagattgctagaggaggaggatcctggctggcaggagtcagattctagaggatcttacattttgctgtactttatcttagagggtaggcatcaaaaagcgagggacagttgaaagtttaaagcatgcaagttaaatgtcagatttgcacttaaaaagataatgctagtgaaaggatggatagagagtgagagatttgtgtcaggaagaccaggaatttattatatgattgacgtgtcaggagaagagggcctaaactaaagtagtgacagtgagtgtagaagaggtggtaaggagaagtggcaaagcagatagtacgtttttaaccttcatttgaaatgccatagcattagagactcttctcattttttactccatttttggcagggaaaacaatcccttaaactgtataccttaaacattccctttaactggttctttgtgtggctttttagaaaactgaaagacagtgctttgtggagttcacaagttagctgatgggtgtttcgtttttgtttaatcctaatttgcctgtctgtgttattttgcccttcttacatctcagggcctgaatttgagtgactttgggttggttacatagtagttcgtatgacctggtggctttgttaggtaagcaagaattgacttcgtcacagaattgtattgtgttgcctttccattcagtttgaaagatgatgacagtggggaccatgatcagaatgaaga

SEQ ID NO: 99172 - DNA, 2149 bp, Homo sapiens
aaggtctgtttagccattttaataaatggcttatgccaaggatcccagccttgtttttctttttttccccatttcttctctccctagtcctaccatcagtttttctatagagttgaataattggaaagtgatatgacttcttagtgtttaagagattcttggctttttactgccttcatacaaaaaaaggctgtgaaaccatattttaacttcagtgctttctgtctttttacaggatgatgcaaataaaaatggtggcaagtggattattcggctgcggaagggcttggcctcccgttgctgggagaatctcattttggccatgctgggggaacagttcatggttggggaggagatctgtggggctgtggtgtctgtccgctttcaggtaagccacccatgagccaggctggtttcttgtgttgcctttgctctcctcgctgcccctgatttgctttgatgattccttctgttcctctggtaggaagacattatttcaatatggaataagactgccagtgaccaagcaaccacagcccgaatccgggacacacttcggcgagtgcttaacctacctcccaacaccattatggaatacaaaactcacaccgacagcatcaagtacgtgttggggggttatgggaggacgtgtccctaagcttagtataagtagatctgtagttgggcccagaggaatatggccggacaggagacttacttgtggagaagggacagaccaggccttccctctagggcttctggctacttgctgcagttctttgtcagcgaggctccctgccacctatactaccaggtgctttgtagcagagagagcccatctgcagaaacccagttgtactacctgggcttgcttaatttctacaggctgtcttgtctttcatatgctaaccactatcttaaaatgaaagacaagtgcttttctttttcttgctgttttttaagataatttcaccctgcccaccctcaccccacttctgcatgtctttttaacttgttagcttcagtctattttctttgtcctgggatactgactacttatcaggaatgactccatttccttgtgtatagagctgactcttagaagaagggggatagtgtgtgtgtgagagagcagaatcaaagggaagcatgaaggccacagggaaaataagcttggcaatctccctaggactcagggaaatagagctctctgtccacagtgagaatcactgttaggcttgctcctcagtgattgagtgtcagaagtaagctcaggctattgtgaaaaagtgtggggagtggctgtcagattgtctcaaagctggagggagagctagccagctaagagttaggactcttaggtttagttctctcatatggccccataccaatatgtgcctttgacaagtgtctttgcaactttgcttcagtttctccatctgtaaagtgggagacagtactttatctaacaaggctattgtgaggctgatttaatctttaactgagggtcttcagatggagaatgcttttacggggccaagtagtagtattgctatcatcatcatcatcattagtaagaatatcatcatgttgttattattgaaggctagtagtgagcccagcaattatgttcagcagacagaccatttgggaatctctttcccatgcattcatagataatgtggagtggagttggcttaaaccagctaagtgccagtttttaagtgggaacactgctatgggcgttggtccatgatcaaacggctggcatgactcatcatagtcacgaacagttattagccagccatggctgtggttgcttgccttagcagtcctgtgttagcattgctttactctgggcacatttttcttattctctattctgggatagaagtagtttctgacttctagccacgttcagtccaggctggagagatctacacctgtttctaggattctcgttttcaaggtttctgaatatcccctactcccacttacccccaaaataagctttttacctggataggagagggaaagaggtatttttcatcaattctccccttctctgctcttctccctttctaataccataaggcagttcttcgtgacttttacagaaacatatgtacacgtccttacagagtttagg

SEQ ID NO: 99173 - DNA, 1096 bp, Homo sapiens
cacactatcccccttcttctaagagtcagctctatacacaaggaaatggagtcattcctgataagtagtcagtatcccaggacaaagaaaatagactgaagctaacaagttaaaaagacatgcagaagtggggtgagggtgggcagggtgaaattatcttaaaaaacagcaagaaaaagaaaagcacttgtctttcattttaagatagtggttagcatatgaaagacaagacagcctgtagaaattaagcaagcccaggtagtacaactgggtttctgcagatgggctctctctgctacaaagcacctggtagtataggtggcagggagcctcgctgacaaagaactgcagcaagtagccagaagccctagagggaaggcctggtctgtcccttctccacaagtaagtctcctgtccggccatattcctctgggcccaactacagatctacttatactaagcttagggacacgtcctcccataaccccccaacacgtacttgatgctgtcggtgtgagttttgtattccataatggtgttgggaggtaggttaagcactcgccgaagtgtgtcccggattcgggctgtggttgcttggtcactggcagtcttattccatattgaaataatgtcttcctaccagaggaacagaaggaatcatcaaagcaaatcaggggcagcgaggagagcaaaggcaacacaagaaaccagcctggctcatgggtggcttacctgaaagcggacagacaccacagccccacagatctcctccccaaccatgaactgttcccccagcatggccaaaatgagattctcccagcaacgggaggccaagcccttccgcagccgaataatccacttgccaccatttttatttgcatcatcctgtaaaaagacagaaagcactgaagttaaaatatggtttcacagcctttttttgtatgaaggcagtaaaaagccaagaatctcttaaacactaagaagtcatatcactttccaattattcaactctatagaaaaactgatggtaggactagggagagaagaaatggggaaaaaaagaaaaacaaggctgggatccttggcataagccatt

SEQ ID NO: 99174 - DNA, 1017 bp, Homo sapiens
cctgtgggctttttgccttagtctgctagaaagactggcctgctgctctctgctttatccagaggtctgcctctgggacttcagccctgtagctgtagagaccagaagaccaaccctctttgagacccagatgctactttcccttgcgtccccctctctttcctctcccaatgagccaaccttttgcacttccactagaatgccaggcaggctgggcccccaaaggctcctttttcaaaacctctggaagccgcggttgaatgtgccatgaccctctccctctctggatggcaccatcattgaagctggcgtcatcggagtctcttgttctgttggcgtgctacctggaagatccttctgtcctggacaagaggaattggaagagcattttatgttttaagaacaggctgacacgcagcagctacaacaacagctgagatcacttaataaatggtgctaaactagcttgtctcatgctcttgctctttatggtgcatcaaagatgtggcctttcggactgactgtcaccatattaagggatggcacagacttttccatggagggccatccggggaatgcagcctcatttccataagcccattgtgtagtgtcatgtggtattttgttccaggactgctgaggcctgacataataaggtgacatctagcttagaaaataagaccccattttctggtacttaaatttgagttcccatctagtcacaccgatgaccagaacagagtgatttctgatatagaattcagcttgaaagtctgttcaggttggaaagggggatccttggcctttgcttcgctgacttccattcgcctttacttcaaagaaatctcttgcttggaggtaaatccctgcttctgtctgtgtggctgtgtgtatatagcttccttgctttgtgctaatggggttttctcgctggtgccaaagctgcccaagccacagctcttttccagccttctcccttctgctttccctttagagccaggtcatcttcctctttga

SEQ ID NO: 99175 - DNA, 2980 bp, Homo sapiens
tgcatctagcctggaatggaaaaggaaaacaggccaaattcccatagtgggctacagcactgggaaagactggcccggcttctctgcaggagtggagggtgggtgattctctttattcctttatctcagagaagagacaggtcaaattgtggaggctttcccacatctagatatcattgtatttcaacactgaacttttataggcaaggaccaacccattcccttctcctggcatggctaaatcatagtccagtagcaccaggttaccccagcttaattgctggcctggctttgcatctgtgatatgtaccaccgaactggtaggcaaagcgaagagagcccagattagcaggaggctgagcccctccctaagtatagagagcagtgagcgcaaggctatgaaccttgcagcctttgggtagaggtagggggaagtgtagaattgcacaggatttgctttctggtacgtgagatgggccaagagtggtcttaaaagagctctttgttcctctgtcttttgaatctgttcagaattccttgttgcctatattaacctctaattaattttttctgtttttagaaactccagtcatgacacttcttacatttaacttgttctttctttacctttaaaagaaggaagttttaatattacccagtatgcctggaatgccagatggaaaatagctagactattcacacctagttttaggtggtagatttgcctcttggccgagctgtgggcctatgagaataagagtgattataccaaagattatggcccactattttatttccactgattccatgtgaagaaatttctttttttgttttgttttgttttgtttttctgagatggagtctcactctgtcacccaggctggagtgcagtggcgcgatctctgctcactgcaacctctgcctcctgggttcaagcgattctcttgcctcagcctcccgagtagctgggattacaggtgcccgccaccatgcttggctaattttttgtatttttagtagagacggggtttcaccatgtttgccaggctggtctcgaactcctgaactcaggtgttccgcctgcctcagcctcccgaagtgattacaggcgtgagccatggtgcccggctgtgaggaaatttcttaacccaggttcttcatgttgaggtttaacatatagtgaagagactaatgaagaaactgggaggggaatgtaatactggaatggagtaggagggagctgtgaagtccatatttcttcaggttcttgacagagagaactgctcggtgtaggctagtgtaaggatggcccttcctggaaataaaaggataaatgacatgaagcttcaacacagccatgtaatttcttgttgacacctaagtggtttaaaaaggaatttaaatctcagcattacagtgaggggtttccctgggtcattgccaaagcattggattttgctttgcccttgtcttcatttggagtaaagagtcaaattgccttctgatgtcactcagggattcacaaagcacatcacatcaccatctttccagaaagagctctgaaacaggtgtcttgctgtggacactgagtttgggaattgacaaagactggcacacttgtttggcattcttacatttttccttaatttagttagcacatacactaggagctttggtaataattctctgaagaagccatgaactgcaggtctacctcctctaagaggtaaatggttaactcataaatgtagtgtattgtcaccctgggtactgtgtcaccaaattaaaccaagaatggagtaacaataatgaggaacttcagacttagaagcaccatattttatatataattcccaaggaactcctcattttggggctgaaaagtggctagggcttaggtaggaaatcagctcccctgagaaaacttgagtttgagcctccagaagcatagggggtctgattttctcctgtgactagtccagcagtcaccaagagtcttttctctgtaagcgaaaggccacgtaccacttctgtcacatttcttatcccttcccaaccctaatttcatagttaagctagtcagcatgaaaattgtaatgggcattgttccctggaaattttgaactgccgtgactttaaattttcagatagtagttacataagcacttaagaaacaggtggaacctgacacattgaaggtctgagtgtagaagggttagaaggtcggaaatatgaaaacagagaaagtgtatactttcctccttgcatctttagacatcataatgctgttggaaactggcctttaccctcagtgaggcctgatgaagaaaaattgtttctaccacctgtgcacacataggcaaggcagaaagtacagggagtgccactgtaaattggaagtgtttttggtgacagttgagcatcagctctgaccttactggcctcccctggagccttgttgaaggaacactggtgcaaatccttgagggaacaggggcagacttctcaagtgaagcaagcagaagtgcccgctggccctgaaagggtaggctgctctgctcctcggaaaggaaagtccagtgggacctcgctgctctgctcccaggtacctgtggctccactcggcttggagggcatctgaagggggatgtggggttattgtgtctgctctctgtgttcaaaagcttttgatctgaatgtgctattgtgttttttgtctctggtttgccagggcctgggaggagtttcatggcctggtgaacagcagcggccgctgatcggacgctccccctctgtctctcacactcagggtagggccttgtctatcttctctgtaaccctgtgacatacctctcatccataggacccctcttcccatttacccccaaacttgcctctaccaacattgagcctcagagaaaaatataagtcccaaaccactggattctcatcctccctgggtcccatgtctcctggtgaa

SEQ ID NO: 99176 - DNA, 1031 bp, Homo sapiens
ctgtcactgtcaggagcaggccacccccatttgctgttctgttttcctcttaaatcaaactggaaaaactcagctggattctcctggcttttcctttactcttctcctcccccttttcactttgcaagtggactttagaatatgatttcttaggttttctgactataaagtggtctatattaacaaaaatattaagtatctgaatgaggctgggcacggtggctcacgcctgtaatcccagcactttgggagtctgaggtgggcggatcatgaggtcaagagatcgagaccatcctggccaacatggtgaaaccctgtctctactaaaaatacaaaaattagctgggcgtggtggtgcacgcctgtagttccagctacttgggaggctgaggcaggagaatcgcttgaacccaggaggcggaggatgcagtgagctgagattgtgccactgcactacaacctggtgacactccatctcaaaaaaaaaaaaaaatctgaatgagaaagtgtttttagagctctccagtttatctgctacagagaaagaatttatttctggcccacctagtacaatagagaaattcttccaaaagataagatgacctgcttatggtaatgattaccctgaaaatcctttttccgtcactaaacagctgaaagagttggggccagacacttgcctgccatctcctttactccaagatagataattgcccaagtcagcaaattctctgctcctaccttcccatatccctgcctttctagtttcttttaataagaagagcagaatccctcctgatagacttgtggtgtccaatgattaggtgggcatagacgtgcctgtaaaagggaagaaatggaacagagccatctgttcctgtgaaatcactttctttagtattaagtgtaggtacaaaaaaagtgtcttttgtaatgcatctctgtaacacagcatattttccctaagagaactcagaaatacacacacacacacacacacacacacacacacacacacacacaccagttat

SEQ ID NO: 99177 - DNA, 3294 bp, Homo sapiens
ccatttttttctttcagggacaattcaagctttcgaaatacaaaaatcacattgtgagagtacacaagctggcaataatccttttctgtatgtgtgtgtttgtccgaaatggatgggaggcctccagccagtccttccattgctcactgaagggacgtccctgagccgtgcgctctccttttgcactcattcctggaggacggattccgctagacaccctccagcatcgctgactttataaagcggaaaaacggaaaacgtgactttgtaatagacaaacattgttttttaatggggttccatgggggggcgttcagcctttctgtttgctgtgtgctgtccagatgcctcttgggcgtcctgttgttctcttcccgtgttgtacgaagggtaccgtggccacgtgtacatgccagagctgttgatgagagttaccagtattatgaatgtctgtgcatccaggaaaagtgttctgttggagagtcccaaaatagctgtaaatgctctcttctagctctgccattaaattattgggacattttgtttctttctctcccctcctccaagcccaccactttctgaagctgtgttactgatgtgatgactgtccaggattttgtatcatcccctgccttatgccctccggtctcctctcctgtgggactctctccttcttaggcacagctgcacttagaattgtaatccagtggctctcactggtttcactgaggcagcttagagggaatgccttagtaaactgaactggagcagaatctagtttgattaggagctagattataatctaggttccaagtacagaatttggagctaaggactgtgactgaaatcattttcccatatgagcagaccctgtgtgtcaggcctgtttcccatatgagcagagcctgtgtgcaagtctgtttctggcatgtccctcattgaggaagggaagcaaaagctggttattgccaggcctattaacacttaatatgcaaattctatcatcctgaaactggggcatctgaggaaaaggtgaccttgctggatggctttatttgcatggctctgcctgtctgcagtggttgagtcctcatcacctggtatgtgtatgagcaaatgtgtgctgattgtgatgcccaggcagaaacctcttgaagactgctgcaggcatgctttaaaaatgaccagtcactcatcagagaagctgggtgatctgactccagaaggactgaagtcagagaagtcacaagagcacctaggattcaaataaatagcgtcagagtcctatagcaacctccaagtagcaccgtcttacttggctcttgtgagcaaagactgcagtaccttaaattaaggcctctctttaaaacatatgtggaagactaggggatccttggccacctggtctcagagaaatcatatgagagtaacaggcatttccttattgtatttgtactacactcttcctacttttccattcctgaacaccctctaattaccactgttttggggatgctttttttctgaaagaacggggagtacaggggccaaaagggaggtgcttctattacagggcaagttagatcagataagaagatctagcagtgatttaaactccaggaatatgaagagtgcattctggtgtccagacagttgtgaagggctcggcaaatataagagcaccattggctacatggagagcaaaggctgtctttgaagaccccagggaggtcttcacttttgcctaaattcagatttgccgtgaaaattccaaagagagcagatatttggatttgccctcctttgggcatctacctgactgttgtgtgtgtgggaaagtcagtgtgtatgtgtagagtgtgcttaggagtgagtgagtggtcaggcctcctggctaggtgtgttgtccatagttttgttgttgttgttgttgttgttcagagttttgaatcttacgttttctagagctgctcatgttttcccttcctttttgtcgttgtagtatttgacagttgtcttttccatcaaaaacatactggccctaggctggttagagcaaggggttatgcctgttaggcagcatcttacgcccagtgttctcccagatattctgcctaacaggtttaagtaggagattaaatagtcagtttatctaaaccctctatttttccaaactagcttgagaggtcttttcatctatttttactccatgggcctctgatatgctgagatgtggcacggttatgattatggtatcaccgttacagaggcaaagggataaaggtctaccagggccaacgtaaccagaatgtgaggagagtgaagagtcggtctccgctttgcacagtaccagaatgtgaggttgccactggagagtggagagtcggtctccactttgcacagttggagctgttctcctctaactcctttgctgggttttctgtttgaaattggcccctactcctctccagccctttactgggttttctgtttgaaattggcccctactcctctccagtgtctgctttttgaatccttctgttcgtgtgtgtgtgtgtgtgtgtgtgtgttccctatgatactggcagtggcaataattttccacccagagagaagcttgtggtccacaatgctcgaagaatgaatttccaagtatttgccagtggaaacggagcagaggctatgacaagagtgatttagtgttgcactttcagagcaattatctactgcagtaataaattgaaaatatcagcaagaaccaggtcgtggacttgtcaatacaagggaaccgggggtactgttactcattctaccctacagtgtataagtcccaatcttaactgcattccaaaacaaaatatgtggaatagtccaggcaatgtcaatctcaatgacacaaatttattgtgaaaatattctctaattgatattaatcattgccacaactcagtttacatttttattatcaaaatatagttggtaacgctccttaacttgggataaggaatattggaatagaagaaagtttaaagaatttgattttactgtaagaaatcactcagcctaagcttggaatgttttagttatattaagtatcttagcctaaagagggacacatggggcatgccgacggttggtgcccacatgaaacactgagggagaaagaggctttgctgagcctcagttattgttgacaaaggatttaaaacaatacagtcttgagacttagtttctgtagatagaaatctcctctctctgtctatcagtcatggtccaaataggagacagaaacca

SEQ ID NO: 99178 - DNA, 1017 bp, Homo sapiens
caaggttagacaggaaattttaattaccctggacttatctggaggcctctttcaaagggaggcaatgagggcagccacttaaaggcaggaccccaatgcaacatcttaaaatgcagccgcaaggtttttgcagcatactaaaagcttgtgttttaattccccaaagagagggtgggaagaggaacatttggctatgggaaagttgtctttttcttaagaatctgaaacggtgatgtcatggatgtcctgccagtgccagagtcccgcgttaccaagacaccagtgaaacccaaaaaggtgaggctgtcgtggaattcttcatttctcgtcccctctcctctcccagtttctttttctcctccttagtcttgtctctaaaggagagagaagcgggtgtagatttggaaggctgggaattttccaaagaggtaaagtgagccctcttagggaggcttactggggaggtggaggtgaggctgcctgcatactggcatcctgatcttttgagtgaattgactctaaaaatgggaaagatgggtggaaataaaaggaagaagttaagtgctttctttttccttggagaaaggcaagaggtactgacttgtcctggctatagcttcagtcaacagtgatcaccttagatgtgaaattttctcacctgcactggagtttgtacatttgacaattttgaattggggggtagggtaagaggacctagggcttgtctgaattctggaggatagctttaggtcagccttctgttttgggtcttagtttctggcagaaagaccccatgccttggaactgtgtcttagacgggtttaagtgctggctgcttttacttgccagcacgcatgattaacccatgtaggaggagctggaaggagcttccacagttgctggtgggtttatctttgtagggagttccctcttcctcctcattcctcgctccacacctccctctccctgggatgtctcctccaccatccttgttacagagccatcgaattttatgag

SEQ ID NO: 99179 - DNA, 1060 bp, Homo sapiens
tttagctatactggggtaaaagtgctctaggctagggagcagcaagagcaaagacccggagacaaaagcttaggagcgattcaggagtagactgggaaaagcatggaggctagcctaggctgagaggctagggtgagtgggagactggtgggagatgtgtgtacttactgtttggtactaagatgagatggattatttgctatcctgaattcttttttcttatctcttgtgattcttggaaagggaaatcagattctggaaatttgggccagcagccagcctccccaacccccttaactcccatccccatccgctaatttggaaaaatttaggatgctcagtatttcaggaaattataatgaattatctttctcaaaagtaaacgttttaaaatgagattgatgataaactgcttgaaagtacttttcaaaagcaattgctttacaagaaggaggctctttggagatttcaggatatttgaaaatgtagggaaattagaaattttcctttcacatttagacacatgattaaggaacataccaggaagaaaggtggaaacaatgtattaactcaaattatccttaatctggttagtaaagaatttttcttaatactgtgctgtccagcccggagactcttcctctaattcatgtgtatatccttcacattttacacgtgtagaactttttgtgctgagttttttattcctccacttttacctttcagactagttgtctagtctgatacttaatagacatatttttttgcaaaaaacattttctgatttccttccagtttatctccatattctttttactgagctttcataaatgtcctctttcattttagttcagctgaggaattttaatattttggttttgaaatgcttttgctggtgagatgcatatgtgaaaaacactttggagtaggtttgcctcaaaatcatgagaagatggaaattacaaggtcagtgtgtgaatgcaactccttggctaaaagggaggcatagtgatggtagtgatgaggtagtgttttaactaattgcctttcttcctcttgt

SEQ ID NO: 99180 - DNA, 1252 bp, Homo sapiens
aaaccccatggtggtcttcatttgacagcttcataagaatcacttaggacttttgttaaaaaatatagttttcagtcccactgtagaactactgagactttctagatgttagggaacctagtttataaatacaccaggtgatctactcttttaaccaggtttggaagccattttctgcaaagtatatttatgatgaaagattgtacttttaaagtttcctaagaggttgctgggtgatttatattaatatttttattatttacagcgttaaaaggatctgaacaaagtctgctcaaatctcctgctgtgaaccagcagaatttttgaacaggtaagtgtggaagggaagcacaaagcctgagggcttttgcaaataggtaatttctgcttttaggttttagttatttttgccctattatttctcctgaggttttgggtagtgagaagaaacttcttccctggtgcctgtcagatcctttatgaacagtaagagtaacataccctttctgcattgaccctggtgtgaatttgtgtcttaaactgtcataataattttttgttggcaagaaacaaggaggaatgctttggaggcaggagtactgtaaagaaccaaagagcagttgacttcatgagggacatgaaccagaaactgggaagctttcaggagccatagtacttgtagatagcacttttttaccagctggccagtgtcctctcttgtctctttttgtcctgctttaattgtatttgtgcagtctggccttttctgctttaacaaacacaaactcatggtagcaaatggccacttaattcttggagccacatatgaacttaggctctagtgccagtagccaattgatgctagcacagtgttcacatttcatattcttgggagggggaaatttggctggttgaacttggttcggttctttgtcattgatcacattagttatggacatagggttggagtctagaagtgcaagcacagttagctgaaaggtcccactcctaatggtgggggcaggtctcagagaaggtagaatggtgactattctaggtggactcccagagaagcttctggacatttttccttttctagcattctaggaaaatgtcctgtgtatagctctgcagtttcgatttatctgttctaaagagttaacgtacatgcctatctatcttttggtgaacgaggccagtaggtctcaccaagcattcttgttgaaatttattagtgctgttttttgtttgt

SEQ ID NO: 99181 - DNA, 1044 bp, Homo sapiens
gttcctacctctctcactagcttcatcttaaactgtgcctccttaccccagattaacatagaaaggtggggagtcagaatataagggttgatttattcatttcactttgcctgctatattattgttttaagtaggaatttcaaaatctcatttttgtgactctagttgagaggagcataaataaaacactctctaactgtactttctggcctggaattccacatttaatctcaactaatagtatggagatatttttctcgttaacaggtttcttcacatataaaaatctattgtaaaaatacggaaaagaatggcagcggaaacgcagacactgaactttgggcctgaatggtgagttttcaaaatctcatcttctttgatattggatgactaatacagtagtaaagtatttgacaggtgctaggtggtttataaatgtgcatgtttttgaaacttttgctttatgtgcctcgctgaaaacaatgtgttagttcaggaataaattatatttggtaaatgagtgtattctatacttaattaaaattttttttctttgtctggttatatatgtaatgatggcgggagtcccacccgccctagaaaattattttctttttatttgagtcgttgtctaggtgcacatacaattttatgtaagtataattataacatttttatgtctgtatgttttctgctacattgttttatcattgctgttcatagattgatttgagaaatagttttcattgaagtattatttgaaagatgggctaggcaggtagttcagtattatactggctgttaacagtagcctatctaggattcagttagcattggacataataacgattaattgacctttgagtctcttacagatgtgtttggaccccgaatatggaattctcatggaattttgagatccatcacattgtagtgtggcttccccccctcccctccttcctttttccccaaagttggtgattgaagatcctctcttcagtggcatcaataataataattactttttctattcaaacctcgggc

SEQ ID NO: 99182 - DNA, 3112 bp, Homo sapiens
aaatcactatttgaagttctaagaaccgatggaactcctgtattttgagagtttatttagaacatgttaacctaagtaatgctgtacttgttttagttattcctttatatttttaaaatgattttcttagtatcaaattaatatgtttctaaaaaaattagaaataactagtaagccagaaataatttcaacatccatggtacacactgtaaataccttggtgtatctttccaggtggttttatgtatgcttatttgtgtatatatacacttattttttacaaaaatgggatcatactgtaccttcagttttgtagcctgcttaaagaaataaccaaatcagaaacatctttttttaatcaataaatattttctgttgtattaaatggttgcattgtatggatgtaccatcatttattcaactagtcttctagatgtgacatatagaagctgttcttgatttttcattataaaaatatttttaatgaacattcttatagttacatctttatttctaccttaattccttttatcaggtggatttaaattcatataagttactttcttagccattttttgtgcaactcatccgcctttatctagaatttgtaactgcttctcttttatatttacataccctcatgtctgtttctttataaaaacatggtttaaattgtcagctaatttaaggaagttgtttttttcagcatcctgctgtttataggtaacagaaagggaacaccaggaatttagacacaacaacagagaaaagaaaaactgatgatattttagaatcaatacacatttagcttgatgcctaatattatgggttggcaaactatggcctgtgggactgtaaagtttttgtaagtaaagtttcattgaaagacagagacgtccatttgcttccatattttctgactgctttcatgctacagtggcagggttgacaggccatttggttcacagagcctaaacattaattctctggccctttggagagacagtttgctggcccctgccctacaccatgagttctcaaggtcatctcagtgtagtattgagcatctttcaatagtatcttacacatcctcctttttattgatactctgaagttttgtttgatggtatttcacttgattggctcagtgttttgtataaaatttgaattgaggtagccttaaacagagggcaatcaccatttccatccttaaacagtagcctcacctaattgtacatctgtacaattgcagacattagagcttaggagcattcccttagtcatctgaaatgctgatgcactgaggaatgcaggtgtaagtaggcatagtgccctatttgtatcatctgtcaaaattccttctggcaaagggagtatatgaggcccttaagtaacccaagtaatcctgagctggaaagttgcagtaggagtagagagtactacctaatttttcttcacgtatgacgttctttgtgaaacttgaggtaaagagctgtgcccagggtacttgagaatcaggatttagattgttaacatcgaaccagtgtgcaattaactctaaatgagacagaagcactaagtgatacggtgtttattaaggtcatcatttttgtgaataatgtaaaacatgttcaataagggatacttaaaaatgaagcaatttatttgtatctggggacaattgtgaagatgggagaaaattgaaaattttggtaggaacagaccatgagtggctgtaagctttaactttttttttttttttttttttttgagatggagtcagcctcgctctgtcgcccaggctggagtgcagtggcatgatctcagctcactgcaacctctgcctccagggttcaagtgattcttctccctcaacctcctgagtagctgagattacaggcacccaccaccacgcccagctgatttttataattttagtagagacggggtttcaccatgttggccaggctggtctcgaactcctgacctcaggtgatccgtctaccttgtcctcccaaagtgctgggagtgcaagcatgagccactgcgcccggccaaggcttgaactttttaaggtctgtggaatcattaggtcttagattatttttctacttagaataaaaaagtatattgcattatcatcagagcagtttaaaagggtatgatacattcaatgccaagtatatcctgtctacatataaagcaatagtgtctttctttaagcctttcctcaaatgctgccaccttagacctttcctgacaatctatataaccctccaccctttactccctatctctcttccttgcttaatttttcttcatgttgtgtatcaaaatgtaacatgacaaatattttacatatttattttattgtctatatcctgtctttcaacccccactagactgtgagctccattgagggcaggtactttgatatagatttttgtacagtttgtttactgctgtatctccagtgcctggcacataggtactgaataaatatttattaaatggatgaatgaattgttggaaagtaaagttgtttttaatgttttgctattgtaaatgatatgtatatatacccttgaacaattttgtttttatcactgatcattttatttggattaatttcttggaagtggaattattaaatcaaaagttttatttttaaggctttggatgatatatggacagtttgaccactagaaggattttatgaattgaattgtcatctcctgtgtgtttgctcttgacaaaacactaagcaccgtcttgataatttttttggtgctaaactccttagatttaggtcttttagagtttttttgttgttagtttcattaacaaaataaacacacttattctagaaaatctggaggaaacagtacaagaggaaaaagaaaagggttaggtatgggctgggcgtggtggctcatgcctgtaatcccagcactttgggaggccgaggtgggcagatcacctgaggtcaggagtttgagaccagcctggccaacatgatgaaaccccacctctactaaaaatacaaagttagccgggcgtggtggattgtgcctgtaattctagctactcaagaggctgagacaggagaatc

SEQ ID NO: 99183 - DNA, 1216 bp, Homo sapiens
aaaaatctattcagtcgagtgtggtggcatgcacctgtagtcccagctactgagagtctgaggctggaggattgctcgggcctaggcatttgagaccaacctgggacaacatagtgagaacccgtctttagaaacaaaaaacaaaaagaagactacccagataagtctagataaggactttattatagggagaataattatagacattacctggctttctgggaaggagccaagaaagctcctttgggagtttcctctgtctcatctccttggtcttaaggaagttttcccaggtctttccttgcaaagaagagggaagtacttgttttcttccccaaagtattttatttatacatttgttaaaatagttatggccttgtggtgtatctgtatatatatttgcgccttgcccaagaagagctaattccattaagaaatgcactgtatttctctcttttggtaagcccattgttgagcttagtgtactggacattggcattaatatttagttaactaatttagttaataaatgaatgttgaatgaagccattagggtcttatgggagacgggtaagagaatgcaaacctgagattgatagcttcctatcgataattatgggattatgtgaaaaaggagagaagttctggaggatgagatgtgttaatatttccagttttcagaaagggtaaaatatttctatgtaaactgaaggagtagtaaattagatgtttttgaggggtgtattttggaagcaaatatttgttcagaaaacattttatcaaatgcttgctgtgttttatgtcttgggttaggtgctaaggcaataaggataaaaatacatggtacctactctttaatggggaagctgacactaaataatttcactttgtcataatgctgtaaaggaattataatgcaagcacgggatattcagctgcctatctgatttttccacttagatgtcttataagcatctcatactctatacttttccaaaactgatctcgttagttttgcctttatatttatttcatcttaatagtatatgtgcctgtttgctcaagctagcagtctcagagttatctttgataattccttttacttctctgttcctatatcgggtctgtcacaacatgtcaattttatctctacagtatctctggaatctgttcatttctctgaatctctattgctatcaccttagtgaaagttgcc

SEQ ID NO: 99184 - DNA, 1986 bp, Homo sapiens
ggttagggttttgggcatattgaacctgatgggctttacatggttgtgtatgaaagcctgactataggagaggtcacagctggacttgagaatcacaagcttacatagaagtgccttttgactcccacaccttcacacattgtttattgactatccaaattgctttcataagctgaagtttggattttggacaacacttaccaagcgaagattttgggagtatcatggggctttggggggcctgctgctgccacttatttactacccatggtagaattggcagtgttgaggttattgatgaacagtgcaggagctagtggagtggcaggagaaaccaggcacactgcgttttgaagtgactgagaagcgaggaagtagagatgtttctagatgaagaggaaagatgaacagtgcatagctagaagggaaatggctgtatcaaaagttttaaacaaatgaggagatatgtttagagacagacgaaagcacatagggattaaatttctagaagagagggttgtatggaggagataaagatcatatgtggatttttttaacttttaggttcgggggtacatgtgaaggttatgtaggtaaacttgtgtcaatgggggtttgttgtacagattatttcatcacccaagtgttacaccgagtacccagtggtttttcgtgctcctctccctcctcctgccttccacccccaagtagaccccagtgtctatcattcccttctttgtgttcatgagttctcaggtggatttttagtgaagaatattacccaaatatgttttagcttttctaagtatctgcaggtgaagagggacttggaattgaatttgtcgattattgaatcatagtacagccattatcctaactcaggcaactgtcttttagtttgagttactgccagtttgcctcagtttcttttcatagcacctgaaggaaatctctgattgtgttattgtgttatttttgtattttttattttttggagacagagtctcactctcagccaaggtggaatgcagtgttgcgatcatggctcactgcagcctctacctcctgaggctcaagcgatcttcccacctcagccttccaaatagctgggactacaggcgtgcaccaccatgctctgctaattttttttatttttggagagacaggatctcactgtgttgcctggactggtctcaaactcctggtctcaagtgatccacctgcctcaacctcccaaagtgctgggattacaagcatgggctactgcacctggcctgtgttactcttaataaatctggtgactataagaaatgtttagtcttgggcattggaaaaccattggtgatccattggaagggacagggtggtgaatacatttgaaatcttattgtgagcagcaattgaagaaattaggaatgttaggccatgagaaggagtctttggggagacatggtgattatttgccaataccagaatgattttcatttgaaagagtgcttagatgtgtactccagtggtagaaactgttgggaaacatgttggtttggtgttaaggaagatattttaaaacaagttctaataaaatatatgtatattttaaactggctattttaaataggattttgagacctaattgttggaaagattgtgtttttttttctttctttctttctttctttttttttttgagacagggtcttgctttgtcacctaggctggagtgcagtggctgttcactgcagccttgacctcccaggctcgagcagtcctcccacctcagcctcctgagtagctgggaccagaggcatgagccaccatacctggctaatttttgtattttttgtcaagatggggtttcatcgtgttgcccaggctggtcttgaactcttgtactgaagtgatccacactccttagcttcccaagtgttgggattacaagtgtgagctaacctgcaaccggtcaattgtggtctttttagtaataaa

SEQ ID NO: 99185 - DNA, 1997 bp, Homo sapiens
catcctcataggtctgctttcttctatttcttggtatgttgatgcttattagttgactagattttgctgtagtatctgtagcttttgagtattatttggaaacgtttgtagatccttaaggacattgggaaccatcctttaaaacttactcaagtagagaggaagagtgattcttggggaggggagaaaatcatctttgcaaataaacagattttcagaagtaattgccaacctgaattcttaccggtgcattttaccactaagggaaaaatgtagatcttcagttcaaaatgcattcaaaactcttctgtcaccaatgtgtgtgtgtgtgtgtctgtgtgtgtgtgagagagagagtgatgtgagaaagtaaaacttgtgggctggaaagtagcgaatttagtgttgttcctgtttatagtgtattttgttctgtgcaaagaaaataaaagagtttctgatttcaaggaacttatgataactgtagaaaaatggaaaaataagccttgttggaaagcttgaatgttactttatgggcatccatacgggaagaagagaatccagggagccaaaaatacatctttttgactcttaaggaaaaggtaaagcaagaagtaataaaaatcttttcaaatactctatgaaatattaaaatcctgggcattggaaagagaatttttcaagagggttttaaactatgaaattttgaacgacaaaaatgttggggccagacgcatgactcacacctgtaatcccagcgctttgggaggccgaggtgggcggatcacctgaggtcaggagttcgagactagcctggccaacatggtgaaaccctatctctactaaaaataaaaaaattagccgagcatggtgacacacggttgtaatcccagctacttgggaggctgaggcaggagaatcgcttgaactcgggagacagagattgcagtgagctgagattgcatcactgcactccagcctgggcaaagagtgagactccattaaaaaaaaaaaagaaacaaaatgttggcatatgtcctttacttgaataccttctgtacacttggtacaaaaatgcagaagtgtgatacacagaggaaaatgcaccttggacatggctgtagccaaaggtcttcctggcagaggggtaaaaactgagccctaggaattagggtaaaaaagaatcctgcaattcaactaatattttaatcctttccatgccagctgctccctttcccagaggccgcaagtgttagcaatttcttatgtatttttccaagtaaatatggaaatatattttccgccttttaatacaagtgatacggttctgtacttccaacatcaagtatttttattgaaagacttccctgaagatttggaaaaattttttcccatcgtttttgtttgcatttctttgcctgtagcagtaaacagttgtttttcagatgtttattcatcatttatatttctgttaatttttttcttgcctttgccaatttttcttttgggatattcatcttttccttgttgatttatgctatttatatgagctctgtgtgtgtgtgtgtgtgtgtgtgtgtgtatgtttgtgtgtgtgtgtattttttgtttacttatttagattttctattttgagctaggttctcactctgtcatccaggctggagtatagtgagggtctcactctgtcacccaggctgtagtacagcggcatgatcatagctcactacaaccttgaacttctgggctcaagggattctcctgtctcagcctcctgcatagctgggagtacaggtgcatgccactgcatttggctagtttcgttttttgtagagacaggatctcgctctgttatctaggctggtgttgaactcctggcctcaagcgattctcctacctcagcctctcaaagtgctgggcttacaggcatgatccaccatgcctggtctggctcctcatattttaaagtcattgaccatagctgtgcccagtaagtt

SEQ ID NO: 99186 - DNA, 1696 bp, Homo sapiens
tacttggagttgctaattcacattgatgtgcagaatgtcctactctcgcatcagaccttttggtaactccctttcatttccacttttcaccagttaaaggcttacaggaccctttcaaaccagatctcttttgtaaaattttctgtatttattctgttatgtattttccctatctacttgtgtatatatagagtgtttagtttgtttgcttatttcctcaccaaacctagcatagtgtaagacattggttgtcaattttgttgatctgaaatgttaatttgcaattatcaggtaaaatcaagttttggatcatttcgtatgttgtgcagttatggttttccattgctagtagtaattagatgcctttttatagatgcagtaggaatgtggggagaagcaacatgtagttttatctgtttcatccatttttttctttctttttttcctttttctcttttttttttttttttttttggcagagaaacttttccatgtctgtaaatagtgctgctgtcctgcgattgacaggacgaggaggaggaggaacagtggtgggggctcctagaggtcgaagttcttcaagagggcgaggtgagctttcatatgaaaaaagtaataatggaggaggaggaggaggatagagaacttacttttaaaatattttaatgcctgatttaataaaaactgttctttgacattaactgcatactaaatgtcctgaatatttatattcagaaccattttttagaggtatctcctctataatccctgatttggagcagaagagtataattctagctgtacagatttgaacatgagggagtctagacagtcccaattcactccaacagatccatgttcctcatccctggagagccttacactctgggagccaacgactcctgaagtgtcttaactatggaagcagcactgaagtacctgcagtcctctgtgacagtttctgtgtgaggggcgtgtgccaagagcttctccagccagagaggggctttaacaaaaactgcctcatcaggactaggacatttaggggtagaaaaaaagataattctgccacattcatttatttaacctatagttttacatatttttgtcttggaaaaatagttcttattttgatattacttgtttctttgatatctgccccctattttgggtttgctgattttctcctatatgacgacattcttaaatatttgtaatatgaatatttgcttaatcatgtagctcttacgttgactaaatcataacagtggtctaaatacaccttgtgattttctgtaagagatgctttagaaatggaagaattggatgtctgcaatgagtgagaccattgtctctgcatattgtaccaccaagattggcatgatcatgagtatagagtatttaaattctttataaatagagtaatttatctacagtctctctagaaaatgcattcaattgtgcattcctgggaagagatttcttttagtagtccactcagaatgtgggaatccaggtgtgaagtgtctgattaaaagtctccacttgttttgctaggtactattacatagttgtgtttttccctctggctttatttgtccatctttagagaatatttttttttttaacctgaggagatgttagactaatctgtaaaacttaaaggaaatacctgtgcaacaaaattttgggtggt

SEQ ID NO: 99187 - DNA, 1374 bp, Homo sapiens
ctaactctttttctagtgtagatagcatctcacagatgagaagaaatagggcaaatgctaaaatctttgcttttgtatcagagaacaaaggccaaaactatgaatgttcttaatttactaatttattcatttggcctttttgctgtatagtccttttttttttttcttgttttgtgatgagaacaaaaaaaaaaataactcagataaattgcagttaaggtagccactgaagaggaacataataaaggaacaggattccattgtttatgatgaattaatcataatttgtatttaaatttgtatttaaatacataatttatatttaaagaatttatactgttaagatgagcttcctagctgattaaaggtactaccttacaaactaccagtaggtattaacatctgaggagaaaataatgccaattcatggtaccatgaattggtactatgaaaattattacaagttccaagtcctacaagtgctaaaaaagttctccagagcatgattataactgatagtgttaatcatgtctttttttttttgtttttttttttgtttttttttgagacagagtctcagaggctggagactctgtcacccaggctggagtgcaatggtgtggtctcggctcactgcaacctatgcctcccgggttcaagtgaatctcctgcctcagtctcccgagtagttgggactacaggtgcgtgccaccacacctggctaatttttgtatttttagttgagatggggtttcactatgttggccaggctgatcttgaactcctgacctcgtgatccacccgcctcagcctcccaaaatgctggaattacaggcatgagccactgtaccgggcagtggtaaatatttcttataaacaaatgttaaatatgtaaataccattcacagactgacttgcagattgttttaaaaactaagtaattttaacagtcagctttgtatcactgtttctgttaaaaacttaaagatatcaataattaaaatttctcatttatgaatgtggcattgggaatacgtagttatatttatattaatgaaaaccgttaaggccaggtgtggtagctcatgcctataatcccagtgctttgggaggccaaggcaggacagcctgggagacatggtgaaaccatgtctctacaaaaaagtacaaaaattagacctgcatgatggtatgtgcctgtagtcccagctacttgggaggccatcatgtgatgggaggatagcttgagcccaagaagtcgaggctgcagtgagccgtgatcacaccattgcactctctagcccaggtgacagagtgagaccctgtcaaaaaaaaaattaaaggtgtgtagcatgaggaaattgggaacagact

SEQ ID NO: 99188 - DNA, 1011 bp, Homo sapiens
tactaaagtgtcctcagtgagtcaggtgataggcccattgtcttttatgttgtcacaggcaagcctaagcattgtgttcacttctgggaccaccccttgaaagggtccacacatttgagtaggagggctggggcatttgaagccttgcgatgggaactgtgtgaaggaaatggagctgtttagataggagacaagattgtggacagggcagagtggggaggagggcttatagggtcactctctatcaatacctgcctactaatcatgatcatgtgaggtgaggacttagacttgatctgtatgtttctaaagggcagaaaagggctaactgttggaaggttcaagggggcaggtattggacacaatcttaaaagatctaattattagaattgtctgaaaatggcttgggttgccttgggaaagtagtgagttgatagaacaatagcctggttttaactgttcacacatattcacactttggtggtttggaatagtcaagtttagtcgttgttatttgtggttttcatattttaactatattaatccaatgagggtaattttcttagccaccctctattaaaggtaaaggttcttttatttacatcccattggtatatctttgaaaaggcaggttccataaaactaaactaacatgaagtatctcagaatattaaggatactaacttctagttagtatctactattatataactgctagtatactaaaatatcatggtaatttccacatacatacatattctaatatgtcatagtcactttgattgaatgctttttgaaaagatgctcacttcaggttaactgctaaagattctgagcttttactttttggaagtaatccacttttgttgacgataatgtaggtctttaaaaaacattgttcataattatatcttacactctccaagagtagcaatactaaactagtttgttcaggcacactgatacattgatcagtatgaggtcaatatgagtatattgtgagatatccta

SEQ ID NO: 99189 - DNA, 1121 bp, Homo sapiens
ataatatgaaactcatctgacttaaatggaaccttagatctcaggttttactcattcacttatgtcaccttgggcagcttcacttaacaagcgagagggtgaactgtgtaagtgatgtagtgcctttaggaaaaaacataccatgtaagtcttcaatactactttattttcaaaggttaggtgaatcttgttaatttattatagaaataagaattcttgctgtctttatgtgttacaatagtcttgggttgggaaaatctgttggtctgatttctacttaagaatgaatgtctaagattttcaaacagcaaaagttcacaataattaagtttctgtgttcttgatattcttctgctattatcagtcttagaccactccagagttcttctttattttcttttccttttggtcaaatagtagaaaaatgtgacttgctgctgagccctgctcttcacacctgcttgcctttactcagctagtatttatttcaagagatgattcctgcctaggtcatcaccagtggggaaggttaatctttcatttttcccacagaaacctgaataagggaaatttcagaaaagaacagccacaaatctgtttgaaacctgatagggtgacttttttggtttttgttttgttttaaggacagtttctcttttttttattgaaatgaaaatcatgcaaatgatcatcttaaactggacataagggaaagggctcattttagcatagataaaataaaaaacagaggaaacataatttttatagactattagatttagaaagaaataatagagttcatctagtccaacctcctactggtgaataaacactgattttgtgtttatagaaaaaactatttgaagttggaaacaggaatttgagtttgaaaatgctttgttgcctaattatcttttgctttatctactgtagatttttttccctactcactcaagttatatctaagtaaagctttatatctataaagacttaaatatatttttgtatttatgaattagagccatcatgatgttttatatgatcaaatgaatcatacataggaggggaatgtttttacttaggttgctagaagtcatttagatgaatcaccgtttgattat

SEQ ID NO: 99190 - DNA, 1327 bp, Homo sapiens
tttagaggtttgtagttctaatgtatgctttataattagcctattcagagtttgatttattgatttgtatttttagagacagggtcttgctctgtctcctaggctggagtgcagtggcacaatcatagctcactgcaacctcagcaaatttttagaattttaatttttgttggtactgggctcaatatattgcctaggctggtctcagactcctgttctcaagccatcttcccacttcagccttccaaagcgctgggattacaggggtgagccaccatacctggtcttatttagagttttatgattaggctttatttgtttttgtcactttgcaaccatgttcgtggattctttctgtcctggatgatggattgctatctctttgcatattctaggctctgattagattggggggtagaaagagaattgtttcttggcaaaataagaaattccaggaagacatttctggatagcattagctttaaaagtaagtaaactagaagaaaaaggttgaatagttcaatgaactaaaataatcattaaggggttaaataagaattttaaaaagataacattagtataattagttttctgctgcaaacagttttcatcagtggttatccttttctcaaggtggtgagtagaaatctaatgtgtgccttccttgtaatcatccttgcgtatgacaaaggtgtcttaagactttagtgtagcagttactaggaacagaacaggaaatgcagctttgcttcccttgagtgagcctctcttgtttgctacaattcaggactatgagtttatatttgactgtcctctttgcttcttcctttagaggtagatacccttgagagtgctgcatacccacttcctgccttttaatggggcttgagaagggcactacagacttgtggagctaggttgttgcttgggtttcctagttcctatatctcgggactttgaggctttggagactgcctttctgtgttgttggaattggatattggccacctgggtatatacaactttcttttgctctgaggtaacttaacatttattggtgattagagacttttttttgtattttcttcagatttgagctaatggaacactgggatgattgttcagtttatttaggttagatggcgatttcagtttcatatgatatagactttaaaaaatcttagtgcattattttaatgttttataacttattaccctaacaagttgtcataatcatttagtgtattcttttttcttggcatagctacttaatgacccttattttgttagattatttttaaatgttttaggagacctgatctctacg

SEQ ID NO: 99191 - DNA, 1085 bp, Homo sapiens
gttacatagctgtgtcattttgggcaaaccactcaatcccattggcctggcatccttagattaaaacaaagaaagtgaaaaaagagggaattatgataataagatttcttaaagctctacagacttatgtaaacaaacatatttccacttcctacaaaggatacaagtttcctatatgatttcttttatttctgtatagtttgatgtctgctcgtatggtttaaaaaattatactattgttacctgatatttaagtctcatcagctgatcccaatagaaagtgaggtggaaggttgggaaggtttgcttctattgctgtgtgtgggctgtaaaatatttgcccatttataaattatttggaggaaaaatagtacctattaaaaaatgataggcagcttcactgatcatcagaattcattctactcattgggttgtagcacttaaaagtatgtattttctgttgccatgataaaaaatagtatagttcatactgaggagttaagataaaggctataactaacaaacattaaatgaagatggcattactatgtatttgttcatgtctggtgtaaatactttaagactatattgaaagtcttataatgatttctcctgccctccacaattagggcaaacactattgagttctaaccctgttatataagctcagagattctattttaatttctcagttgcagaagtatctattaatttccgcaataattccatgcttaaaaatttacgattaggatactcatcactttcttcttagattacagaagtaaaaacaaagtggcttattcttttggcatttgtttttttatgctcattttgggtttttgaaattccttccaaaagaaaaagactttttttttcctcaagccactgaattttttttcctaaggcctttatcctctactgatatattgtaatagaaaattagtatacatttaataaaacagttaagaaaatttccagtaatacattcaatatggctgttattgcatttttaagatttaagggaaaagaatatagaaaccttactatcctacactatagataatgtctttgttttaaaaatctgt

SEQ ID NO: 99192 - DNA, 1029 bp, Homo sapiens
gaaggggtgcattttttccctctaatcaggaccggtctttagtaagtttgcataatcttacttaagagtttttttgaaagttcaaagggataaaattccctgcaagatttttcagccgtctttccttatatagcatgttgaagtgtgagatatttcctttactaatctttttttttttccaccatgtctttggggaagatttatttggataaggacttataggcataaattaatgcattgattttcttagttttcttctcatgtctcatcagaatggctaccattagttccagaactagtaatatagataattacgtgaaatcttttatttttttggttaggaaacaaactttttttttttaaaggctgtatacaaagaccttgaataggaataaaattaattgttctgtacctgatactttaaaaaatgcacacctgtgggaaagaaccgaagaattttcttaaggcttattttaatgatgtttagaagatgttttcctgatcagtgtgatgaagtatagtgttaataaaacatagtgtacagtgtacagaaaatgtaacacaacattgaaatagtgtttagctggaaaatgtgatccagcttgttggaaccctgaaacgtgctgtggtatggctttgtgcagtgccttagtgaacagtacttttctcctcctccgttagctgctgattttaaaactttgaccaaatgtcacatgtaagaggatctgagaaacaaagactgtgattgttcaaagtaaaatcttggaaggcctgctgggaaaattattaatgtagaccaatataatgctacttagaaagtgaaatccgcctttgtagaatcctctccgtcccccccccgccccacaatttaaaaaatatattaattccttctttgttttattagtaccaaatacttcaacacaagttcagacacagcattagaaacactgaccttcagaactagggaaggtaaagtataaagaaggatttgtggtgtgatgctcattccctgcatgtactggtaggaat

SEQ ID NO: 99193 - DNA, 1509 bp, Homo sapiens
gatgcctagtctctttccatttccacatgtccaagccaactacgaattgccttcccacagatttcaggcagcctctgggtatgtaccagcagacagctgagcatgagggctgtagggttgtggtacatattcagatggcctgaggacctttttcagagattctgatacactgcagtttctccagtctctgctgttttttcaggactcttgttaaccagctgagcaggttatttattcctcagggagaaagtcgtaactctctgggtacagaagttaaactgctctgtcctagccaccctgagttttgtttataagtaattgtaggggagaggggtggtaaatatcaacacttgagtgggatgccctttcaccattttctttggtgttagatttttttttggtgttgatcagataatatatatctgaacagagtaatacaaagtcactccttaaaaaatttgcacataaacaagcttcaaagtctgtcccataattccacttttgcttgtggagcttgtggagattgggcacttgtaagctccaagtctcacagctgtagattttgttggctgagtgcctctttgctccatctgaagttttccataaacactatttttggccgtgggtcaaacatgcacacaggtgcccttttactgctctttctccttaggaagtccactcagttagaccaggcaaaaactaacactgcattttaatttaatttaatttttagatgaatcctatttggacttaataaactaagattgaaacaaccaagtatttattgccactggggaaattgtatatgtagtacgtatgtattttagcacctttacataatttgcttttaacgtaaggacataaaatatatcgttttcctcatagtcatgtttgctatattgaatggaaaaaaatacatttaaaatttgtgtttctttgccttttgagggtcacagacacctttaaaattctgacgaaagctgtagacccttttccctgaaagaagaagaaagcatgccagcacaaagtgcatgtccagtgcaaggattcacagccctgagctcattcattgactgtagattaagaatatttggttcaggcatgagtttgtaaataattcaataaggtttactttaaaatcatcttgtttgtaaatctgttaagattttaaaagtaagtcaactgaaatacagtatttggttagtcaactttgtcatggtgctgacgttacagaaggaggaagcctttgattttgaatgctgagaagggccatgtaactgtctctcactcattttagtctccgttgctatgaattgttggaatttttagacgtgaagggaacttagatgtcatcttctaaactgcccatgaatgactttaatatttattatttatttatgtttattttattattattatttttggagacggagtcttgctgtgttgcccaggctggagtgcagtggcacaatctcggctcactgcaacctccacctcccgggttcaagt

SEQ ID NO: 99194 - DNA, 1717 bp, Homo sapiens
caacatgcctgacctgttatttattttaaattatatcaggaatacacacacacacacacacacacacacacacacacaacttataaagataatggtctccttggcactcccacccacccacccatccaaatttacacaagtaaatctgtaatcaatttggttagaagggatttattttaatatttttggggattgcttagatgcagtataatttttagttatattagtagtaattggaaatgtgtatttttgtgactgaagtcaccttctaaataatttctagaataaaatttttatattgaagaagttggtcttaaccatttttttttcaggagcatgcattttgaaatcattctgtgggaagatgaaaacaaatttagttctatgtctcccctttttagagatgttgacactttccttaaatgtaccatgcatgatttgtctaccacccttttagcttgttatacttaaatcccagatctctgtcttcccatttcagtttctctagaatttctggctgcttccaatgggtcaaatttatgagtgaaccattaagaatcacttagtgtagaaataaaccatgggttaggagtttgaacactgcctaggttctgtttctgatttgattatgactcagctgtgtggccttgggaaaccaccttactggtatccctatccttgcagaagcaagagagttaatgatggttgacttaatctcttgtggttattatgaagatcagataagatacattaacacattttgccaactgaataaggttatttatttacatgtgtgtccatggacctggggatcaggtgctatgtctcagccttatctttgtttttaatcctgtgtctctaattgtgtttgtcagtaaaggagtgagtcatttaatggttgctagatgtttgagtaaaacaaacaagcaaacaaatggtaaattagtactatttctttttaaaaaatttttttttacattttaaaaattatagataaatacagagatgaggtctcaccatgttgcccagtctggtttcaaactcctaaactcaagtgatcctctctcctcagcctcccaaagtgctaggattacaggcgtgagccaccatgcctggccagtagtactatttctttgggaaaatatttagtagtagtcaacaaagttgagcatactgtgacctggcagttttgatgctaagtatatacccaacagaaatgcaaacatatacttaccaaaactcatgtccaagaatattcgtagaagcacaattcttatgatagcaaaaaggtagaaaacaacctaaatgtttctaagcagtagcataagagtaataccgtgtggtttgtttatacagtgagatcctgtacagccatgtaaaagaccaaaatattccctgtaacaatgagaatgaatctcctgtgcttgcttcggcagcacatacactaaaattggaacgatacagagattagcatggcccctgtgcaaggagaatgaatcttcgtaatgttcagcaaaagaagccagatataaatgaatattccattttataaaaaagtttaaaagcaggcaaagctaatatttggggctagaaattaggatagtgtttatcttgggaagggctgattgggaggacgcatgaagatttttgaggctccttaaaatctttttttaaaaatctaggtggtagttaaattatatgtatttgctttatgaaa

SEQ ID NO: 99195 - DNA, 1027 bp, Homo sapiens
ggtggcgtttgtgtgtgtggatgagggagctatgtatacatgtgtaagtgtacccatggacagtgtttggaaagactttataagaaacttggtgatggttccttctggggagtacgactctgagggtcttgtgtaggaagatggacttttcattgtacgctttttcaaaaaaaattttacataatatttttgtttaaaaaaattgcccagtctctgaacatggctttaagaaatgtgtctaataatatatacatatacccactgttattttagtgatttttttctgaatattgaaatggacccatttgcaggaaagcttgatttgagctgtgaagtttgttttcaaagcctatactggcagaggctcatgtttacttaccatattattttctttatagggagaccaaattttgaggaaggtggaccaacatcagtagggagaaagcatgaatttatacgctcagaaagtgaaaattggcgcatctttagagaggaacaaaatggagaagatgaagatggaggttggcgactagctggatcaaggagggatggagagaggtggcgacctcacagtcctggtaagaattctgttgagtaaaggcacacagggactgaaataagggaaagtttgatggaaatagggattaaatgaaaaagataaactggcttaaaaaatgtgggggtggattcatattatttatgctgtcacagttttattactagaaaaaattgcaacataaaaatttcctacatctattcagttgattgaaatcacttttctatttttctggggcaaatagtgtagtttaatgggaagcacctgcgctcaactgcagaaatgagggtttcattcagttttgtctacctctaaatctctgaatcttttttagcattctttaagatttataaatgtgtaaaaattacacacttgaaatatgtgcttccctccccaacaatgagtgtttttcctaacaagaaagggtttattctttcattttttcccttttgaaaatgtgatttaacctta

SEQ ID NO: 99196 - DNA, 1784 bp, Homo sapiens
agaaagaaaatgctttaagattgggcaaaaggaaggtgtaaacttcagtatggaaggatgtctagtgcattaagtctggatgaggagttggcggctaatcagtattttaatcaagtacctaggacttactgaaagtgcgtacttggaatacagtgtcctttaaatgtactgcattttagatttatcttttaaagctttagagtatgttgcctggctcagtacttaagtactgttgtcatctcgtaatggtacatatactctgaactctgaacttcatttagttgcctaatgttctctttactaggtcagtccatttgagtttgcggtcacttgtagttttctcctttattttctattcctgattttcttattcaaatactgtcataaaacttttctaaggtttgtgtcctccttctcatctcagatggccctcgttctgcaggctggcgggaacacatggaacgacgtcggaggtttgagtttgattttcgagatagagatgatgaacggggttaccgaagggttcgctctggcagtgggagcatagatgatgacagggatagcttgcccgaatggtgcttagaggatgctgaagaagaaatgggtacatttgactcatctggagcattcctttctctaaaagtaagaaacgtgttttaaatgtcatgaccagcattaaccttataccaaagccaaatctgctgttgatctttggttttattctctttctacagaaagtacagaaagagcctattccagaagagcaggagatggacttccggcctgtggacgaaggggaggagtgctctgactctgagggtagccataatgaagaggccaaagaacccgataagacaaataagaaagaaggagagaaaacagatagagtaggagttggtaaggcctcttcttgccctttgccttttttttcctccatcaaaccaaaactttcgtaagttcaactaagattacttcgtgttccagaagctagtgaggaaactccccagacctcatcatcatctgctagaccaggtactccttcagaccatcagtctcaggaagcatcacagtttgagaggaaagatgaaccaaaaactgagcaaacggaaaaagctgaagaggagactcggatggaaaatagtctaccagccaaagtgcccagcagaggggatggtatgtatttgtgggaatagacaagctaaaataggattctgctgaggccagtgatcactgataagttaggcttctgcttatgcctcctagaactgcttttagtgggtgaattatcggaatagattattttaccagtaaacccagtcaaacagtgcttctcacgtatgtgtccatctcagaattaccaaaacagagttcgaatctgcaagggtggagctctggaatctcatgtcctaaggtgttatgacatagccaccctgtcattactggtgaactgggtgtcatagcctttgcattagtttgattcccgtattagacagttaccttcctttcatgtgttgactaattatgtgcccagcttaaattaccagatgacacaccaaaatgccatttttctaaaagaggacaagtagagaacatatgtgaatctgtggcagaataagcttaaaacatatctctttcagttgttagtgtattggtttaagttgctcatacactttattaggcaatattaatgctcatttccatgtttcttcttgtacgtatttaaaaatgtcattgtaatgcctgacgttgaagggttacttgattcatttaccataaaaattgat

SEQ ID NO: 99197 - DNA, 2449 bp, Homo sapiens
actggttctgaggtgttgacgagaagaagttaagtggagatggcgagagagcagttgtgaatgagggactgtagctagatgggagtagtttagggttagagagagaatgaaaattgaaaagattgcatatacttagtaggggtaagaagaaaagaactttgagtaattcccatttttaaagggtagaagaagaggaaccagagaaaaatcctcagaggtaaaagtagagacaggagagtagagtgcagggaaactaaggaatggggatgttttagcttagaattgagttgataatgtcagatgctactaagagattggatgaggaagactaggaaaagtcattgtatttggcaactttgtgtcactgcttatctttgagagaggagctttactggaaaggtgagagtagaagtccccttatagcaggtgtgagtaaagtggagacagcatgtatagactatccttttaaaaagtatggcaaagaatgagtcagtgagaggagcaggaatttggagaagctatctgtaattgaacaaacaagatttcaaaggggaaactgcgattatacctaattacttccatcccccttttccttcttaagaacctgcacactgagaggttagaaataggaacaaagacagaacctcttttataatttgtattcctattgagaagaacatcctgcactgtacaggtagactccaagtgcttctaattatcctacaacatgtaatatattgaattatattaatcatgacttgaaacaggtacttactgagcataatcattgatattttcagtaaaggttttgatgagagatgacatatctttcagaagatttagggtgcattgttaacttttacaattggagacatgttatgaagaaaggattagactgattgtttctaagaggtcaacctgtaactgggtagatgctctggtgacacaggtaagccctggagaagcaccttttagataccttttaactcttaccttttgtcattctgtgtaggtaattttgtcactctaggaaggaatattacgtttctccatagaagtagcttcactgttcatgacagggctcacgttttctgtttggcccatttagcaggctgtgcgacttgataatgtagttagccttcacagaagtctctgtatttcaaaggattttcatctgattttttccccctagaaatggttgctgatgtccagcagcccctgtcgcagattccttcagatacagcctctcctcttctcatacttccacctcctgttcccaatcctagtcctactctccggccagttgaaacaccagttgtaggtgctcctggtatgggcagtgtttccacagaacctgatgatgaagaaggtctcaaacatttggagcaggtaaaaatcctgttaattctttttgtctcctcttaaactgccgtaagaattagcaggcattgcatgaatattcaaacataaaacttttgtcactagattttaagtactggaaaaactggatatttagtgtttatttgtacaagtcattgtctttcaaatcatttcatgcttataagtttctgctatgtagtagtcattatgtcaggttattttttgctcttaggttgcccttagctatttacttttcttttttctttttggacattaatggaatgccaaaaatggtgaatacaagcagctgtggatggtcactgtatcttttgtattttttgcttcaagtataacagggaaaatagttaaactttcagagcattaacatcttattcatgtctctaaatttccccaagattgtgtgtaccattgttatatgtaaagtaagtgatagcttgcttttctacgaaagaatttctcttccctttggggtgggatggttagtggcaggaaatgctgaagaaaggaaaaagcgagatagtgtcttagtaaaacttgtaaaacgtttcatttataattgtattaattgagccttttgttctattaacattctttttacaggtttagtttataccatttagagttgaccaacagcttattagtttaaaaagtactcttagccaggcaaggaggtgcatgtcctgtagtcctagctgcttggggaggctgaggtaggaggatcgcttgaacccaggagttcaagaacagtctggataacgtgatgagatctcatctctattaaaaacaaacaaagtactcttactagtgttgatttgaaccctgggctttgatccagagcagtgtttgttttaatcttagttgatttgattagtaattttcagaccttgaacaagacttggcatctctgagctttagcatccccctctgtaaaatggggatagtacctgtttcatggcattgttgggagaagttacctgctatgttctttgcatagtgactttcatagatcaagtagtccaaaaaaaaggggcaggcactgttattatgt

SEQ ID NO: 99198 - DNA, 1020 bp, Homo sapiens
attcagaacatttccatctccacagagattcttcaggttgctcttttatagccacctgagcttcccttctaccccaactcctttgttaacctctagcaatgactaatctgttctccagctctgcattttgtcattgcaagaatggaatggaatcacacttttggagattggttctattcactcagcataattctctggagattaatccaggttgttgcatatatcagtagcttgtgtctttttattcctgagtagtattgtgtgatatgaatgttatcaaagtttgtttaaccattcacccattgaaggacatctgggttgttaaagttttggggctataatgaataaagctgctataaacatttatggacatgtttttgagggaacataagtgttcattcctctgggctaaatgcccaggagtgcatttgctgagttgtatggtagttctatgcttagttttaaaagaaactgccaaactgtttcccagagtggctataccatttcatatgcccaccagcaatgtatgagcaatccagtttctccacatccttatcagcatttgatgtttttgctatttttctgttttaaccattctgagaggtgtgtagtgatacctcactggggttttaaatttacattacatttccctaatggctaatgatgttgaacatctttgcatgttcttactggccatctatttgtcctcttcattcaagtttttcttcatgtttcatgtcttttttgttcatgtcctaattggattgtttgcttattttacgttttttttttaattcattttaaatattgttaaaatacacttaaaatttaccatcttagccatttttaaatatatggttcagtggtattaaatactttttcatcttcccaaattggaactgtatacattaaacaatagttcctcatttcctccagtccctggcaattaccattgccagggactggaggaaatctgtttctatgaattttctatctgtttctatgaattttactattccg

SEQ ID NO: 99199 - DNA, 1511 bp, Homo sapiens
tacatattagtcacggaaacacttgattctctttgaaaacacaacccaaatatatcatctaatgaaggaattgtagttctttgaaattaatggaaatggtaagggaaagtctgaatggaagactgaatacttagctataatgatcttttcaaaactcgaataacctgtgcccatcctcttcacaccccagctcctccccaacagggaaacggaatccttcagtagcattccagcagatgtagaatgaagaccaacatcttatcctggcctacctacgaggtcctgcaatgcctggcaccttacctttctaagctcatttcagagcttttacctttatctgctaggcttcaacacagttgacctctttgactttctttgcttcctctagttagaataaacattcccctctcttccacttcatttgcctcttgccttctcattcataaagtttctaaatttgaggtttgccttaaaataaatgttaccagtgcttcacaatatttttagggcttaaaaaaattagttactggtattttaattaaaaaatggaaccatggccgggcacattggctcacttctgtaatcctggtgtgggagggatttgggaggccagagttagaggattgcttgagcccaggagtttaaaatcaccctggacaacgaagtgagacctgtctctacaaatagtaatgaaataataatgataaaaaactagccgggtatggtggcaatcagtggcagagatgggatgatcacttgagcctaggaagttgaggctgcagtgagctgtgattgcaccgctgcactgcagcttgggcaacagagtgagaccctgtctcaaaaaaaaataataaaaggaaccgtaatgctagtagtgatctttctagggctctgacactggggtactgttggcagggaaacccttcttcctcttgggctgctcttggaccctctcagtagtgttccttttggaggtctttcacctgtacctcattttttcttctccaggttggactgtctggtgacgggctgtagttaaaagttaccataaacctttttttttctttttaaagagatggagtctcgccatgttgcccaggtcagtctcaaactcctgggctcaggtggtcctcccaccttggcctttcaaagtgctggattttaggcatgagccactgcacccagccaataaacctttagtgtggacactgcatttctacagtaaagtcaccattgacttattcatcaattgtatattgagggcctgtgccaggcctcgtagtaggttcttaggagatgaagatgagcaagacctagcctctgtagtcaagggagtgtgtaggtgaggaaagtggctttttttccattttgtttcttttaaatgttgatcttaacccagtatttgatttcacaatccactaatgtgttgagacctatagtttgtggagagcagtggtctagaatggaagattcctaggtgagaggaattatttctcacaccatcctagttg

SEQ ID NO: 99200 - DNA, 1925 bp, Homo sapiens
agtcacccagctagtggcgtcttgccaccataccttctaattttagtgttgtcatttatttatttatttatttatttttgagacagagcctcactctgtcatccaggctggagtgcagtggcatgatctcggctcactgcaacctctgccttcctggttccattgattctcgtgcttcagcctcctgagtagctgggactacaggcgtgtgccaccacgcccagcctatttttgtatttttagtagagatggggttttactgtgttggcgaggctggcctcgaactcccagcctcaagtgatctgcctgcctcgcctcccaaagtgctgggattacaggcatgaaccaccactcctggcttatcttacttttaaataccagaagtttagaagatgacacataactttaattttgtaagctctttagtttctaagtgcctcctgagtggctcagctttgaatgccacagaggaaaaaaaatatatatgtatataagcgagagggtgggaaagaagttaaagttaattattttaggagtggtgtggaatgatggcaaagtcagtcaggttttgttatgtcctttttgtagaagaaataagatttgctgttcttgtggtgcagaggttggcaaagtctgacctttgggctaaatctggcctgctctctatttttatatttataagcaaagtgttactgaaacagacacacctgttggtttgtaggatgtatattgctgcttttgccttatgatggcagaattgagtagttgcaacagagagtatatgagctgcatagatgaaactatttactctctggcccattacaaaagtttaaccctgatctagtgaagaaaaattacctaaatttttccaagttgaagacgatcaatgtatgaatttttatagaagtgttacattttttacaaagggtacgtcatatggttaaagctactaatttgaatctgtttcatttttcatttgatttctgataaaaggttatctttggagtttaccaatttttgacattcgtgattttaaaaatattttctctgaatagaccactttgcactgaattgtgaatttttttgctatcctctttcactcggaaacacgccatctatgagttcagttctttctagaatgaagcatagaattttctatgtgtctattatcataatgaagaattataaaatatatttgatagctatttctaataatgtctcctggggggctttgaattgaactttgtctttcagcatctcagccatgtgaactaagtgtggattgacaggttatacttttttttttactttttgaagacaacaatatgcacaggttttggcccaacagcagaaagcagcactgtcttcccagcagcagcagcagttggcacttcttcttcaacagtttcagaccttgaagatgaggttggtggtcattccattatgtgtcatatggggtgcatgtgttgtgaaagaaagagaagaaaggagaaattctggtatagtgtgtgatttctggcactggaacactcccaacacatacctgcatgttgtatgtaaaaaagtatattttaaaaaaatatttcaggtggagataagcgtttatttggtcttttactcatagatataaattttgattaatcaaaagaccaaagaataatgggaactcttgagaaacagtgtcatcttgtggaacctgcgacagaaaaactgtagcctaggattttaatttcacttttactcatagtatctcaaagtattagccacaccacaaaaggttgtaattttctagaactcagaagccattaaggtaggtctaaggaaaaggaaattatgctagaagtctagaagaaatttctgctgtttcagattatcgttcagagtaatatttctcctgaacaagtatcagtcactgctcttaaaaa

SEQ ID NO: 99201 - DNA, 1001 bp, Homo sapiens
ttgagccttaacccatcccatgaggtaggcagtttaggtggtaggagctccattttatggatgggcaaactgggactctgagaggctgtaggacttgattaatgtaacacacaggaaactcagaactaaaatgcagaccttttttcattataatatgctgtctctgtgacttctattgagatgatctgggttttttaagatacggatatacagtatctttaagatatacatatcttttaagatatagatatacagtgggtatatccatcatttagaagtcaatatgtattaccatagaggattccagaagtgtgatcattgtgcccttctctttgttccaccccaaactgctttggtagtgttaagttttagtaaaagagtgaaggcgttttctagccaaataacctggagaacctgctaatctagaaattcctcttcatctttttttttttttcctgcaaatgacaagaacaagttaattttttatttcccttttgcagaatatctgatcagaacatcattccctcagtaactaggtctgtgtccgtgccagatactggctctatctgggagcttcagccaacagcttcacagcctacaggtaaaaacttagattaacctttagtaccactctgaggattcagagtctaataataattttacaattcagttcttaaaaaatatattaggtttctgaatccattttgtatttgatattaacaaaaggtccattttttactagatccaagcaatattgaaggtgttactgaaaatatacttttaaggatttgtttgaatttatttagtggatttttttttgagtcagcatctcttttatgttgttctgatcagtgtggaaaaatcatttaaattattttcgatctctttagccagatcgggaaaaaaagcatacataaaaacatagtaatggtgacctattcttttgagttaggaattaatacaagctaggcatggtggtgtgtgcctgtagtgctagctat

SEQ ID NO: 99202 - DNA, 2335 bp, Homo sapiens
tctctagttggtgtgcagtgagaggctgtaaggttgctggaaatctatgtgctttggagtgtaatacactgggatttaaatcctggcatgaccacatgcttgccatgtgcccttgggagtgttagaaactacttctgacccttagtttgttcatctgtaaaaatgggggtatgaatagaaacattatagggctttgtaaggatgaagttaattccctgataaatgcctggtacttcccttcattctagatgtgttgaaggatattcacagaaactagagtccattggcagttcagtcttctcagaggcaaaacagatgtgtttggtggagctcatttaggcacagggaagcagcttttttcatgattcctacggatatgtcaccatgtgtgtaagctctgtcattcctcgttgtttcttttgttgtcttacagtttgggaaggtggtagtgtatgggatcttcctctggacaccacgacaccaggccctgccctggaacagcttcagcagctagagaaggccaaagctgcaaaggtctgaaactcattcttctgcaacagtgcattgtcatctggctgcaggacataaacattgctgtttattcatctctctagctagctatgctttttactttcagtttactgctgcttagctggtataagtacattcatattgtatctttactgtgctctcttctcccaaaaaaaaaaaactcaaaacagaatttaaattactatgtttggtttggttagttggcacattgttgattatagacacatatatattttaggtaacattattcatggtatgaacatttgttataagtaacaagaatgtgagaaaatatccactacattgtttatgagactcctgatatgtggcatgagttctcccattgaatctttgtagtggtatttgtttatatttcttagtatcctcagacgtagcagccaaaaagcccgacattaacattagattgtgtgttccattcacattttttggaagagctaaatcttgaattttggttttagtacttgccagaaaagaatgtctacatcaatacctagtgtcattgtaatgatttctaggttctcaggcgtacaagagagtgttgttgctgttttatacttaatgcattcttatcccctgaggtcgtgacagtctccttagagttcccagaatgtggaaaggttcatacaacattgctgttaaaacgttatagccacactgttaaatgttcaatcagaaagttatttgtagggatgagtaaagaagtaccatccaagagcattctgatgttactctcatgggtggtataatggtaacgtggagtgtggaggcaagtacaggtgggaggaaagtgcattcaattgagacagtcataaaattcttctaattactgtgatatgtcacagcttagagctcttacagggtgttgatgttgtagcgtatgtcagaatttccttccttttaaaggttgaatagtattaatattccattgtatgtatataacatattttgtttatctattgatctgttggatcacctggttgcagtgcagtacggtacaagcagctgattgaatgaacgaatactactggtcagtgctttcggagtgttcctgtgcttggtttcaagtttctaagagtactcttgtgtaatcacagctagagcaagagagaagagaggcagaaatgagggcaaaacgggaagaggaagagcgaaagaggcaggaagaactccgaagacaacaggaggaaattcttcggcgacagcaggaagaagaaaggaaaaggcgagaggaagaagaacttgcccgaaggaaacaggtatgtatctgggaactctgaccataggattagtgcttgatgagggctttcaggctgctttctttcatcatttcacagatactcctgaagtccacaggattggggttagaaccttagaagactcactcacctttggaaagaatctctgtttttcaccaacacccactgtagggatattcttcagtcctagtaaaccactagaattgatattctttgcatatttcctagagttttataaaccagttagatttcagaagttctgtccttgcatctaaaaacaatgagaaagtaactttgatgtgcagcattaaatgtcaaattttaaaagttacatgggctttaaaaaaattgtgctaacatatacataacataaaatttaccattttaagtgtactttcagtggtgttaagtatattcattcatattgctgtgcaaccctcacaaacatgtctgtagaacttctccaactttgcaaactgaaactgcatatccattaaacaaggagc

SEQ ID NO: 99203 - DNA, 1745 bp, Homo sapiens
gaggtatatattatttgtacttgtgttttatagccctccttttgacatgaattatgtcatctttccatgtcaaatgtgtatctaaaaatctacatcatcatatttgctagctgtattaaatttcattttataagtaaattataataagttgaccaattccctattgttggacatgagggttgtttccagttcttcattgttagataagtgttcgaatgaaagtccttgtagttaagtctttgcttaaggatttataaccagcgaggtatatacttttaatattttttggtctttttttttctttttctttttttgttgttggggggaattcaccattcatgtgcttggctcatttttccattggggttttcctagcttcacttgaaaggatccactcttttaatagccccacagtctagcctttaccacttgttgcctactttttggccccaagaggtgctctttgaaaaacaaaaaagatccatgctgagatgaaatgagaactacggttaattcttagagtcacactatactgcagcatatagaggctctaaggattattgcagtaaaaaagtatgtttagttctgtgttgcgcagttttctataaatgatctcaacaatgggacttctttctgtgtaatacttaatagtattggtgggacttttgatcttcagaacacgttctgggacacatggctttactcattacttctgactgggagaacttatcttaccccaaatttttggtggctatgttgatttgccctctctatgccttaagttcccagttaattaaaaaaatagggattaaagataccagtggagaaacaaagctatacttctaatgtagctctttctacggttaatcagtaaatgatgtagctaatatagaaaccagggtagacttcacagtttattgtaatttaactgctaatattttaaattcaattttcttttcattgtaatgcgtccaattccccaatttacatgtatactttttactccagatcatgattacttttatgtttactgtttaacagagtcttagcagcagatagcctattactttccaaatatgacataataaattgaatgatagacctgagtccctcccccaccccccaccctccatcttttttccttaggaagaggctctgcgtcgccagcgggagcaagaaattgcattaaggcgacagcgagaagaggaagaaagacagcagcaagaagaagctcttagaagactggaagagaggagaagagaagaggaagaaaggcggaagcaggaagaattgttacgcaaacaggtgaccagatggttttgtcttctaattgttcctttgaagctgggaattagtgatttagaaaatattaggacattaaggtagcctatctaaaattttttcaggttgctaaaaattaaccaaaagaaacctaactggctcttattacttctgtctaaatttcttcaaatgaaaacctgttttctagaggaaaaataaaatttgtcttatctttctggtttttgctcagctgtatagtggaaatgttgtaaaatacatggtcttttttaaagcaagtttcaaactaaagcggaatagtacaacaaattctcataaatcacccagcaataatttctttttttttttttttttgagatgagtctcactctgtcgcccaggctggagtgcagtggtgtgatcttggctcactgcaagccccgcctcctgggttcatgccattctcc

SEQ ID NO: 99204 - DNA, 1022 bp, Homo sapiens
attttttttcagaaacctaaattctgttagacatagatagcttccaagttacattgtgtgttgattcattctttggtttattcatttaacagttaacatgtttagttaatgtactacatgccagttactgtgcttgttttctggtggagtataagactttttaggaaattgtttctgtcctcaagaagcacagcctatgtgtgtgatgaatatacaagaagtaagcgccatcattaggatactttcagctccaaaataaaaatacccatttaaggtggctttaataataaatgaaattgttgcctcacactctaaggaggtctgcccatcagcctgttgtacacttgcttcagtgattcagtgaatgccattaagtatttacggcctttgcatactcctcctctgccatttcctggtgtgttgacttttgagttcagatgtttcacgtcatggttaagagttttggatatcacagtgtgtgcaacctgtatccagacaggaaatggcccttctctcatgctttcttccttttatctgggaagaatttcttccttagaggtctcccagtagacatctctttgaccccagttggatcacatggctacccctagttaacactggaagcttaaaagcaaaatctgacattttaaacctctgatgtggcaggaggctttgtctgccaggaataagcctgacaaaggtagtggttattggataggtagaaacaggagctgccataggtggactagaagcaaatagataaggacagggtatagttgaccttaatcaaaaggcaaaggtgaagtatacctcctaaaggctaggcaagtctccgagtggctgacttctatctgacctacgttttaaagaatgaagtagaggaatatgatatgggtaagacaaagcattgcagacacagcagactccaaagatgaagggaatttcttagtgaaatgagttccgcagggcacaatggaatggttttgagggaaggaagcagaaggaaaatgagcccaggtgag

SEQ ID NO: 99205 - DNA, 1789 bp, Homo sapiens
agttttgcctctcaacacctccctcccccagtctttgttaacttccctctgcacccctcccccaccccagggcaggtgcattttgagagaaatgccctattgtctgtcatattggctaaaaaatgttaagagttgattatgttcagtagtgttgaagacattcatttgaagagttgtttggcagtatcagtgatggtttaaactgtttataccttttatcctatcaatatccactgttatagatttctgctgtaggtccattcttttggggactgtttggcattttatttgttttgatctatgttcatgtattatttttattaaatacattttttaagtctggttaggtttcttttttattgtgttcgcttgtttgatgcctcagtattaaaagtgtgtctttttctggccaggaagagcaaggggttctctgagaataatcaggctttgagaatattgaaatattcaggacctagatatttatactctattttagtcaataatcttaagggatgggaaaaataaaattattgattaaaagcagcttaatgctcatgactagaagctacagcctggttaacagtggctccctttcataaaggctgatcaagaactatgccagcatctctcatgagatgagaaatctcatggtgctaccctcagaaatcgtgtccttaacactttcactggacagcagcatatcatgtcctttgttgctttcgtcaattaaaaaatccttaagccaatttagtgattcttttgtttactcctctttatggttgtatattgctgtttatgtcagtaccagatgtaacaaatttgttgtcaccaagaggtagatgaaatgtaagtgtgtatgtgtattataagttgttttaaaataaacttaggtttggagcagtgacaaaaacttaagcaaaagaagctgagaggatagtaagtaaaagcaatgaagaaggaaatttgaattgaatgtggtaaatggagttgagagaaatgcatttgttctgggtatacataatgcattattgcttctttgtttcctgtccacatttcctcatgaactttctggccttcccttttttgttagcttccttcttcttcaacgtggggccagcagtccaatacaacagcatgtcagtcccaggccacgctgtcgttggctgaaatccaaaaactagaggaagaacgagaacggcagcttcgagaagaggtaaaattttaaagtaaaagggatctagtcaagcgatgttccagaatatctagcatgcattatgggttagtggttactgaggacaattactgtcagaattgttgtgtgtctgaattggacgttcattattaaacttcagcccataatttggttaccctagcaaatgtgaaggatctcataggtataacatgaagattgagtaacataactgttcagttttcttaaacattttactgtagttcttgagaagacctcataaataaaactacacgggttgttcaaaattgtgggtgagttgtgtgcagataatcttttataagtctgatgtctagaaagcagaatatgtttttctctaaagacactgggttccctgactagtctagaaaaatgtgacagaaataaagtacctctgcttttaagtgtatatcctgtagttcatcattagggtaggaaggatacaaaagagtataaaagggaaggggaataacacagcttttgacagagaggagaaaatgaataattttcatagtttggttcagtatgccattcggtgctcattcattcattcattcattc

SEQ ID NO: 99206 - DNA, 1224 bp, Homo sapiens
cacatatttcttacgtagaaaaacccaagatgattttatttcattatcatccctggaggcatcctttctgggggcctctaacctgttccaatcaggacactctcagcttgctttatagctgctgttttgtttttcttgagttcctgttatttacatgtttctcccaggactgattttgattttctcatgttttttctcctgttttccatctctgtgcttttatcttttttgataagatcttgctgtgtctcctgggctggaatgtagctaggactacaggtgtgtgccaccatgcctggctaatttaaaaaaaaatttttttttttttgagacgggtgtcactgcattacctgggctgccctcaaactcctgagctcaagcgatcttcccaccttggcctcccaaagtgttgggattataggcatgggccaccacgccctaccctttttatcttttctatggggcattttctcagttttacctgcagtccttctattgggcttctcctgttagagacagggtcttgctctgtcacccaggctggagtgcagtggtgtgatggtaactcactgtaaccttgaactcctgagctcaagtgattctcctgcctaggcttcccaaaatgttgggtattacaggcatgagctaccacacctggccctgttgagcttttaatatatgctatatcaaacatctgtgagtccttattttgttctttaagtattttttatagccttttattgtttcattaaatgcaccatcttacctctctaaggatattacttactgatagcttcttaaaaagccaactcctattttgccgttctcttatttctatttctgctgaattatttttgttttggtctttggcttttatgttagaagtttatgtcaaatgtttggtaattctgggctgtttgttcctatttacaaataaggcactcagaagctgattggaggttctggtatgtacagcaccttgatgggctttcctataatagattctggctgggttgttctgttggggacctccacccccacccccactccaatttgttggtacctacttataggtgtgttctcttgtcaagctggttggcttccccacaggataatgtgccagtctgatttggcttcttcagacagggaatgttcggttttctgctgtggtgagggagagtgaattgcctaactgcacagagtgcgggaggcaatctggagtct

SEQ ID NO: 99207 - DNA, 2539 bp, Homo sapiens
tcatgcctgtaatcccagcactttgggaagccgaggtgggcagatcgcttgaggccaggagttcgagaccagcccggccaatatggtgaaatcccatctctactaaaaatacaaaaaattaaccgggcattgtggcttgaacctgggaggcggaggttccagtgggctgagagtgtgccactgcactccagcctgggcggaagagtgagacacagtctcaacaacaataaaaaaagaagtaattttgcatttcatgtttttattctcctttttaatactgttagcgatttacatttttatttgcaacagcagaatttaatcccatcaagttaattttatgtagctactgtgtatttacattccatttagtatactggatatttataactattatctaaaaacaggaatcctcagctagcttctgtttttatgcaacagcaaaggcgccagcagagggagttgatgaaagctcttcagcagcagcagcaacagcaacagcagaaactctcaggttgggggaatgtcagcaaaccttcaggtaccacgaaatctcttctggagatccagcaggaagaggccaggcaaatgcaaaagcagcagcagcagcagcagcaacaccagcaaccaaacagagctcgtaacaatacggtgtgtgcattttcctaagctgtcgttgtatggactagtattatcttttctgactgtcttcttatctttttaacatgattcacgataatcatttttctctttttctttaacagcattccaacctgcacaccagcattgggaattctgtttggggctctataaatactggtcctcctaaccagtgggcatctgacctagtcagtagtatttggagtaatgctgacactaaaaactccaacatgggattctgggatgatgcagtgaaagaggtgggacctaggaattcaacaaataaaaataaaaacaacgccagtctcaggtagggctcaaaatgaccacacctatgcaccttggttggttgggaggtggggatggaggaagtgggatgttgggtgggcaggaaaaggtagttattgagtttttgcttaccgttttcatctgtgttcaagcacatgcagtcataattatggtgattgctttcttccccatagaaacacattcgtattatttcttggggctcctgctgagcacttattctatcgcctagcacatggtaaccacttaataaatattaggaatagtataatgtttttgttgtgttgttgaacatttctccaaggtattctctagataccttagcatttttcctatatttgtatttttaagtaatttatgctattaatatgagtattataaaatacctctgtaatgaccttaaacctatttatttttataagttagttacattttcatcttcatctttctttcttcaatatacagtgttgttgaacgagcatgggttttagtgttaaatacatgaactcaaatcccagcactaccacttattagctgtgtgaccttgggcaagagggaacctctttgggcctcagttccctcatcggtaaaatgaagataataataacaactttatgcatgtaattgtaaagattaaatgaatacatgataagtagtaagtgcctggcacatagtaactacttaataaatggtagtgttgtcagattgtttcttcttgatttagggcctaacatattatgaatagaacaataaatttctgttagtttattgagcatctttgccaggcactgtgctgtaggccttttcatagaacatctttattacttatgataacccaaaaaagttgttagtaccgttttacagatgaggagactgaggcttagtaaaattaaacaacttacctaaggacacgtaggaagaatttcatcattttttctaagtagaacccctgtatccacaaattaggatatattaactgaggctagattttaagggtatatccaatccaaatatttgaatttttttcttttttggagccaagcattggattatttactgggcatccatccagtattgccaagacattatttatggtgttgtactataatcatatagtaacagtttctgggaatataatatcaccctattgttttgctttagtaaatctgtaggtgtgtctaaccggcagaataagaaagtagaagaagaagaaaagttgctgaagctctttcagggagtaaataaagcccaagatggatttacgcagtggtgtgaacagatgcttcatgcccttaatacggcaaataacttggatggtaagaattggggagggaaacccggcatgtggaatgacagagcaggacccacagagaggctggcaaatttgaacagtgggccaaaagtcaaaagatgaaatctaaggaggtcaactgctgcacctgccataggaacttgactctttaatagtattacttgtgagaaaagtccagtaatactaaactcaaatagattattggtggttgtcaaaaagtaaatgccatcttagactgccttaatgatacacaggacagaggag

SEQ ID NO: 99208 - DNA, 1026 bp, Homo sapiens
agtgaaaaggctttggcacagtttagagaaaaacttgctcatggttagctgtttacaaacagaactgtctcccatccctgaatatttgaagagagactggtcaacatgtcaggattcccctaactaataggctgaattgaattaatccacctctgataccctgtctaaagccaagaaactgtgaaaaatagcagtaaaggaattaaagagttcctttgcagcagtgtaacaatatctaatggtttaaaagcctacagagaaaacaattttaaataacagtaatggctgccatgcattaagcacctaccatgtgtgctaggcactctcttggagttaacatgcagcatcccagttatttgattagcagtgatttttaaagatacctttacaagataggtgatattatccccattttataaattaggaaacagaggctcagaatggttaaataactcatcaaggtcacacagccagcaaatttcagagtcaggttttaaacccatgtttgtctaactctgatactcatgcttttctcctataccacacactgcttacattttccatttgatttctctctaaaaaatctcagtggattgaaagttccaggaagatatagctgttttctttagtgtatgttgtagtgcctgacacatatcataggagttaataaatactgattgaatttgagggttcttaaggaaagaatgaatccccaaattacttcagccttagtcaagtaactgtttcagtcagtataacattcagtgaaattaaacatgtggtatggatgttgtgattatagtgtttttttcatttctatagggtagataaaagaatatttaaacacaattgctgcatacttaccaagtgtctgtcattaatgtttgattaggtataaagatacattaaaaatggaaactgatttttgtaagttctctttcattatttcattgttacccttatcttctcccctcccgttttgcagttcccacatttgtttctttcctgaaagaagtagaatctcct

SEQ ID NO: 99209 - DNA, 1092 bp, Homo sapiens
ttgaactcacaactaatagcactactattcgtgcccaaatgaagcttatccagcacacgtattttcttcctaaggcacctcacagccttcctgtgcttaggaacaacaaccagttcttcagcactatagttgagggccactttacacagcgaaatctggtggctcatgtccgtaatcccagcactttgggaggccgagacaggtggatcatgaggtcaggagttcaaaaccagcttggccaacatggtgaaataccgtctctacgaaaaatacaaagattagccaggcatggtggtgtgctcctatagtcccagctactcgggaggctgaggcaggaaattgcttgaacctgggaggcagaggttgcagtgagccaagatcacaccactgcactccagcctgggtgacagagtgagactgcctcaaaaaacaaacaaacaaaaagtgaaatcattaacaaaaagcacaaaaatttggaaaacatggcactaaatagaccacaaaaagggcacttgttggcagtattgagaactgtaacaagaaggcattgtttccttgttctaccttaactgggaatatatgcctttagcatctcatgttttttgctctgagtatgtgtatttctagaatgaccataaaagcactacaagtattcattttggggttacaaatacattttaacaagtaggtgaattcacaaatatggaatctgtgagaatcaattctacaagttttctgaaagacaagatggcaaggctcatggaagggcttaaagatattcatatcctttactcctgtaattgttattctagagataatcagtattcattatgggtcacttacgatgaggatgtggaagatacagagaagtacaaggcatttaacatccaactgggtaatgggctaacaggcataaattgaaggaaaagtgaaagatgtaaacactgaaacactaggaaaaacaaattttttttttgggaggaagtgtcactctgttgcccaagctggagtgcagtagcgcgatctcagctcactgcaacctccaactcccgggttcaagcaattctccttcctcagactcccgagtagctg

SEQ ID NO: 99210 - DNA, 1038 bp, Homo sapiens
cagtaagcacgtgcacccatgggcgcacgcatacacacatgctcacaccaggcttgtccttccacagagctttttccacttctcccccactactaccacctgtgccttcaactggctcattggctaataagagccacaagtaggcgtgaagggctagtaggcaatttcatagtgtaaccagttggtagaaagtatacagacagtatttttgggccagatcgtttctgggattgctgataggaataaggtacacgactttaactttgtttggtaatatgccacccctgtcctctctgtcctggggcccagggaacaaagagactttctgctcttggttaggtgagaggtgcagtggtctgctcatgattatttgcagtattcatttcctagcatttgatacagactctgtatgtaccagagaagttctgccgtcacagcagggtggaaacccagagttaaccaggacaggctttgtggaggcactgagccctgagtgggatgtcttggtctaaatagaggaaaatggtggctcagtggccgctcttgattttattattagaacatgtgatgaaaagctttttgtttttctgcttttaagctcattcttgataaggtgaggacaaaccaaacattttcctagggtgagccaagtctgaatctgctgtgtaatctcagtcatgctgcttatttcacaggactctgtgtgggggatgaaccacagtacactccattcagtatttcagaccaatcaaagcaacaaccaacaatccaattttgaggctgtgcagagtggcaagaagaagaaaaagcagaagatggtccgagcagatcccagtttattaggtgagcacggtcctagtctcagctgagtgttggaggagtgcaggtgataccagttatcctgtgtgagtttccattgagcattgtttttcaagaagggaaatatttctttttatcaataactaatgttttaactggttcaaaataagtagccagtatttactgggcgtctcagtgcaggacctgtgcctcatgtaa

SEQ ID NO: 99211 - DNA, 1040 bp, Homo sapiens
attagctacacattccccatgcataaaatgggaaaatgggaagtcttcgttgaaaaagcagtcactgatggaaagagaattttgcttctaaaacaaaccagcagagggggccacagcctcattttaattatcaatattctccagtatctcctatcttcagtaggcttcctccacctcccgggttcaagtgatttcccctgcctcagcctcccgagtgctgggactacaggtgcgtgccaccacgccagctactttttgtattttagtagagatggggtttcaccatgttggcccggatggtcttgatctcctgacctcgtgatctgcccgccttggcctgccaaagtgctgggattataagggtgagccaccgtgcccggctggcttcctctttttttagagctcttcaggtggtcattgtgaatcagcaacctgcactcagatgtgataaacacacaatacagtttctccccagactttccttgtaagaacaacctcacaaatcttaaagaactcatgtgagtgagactatgctctgaacctcacagaatgtcatctttagagccaggcatagtggattgaatccgtgtttgtgttgccttgggtttcacagtacccagaactttcccttacatcaaatggctgaatttgataaagaatggcattcagccaaaggatgaatgcataccttgctggttttttaaatgacagttaaatgagaatatgtctgtttgctaaaagcctagactgataattaacatattaatcaactttttttggccacagacttttcccttcctgtctttgcatgagtaaaattaatttagcttttaaattacacttccacttcttttgcatatagttcattattgccttttatcacattttatctgttcttaagatacacgtgaagtcaatgaaaaatctgcctcagaataaagtagtattttatttcatagactggcctttaggttcttgtacttgcctaattaactgttactttaaaaacataaacattagggtcaggcacggtgactcat

SEQ ID NO: 99212 - DNA, 1098 bp, Homo sapiens
tttcttctattttgttttttcttcttctttttccccccatcagggcaaatggtctaactggtgcaatcatgaagagagttaatggttaacagacattggccaataacaaaacaccccatggactgtgactcgagtatccaacaggcagtcagagctctcccggtctgaaagttgcattgccactgctaactttgggattgcatcagagaggccctgagtggggttgagatgaggttggtttggtttgatgttacacactcctcacctgttctttctgagtgtcctttctctgaaaggatttatgtttttcttcgttagatagtgacttctgagcaagctgatctcccctggcatgctccaacctgattggacaaaggaagctctatggcctgggagagagactattcttaatttttctttcttacaaaaactgatttttcccataaatatttttacttcagaggactaggaccattttgttttgggcccttctgctgaaaatttgtctcgtttaagaggcagctagaatctttaccatatgtatgaatttgtataatttcatttttggatagggataaacttttgcttctgataaaagcctggaatttcatctggtcctcagagcattgcgtgtgtgtcttgctgtagcccggaaaaggttttgtgtaaagattctgggatggcaagttgtttgccttttctgaaaagagaacatacagaacctgtccatctttaagaccttcatccatggaatctactatacaggaggatgcagtgggctggaggggatgggcgaaaatgggagcaggaagcctggcctggcttctggtcatggcctcctaaaaccttaaacttcaagtagaaatgtactcaagccctatttataaacaaatacttttcctgcctccaccaaacccctacagaacatcacctggaattgccactcacactgggttggagtcattgggcagctgtgcctgtgcgagaggtgctgtggtctgggcagcccctggaaaagcacctttgctgcctgtcattgttgcctgaagaaggctggagttgctctgagagcagtttgggtttggagtattatatttg

SEQ ID NO: 99213 - DNA, 1054 bp, Homo sapiens
tctacatttccacacctggcagcatgtctaacatagaatagatgctttgtaaatgtttcttctgtgaataagtgcatgagaccatgtacttggcatcaggtagacaggatacatgtcttcctctgccatttactagctgtgcgacctcagacaagttagttcatctctctgggccctgtatgtactgaacaacttaacggagcatcttcgttggccagacactgttctgagccccagtgttgcagtactgaacacagtcctcttgatctccattctcacggagcctccattcagcagggaagacaaacaatgaacacatattggaaggagatgactttagctcgtggtgattgaaatggaacagaacaaggcaacttgatagaggtgacctggtggctattttagacagggtggtcagggaagacctctttgtggggctgagacctgaatgatgaggagttgcccctcccaggggaaattgagtctctggagattcctcagaagggaagctcaaggcagatatgagttgaggatgagagtggctcagatcttggtggggcgggtgaggtggggggctgcatcatataggacctcggagggcagggaaggggtcgggatcattttctcctctacgtggagaagaactgtactggggtttcaagcagcagggctgggtctattttggaagtaggacgggaacaccatgcagcaggtgtaggagggaggaaaggtaacatgcaaggacagtcctcgagttttgtttaagcaacggagtgggtgaggtgagaagcaccgggggagaggcagatttacagggaagaagaaatgaagatctattttttggccatgtgaattctgagaagattgtagagatccctgtgtcctcatctgccagaaggggataataatagaacttgtggggctgcggggaggctggaatggggtgaggtgcagagagaacccagagcattgcctctcgatggttcaggttcagtgatgctgccctgatcctctttccctcctctcccaggttcctggtgaggccaatcccatc

SEQ ID NO: 99214 - DNA, 1071 bp, Homo sapiens
cagtgtgatccatgctatcacctctcagtgccgggcacaaagccttgcacagatgaggtcttgttgacaattgggtagtgtctgtagcacaggataaactaaactgtgagtacatggactctggaaccaaactgcctaaattcacgtcccagctctgccacttagcagctgtgtgacctgggacatgtcatgacctctctagccctcagtttcctcatctgtaaaatggggatgataaaaattatgtgaataatatgctcaaggctctttaggctagagcccagcatgtagtggccactttgagagtcagctgttattagtagattctgagaaccatcaaatcaactcatccataaaatggaagctcttcacacaacaaatgcatatagagaagctgcagtggggcaagacaaggggatccagggccagcagggcagatgaggcccctgcccacatggaatttatattctggtgcattgagtagccgatagagactcaaatacatctgtcaatacagatgaatgatcagatggatgatccagctatgaaaagcgctacaaagaaaacaaaacagggcaaaggggtagaggttaactggcaagaggggatagtgtagaaagggcagacatggaagtttcctctgagtaagaggcacattggcggagaccccgaggctgagaagcaaccagtcgggcaggggtctgagggaagagcatcccagctagcagagcagcatgtgcaaacgctgggagatgggcactggggcccaggttagggaggccaggcagggtgtcaggaggcaggggggtaggcaatgcccagtgcggggccacatggggctggagaacagcagcagacaggaccagagggctgacgaaagcatgagagtttcctgagcagcctctcgttctggctgatggcgaatggacatctttcttcatctgggtggccaatgggttcccccgagaaacctgatcaatgcgtagacccttgcctcagataaatcccaaccttcacacaacagtttgcatcccatgtcaggttttaagaccactatgaagccccccaagt

SEQ ID NO: 99215 - DNA, 1057 bp, Homo sapiens
ctgctttagaggaatgtcagagggtccttcctgcacctgccattgctcaaattccttcagctgaaaatattcaacatgcttaggatgccatattttgcaatagtgcatcctgaaccccactgatagcacagtggggtgcaagtagcccagtcttgagtcccaggtcagccacttgtgacttgggtctggtgccttttctctggtcctcagtttactcttctgtccagcagggatagtagcagcatcttgcagggctctcatgagtcttatgtgggtgaacatcaaagcaactggtgcccaacctccagggagtgctcaatatcattgactgtcaccaccaccaccaccattattattacccttccagggtagccgtgagggaggctgatctcagggaatggctgggggtgacatcatagctgtcatagtcctgcagaggggagctcatagcatcatggtggcccctgtgtatagtggcaagttgggcaggagaaatggggagtcactgatgatttgaacagaaaggctgtgtggaaagtgagcttagagtgatggtttcctcttatctgttgatatgatttggctgtgtccccacccaaatctcatcttgaactgtagctcccataatccccacttgtcatgggaaggaccgggtggggaggtaattaaatcactgggatgagtttttcccatgctgttctcatggtagtgaataaatctcatgagatctgatggttttataaagggtagttcccctgcacaagctctcttgcctgccaccatgtaagacgtgactttgctcctcctttgcttctgctatgattgtgaggcctccccagccatgtggaactgtgagtccattaaaactctttcctttataaattacccagtcttgggtatgtctttattagcagcgtgagaacagactaatacatctgttaaggagagaggggtggccccaacttggataagaggagatggaaacgttaagatgagtgaagactgtcagagcacctgattactaaaaaacttaagattgaaagaaacacctcccagg

SEQ ID NO: 99216 - DNA, 2639 bp, Homo sapiens
aatgacattgtttctccagcaatcctgaaaactagagatgatggaacaaggttccagagtccggaggagaattatttcaaatttagagttctgtcagttaagtgtgagggtcgaattctcagacacgcaaggcctctaaaaatgtatcaccgattcttcctttcttggaaagccactagagatgctgctctaccaaaatgagggtgtaaaccaagaagaggaagacctggggtccaagaaatgggatttaatacgagagagagaaacgtattcctggattatgaagtaaggccccaaggtaaaggctgtgcctcggcccttgaagtcaccagtccagagaagacccagaagctctgggaaaggctccctcaggacaaaggaactgatgaaagtagttggtcacatggaaaagagagttataaactggggaagaattagaaacaataaaaaaaaaaagtatggcaattactaactccaggaataacacaaagttgtctagaaaaagagaaacattcagggctggtctgtcaatagcattttgataatcagaataacaaacactgagtacttatctggccaaaattatgatataattgttagaaggatgatgtggggactgaaattatgcattggcagggagtcaagttgggggagcaggttgtgtgtgtgaaagaaatttcaacctcatcttccatagtggacagtcaaaaatgtaataggacataatgaaaactgaaacatcggaaagtattaatctaagcattttttttttttaagaaacagagtagaattccaaaagaatccattaagagagttgaaattggttgcctgtagggagctggacattgaagagaggttgggttgtggaggactattgtttgcaaaaaccttatagaacaacttgactcttttaattgttgatgacagtaaaatgtaaaattaaatttagatataaattaaaaacaaagcaaaagaaggaaaggaggaagagtaaggaagaaaggagggagggagaagaggaggaagaagaggagaaggaagaagagagaggggaaggagggaggcagggagaaagatgaaaagacgatcacgctgtctctgctctggacaggccaactcttgcttgttccagacatcaccctccccaagcatgagcctctcttgggaagagcagctggaagcagagggagctgggagaccagacacaaactcggggctcagcttggggacgggagttgatagtcaggtgcctggaacataatggagaccgtccatattggttgaatgagtggatgaatgaattaatgaatttcttttctcttaagtcctgcagctcattaagtcacagaaatttctgaataagttggtgatcttggtggaaacagagaaggagaagatcctgcggaaggaatatgtttttgctgactccaaagtaagtgacagcaaacttctaaaatgggctgtgaggtagggaggggacacaagcgttttgaggctcgctgtgtgccagggagtgtatcattagctcactcagttcccagaacaacccatttcacacctgggaaaggtgaacttagagaagttgaggatcatgttccaggttggcctggatttgagccatcactgtctcaggagtagggaggcttcccactttgcccagctgcctcccagcctcgaggccacatcctttatgacccacatctaactcagccccacacctgggggaaaggctttcagcttctctgggctggacttgggaaatctttgggacactcctggattgattgattgattgattgactgactgacttgagacagcgtctcgctttaccatctaggctagtgcagtggcgtgatcacagctcacggcagcctccacctcctgggctcaagggatccccccacccacctcagctgaggtgagacaagtagctgagaccacagacacacaccaccagctaattttttatattttgtagagacagagtctcgccgtgtttcccaggctggtctcgaactcctgggctcaggcaatcttcccgcctctgtcacccaaagtgctggtattataggtgtgagccacccctggatttaaatctgagtctcgactggagctccatcccagagactttcatttctacactttgccccgctctgcagaagtgagatgcccctgccaggatgggttcctggggtaagaggtgctgtgggccactggggaaacccaggctgggcctctgtgcccccacagtgggttctttgtgacctgacccctcatctcagaaatttgaaccagggccaaaacctatcatcgtgaacctcattcattgttctctgccatgcagctcgtgtgaggcagtaaaaatggattgcaccagcctgaacagcctagtcagaccccatgtctacaaaacaaaaaaattaggccaggcacagtgggtgccttatgcccataatcccagcactttgggaggctgaggcgggacggttgcccgagaccaagagttcgagactagcctgtgcaagatggtgagacctcatctctacgaaaaaaaaaatagctgggtgtggtggcatgagcctgtagtttcagctacttgggaggctgaagtgggaggatcgcttgaacccaggagttt

SEQ ID NO: 99217 - DNA, 1317 bp, Homo sapiens
gcaagcaccaccacgcttggctaattttgtatttttagtagagacaggagtttcaccatgttggtcaggctggtctcgaactcctgacctcaggtgatccacccacctcggcctcccaaagtgctgggattacaggcatgagccaccacacctggccctctgatacattattaatgaatctcctaaggctggacagtaaggttgcttctgatttttttctgtgctgaggcctgtgctgcagagccgtgacagggttggacttctgcgcagctcctgatcactttgttaaagtcgcacctttgcaggggagtgtctaggccagaagccactcgcttatgactttggacacatgtttccaggttgctgtcctggaagttcacactgatttacgctcctctcagttttcttgaagctgaccaagtcctttgcaaagtgtaatgtgcagggaggcagaggcctttctaagtctgtctgcccttccatccctagaagagagaaggcttctgccagctcctgcagcagatgaagaacaagcactcagagcagccggagcccgacatgatcaccatcttcatcggcacctggaacatgggtgggtccgcgcgccccctccctgcagtcaccccctctgcttctgctttcctgactcaggcatcctcaaggtggggtggagtgacgacatccatgtccccttccttcctgccccagggccctgcccctaagccccagcccacccgcacaacctccttcctgaggaattccacccttttcctgagatgatgggtaagaaaaacgagctttgggactatcgtaccccaagagcagctggcgtgggttactctgtatgtctaaattggaaagttttagggaaagagtctgaatatctaggtgaaggggctcatgggaaccctgccagccctaggcagctcaccaaggggccccaggcctgagagaaagaagtccaccctgagtagggttgccagatttatcaggagagagacagagagagacagagagataggtacgtagacaaaggatgcccagttaaattttaacttcatagaaacaattttttttagtatatgtttagctacaaacaaataaatactaaatatatatgctcatagacattatgctgaatatatagtatatatacatatgctaaataagtgtaattattatattaaatatgaattatactaagtaatattagtttaagcatacagctaataatatactaaatatatgctaaatatattttgtattaaacatatatattgtgtatttactaaacacatgcactctactaaatataaa

SEQ ID NO: 99218 - DNA, 1536 bp, Homo sapiens
ttttagtgtaagtgttcaggtagaaataaattagatagaagacatccagataaacttattctaaaaactaccagtttatctgaaattggaatttcactgggtgtcgtgtgtcccctacccttgtcctgagaggagtctgggaggaagagggtgagcagtggctggcaggggcctcctggaagtgaagtgacagcttgtcactcgtgtcccagggccacagcagccgtggagtagagcccgggccagtgccccagggggtcacttgtccccttcggtccctttcagtgtttctaataagagacaatagtctgcctgatctcctccctctggacatggtcagggatgtccatgacacaagggcaggggtgcccttcccacagaagagtatggaaggagccagctgaggccatgccgcaggagggccggggacccaccagcccgggggttcgggcacccactttgagcctcttgggggagcagaatttagccacagtccatttactccaatgcttggcttctttgcacttgtaaggcaagaagctcatctctttgaggaacaaagtttgctcatccttcaagggcattgtagggagaaccgttcaaaatttcttgattgagcttcttcaactcagttttgaaatgggaatgcggaggagtttccacactctcccgtttctctggctcacacccaggcatccctccgctctgggctgggatctgtcttgcaagggagactttgttgtctcccaacaatgggttagaacccgccatctaaaacttgtcagttcccttggctgtcttgagaataggatgtgagttccttgagggacaggactgtgtctcaattatcgtagcctcaaagtgcaggacagtgtctgacatcagggaatcttctggtgtttctataccttgaaacttgacattacgtttaaaaagaggcttaactgagctctagccctaaccgacatcctgggtgaggttggcgcccaggcctccattgcaggcatttctttgggctgcctggatggtcttgtgtaatgacgtgacctccctcacactcccgccctctgttttgaattctcctaatgctttgactcgatgtgcctttgactcacttggtgttgggttttgctgttgaaggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtgagcagctggctgcacgctgggtgggcttccgggatagaatctttgctcggctgggctgtctcagaggcaagggtgggctcagcctatcagctctcagttttcaaggatgtctggaggcccccactgagagatgcgtctgtattcagaaataaatgggatctgtggggtattgctgaaaaccactgagtcctctatc

SEQ ID NO: 99219 - DNA, 2240 bp, Homo sapiens
ctgctgagcagatgctgctgctcctggtcccctgccctctgtacacccaatgtggcctcaaatgccctttgcatcctggctgtgccatatttgcacactaaggagttctgctgcagcagggctggagggctaagtctcacttccccccacctgctatgctcctcgccccacacctatggcaggagtgacttcctgccacagtggagggggaaccagtgaccccgtgctagatggccgctttttccttgcattaggcgaaaccaaaactatatgaacattctccggttcctggccctgggcgacaagaagctgagtccctttaacatcactcaccgcttcacgcacctcttctggtttggggatcttaactaccgtgtggatctgcctacctgggtaagggctgcccgcctggggctggggctggggctgtatgagatggaggctcccttgagtcagcttggggcaggtggtcgtggagacatgtgaatcaagtgggctgaggcggctgctccccttgggggctcaacgctgtttccattactgagcctcagccgctcctcacggttcccctgtgctcacacccggttcccataactgtcacagccaccctgccaccatcactctgcagcccgggtcatccagctgcccgcccccagccccgaagcttgtcaggcctggatcagcagggcttctcaccagaggcccgggcatgttcttgttccaggaggcagaaaccatcatccagaaaatcaagcagcagcagtacgcagacctcctgtcccacgaccagctgctcacagagaggagggagcagaaggtcttcctacacttcggtaagagcagcaaccccggctgggagcggtggctcacacctgtaatcccagcactttaggaggccgaggcgggcggatcacgagatcaggagatggagaccatcctggctaacacagtgaaaccccgtctctacttaaaaaaatacaaaaaattagccgggtgtggtggcgggtgcctgtagtcccagctacttgggaggctgaggcaggaggatggtgtgaaccagggaggcagagcttgcagtgagccaagatcgcgccactgcactccagcctggccaacaaagacagactccgtctcaaaaaaaaaaaaaaaaaaagcagcagcctctcctcttggagcctttccagccatcctttcgtcccctttcccctgatttcctaccagaagaatagggaaaattggccagatgcaaaacctggggaatcagaattaaaacgaaagtctctctgtttcagaggaggaagaaatcacgtttgccccaacctaccgttttgagagactgactcgggacaaatacgcctacaccaagcagaaagcgacaggggtgagtcctcttcatagacaccttccctgccctccatctcctccccgctggtgtctgttcccaaaaggtgaacagaaagtgtcttcatccattaggcaaaaaaaaaaggaaagaaaaaaattagaaagcacatgttgatttgtgttacagagtaaatgggaagccacacttgtgcactgctttgagctgggaaaataacccttgtgatttaccttctgtccagatactctaagatgctgagaggactttaaagtattatttccttaactgggttctgaagatcatttttttaaagtcccgtgatcaaatatatttactaaactgctgagtgaattaacattaagcaggtttcttcgctgcaggacttatcagagcttttatgggcccaagagcactgtggttctccatgaggaaatctgtatgccaaactcagttattcatggaacaccaattaatgtcttatgaggccacttgttttccaaggaacagtgttttggggaaagatgcaataaaatatgtattcatttgttcaaagatatttcctgatggcctattatgggttaggcactctcctaggtgatgggagagcaaagatgtcttttccagggacttcacagtaggaaaaacagatatgcaactagctgtagccagagccagaatgtgacaatgccagggcagggaaggatcagggaagccagcccctggcaggattcaagggtcaaatggctgggacggtgaggtacccaggcccactagaagcctagggcaatggagcgcaagttcaaagtgtcatctgaaagagttctgggccccatctgggctcaggagaaagtgaagaactggacgtgggagaggaagg

SEQ ID NO: 99220 - DNA, 1051 bp, Homo sapiens
gatggatgggtgaatgagtaaagatgggtagatggggagatgaaaaggtggacagatggatgaatagaactgggggtggaagctgaagtgtgttattaaagtaagtgactgcagaaagtgagcagagactgagctgaaaatacaggtgggggttcatctgagtcagaaagaaagtaagagaaggtgaagatacaagggatactgaagtagtcaggaggatatgtgagggaatacagcaaggtgagttatcttagtctaaagaagaaggcgtggcagtggagtctggacttgagccatgtgaaaaaagtttaaagccacctacagggaaattctataaaaagccaacagccgatgaatttgaggattacagaggccaccagttaatctgttcttttactgattaaaaaaataataataagaggcattttttaaagcctatgactttgatttgcagatgaagtacaacttgccttcctggtgtgaccgagtcctctggaagtcttatcccctggtgcacgtggtgtgtcagtcttatggtgagttcaaacactggggaaagcagaacaggatcagagaatggcaccaagctgggaggtgtgactgccctaaaatctaagggcttcagtctgttgatgtgtcaaagggaggaattcactgtaaccctaatcaggcgacctggaaatgttgatgcttccctgcctgtcttgtgctgccacctaatccatatcccctgctttaggagacatttgaattatagagcactttttttctttttctttttgagacggagtctcactctgtcacccaggctggagtacaatggcatgatctcatctcaccacaacttctacctcctgggttcaagcgattctcgtgccacagcctccccaagcagctgggattacaggctcctgccaccatgcctggctaatttttgtatttttagtagagacggggtttcaccatgttggccaggctggttgcaaactcctgacctcaggtggtcagcccacctcggcctcccaaagtgctgagattacaggcatgagcc

SEQ ID NO: 99221 - DNA, 1948 bp, Homo sapiens
ttcttctgtccatggaggaggcagtgtccacactgtcttccactgaaccctttaagcattgctgtggaaggacaacaggtgcaaaacttcgcacttctggagggctccataactaaagtttctttctgctttagggttgccatccttggcctgaccggaagggcttctccttccctgcttaaaaatgccttccctcccctgcaggcagtaccagcgacatcatgacgagtgaccacagccctgtctttgccacatttgaggcaggagtcacttcccagtttgtctccaagaacggtaagcaaaggatggtgtctgtttctctgttttcctcaatgacaaggagtgttgggagcttgtcttcaggtggcagtcagtggtctgcattagaggaaggctcattttcccaggcaagtccacaatatcagtcagtttcttcatgtcccagccacagcacaattgcagtccagagaatttacttgctctgcttggcaagtatgtcagccttttgagcctcaattttagtctgaaaacgtgggtaaatcagtgtttaccaaggtgtggcctgaagacactgaagataattctccgggtgggatgggaggagggggcgggggacatgaataaacatttattagtaatgcctttgttttaacatgttttacatttctgtcttctgtttaaggcaagcaccattacttttccatttaatattgtgatataccttattcagctacacttaattttaaaaagtgagtctatttagagaaaatatgaagtaaagagtagcacaggtgcgtggtaggcagagatggtaaaaatcgttaagatgggatgcaaatgactgagttttgggaaacaccacagtaaataatatttagatttgcaggtaatttttcaaataatccagctcagccctggttgccaggccaccctcatcccagctgggccaggtgttctctgtaatgtgcccatccagcccttggcctaggtgaccagggagccatgttgtctctgcccagtctctgcttccgcggtcagcccagtggtcactgggctcctttaggaagaccaagcgtaggggacccaaatacagggaaagaccatcttgctctgtgtccttcatgccctgggggacacacgtgaggccgaagcactgtcttcctggggtgctcttatctatcctattgtatctaacatccatggccccagaaatgtgacctccctcctccacccaagccttgacccaccatcgtgtctccttcctaagtctggccactgtgcctttctagaatcttcctagtccttaggcaggacctcttccccgacttccacccatctctcctttctctgagctcctgcagccttgaaggggttgcccttgccatctcctcctctattccggggtagggcatcctccatgtcaggctgggcttccctccacgggggatcagtacacagcagatgctggaaaacactgatcacggggattgagcattgacagggcatctacctaagccaagcctggactgggcactgtgggatttagaaagagaaaggaaagaaggaaggatgtgagggatggaggaaggaaaggtttgttcatggtctccgaacaagtctctgttctgtggctcaaaatttctatgaaaggacagaacacttgtttaaaagcagcttaaggatgcttgcaaaagcatcgtctaaattaatacagttgcaggcaagttaactctgtacaaatgagcttatggagtccagaggaaggagtggggataactgtgcctaagggagagagagctgctagccctcattatctgaactcagaaacagcattgatctgggtattgagcaaccgagccattgtacaaagtctttttgctggaactagctgggagcctgaaatagtgggggtattgcctgaggtcacacagctttagtgacagagatg

SEQ ID NO: 99222 - DNA, 1717 bp, Homo sapiens
gcagccctaggggcaggggtggccatgaatgtactgaccccccagtcccttgtaggtggcaagcagggtccaatccctggccctcagggtggactgtgacccactctaggttccctgcaagctggggctctgactcaaccagagagtgttgggcccaggtccagacctcaaagagccggtgtgagggcctgagcagcagctgcctgttgtcgccctggcccctcttgctcgttggagatcacagcgtctttctcggggggactgcagcgtccgaaagcaagcaggagatggacaggctcccctgagccagcagcctttagcacaaactgtgtttaggaaacaccctttccgggtgacatttctaggcagattgtctaaagctgtttcatggctagggaagagctgcgtgtgtccagccgtcttcgctgagatggtctgcacagtgatcgggggaggaaaagggggcatcacctcctcaaaagggcattttgtgagggcctggctgggatgcttccagaaatcaggaagaagcgtgtgctgccagttctgcccctctggtccctgcctccttctccaactgaggtgggcccaggcctggtgctagagcggcctttgtcactgagtccccaagctccagttcacccagcagggtcaaagcggttcgaaaaatgatgaggatttttgtgcgggtgtttttaataaactatcaagacagttccatacatttctatggaaacagcatattaggaagcttaaattagaatttcaaaaggctgctatcttgagtggcgtgggacgagctgtcaagtttcctaatctttttgcctgtgatgtgatgatttctttgttgcctggtttgttgcaaagaggaactgaaaaggagggggaatctctttgattttcctaaaaataattagaccatgttggcaaatgaccaatccctgcacaaaaacagaatccccggcaggcctgactcctaaatgatgctgaggccccgagataaaaaaaaaaaaaaaaaaaaaaaggagagagcacatcttcctaggtctgggtggggtgaccccagggagtcttttctgtctggttcttgctctgttttctgaaaaccagcctttttgtcctccaacaggttttgtcaagagtcaggaaggagaaaatgaagaaggaagtgagggggagctggtggtgaagtttggtgagactcttccaaaggtaattctagagcaaggcattccccagagggagatttgcatttactaggccagtagtaccagccagtggcagagctatggccaggcctgaccagaggaagcaggaatctcatagaccaaatgcagaaagagacccactctaggagcaagctctcgctcaaggtggttcgtaacacactttacagcagtgggtatgtggccttattattcctaaatggtttcagttcccctaaaggatcacagaagggatctagaggtcagctcgtctaaccacatgattttgcaaagaaggaaactcaggtgcagggccaagcgctgtttgctcatggcctcatggctgcagtaacacacctaggacgcaaccccaagaccccgatcccctctttgacgcttgttttcctattcagtgctggttcatagaatcgagtacaaagaggcatagagaggggtccattggctactgatcatacacttgtgaacacacgaagtactcgacatgtctgtgg

SEQ ID NO: 99223 - DNA, 3244 bp, Homo sapiens
tggcagagcacatgggagctgtggagtgtccctgacagcctatacgctcagaactcagttctcaggaggccggtgcctgacacagtggcagcgtgcagtgtgtctgttggggccaccttgcctgggtctgggccatcccctccatagctttaagctgattgcccccaattccaggctccaaccttgatctctgtgacctcacactcatttttctaaatatgcacatggctgtctctatgctgacgctgcacacacaaatgtgtgagctgatgtgttccagaggaacccctgctggagtctgccctgaaaatcccctccttcctgccacccaggctacccccccaccatctctctgccctgccagccttgccagcttctcattccatcctctgcacctgctcaccagccttcggaccgtccaggaacaggccaaacccctctcacctggaggcctttgcatgtactcttgccactgccgagaacagtctccccttctttctctcttatctgcttatcttcttatctcagatgaaagaccacctcctcagatggggcctcctggggtcacccaatgcccagttggtcccaacacttcactagtccccatctctgccccttgttattctcagacttcagcactacatcaataccgtgtctctgtgtcactgagcttgtttttctctcccatcaaaagtgagttccataagaacagagaccatggctgcctcactcacagccatattccctcctcccggcctggggccaggtgcttacgaggccctcagtaatcacggtgttgcatggatagatgaatgaatgaatggatcactgcccaagaggtgaaggagttgaggagagctcgagagagccctagggttatcagaggacactttccttgggctggtgctgaccccgagaagggaagggacccctgagatgtgactccatgtcctccctgcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggtgagcatcctcttcattaagacggctccctccctccttatgaaagcgccctgggctttgggctttcaccctagaatggaagcctcataagggccacaatttgtgtccacttggctcatgacttatccctggggcctgaacacagcaggcccctgacatgtatgtggagtcttccatgtcctaacctgttagtgcaactcgattgctttttaaagggtaaaaatttgtaaagatattgccaagaaaaggaacctcctataaaaactatatacatatcaaaaaacatgttttgggccgggcatggtggctcacgcctgtaatcccagcactttgggaggccaaagcgggtggatcacctgagatcgggagttcgagaccagcctgaccaacatggaaaaaccccatctctactaaaaatacaaaattagccaggggtggtggtgcatgcctgtaatcccagctactcaggaggctgaggcaggagaattgcttgaacccaggaggtggaggttgcggtgcgccgagattgcgccactgcactccagcctgggcaacaagactgaaactccgtctcaaaaaacaacaaatttcggccgggcacggtggctcacgcctgtaatcccagcactttgggaggctgaggtgggtggatcacttgaggttaagagttcgagtccagcctggccaacgtggtgaaaccccgtctctactgaaaatacaaaaattagccaggcatggtggctcacacctgtaatcctagctgaggcaggagaatcgcttgagcccaggaggcagaggttgcagtgagccaagattgcaccactgcactccagcctgggcaacagaacgagactccataaaaatgccaggtgtggtggtgcatgcctgtaatcccagctactcaagaggctgaggcaggagaatcgcttgaacccaggaggcagaggttgcagtgagccaagattgcaccactgcaccccagcctgggcgacagaacgagactccataaaaatgccaggtgtggtggtgcacgcctgtaatcccagctactcaagaggctgaggcaggagaatcgcttgaacctaggaggcagaggttgcagtgagccaagattgcaccagtgcactccagcctgggtgacagagtgagactccgtctcaaaaaaaaaaatggccaggtgcggtggttcacgcctgtaatcccaacactttgggaggccgaggcagacagatctcgaggtcaggagatcaagaccatcctggctaacatagtaaaaccccatctctactaaaaatacaaaaaattagctagatgtgctggcacgcacctgtagtcccagctactcgggaggctgaggcaggagaatcacttgaacccgggacgcagaggttgcagtgagctgagatcacaccactgcactccagcctgggcgacaaagcgagactccatctcaaaagaaaagaaaaaaaatgtttctagagctagttaacctttgggcatctcccgctccctagagggccctgtggaacagggtgggagtttccatgtagagcctgctcgcaccctccagttcccctcttttttctcgaccatgaggttccccattctataagcagcttcctagtctctcctgtaggggacacttagttagaaactggaactagggatgtaaaaggcagggcagccagcctgcagagagaggaggcccggccctgaaactctggggaagccccggacggtggagaaaactgatctgagtctagaactggttcaggcagaagaatggaagccagataggagaccgggctacgcagccgaggaacagggtcagcacttcccaaaggcacagacgctctctggtgctgctggaacagagcagagccaaccatgggtacctcgtggatacacaagtggggagctctacatgtttctagtagccacaggatgacagacagacgtgaaagtgcaggcccaattaccaacgatttaagatgggcaaga

SEQ ID NO: 99224 - DNA, 1133 bp, Homo sapiens
taaaattaaccatttcaaaatgaacagtttgctaggctgggcacagtggcttatgcccataatcccagcactttgggaggccaaagtgagaggactgcttgaagcgaagagttcaagaccagcctgggcaatatagtgagactccccatctctacagaataaaacaaaactaaaaaattagccaggcctggaggcattgctactcccagcaatgtccagctactcctagctactcccagctactcccaagtagtctcagctacttgggaggctgaggggaaggactgcttgagcccaagaggttgaggcagcagtgagccatgaccgcaccactgcactccagcctgggtgacagagcgagactctgtctctaaaacaaaacaagacaaaacaatttggtgccattcagtaaatttgcaatgttacatgtctctatctagttcagaaacatttgtatcaccccaaagaaagacccagagccattaagcagccatgctcccatgtcttctcccctggacatgtgtcttccctgctctgtccctggctctaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggact

SEQ ID NO: 99225 - DNA, 1005 bp, Homo sapiens
ttgtggtgagccgagattgcgccactgcactccagcctggtgacaaagcaagactccgtctcaaaaaaaaaaaaaaaaaaaaattaaaaaacaacaacaacggagtttcactctttgttgcccaggctagagtccagtggtgtgatctcggctcactgcaacctgcgcctcctgggttcaagcgattctcctgtctcagcctcccgagtggctgggattacaggcacctgccaccatgcctggctaatttttgtatttttagtagagatgggatttcaccatgttggccaggctggtctcgaactcctgacctcaggtgatctgcctgcctgggcctcccaaagttctgggattacaggcatgagccactgcacccagcctcattgttattattaagtcgcattcatacttgaaaatttcccaatattttggagaattcagcacactttccctctccttcatgtaaaataaaaaattttttgagcaaaactaacagtgattaagaacagactccaggccgggcgtggtggctcatgactgtaatcccagcattttgggaggccgaggtggatggatcacctgaggtcaggagttcaagaccagcctaaccaatatggtgaaaccctgtctctattaaaaatacaaaaattagctgggcattgtggtgtgcacctgtaatcccaactactcgggaggctgagacaggagaattgcttgaacccaggaggcggaggttgcagtgaaccgagatcgcaacactgcactccagcctgggcgacagagtgagactccatctcaaaaaagagaacagtcaggctatgttggatttgaatcccagccctcccacctcctggctctgtgccttgagcctcagtttacccatctgtaaaaaggggctgttaatagtacctacctcatagacttagaaggagaattgcattgtaggctattatgtattattaccatgtattatcatctatatagaaattatatatttatatttat

SEQ ID NO: 99226 - DNA, 3235 bp, Homo sapiens
tgcagggacctgggccacttagttcaacatggcctggtgagaatgagccctgacagcccttctgttcttgtcccacagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactcagctgtgtgtgtggcgtttttcctgacattcggagccatagatatccttctagatggcagggcctgcacagggcacaactgaggcagttaagggttcatggtggtgatggatggtgttgccctgaccagatgggacaccatagagccagtttgaagctggtcctggactaggaacaggagtaaaccgcaccccttccttccttccacccacacatcttcctggcactccaagcaccctgcggccacccagaggccacgagcatcccctccaaacctgctgtcctgcagcccacaagttcctcccagcttttataagttttcaccacttaagctgcagtgacaaaaaaaacacgtcaacactccccaggtcatgggttcccaggtcagggagtagacccccgcccagaggcacagtgcgggccacttccacggcgcctctgccccaccttgggctgcctggcctctgcttctgctcacagacaccaggcctgggctccaggcagggcctggagccgtgtctttggcagcctccaagcaaaccattcactcccaagcctcagtggcacctggagcccagcaggggcaggactgagtgcctgctgggaccatggctccctacccccactcaggtgtccccgccctgcaggctcactgcctggtgtccgtgtagaacctgacctaagtcccaggccccagcctctgattcaacagaccaagggccacggtggagagagagctggagacacccagacattctttagtctcccagcccccatcaccagagctgaggacccaggcatggatgcccatggtccctggggaacccactggctgctggggtgggctggcctgctacacaagtgccatcatctgctcacccacagggagaatgtcaagcccaaggccccatgcccacttaggatggatgtctaggcactccccagcatttctgtgggttcccaggagatacgggtaggagagcaactgtttggggcatacatcatgctccccgtcacctgctctgggttccagtcactcaagcaaatgcagtgcccccaccacagtcaaacccagggctgctgtgaggacctggctttgattgcacgtggtcggacagctgaggcccacctggtgctcagaacaggaaacgctgtggaatgcaagaattttcatccttgccttttccatctctctaccctgcacccaccccgagaggtcccggaccactttctccctaggctttttgctgccgtgatcatctgggttccaccttgaccaggtctctctcctgtctctcctttcctgacaattctaggcattccaaacacccaggttcccccttctggcagagggggaacccagacatccccacctccttatcacctacataattcacctccaagtaattcacctacaccaggctccctaatcaagaaggcaggtcaattagccagctctcatcaaagtgctccattcctaggatgaatttcaccgccccctgagattgcagatgctgctacagtcactgttccttttcagaggtaatttttttccttctctgcttgatgctatgaaggctggttgagagcagcagagtttgtgccgacaggaaggtgttaccctcatgatggacagtctctagcagcgctcttcccagtgcctccaccgcagccccccccccacccccccgcagcctggagggcagcgcctgcagccagtgccacctgcagggacagagtcagccacgggctcctcctccttcctgcatttccattctttttccacaccattttccccacccggataggagagaaattagtgagtcattcagaaaagctctctcccacagctaccttccctggttccagcctaccaggttctcatctttgcatgtccttaaaatagctcctttctcttggcaaacaaatttccatggagacccagctatgggaaggcccag

SEQ ID NO: 99227 - DNA, 1188 bp, Homo sapiens
acaaggtgaagtcccacgataagccgtctgcaagtggagaaacaaggaagccagtccaagtcccaaaacttgaaaagtagggaagccaacagtgcagccttcagtctgtggctgaaggcccaagagcccctggcaaaccactggtgtatgtccaagagtccaaaggctaaagaatgtggagtctgatgttggagggcaggaagcatccagcatgggagaaagatgaagactggaagactcagcaagtccccttctcccatctcctctgcctgctttattctagctgtactggcagttgattaaattggtgcccacccacagtgagtgtgggtctacctcttcagtccactgactcaaatgctaatctcctttggcagcaccctcacagacacatccaggaacaatactttgcatccttcaatctaatcaagttgacacagctgaaatgagccactaccactcaggatctataagatacaagcctgaggcaagcaaggagcaatgacagtaaacagcacagactgcagacagggctgcaagtactgacttcacatcaacgagaacccagtggaagctgagagagtgcccatttttagcacaaaatttttaaacctagatgaaaacttagagaagtaaataattcctgccaaagtctcacctataagttatctgaagttagttatctattaactttgtgactggacaaattatttaacatcttagagaagacagaatttgcgatttgtgttgatccagattaattgcccttaataagtcaataatgttcagaagaatgcaatagaattctgaaaatccataatctttcttaatgtccaaacaccattcaaaattgtttcataacaagaatccacaaaacgtgacccatctcaagagaaaaaacaaacagccatgatcaaccccattccagatgctggaattagcaaagatgttgaagcagctactataactatactcaggggcataaaagaaaatactctttttttttttttgagacggagtctcgctctgtcacccaggctggagtgcagtggcgcaatcttggctcactgcaagctccgcctctcgggttcacgccattctcctgtctcagctttcccaatagctgggactacaggcgcccaccatcacgcccggctaattttttgtatttttagtagagacggagtt

SEQ ID NO: 99228 - DNA, 1052 bp, Homo sapiens
aggttgggcatggtggctcacacctgtaatcccaacactttgggaggccaaggtgagaggatcacttgagctcaggaatttgagaccaaccagcctgggcaacatgacacaacctgtctctacaacaatacaaaaaattagttgagtgtggtggcgtgtgcctgtaatcctagctactgggatggggctgaggtgggagcatcgctcgagcctaggaggtcaaggctgcagtgagctgtgatagcaccactgtgttccagcagcctggtcaacagagcaagaccctgactctctctctatatatataaaaatatgtttacaaatttgcagtttgcctaaccagcaattccacttgcaggaatttatgccaagaaatatttggacacatgtccacatacaaaaatctttgttgcagaattgtttttaggttggtgtaaaagtaattgcggtttataataatgatgagaagttggagaaaaaaatctacatttccaacaataagagattggttaaattactgtacatttattgctggaaattgttgatagtaacagcagtatatgtcataatttatgtaaaatgagtatgtccctagctcatcatagacaaatatttgttgaacacatgaagaataatttctaaagaaagaatatgaagctctgctagtcctgccctcctcctaactcaccagctttatctagcacacaaccacagccacgctgaagcctcttacttccttctgcttaccgtgctccctctcgttgcagggcctttggatttactgtgttgggcacatcttcccttctgacttctccaaattaatttctgtgtgttcgttctcatttcagtagtcacttcctcgcaacagtaggatgagagaccttcacaacctgttacagatcttatctccctgttacgcgtgtacctctcctttatagcattgatcccagttataggttcacatgtatttgtatcattacttgataaaggtctgtctcccccagtagactgtaaactccatgagacaagagctgtgtctgtttttgcacatc

SEQ ID NO: 99229 - DNA, 1065 bp, Homo sapiens
ttgggggtctcaaccagctttaatgagcaagagctgcctcctagttcctggagaaaaactttaagcaccagttattgtagtgagccacagtcagttattatttataaggaagctattgggagtttagttatgtgttgtttggcaactcgacttgctagtgggagtttggaactagaaaaaagtgatgaaaagcaggcaaggcaggttgaacggtgggcttcatcaggttaccccttgttcagtctttccatttccacaaacattatccataataagcctgccctcctgacttctttgtttccattcacagtatcgttgttttccactagtcatctatggttccttcttccctctagatcttcccatctccatattcctttattcctcatattccccatattcaccaagcccattggttctccaccccctagcctcttgcatcctttggtttgcatttattttgccacctcctttgtttatttatcttcttattcccagactgtggtgagagcctcattcactcaaaagactcctgtgaccgtagtgtgggctgggcattagggctgtagagatgagtaagccagagtccctgctctgaggaggaatagagtctagtgggggagaccaactcaaagggacatttgctagagaatgtaagggtgttcacagaagctgggcactttgttggtttcctttcccctccttcctgtctctccaaagttcctgcctgtctcatcctaattaaccgtaaaacactgcacactgtgcttaaatagtgatctgcatcagttatcagactttctcttaagtattttcatcactttgcctacagtttaaaatcaaactcttcagcctcgaaattgtttattctaagcacggttcctggactagtgacatcttctgggaaactgttagaaacgaagattcttgggccccacctcagacctactctattagaaactctgggggtggggcctggtaatctgtgttttcagaaatgctttagctgattgtagtgacctctgaagtttgagcactaccacctttactgctactcagacttcc

SEQ ID NO: 99230 - DNA, 1086 bp, Homo sapiens
taatactcagtttccatttgacagtactcagttttcacttgaatggccacaaacgaactctttaggtctcctccaaaacctgctcctcccacagtcttgcccatttcagtgggtgacacctaccttctaccagttgctcaggccaaaagccttgattcatccttgactcctatctgtcttcatgccccatagccaattcaaagtcaagtcctgttagcgctgtctttggaatggatctagaatcagaccgtatctcacctcactgctcccaccctggtctgagccgcactgtcccatgtttgcacttcacagtagcctgctggctggtcttcctgtttcggcccttaccccactgcaatctgctctccttttaaaacctaagtcattcagctgctcagagccctccagcagcttcccttcacgcctagtaaacctcacagccctcggaggtgcccacaaggctctgcatcatttccccacctcgtccttgaccgcacctcctctgtccccctgtgcctgggcttcagtcacccttcctccaaatacaccacctgctgtacacctctccaggctctgctgctgctgctccttctgcccagagggcccttccctcaagggtccacatggcttattcctcacttccttacagtctctagtcatgtgtcacgtaggagaaaccctcctcaattacgttaaaataggaccccctccctctgttccccttcttgtgcttgagttttctgcaagcacatgtgactgctgacctcacacgtgctctcagttgactgtcagctgtgtggaagcagagccctgcactcactgctgcgtcatcggcactcaggtccttgctgagccagtgggccctgttggtgcctgttactgggacttcattcaggaactttccaccctttattcctgatgtgcctgatggtcacagttgctttgcttttttccatgtgtttcatgtctcctcctttccactcatagtgcctgtaaccgcagctgctggagacacccgaatggtttattggctttgtgaacatgtttctggagttatggtttcattgcctaattggaaaggtttgg

SEQ ID NO: 99231 - DNA, 1056 bp, Homo sapiens
gcccatcaccagaagggcaatcctgtgagagcgctgccagttaccatgctccaaaatcagcatgagaggcaagagtggagaggctttaaagaacaaaaaagcctgctacctggtgcgctgaaggcctcactgatggtttcataaagcttttcagtacaaaccctgaaatttcagagacattcgtgagaaagaatcaagtcctaggctgtgttcgcctggatggtggtcttacggcaaagctccagttgggaaaatacagttcaccatcagtacagctgaattgattatcttttcagcagaaatgagtctccaaaaaggtagctgaagttgaggagtagacagctgtcctcagcaagcccctggcagtcacctggaacacttctcattccagccaagctgtccttcaacagggagtggcagggatagttcccctttgtgtccccataggcgcctcggctccttgctgtcacccagctcatttattctttcttaaaaataaatcgccacccactgtgtagtttccaaatgaggtcctaaaatttttatttatgaaagtattcttctttatctcccagttagctcaactggtgattgacctgaataaccaaatgcagcggaaggacagggagatgcagatgaatgaagcaaagtgagtagagaccccgcctccttggagcctggtcattgggtcccatgtcctttgttctgctgacctcttgtgagcagggccagtggcagtgagtggccacagtgcacttagcgagagtttgattttcagtgcatacacactctgggatccttttctaccagctctgagaaggaaaaagcaaggacagtgcccacaggcttctagcatcctcctagggatgtcaccttggctcttgcaagtggcccagagacactagcagctctcctgtggccgctgtgtgtgggagctggtatgttcctgtggtggaggtggtagggccaggatagctgagcgcatggcccttgggaaaagggaaatgagtttgtgagcaaaactgttgctgaccagggagaagcctggcagacaag

SEQ ID NO: 99232 - DNA, 1113 bp, Homo sapiens
ccctgtctctactactaaaaacacaaaaattagctggatgtagtggcaggtggctgtaatcccggctactcaggaggctgagacaggagaatcgcttgaacacaggaagcggagattgcagtgagccgagatgatgtcactgccctccagcctgggtgacagagagagactctgtttgagctattaaagacctttcctttcagctatagtgatgaatccctgataacaggtggtgttttcctctccctgtgaccctaagtcaagtttttatctccaccttgcagaactgggacctgaagttatagaaagtagatttcagacagtcaacaagtgctttaatcatagagtagtggtactcacacaccttataccgagattctggtttttcctcaaagagagttagttcacagttgtctctaccagctaagacaatttggataaattgtatttttggtaatttgccctgtaaaacttatttttcatcttccaggtataaaatcaagagtgtaatgcactttttaagctatacccacatcccttcccaagattctgctatactgcctagaggactttccttcattttgagaattaccaccgtggtaaaaacttacgagaaatttcagcagaattcttgattgcagctcagtagcattgctagagttctacattaggggtcctccacctagcaggcatagccatagttagaagtgaaatttatcaaagaagagagagtaaggtcagggttaggagttagggagtttctgaatttaggacttgaatgagagacaaaaatgattctgagaaggggagttagtggatgagactttgaccatgttaaaaatttgtcacagccaagacttctatgtcaagctttagtaaattaaagttactaatgttatgtaaactttgacatttcaagaatctcactatacctcagtttcctcatttataaatggcaataatgatatttacctcaaaaggttgttataaggcttaaatgagttaaagtctgtaaagtaattaacaatgtcaggtaaggggaagtcctaagtaaatcttcactgttagtaatcaggctgtgggtgtgttaatgcaggttgagcatcccatatc

SEQ ID NO: 99233 - DNA, 1036 bp, Homo sapiens
tttgtttggttttttttgagacagggtcttgctctgttgcccaggctggagtgcagtggtgtgatcatagcttctaatgtttttatttctgtaaaatcatcttacagattttagaaagaaaaatgttaaaggaagaaaatgaaaacatacagttcttccaccactcagaactaacatccatatatcattttaattgtattttgctggcttctaatttctcacaaatcatgtactgatacggcctttgaccctatttctgattacttacttgagatagattattgaaaataaaatttgatgggtcaaagcttttggaacatcaccaaataaccttccaaaaagtttgtgttcatcagctgtgaatgtgaattctaacttcctgcactcagtacccgttactgcctcactgtttcctgttgacactttgaacgatcagttttctgcctcttaattgtgcctgccatgtaatgcggtggggtttttgttgttgttgttttgtttgttttttccctccttgctccctttggtttgtaacttaaagtggaaacttaagcgaaaactaagatctcttggaacaaaaggaatcaaactagttctggagcttttcctaatctgcctacaagttaaggtggggtatcttctctgagatttgaagctttcatagtggtagaaaagagtttccttcgctctaggatgtttcttttctattgaaatgtgttttggaatatagttttagagttttgatccactattttttaaaatgttggttgcttccctgtaagtggaggggtttaaattcaactaggagtcattcaccaactaacgtcttaatttacaaagaaacaaaggttcccatatcatgcctttgctttagatatgtagggtacgtgtgtgtctgcactctcagatgtggaagattaatctcagttgtattttcccaagccacaaagtaaataaatagttgacctggaaatgagatttggtttcttcagaataacagcttataaaagtgtcatttgcataaccgggttgactg

SEQ ID NO: 99234 - DNA, 1013 bp, Homo sapiens
gctgtaaaagcctgttattttattttgtattttattttattttgagatggagtttcactcttgtggcccaggctggagtgcaatggtgcaatctcagctcactgcaacctccgcctcccaggtttaagcgactctcctgcctcagcctcccaagtagctgggattacaggcatgcgccaccacgcccagctaattttgtatttttagtagagatggggtttctccatgttggtcaggctggtctcgaactcctgacttcaggtgatctgcccgccttggcctcccaaagtgctgaaattacaggcatgagccaccgagcccggcctaaggcctctccttaatctctatgcttccctaaggagtttctgggtcagaggacatacatctttgaaaggttttgataacttagcaaatgctagtgttttcttgtggtcccgggcctaagcacagttgcaagtacttaaaaccataaaattctattttcaacaggacattgtcaaaggctcagctcatatttgcagttcctgtctttgcagttctcctctcttccttgtatgggcacaggtgactctcgcaaacctagatccctgggaaagccaatcaagaaaataaagcacagccttgtcctttttctttcgacctgccttttattcccttctacatcctggccaagaatgtggtgcaataattacacatagtcctggaataaatagctaaggaaaataaatttactttgaccaggtttaacttgcttagtaacaggttcttaagtatatatttacctaatccagataattatttattgaaaaggaaaaatctttctgtcaagttcttatgaatccaaacagtaggtgatgaaatcttgggttattacatttaattatcttctccatgaaggttgcatctcagtaggaggtcattaagaccaaaataattacttgccctcctccaagtaggaaagacgtggcccagaaaaatgaggaagggggattccagaggtactttgcatccgc

SEQ ID NO: 99235 - DNA, 1134 bp, Homo sapiens
cctacactgttgttttatattccatagctgctgcccctaactaccctaggtacccctcagcccttgtgtcatgggaactgtgcttggtgagtactgcagcccttcaacagtgatgctgactgttgatggaatgccctactttggcactggttatgtggttatagactcaacagatcatattttattgcttcaagtgggaactgtgtttatacctaaaaggatcaaaagctcacttttaaatttattctcagttgaaattctggatttgatttgaacaggttaaatgtttattgtagtgttgttcagaacatggcagctcttcctttttctccaaagaatctttaacgcattgctgtcatagccaagtggtttaggatctaactagaaaatgacattagcatttgcggaaccgattaatcacagaactgttcaggagaatcaaagaatgtcttgcctttctttccagggatgatgacattgaggtcattgtggatgaaacttctgatcacacagaagagacctctcctgtgcgagccatcagcagagcagccacgtaagtaggcaggtttgggccagggaaaagacagcttgaggagcaatatgaaggcacatctgtggacatgacaaagaatgcagtcagatgcacccaaccccttaccccttttctgggacacccagcgtcgaacacaccacagaggtgtccagtctttctcagttcacctctgcttaatgggagggaagcagaacacgggtggcttcaaatgcttctaaatacaaaaaaatgtagtggcttactcaaatatggacagtgaaaccttattaagcagaatgattgtttaggtttgatcatcctgtttcattcttactagggcttccccccgcccgcaccgcccttcaagagtggggattggttactaacagtcagaaattgtgaagttagttagccaggaattgtgaggttagttgtctaatgctttatttccagggaaattaatttaatactagggaaccttgtttcttttgaaacttctaggctgggttttccctttcccttcccactgttttctggcagtttggtactgtgttgggtttctcttggctggggtttgggaactaagtgggaaacatattccc

SEQ ID NO: 99236 - DNA, 1966 bp, Homo sapiens
agaatctagaaggacaggctatcaacagaggcagtctgcttaagcaaggtcgtcttggagtcctttctaacaatttgatgagcagtaaacctctgcaatcctgtctaatatttgtctttatgttatttcttaggagacgctctgtctcttccttcccagtcccccaggacaatgtggatactcatcctggttctggtaaagaagtgagggtaccagctactgccttgtgtgtcttcgtaagtatgcttcagccccgaaccctaccacgcttgatatggtgacagagcctggcaattaaagggtcctttctaggcctgcagctaagcattccattgttttacttatatcaagcctttccaccttttggctctgtcagctgtgagaaattgatatattttgcttagtttcagaggacaaaatttgttacaaccatcctctgtaatggcagagctgactgagaaaggattgctagcatgagggatggggcaaaggaaaagtaattagggattgtgaaaaatgggagagggatttatataattattgtcaccaattggctccagtttagagtgagttgccagtcagtggtgtattatggaagttcagtaggacagctgttggtttcatgaattatatccctatctgtatgactcccagccattaggggtctatgactggaagcagtcctgggcagaagccacggtgatggataccagggctgtcacccggagttcagagctgggtcctagtactagcaggtagtttgcatcccagctggggtagttgagcagaaattgaaccagcctggggaaacattcagtacctggctcagaactgtcaaagcatgaggagggtaggaaacagagcacaaagaacagaacctggagagttggactgactccagtactggcctaataactggcagcgggtaagtgaaaggagccagctttcaaagcagggaagattttgccgtaaaaatgggatggaatttatatggtgggagctttgggttccaggtataaggagggacttagctagttacacagtggactggctgagtgatgaactgccttgactgttgtaaagagagttccgctttggaggaggagttgggatggggcgcatcaacgccccttcccagtcccactccactcctgtgattccatgatgcaccgggcacctgcagaggtcgatgatgattggtaaaaggtctgattgcactgaatgtcacggtccctttgttgccctcaactcccagcagcccattttttccctcccgtcacatttaagtcatgtgtatgggatcatggagcagctgataatttgggattctgtcagtgtgtgtttctgagagtgatcggctcacagctgacgagtatccaacaaaaccagttacacaggagactgacgagtggcagtcatgggtgtgatggtgcatgatctcaagttttcaatctgagacctcctaaggagaaagaaaccataaaaaagaaaaggaaatttcatgggggtaaaaggtttggtcacctgtcatacttttcagcagtgggtcacaagagggaggcaaagtggaaaatgaagttaccaaagtgatgcctgttgcccagcctgttaatagtcactccctccgtgatacttcaagcattttatttttttttagtcccaagcaaatgtaaatatcacatattctcttccccaagtgaccttttagacaagtgattatctacttaacaatctcatattgatagtctatgttttctagtctttcttttccttctctattatagaaatttccaaacatacgcagtatctcttcccccccacacttatgctggagcaatttgaagccaattctaggcattatatttcatccaaaaatattttactgcccataatcttcttaagagagtatagtgaatttttcgattattcccttttcccattctagaatgggatgctgagtctcact

SEQ ID NO: 99237 - DNA, 1037 bp, Homo sapiens
agacttttgtaaagccatgtggagacttgagagatttttagaaatgggtatggtgttaagttgtggtggaactgtgacagtgctgaagactggcttggaggaagcaggtctgcagtggcccgtgcgttcagtgcttctgcagagatgcagaaggcccaggtgggggctgaggaaataggggagaaaggagaggaccaggctcgacacattgaagatgaacagttctcagagtgagagttgggagattaggcaaggagagagtcaagggtgcctctgaggtttctgacttgttaatatttgctgctagtgaaggttgccaagggaaaagtgagtagggaaggctgggttccatttggagcttgaggtgtctgcaatattctgatgaaattgagcaagctcagaaaaaaaaaggtctgaactcgaaggagactggcgagttgaagcacactcacgacagtagctggtattcaggctggttgtatagggtgaagcatctaaaccttcttgtacttgattattggggaatttatatcgtgtgaactgaattcctctgatttggctaaaaattggttttcctcttctttattcccacagggatcttacctcttagcagcttcaaatgattttgcaagccgaatctggactgtggatgattatcgattacgggtaagacccagttaagaaagttagtgcaatctccaaacttcatgtggtgttatcaaggcacaaactggcaggtgcttaattaggggactttgttttcccaaaaatcatgcttgattcaccctgcccttcctttcctccttggggaaatctgtgtttccactttatactctttgtccaaaactcagtttcaaaatatttgcaatgggaccctcacatttgcatgaaaaccttggaatactcttcataaggactaaatactttggtagatagcaattttggcttaatggcacagaacttagcaacagcatgtgaattgtgattcctgtgggctctaaaacctaattacctaaagtgggatatagaagtacaaa

SEQ ID NO: 99238 - DNA, 4105 bp, Homo sapiens
atgtggtccgaagttttcgcttctgtgctaaagtggagttaaccccactgaaaatagaggaaggattggtttcaaaaatgttaacacaaaaaaaatctaaccctgaaccatgaggtctcatctttgggaactaaggtttggagtgcagtggcatgatctgggctccttgcagcctcgaccttctgggctcaagcagtcctctcacctcagcctcccctgtaacagctgagactataagtacccaccacacccagctaattcgaatttttttgtagagatgagggtctcactaatttccccaggctggtctcaaactcctgggctcaagcaatcctcccaccttggcttcccaaagtgctaggattaccagtgtgagccactttgccaacccttgcattttctaattagaaagaaaacatcagtgaataccttctgaacctctggtgttttacacatagaaaaatgttgatcatgcactgcatagaggtcaatgatgaatggtaaaaggtctgagtcctcagatcccctcccggcatcccagttatccccagctgcctctcctccatcgcacttcagaagtgctgcgatgggcagaagggcagctgacactccgtgatgtccctcattctgtgttcctccgtgagctcagggaagacactggttggcatccaacagcttagtcacaaagggatttgattgttgggagtgctggtatctgtggctatgatctgccttgttcaagctgagacctctgattgaaaatcccccaggggttttaattgtttacataaggagtcctgatgtttccttttgtaaattatgcctgtggtgaccttgtctagtctgactttaaatatggaactgactttcagcagcatggcgcaacatcgaggctttaaaaattctttaatttgatataattcagacatagaaaaattacaaaaacagtacagcaggtatctgtggtagagctgatttcaaattcaagattgaggatggggagcacgtgaagcttggtgctagtgatgttgaatttttgtttttaatgttatttttagtgggagttttatccttttggtcttgatacctcacctttggccaacactcaaagataggcttcctatgagatacatggcccctggataagactcagtgaatgaaattgttgcttcttgtcctgtttgggatgtgtgtgtgtgtgtgtgtgtgtgtgtgtgtgacaggatcttgctatcactcaggtggagtacaatggcactatcatagttcactgcaacctcaacctcccaggctcaagcaatcctcttgcctcagcttcccaagtagctgggaccccaggcgcatgccaccactccctgcaaatttttaaaaaaatttttttgtagagatgggggtttcactgtgttgcccaagctgttcttgaactcctgggctcaagcagtcctcacaccttggcctcccagtgtgctgggattgcaggcgtgagtcactgtgcctgacctgtttctttttcctttgctgtcttatcgctttgagtgttcctggccggatctcagggtggtctgacactctgactctggaggtaaggatgctgtggatactttgccagcataggcagggcctggcgccctgaggctcaccctggctgtgttctctctcctagcacacactcacgggacacagtgggaaagtgctgtctgctaagttcctgctggacaatgcgcggattgtctcaggaagtcacgaccggactctcaaactctgggatctacgcagcaaagtctgtgaggaaattcagtctctctgtctgtgtatatgcttagatgttagcgtggaggtgtgtgtttgcacgtcagagcctgcatttatgtaatatagtttgaatttcagatctggcttcatgtttagaggggcactgaggatagtgatagtttttcttgtttaaagcttcatttaagtgagtaactctgacaagtcagtggttagagggtggcagcattatgtaaacagccacgttggtgcctctgcttgattaatgatgtttgcatttctttcaggcataaagacagtgtttgcaggatccagttgcaatgatattgtctgcacagagcaatgtgtaatgagtggacattttgacaagaaaattcgtttctgggacattcggtatgatacccaagctcctgactggaggcacataagagtctccacagtaatggttctgtacatgggttgtgcttttaagatctcaggacatggcagaaatgagtttcggtacacgtatagtgttagcttattaacacttggctgttctttcccatgaagtagactgtggagcttagcaatcatttattgagcatgcagtgagtgctaggcccttcaccagctggcaggtaagaaaaggcaaacaggatactctttctacctttaggtaatttaaactgtagtagggaaggcagaacgcaaaagtcagtgactagtgtgttgaagtggaggcagctacgtttgttccagtgtgttaaagaatgcctctccagatttctccggagacgtgagtaggattcacacggcaggaaagccactcaaacttttgagtgtgtgtctggtggctgatacatggcaagtgagcaggaaacagggcagaagccagtgagggggctatgaggggttgaaatcaggttgccacaggcttgataagccattgtcaaatcactcgatcttgtaagtcgttgggtgtttagcaaggaaatggttgctttgcaggagtctagtagacgactttggtggcattttgagagggcatattagggaataggaaaccaatagagttgataaggacctaagttcaagtcagtagaggaacatgtggaggagagaatctatttgaaggagaatttggacagggcttattgacaggttggaggaaggggaagacaggatggagagtaaatgaggacagcctcccagcagggttgtagagagggtgggggtacagggcctgtggtgatagatgatgctttgaaacacagcatggcaccagaaagtcctgacaatgctcatggttcctggacaccacttcacattttattcataatctttagtttgcttttaaaacctgaaattggaacttgaaagatggaatttgagagttaagttggatgttcgaagtctcttagtccatcccataatttgacaggtgaagaccctgagtcccaaggaagtggagtagcttgcttcaagctgcatatttagcaacaataagataaattcttgcttagttaaggtgggaggtaggaaaaggtttcattgaaagcctacaacaaaatcatcacagaacaggtcagcaccccctttggctatgaatgtcaccaacagggccctgcccagggtggctgttagccaccctggacatgggccacagcacagagaagaagagggaggtgcgtagggccgtggctctgccctggctttcctggccccatatctggaggtggagggccacagagccacagtgaatagggcagaaaacctgcaagaggctagagttacacttacaaggcagcccaggcccactaatgcaggtttctttgccaactttatccaaaagttgaaatcacatcactgaaaataatacgaattgggtagtagccctagttagctcatgctgatcagaaaccgatgggcgattgttgtcattccaaaaatggatgaggaaattcttaccaacttcagagttctagtctgggaatgactgtcttagggtctgttgatgggaaagtaagaaaagcagtcacaggttattagaagactgggaacacattgactgcgctggcagagcgttgcatgctagttgaattgcagtgccttttttttcctccacggcatgatgtgaagtagttctggcctacgttacatttctcagatctgttctccctcttagatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcaggtaactgaagatgtgctg

SEQ ID NO: 99239 - DNA, 1009 bp, Homo sapiens
ggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttcca

SEQ ID NO: 99240 - DNA, 1117 bp, Homo sapiens
tgattttcctgcctcagcctcccaagtagctgggactacaggcaaatgccaccatgctggctaatttttgtattttgttgtagagatggagtttccccatgttccccaggctggtctcaaactcctgagctcaagtaatacacccacctcagcctcccaaagtgctgggattataagcttgagccaatgcacctggcagaatatgcatttctaacaagctcccagaagatgctgatgctgctggtccatggaccagactttgaaaaacaagaccttatggcacacatgtaaagagaagcctctccaaacttcaaataattcttcaggttatagatctttagcatattgaaaatttgatgtgtgcagatttgtgatggccatttatcagtttagcatttcatgcatgtctgattttttaatatgttcgagctctttagagttgaagctgtccacagcaaagacattacttcatttgtatttcctgactacagtacacagtaatgactctgtagaactgcatagctagaatggaaagaaagaaaatggagctaacactccgaccagcacattcaccagcacattataaggtattttgaaatttcagtgaagaaccgtgtaattctgcaaagctatcagttaaaagagtttaatttatttaaaagtttctagaaagttaacattttttggatatgagcatgaaagtgcttggattcctgattttaaatttaaacaaagcattttttccattgtgaaatgaagactagtaaaaattaggtaaagggtttaagttgtaaaaaacttaaaaaaatgcaccgcagttttatgagatataattcacatgggatacagttcagtggttgttagtatattcgctgttttgcaaccatcaccacagtcaattttagaacattttcatcaccccgtttcctctcaactccctcaaccataggcaacaagaatctactttctgtctctgtgtttgctgattctggtcattttacataaatggaatcatacaatatgtggtctggcttctttaacttagcataatatttttaaggttcatccatgtcatggcatgtatcggtacttcatttctttctgttgctgggtaata

SEQ ID NO: 99241 - DNA, 1050 bp, Homo sapiens
tagatggcttgaacgacagttggcccttttgtttgtgcatagaacccaacaaagtgactctaagagcccggtggcccggcatggcccgagcgaactgtgcaggggcctggccctttcactcctgactctgctctagggggcaaggagaggcctcgtcagcctagcagcatttcctgtgggtgcctttcacagctgccacgtgcaaaatacagcacattattttggggtgttattttcttgaccacttttggttcattgcttttgactaaatgtttaaaaatattctgcagcatatctatagtactcacaagcagcgaatcaggagaagaaatgcagtttctgagaaggcttcaaagaaataatggtctttatcttttccccagccttttccgctgaaacccaccagtctttttctgagcactcttgttataaataaagcagcagctctccttgggcagcccaagatcgcagactctcatccgccctcagaaagattgtgcgtgtgcgtgtgtgtgcgtgtgtgtaagtatgtggtgcagtgagttgtgttttaattttgcttttcttttatgtatgagatgtgtagcaggagatgcaagaaaaaatactccagcatctgtcctttaaagataacttataacttttctgggttttgggttgttggttttgtcttttttttttttcccatttagggaagagatggaagtgattgctttccccacaaaggtaaggaagatgaatggggggccaggagagacgtcttcacagtgaggcctttgaggtcaacagagaaagggtctcgtggtatatgtttcaggcttccatggatggcattgttctgtgcagatgtatttgaaatgagtttcatccatgtgtacttggatgtgaaaaggatgtttggaaacaaataccatttcccagtccttcacactgaagactggtttatatcctcgctaccagaatcggggtgggactttctgtctgccttggatcacccttggtctgttttggacgggacctcagatgctaactgtatgctggggatccccg

SEQ ID NO: 99242 - DNA, 1864 bp, Homo sapiens
tgcctcagcctcccaagtagctgggattacaggtgcctgcaaccacgcctggctaaaatttttatatttgagtagagatggggtttcactatgtaggtcaagctggtctcgaactcctgacctcaaatgatctgcctgcctctgcctcccaaagtgctgggattacaggcatgagccaccgtgcccggcctagagatggggtttcaccacattgcccaggctggtcttgaactcctgacctcaagtaatctgcccgccttggcctcccaaggtgctgggattacaggcatgagccactgtgcccagccaaagtagaaggagctgagcttcttgatgtgtgaacagaaatgggaaattctttatttttaggctttctagcaattaaccttgtttctgtgtgccctattgtaggtagatttaaagctagaagcaccaggtgggtgctgctggaggaggagcagccagtgaaagtcacagattactgccatgtttaagcggatgtggtgttagacattcagacaccagtgtgttggctgggattctgaatacctgtgttttttatcaggattggtgtcagtactaatattttggtatttaagaaatctggagtctgaataatttacattttgagacatatccctagaaagttactgcattaaaatttgaaatggaacaaagcagcttgtttagaaagggttctgaccacttccctcaattaaaaaaaaaaaaaaacacgacaaaataaccttttacagttagttctggtggtgcggggaggggaaaggttacttaaaagattgagtttcttttctgagttattagtttgattttctccagggttcctcatagagccatcgtagaatagaggggatggtataagggaaacaggaggcaggggctgtgccgggggaccctgtagggagtggagagggagacgggggaggtccccaggcctgactcccagccctgccctggagcatctttctctccaggaccaggatccttctgctctactcccttgtttcctttcacggccagaccctttccatttggacctgtctctcttctccagaagaatttgttttagccaggaccttccccctccatgtgctcgctggaggaacaagccaggaggacacggaatcctcagtccagaccccggccttccctcagctaaaacactgtgtgagaacatacttcacatgtaaaagtgaatactggtattgacagtagtaaatacagaaataccagcattgggttgtttgctttggttctctctctttcttccttcactaatgcaatgacaatgtttgtagatttttttaaaaaaatcatggcactatacctgtgagcccgagcttttggttagaagcaggtgggtgggttaatttggattggcttattgattggatgctacagtttcaaggtactggggcttctgtgggtgcttgttagggatcattggggtgtggtgggcagcgctggctagtgcttagggatgtacctgtctttatgtgccttagtccctgtgtttgtctctttctagtcaatcatatttgatgaggtggatctgacagatgccagcgtagctgaatccagtaccaaaaacgtcaacaacagttttacggtaagattcctcagtcatgcctttcttgattcttcactgaagttggctttcctttttgatctgaacatgtgtccaagcagttcaaacgttttcattcttttcttactgattggaatgattgctggtaaaatttgaatttaatgctgaaagtaatactgtggttggagaataaccaagaatttggcatgcataagcacaaaaggacaatagggaccaaatgaaaaatttttatatgtg

SEQ ID NO: 99243 - DNA, 1616 bp, Homo sapiens
gggtgtgttggcacatgcctgtaatcccagctactcaggaggctgaggcaggagaatcacttgaacccaggaggcggaggttgcagtgagccgagattgtgccattgcactccagcctgggcaacaagagtgaaactctgtctaaaaaaaaaaaaaagaaagaaaaaaaaagaggtgatcaggccaggagggctctgctctggggatggattaatgctgttattgtaggggtcagttcctaataaagggatgagttcatctcctcccccttgttctcactgtcacctttgacgcagcatgaagcccctcaccagatgccgcaccatgctcttagactttcgaactatgaggcaaataaacttctgttcatttaaaattatctagtctgtggtattctgttacagcagcgcaaaacagactaagacacatgtctagagggctgcttatgtgtaatagctatataatactgcatatataaagggcagtttatatttaatgctggtagaatatcatgaaggtagtgtatgttagagttaggtttagctactgtattagtttctcatggcttccatagcaaattatcagataacatgaaacagaagaaatgtaattctatcacattcctggaggccagacatctgaaatcatggtgttggcagggctggggtcctaggagagactctgtgacttgcttttcccagctcctggtaattccaggcattccctggcttgtggctgcatcgcttcaagatctgcctctgtctccacatggccttttcttccttcttctgtgtcttctcctctgttttcttaaacagacacctgtccttggatttagggcccactcagataatccaggatgatctcatctcaagatccttaacttgattacatctgcaaagactgtttttctaaataaggtcacattcacaggttccagagattagaacatggacataccttttggaggccatcattcgatgccctatagctacaaataagaatggtgtgaacaggcaaggttttattctttcacaccaaagaaagtagtccttggtgagtatggtcattctgcaaggtcgaccgagcccttccagaatgtgagtcttctagtctaagaggctatgaggtgctagtcaccactgtgtctcctgttgttggacggggagacgaggagaggagaaagtgtgttgcctggtaggagttcataaccaggattcatggccccctcaaagcggtctgtggatatgactatattgtattaaaattggtttccactgtaatcataagtattttatttttggcacttagagaaattctgagaaggagttcataggcctcaccagactgccagaaggggtccatggcacagaacagacgaggagctcttgtatgacttctccaaagtgtgacatggcacttctgcggacatcctcccggttgatctttagttatgtgctcataccgtatagctctcaggatgcttgccctgaaataatcatatcagaataaccatgttatgcagagagaagggtgatttttcatgtctgtatttatgacttccttttccccaagtaatatttttgaatagtttatggtatcaagaagtttgatga

SEQ ID NO: 99244 - DNA, 1906 bp, Homo sapiens
agaaactttatgagagaagggatatcatggggcttgttgatctgttttcatcccagcgcccccgaaccatgcctggcaccaaatagccacactgtaaatgcctgtggggttaattgatttgttgttgctgtatctctattccttggcacctctgggaagcatttttgtctccccccgtccacatgggaccgtgtcgtcactgtgctgtgacgggagctggctgagtcaggctggcaggctgtggctgccctgcatgccgtgccctcccacggtggctcttcaaattcttggctatgtgcccagcactggtacacagaccctctgagtcagggcttgccaatggaaaaaatattttcaaccttttttggtcttttaaaatattaaaacctatagttggaattacttcttttcatttttacaatgtacttgaagtatcagaggaataaggaaagccattgtaagcttggttagtggaaagggataaaccacctctgagcatccaaataaaattaggaagcgggggttctagatgagggaggacaattccaggaggctcttgaccttgtatatgattccctgactgggaatgtggtctgagatgccctttcctggacagattacaaatgacagcccctggagcaaacacatgaatcagccagggagttaaaaaagaacagggtagtttggactgggcctctctctttcaggacatgactgctgtggctacagactgcattcaggtccccagcatctggaaggagtctgtgcccacttatcctttgcatcctaaggggactgggtctttgtgcaccagcagcagccgtagaggttgggcttgggaatcaggggctcccttatcaaagctgggaaacttagaacaacagctgtgccgctcatggacctgtagtctctcctgttaagcagagtgctgagttcatgtgatagcaaacacagctctgccagaccacagggtcaccaggcaggcactccatccctccctccagggggagaccacggcatgccttggatgaggtgacttggccaactgtcttgtggccccagctcctgacattacaatgtgatgactgtgacacttggaagagaaatgtctcaggtatcgtggtcctgggtcctgtggtacaggaccttgtctctgcggtcctgtacttttgcttcacaattagaagaattgaaagcttcaggttgtttcaggtatgttttttcaagaagtgcaatagtagtgtgtttatagatgttttccttagagttagttttgggggagagaagatgactgcccttccatcctgcaggtggattggctggggaatgaggccatctcttttcagagtgagcagtgaaccatttttgtctgtacactgacctggggctgatttggcatcctgaccttccagtctgagggagttggtaaggggctggaagggcccattctttgtgtgtgtgggtattttttagagacggggtcttgctgtgttgcctgggccggtctggagatcctgagttcaagcaatcctcttgccttggccttccgagtagctgagactacaggtacatgctggacccacactttggactctgtccctgctggcctagttctttgccaagagcaaaacttgagagcaccctcacacaggtaacagttagaccttgtcaggagacatggctgttttcccagacagctgagctttcagactaaagcacagaaaagttggaggacatgggactccttagcccacaaaagaaactctattttaattttccatgtgaaataggagtagggtacgttagggtagggcatcttggttatgagatgcctgcagcaagtgccatcagggtggctgccagctgagtcatctccctcaaagagctttcctggaaccactctccc

SEQ ID NO: 99245 - DNA, 1047 bp, Homo sapiens
ttttctcatttctcttggaaaatcatgtacttgaatcaagaatagaagccaaaattgttctttcaaatagaattttaaagcttttttttttaatccttaacatataaacgtaagactttatttttatttatttatttatttttaagatggagtcacaccctgtcgcccaggctggagtgcagtggcgtaatcttggctcactgcaaattccacctgccgggttcacgccattctcctgcctcagcctcctgagtagctgggaccacaggcgcccgccaccacgcctggctaatttttttgtatttttaatagagacagggtttcactgtgttagccaggatggtctcgatctcctgacctcgtgatttgcccgcctcagcctcccaaagtgctgggattacaggtgtgagccactgtgcccggccgactttattcttttttaatagctcatttttggattggcaacacatgcaagtggtacagaaatcttaaggctaaaaagatataaagtgtttcccagccactcagaggtcctctcagttagaggtgactaatattagtgttttctctgtacccatactcttcctgcaattggcttttatctattaacagtgtgtcttagaggttgttccatataagaacatgtagagtagcttcaggggttttagtggctgcatagttttctgttatatgaatgtactgtcattactgtagccagtctctaccagccttatattgatcactatttgtttggtttcaaatattttgtctttatagtgaatgccgccacaaataaccttgtatatacagtatgtgatttctcatgaagatacaggagaggataaatttatagaagcatggttgttgagacacaggtgtatattttcaagtctgacagattttaccaaatggtttccatagaggttgtattaatttttgccccagtgtatgagaatcagtagaccatattataaaacatttgatctctgtgaatctggtaggttaaaaaatgggatctcctaattttaacttgcatttgccttataa

SEQ ID NO: 99246 - DNA, 1012 bp, Homo sapiens
aaatggaaaggcaaaggtggagaaaagtgtccatgctactgttgacaaaagggacaatgtgatatacatgtttgcatgtatcttaaaaatggaaggagaaaccttactttctctctctcttttttggtaaagcagcctatgggaaccaagataggggagagatataaaagctagatttctaaatctaccttgtttgtagatttgactttggaactccatcgctatattataatcattataaaacaaaattaagtaaaaggttatgacccttgaaaattttgatatacactatcaattttttctctaaaaagtttataccctgtttacctcctgtcagtacttgaggagaactctttttcccccacatgtttgtcagtactggatagtcatcttttaaaactttgccaatcccatgggcaaaaaatagattgctattttcatttgcattctctgatgactagagtgattaagcagctttttacttgcttattatccattttgtatttcttctgtgaggaagtccaagctagagcaatcaaacaacaacaaaaaaagaaataaagggtatccaaattggaaaggaagaagtcagattatccttgtttgcagatgatgtgatcttatatttggaaaagcctaaagaccccaccaaaaaaactattaaaactgataaattcagtagagttgcaggatccaaaatcaacatgcaaaactcagtagcatttctgtatgtaccaacagtgcacaatctgcaaaagaaatcaagaaagtaatcccatttacagtagttgcaaataaaataaaatacctaagaattaactgaagaagtgagagatttctacaatgaatactacaaaacattgatgcaagaaatggaagagaacacacaaaaaatggaaagatactccacgttcatggactggaagaatcaacattgtgaaaatgttcgtattacccaaagcagtctacagattcaatgcaattcctattaaaataccaatgacattcttca

SEQ ID NO: 99247 - DNA, 1684 bp, Homo sapiens
ctcatggtattccagacttacagctgagcagacttccctcaactgttcaaatgctggccatcactgtgggctccctgaagcagtagcaactgtgtcttccactgttcggaaaacaacagttgttacttctttttttatttccttagggtttactactgtgtctaagtagcaagcaattataaatgtccacttaaattgattgctgatgaatatataaaaactaaatttcactgtctttttggtttgagatcattcttatttttaatttttagtgatccttgataaccatttttgttttcggttcagtgtgaatacctgaatgaaatagtaatttttatgtctgtgtgaggtcggttttaagaaagcgttcatagctatcagcacttgccttttgttcatggatctgttgaacctgtttctttctctaggtcataactccatgcaggaagctcatcttgtgtgctgataacagaaaagaaatggaagattggattgcagcattaaagactgtgcagaacagggagcactttgaggttaaaaaagaaaatacccttctccaaatgcctcctgttgcctccctcaccccagtgtctgctgtctgagtgtctcccacgtgcggacccacagtctggagctcacgttcttagcatgttctttatacaattaaagcttattgcttgtcctctcagcagacctgtcctttataaaccttcctcctctcctctcttggatactttgtttaatcttgtccaagttactgcatttaacaatttaaaagagaagtcttatctttgccctcttggtttcgttcttccagcccacccagtacagcatggaccacttctcagggatgcacaattggtacgcctgttcccacgcgaggccgacctactgcaatgtgtgccgtgaggctctgtctggggtcacgtcgcacgggctgtcctgcgagggtacggatgtgcgtttgttattctgtcaggaaaggtggcctggcattttacttgataaagccttggaaatccaaacccagtcaccataaataagccgttgtcacccatgtggtcagtcaagggcacagcgatttctgtgatgccattcttgtttattttacctgccgaagagtccttgataaatcattttttatagtgctcagagtgaaaagggaagtggtgggtggcaaaaggagaaatgggaaatctagagcacacagagggaaaggcactgaaggaacagtggtcggcccctgtgtctcacactctgcagccggggaaacggggctgtgcatatatggactgaaagtgtgttacagacttagaggtcagggctgcagggtttgggcaagggcattcagtctggtggcaaagcagtgggctagagcagggcttgttagctatagcctggaccacaccctgcctctgcctgtttttgtacagctcccacgcttcagactggcttttaaatttttaaatgattggaaaaaatcaaaagaagaatcatattttgtgacacatgaaaattacatgaaattcaaatttgtgcccgtaaaaaaacattgtctctggctgcttttgtgctacatgacagagttgattagtggtgacggaagctggttgcgacctgcagagtctccactgctcactctctggcctgttacagaaagcttactgatccccagctttccctg

SEQ ID NO: 99248 - DNA, 1023 bp, Homo sapiens
tgttctgtgtggagcctgggcttggtgccgcatcacctatgcctgtctgtcttctgagcactcattctgggtcagacactgagctcgaggcagggtgcgcaggtgagccaggcggggagtgcagatgcagggaatgggtaggagcacacgcagggtcccccggcacttcagtgggggtgacacagcttctctgggaacccggtgggggcagggtcgcaagtcaaactgggcgtccttccacgtctccccgagctggcatccgaggagctctagtgttctgaaggctgcagggaggcgggaggcttctgggctgagggcaccgcttgtgcagaggcgaggcaagagggaatgcagtggggccaggccaggcagcagcagaaaggtggcacctgccgtcagggagggctgcgggtgctggccaagaggttcgactccttcctgcaaatgaggggcagcctcataaagcaaggcccgtggccaggctcgtgttttagaaaggtcttcctggaactcatggggagctttcaggaagggtgtcaaggtgactgaggctcctgtgggactctgcgagagcacggtggtgacctgagcgggtggctgggttgggtgtggaggagaggctgccaggaggggctgggtcggctgcaggctgagaggaggtgggtctggcctctggactgggttggtggtcgagctaccattctccgagtagggatgtgtcctgttggatgtgccctgggataccagagtggtgtgttctggaggacaggtgcaagtgttggctttcaggagtggcctgggggctgttgatccagagtcacctgtgtggtccttgaaactggatgtggtcacacaggaagaggatgaggagtgagcagaagcggcactggtctcctgagtggggacgctgctgggcaggggcagggggagcccaggaaggaaggaaaccgaggagttaggagggtaggaggcgtgggtcacatcaccggaggactgagtgggcccaggcatatgtgctgcagt

SEQ ID NO: 99249 - DNA, 1091 bp, Homo sapiens
attggccacttcatgctcacctcatgtaaatgaagtggtagcttgcattcagtctgattggtggcagaaagcagccaaccagaggctgaagtggttacaaaggtcacactcctgtgcaaacatctgattggttgcaaaaagcaaccaatcagaggctaaggtgaagttacaaagttgcatttctatgcagactaagactcagctcgcaatcagtatggttggttgtggacagccaatttccccaatttcccacctgccagggcgggaaaggtggggatttgcaaagggagtagcctctggtctttttgttacttaggcgtggagagttaggattttccttttgatcgagttctaggaagtctgggtgaaatggcctgaggttccctgcctgcagaccctgttctcctgcctcagctctgcatgccatttcctttccttgttcagtgctctgtcctgaaagagaagctggattcccttctcaagaccttggacgatgagtcccaggcctcgtcctctctgcccaacccgccccccaccattgccgaggaggctgaagatggagatgggtcgggcagcatctgcggttccaccggagaccgcttggtggcatcagcttgcccggcccggccgcagatattccggcctcgagaacagctcatgctgagagccaacagcctgaagaaagcaattcgtcagatcatagaacacacagaaaaaggtaactggccttgtgatgaggaggggctttcctcaggccagcactgggcatgcccagcgtcccctgaacacggagatgacagaagggtgcatgttgagaaaacctccactgcggccctctccacccatgtccaggcaccagacccccaacgagttcgcttgccctccttccacccctcctctcacaccctcagaccccttcatgctgcctcccctcgacctctttcctggccctcattgacttcactataagcgtctcactcccgtgagagccttgaggtcacggcctcacacccgcacacctgcgtgtccatgcagccgctcctcccgcttgcagccctccagcctgcgccaggctcctctgcatcccttgc

SEQ ID NO: 99250 - DNA, 1030 bp, Homo sapiens
cagaggttgtttgaggaagatcaggccgtggggtgaggatgaggggccctccacccagcctgacagcgcccttggctttgcacccgcgtgctcagccgcacacactctccttgcacagctgtcgatgagcagaatgcccagacccaggagcaggagggcttcgtcctgggcctctctgagtcagaggagaagatggaccacagagtgtgcccaccactgtcccacagcgagagcttcggggtccccaaggggaggagccagcgcaaaggtacttgtgcctccacctccctctgcgcaccgtcgtgtgcttggttttggtgagacgtagcgggcttgccaggggaggttttagggcactttctcatagttgctttggccacttggttacataaaaattgagcgcccaaggcctgtttctgtgcatctcctgtgcgcgcccttgaggtgggtgtgtgcggtctgtcttggtggacagcagtagaacccgcgagaccccctccatcagggcgaggactgcctccctgaggagcacttgcgtcctgccctcactgcttccttggaaccacactgggccccagaactgctcagaaggggctgtgtctggcagagggaaggcgggtgggtgagcgtgggccttctttgtccttgcccctcctggaacagcccacagcgcaggccctggtggagggcacccccagcctgtgcaggctgctgggaggcccatgctcagaactgacccatggccactgcatggccaccactgagagctctgctgtgtgtgtgctccgcctcccacagcccggactgactgggctcacccctccctccagcgctgccacctgtggcctgtgttaacctctccatgagcccagccccccaaacatgtgcacccactcggtcctccgcccccttctttgtcccacacacttcacgcaactgcctgtggtttgcagccctccctcctcagccctcccacctgctcgtgtcgctaaggaccccccaggatttcacagtctctattccacacagc

SEQ ID NO: 99251 - DNA, 2079 bp, Homo sapiens
tgttctaggattttttttttttttaagacacaatgattaagctaatagggcagtaatttctaggaccatctccttcccctaatgttaaaaaaaaaaaaaagtcctatttgtctctttctagttgtgatctcgttggcatccccatagtgtctgtcgcagtcagatgcatgcttcagagcagcaggtgtaattgggctttcgggtccataggcatttgagagcaccctgaagtcctgggaagacaagcagaagtgcgagctgccccgccctccatcctgttccctgcacccggagatgctgtccgaggaggaggccacccagatggaccagtttgggcaggcagcaggggtcctcattcacaggtgggctcctacccctctgcgttgcgcatgagcctcccccagggtccctgggactgcactcttccaaggcccctggggcgtggagctgctgctcctgacttttgtggggtctgcattacccatgagggccgagcctgtttatgtgccctcagctctggctcatttccccagtggtctttcagaactcgcctggagtttacatggctggaacctaaagcccactgtgattttcaggaccactcgtttaaaacctgcccgggctcagccgggcgcggtggctcacgcctgtaatcccagcactttgggaggccaaggtgggcagatcacaaggtcaagagattgagaccattctggctaacatggtgaaaccccgtctctactaaaaatacaaaaaaatttagctgggtgtggtggcgggcgcctgtagtcccagctactctggaggctgaagcagcagaatcagtcgaaccccagaggcggaggttgcagtgagccgagatagcgccactgcactccaacctgggcgacagagcaagactctgcctcaaaaacaaacaaaacaaaacaaaaaaaccctgccctggctcccgagggcagcccgctgacagccgccttcactttgccctcgttttaccctgagaacaggcttgctctttgttctcaagtttactttaaaaaaaaaaaaaaaaaagacaactgctggggcatttcctctcacctgccttctagaaacacccctggagccactgtgtccctcgtggctggtggtcagcattgtctgccattcctgctcctcgcccgccaggtgcgggttccgcctgtgagtccctcccagccggcagctgtgctgctccgccggtgcggggcctgcctgcattctccccccgtggccgcacgctggctggtgccctggtgtccctttcttgtttcccctgggctccttcttctcctggctgtggacaggtgcacccgtcggttttgtgcccggcatgccgtgtgcccttccaggcagcctgcccagccctggcgtgcagatggatcgtctgtgccagccttcggctcttgtcgagcaggtggtcgctgtcccagtcatcaccggcgttcctcgctctgcacttccataccggctgcagtccttcctggcgctgcattctctgccccaggagttggtgccactgcggcccctgtcctcgtctctcccccaccccacccagatcagtgatggggctggaggacttcagttcagctaattccttgccgtgcagtgggcttctggtggcctcccctggaaagccattaccctgtcccctcaaagcccatggtggcccctctggcctgcctggaaggtgcacttgcacagcactgcaggaagctgctggcagcggcctgtttccacagggtcaggacaggctggccccgctgcctttgcttgcactgctcctatagtctctgtcccccgatctcacctgcctgagccacatctcagcctccctgggacctggtgtgacttgtgctctcaccgtcttccctatgagggctgctatctggggtctggctcagagcccatcactgcaccaggattgtcctgttcagatgagggtccttttgtccccagggacagaccggccagttacaggttccagcaaggctgtggggattgtgccttactgcagcagtctctgcagtgggcctgtgcacactgtcacttgcccactgg

SEQ ID NO: 99252 - DNA, 2296 bp, Homo sapiens
caatccaacactagaagattggctaaagaggttattttaataatttttgtttagatactgatatttatgatattttcaaaaagtttttaaatctcatgagaaacgcacatgtaaagtgaaggaagtagaatatgataaaaatagacactatgatcactttgaaaccactttaacactcactaaaatcaacactaaatacaagaatcaataagggagagaagccctttcaggcacaagaggtctttcccagctcccgctcatctcagccctgcctgccctcccagcctctctggtggagatgggcatgaggccgtgatcagttgcagcctgattctcagtattcctcattctccccaacagagtgtgatgctggatcttgccaagcgcagtcgcagtggtaaattccgcctcgtgaccaagtttaaaaaggagaaaaacaacaagaacaaagaagctcacagtagcctgggagccccgggtacctgcctctctcccgcgtgtgtttctggccgtccacgcctgctggatcggccccgttcccctggtctctgctttctcccttggccttgcagctcctccctcttggtccctgtgctgtaacccccggtcctgcgaccacacttgtctgttggtagctgcagccctccaccctgcctgcttcccctctgaccgttgtcacacccggccctgacgtgctctctggctttctgcctgccctgagttgggggattcgaggtggggaggaagacagcagtagagtggtgacaagacaaacttggagacacaaagctctggactcaggccgtgctggggcatgccctgcctgctccctcctgggctgctggttcctgataaattgatgcattggtcgaggttcctgtgctgggaagcccaggccaccagagattgtgggtgatgaaatcaatcgaatatggtcctgaaggacattgttcctttgggtcagtaaattggagctaaactctctgtctgaaggatcagccctgaatacccaggccatatccagtgctgtcaggggctggagaggcctccaagcctggatattgggactggtgtttgccgccagtcagggcagctcctgtgggtttttcttctttgcatgtttgtccagaaatggggtttctgttaataatggtggctctgactatgtgaattgaaatctctgctcgtttcctttcctgctatggtccagaagtgaaatttaacccttctagaagctggaggaaaagctggctttggccacaatcatgaggacatttccctcatatttggtggtggtaaatccctcctgggacacggggaaatgaccagaggctggcggcccacctggcaggaacagatgccagctctgctgcagccatcgccccttgagcgggtggctctgtgcctctttctgcactgctggtgggtggtgctgttggctgggtgatggataccggctgccagagatggctcaggtgccagctgctgggctatctcaggcactggctgctgggctatctcgggtgccggctgctgggctatctcaggcgctggctgctgctgggctgtctcgggtgctggctgttgggacgtctcctgtcctggcactgggctctcgggtgctgggtgccagctgctgcctaccttgcactgggctctgggcactcactgcactcgtgcttttccatctccgacagttcacctctgggggacagaggaggttgctgcctggctggagcacctcagtctctgtgagtataaggacatcttcacacggcacgacatccggggctctgagctcctgcacctggagcggagggacctcaaggtacttccataggcgtctccctggaacctgcacttgggcttgcacgcagctcccttctcttccatcctctcccccgacctggccatgtcccagcatcacgattcttctcaggctttcgtgtatacctcaggtgggggcggctgtggccctcatctaggcagtgatggctccacccaccacaaccagaggaagccaggagcagacataatggggggcagagccttggttatcttaggctactcagacaaggactgtcttcgtgttaaaaacactatgaggggacacagaccctgaagcacagtcacacacgactgtccccatgctgctcctgggcgggtgctgccactcgtctgcagggagcattgggaggggtggttgggtgccaggcctcggtctatgccaggcctcacgccacatcttgcaggcccatgcccctgcccaggttggcctcaacgggccaacccctgg

SEQ ID NO: 99253 - DNA, 1030 bp, Homo sapiens
cctggcatagaccgaggcctggcacccaaccacccctcccaatgctccctgcagacgagtggcagcacccgcccaggagcagcatggggacagtcgtgtgtgactgtgcttcagggtctgtgtcccctcatagtgtttttaacacgaagacagtccttgtctgagtagcctaagataaccaaggctctgccccccattatgtctgctcctggcttcctctggttgtggtgggtggagccatcactgcctagatgagggccacagccgcccccacctgaggtatacacgaaagcctgagaagaatcgtgatgctgggacatggccaggtcgggggagaggatggaagagaagggagctgcgtgcaagcccaagtgcaggttccagggagacgcctatggaagtaccttgaggtccctccgctccaggtgcaggagctcagagccccggatgtcgtgccgtgtgaagatgtccttatactcacagagactgaggtgctccagccaggcagcaacctcctctgtcccccagaggtgaactgtcggagatggaaaagcacgagtgcagtgagtgcccagagcccagtgcaaggtaggcagcagctggcacccagcacccgagagcccagtgccaggacaggagacgtcccaacagccagcacccgagacagcccagcagcagccagcgcctgagatagcccagcagccggcacccgagatagcccagcagccagtgcctgagatagcccagcagctggcacctgagccatctctggcagccggtatccatcacccagccaacagcaccacccaccagcagtgcagaaagaggcacagagccacccgctcaaggggcgatggctgcagcagagctggcatctgttcctgccaggtgggccgccagcctctggtcatttccccgtgtcccaggagggatttaccaccaccaaatatgagggaaatgtcctcatgattgtggccaaagccagcttttcctccagcttctagaagggttaaatttcacttctggacca

SEQ ID NO: 99254 - DNA, 1057 bp, Homo sapiens
tgcccagtaccctctctctccttgcggaatttttagtccaactgatcacagaacccacaccctaaaaaatacaacagcattctaatggcattctaacggcattctgatggcatgctaatggcattctgttttgctttttagccaccaacaactcaacctattttcagagcaggtgaaaaacaattctgaatccagtttggaaagattccggcaaccaacactttatgtcaaagcacaaggaatgatgacaaagactctggcgatggaagatcaaaaacaggcttgttttatttatacacagaacaacttatgtacagcactcaggtatggactatgtacatgacaatacaagaggcgtttgtttccacggtggtcactatataaattaagattataaatacgagggggtaagccccacctgagggcacagaaccttttctccaagactcttcagggatccttcctgcctctctctgcacagcagaccatgaggcccgtctggcaacaccacaaggggacctgggccggggcagcagagcagcccccagacagcgaggacaccccagtgcgggacgccagcccagcaccaaagggcaggttcctaaacactcatgttcattccttcctcacattctaacttgttagaattagaaaaatggtttttatgtaaacagtgttgttctaatcactgacaacatattaattttaaacacttttgatccaaacccaactccttgccaggagtaggacactgaggacttggggtggccctgatgtccttgaagccacagtcagctgtttatcctcctcatgtcccctccccacccaagttccagcttgcctggggcttgttctgggaccctaagaaccccaggatgcccacatcgccaggccagcagggccaatggtcatgcagggactgcgggacaggttcccatcatctcctgtgttagcccattccacctgggaaaccaagcgactgccgtggctggcttatttctccctctgccaacccccatctacaatgttctggggaaaacaatgagaggtggaaaag

SEQ ID NO: 99255 - DNA, 1077 bp, Homo sapiens
cactactagaatataagtacttggtttattcattgctatatccttaatacctagaatagtaattgtgcccatgtcatagtcaataattatttattaaataaagatacacccaaaattgtctacaatcaaaccatcttgttcttttttcgctgtaggaaaatattttacaagtccttttgtaaatatcatgaactattaagatttgctctacctattatgatatgagtatccttcttgtggtctgcttgttatatgagaaagttatctttcaaccatgtctaacatgtatttaattttagtgtttttataaaaacacattcttaatacaagttgtacaaccagaaatagtttcctggaggggaattccaggatcaaatggtgtggacattttaaacctcttaaaatagttaaatatttcttcaggcaagttgttccagaatatgagtatttattttacctcacccacaaaccagcattgactatttcatcgtctaggtatttcctaaattgataaatgaaagatgattatcttgttctcatattctccagtgctttgatgactaataagttcaggcatttttgcaaactgtattttgtgagtgcatgattgagttatttcgtgtattttgactgcttctgtaatgaagtctaaaggaaaagctctcttggaatttgtgtgagctctttatgattttgaccctttgtcacaatggttgtaagctgtgtcaggttttgataggcacagtgccttttgcccttttgaagagcagctgtgtgcctcctcaggccccttccatgggcttttctgtccttgaccaacttccagggcactcctgctctcaaggaggcctctagtccctcctgtttctctccagcagcctctgtcccctccttggcaacttcagcatctgtgccgatgccctttctgtcctctggccgcactgtgctgggctccaggccttggcctcactccctggccagcagccccctcccccatggggacatggggctgtgcagcctctgctcttgcactctgcactcccctgattccatgggcccacatcttcccgtgaactc

SEQ ID NO: 99256 - DNA, 1071 bp, Homo sapiens
agccaggcgtagtggcatgcacctggaatcccagctacatgggaggctgaggtaggagaatcgcttgaacttgggaagcagaggttgcagtgagccaagatcgctccactgcactccagcctgggcaacaagagcaaaactccatctcaaaaaaaaaaaaaaaaaaaaaaaaaaagaaagaaaaagaagtagtgtatgtgggagacatttattaggagtaaaaaacattgatgatgaagcaatttatacttctgggtaggcataattattgcttaaattgtaacattaatcatagtcgtattttcatataaattgagattttttgttaaagtttcatgggcccttggctttacatttttgaaagtaaataatacatttattggatttttaaattcagattaaattgcatttacacatctgtcttgttattagttgttcctgttttttgcaatggggagtgacgttcaacctgggacagaaatggaaatcgtagtagaagaaacaatatctgtgagagatgtaagtaattttaccttttgttttcagaggctgtgtgtgtttgtatgtttgctgtgaggaacagtggtatcctgtgttaagatttggaggtcctaaactaggcctgatatggtgtacttcagagaattatatgtactcactagaggaattattttgggagcttgaaaattggtgaaccaactggatttttttttttttttttttttttttagagagtctcaactctgtcacccaggctggagtgcagtggcatgatctcagctcactgcaacctctgcctcccgggttcaagtgattctcctgcctcagcctcctgagtagctgggattacagttacctactaccacacccagctaatttttgtatttttagtagagatggggtttctccatgttagccaggctggtctcaaactcctgacctcgagtgatccacccgcctcggcctcccaaagtgctgggattacaggcatgagccattccactcggcctcaactggaaattttaaataagattacaatttttttctttctatcaataatagttttttatt

SEQ ID NO: 99257 - DNA, 1714 bp, Homo sapiens
tggtgtatttaagcaatggatactgttcgtcactgaagagcaaggcactgctagttccaccacatacaacacatgaatgcatctcaaagtcattatgccaagagaaagaaagtagatgcaaaagagtacacattgtgtggttccatacataggacactttagacaaataaaatctaagctgtagttacagaaggcagatcaggattgggagggaggaagagggattggctgcaaattgacagggagttttaggggggatgatgcaaactatacctcagtttgctggtggttaccagatgtttaggtacttatcaaactattaactgtacatttaaaccagatgtattttattataagaaaattataactcagtaaagtccattaaaagtcattggtttattaaatgcatagtttgctgtcatcccatgaaacttgtctcccttcttccactcttgcccctctccaaaccatttgatcatcgtcaatacgtgtgaattagatcctgtcactcctccgcacaaagccctttagtgctttccattgcacttaggttaattccttaacctagcctacaagaacctgaataatttgacccctgcttaactgtaaccttgtgatctgcttttctgcgtactcacaactcacttcccatgctgacttttctgcgtttctcagtgcacaagctctctttaacccccaagacttcttagtgctcagtctctctttcaagtctcttccctttgcttttaacttcagctgtttatttggtcttatatgagatgttccttctcctttcatccctgaccacacagtcccagttaatcttgctgatgtactctcctaacaccctgtacttttccttcatagcatttatcactgtagctgcccttttatttgtgtttttaatatccacctcccccattagacaaggttctgtgaggactgagtttacactgctttgcttaccactgtatttccagtttctagcacagtgcctggcacgtagccaatacacagtaagtacctgttcagtgaaaaccaacagattttaaagagacagtattttaaaagcactttttaagttggggaactctttaagtaaattgtttccgtcgacaagagatttatgtgagaattgtatgctagcctcatattactgtaatacaagatattgaactcaggaatctcagaaagggattctgctgtggtctaataaagttagaacttctaaggctcagactattgttgtctatacagaacactcaaccttcccccacccctccaatttatgtcctactttttaagaattctgtttgaactgaaaacttggtatgccccttccaagcaccaggggatcttgaggaaatatattcttccaaagcaagaatctgtatcctcaaacatagcacatgctggccgatttaataagcataaaatcacccaacatattttaaatataggcagtctgcttgtactgctctgacatgcacgaatttcattactaccatttagttatataacatcaatcccccagcaagatggttaaaatttcagcaaccatggtatatggtatattaactgtaactgaataaagtacacacttgactgccagctcttcagggcacaattcatcacataaataacacatgtgcaccacaagcagtaaccattgacttcatttctttcaagtctggtggtttgtcactgcatgtac

SEQ ID NO: 99258 - DNA, 1018 bp, Homo sapiens
gaatacaaaaaacagtttagggagaactcacatacctaccacccaaaatggacaaatattaacattttgtcatatgtttgtttttgtttgaaacattataaatgaagttaaagtcccctgtgttctcctcctcagacctattctttctctccttccccagatacaatgagtatatctgatgtgggtgtgtatctagtccatgtattcatgttgtactatactgaatgtatattctgcaaactcactattcacttaccattaggctttctgtgacagccttattaagatataatctacataccataaaattcactcagtttaagtgtttaattcagtaatcatcagtaaatgtgtagagttctataaccatcaccacaatccagttttagaatacttccattactccaaaaatatccctgtacccatctgtattccaagcccctggcaaccactaatctgctttctgtctctatagactttattttcttaatgtttaatgtaattggaatcataaaacatatagtcttttgtgtctggcttctttcacatagcatatcatttttgaggttagtccatgatttagtacgtatcaatagcttgttcctttgcattgctgactagtctagtattccattatatggatagtatcacattttgtttatcctggacaaacatgaattgatagacatttggattgtctctacttttgtgcttttatgaataatgccactatgaacttttacacataagtcttggtgaggagatatgttttcatttctcttgggtacatgtaccggattggaattgctgggtcatttgcaaatttatgtttaactttataagaaactctcgcactattatccaaagtgactgaaccatttatactcccactagcagtgtgtcagggttgcagtttctacatgtccttgtcaatctgtgattaattgtgattatcttttttttttttttttttttgagacagagtctcactctgtcagccaggctggagtgcagtgac

SEQ ID NO: 99259 - DNA, 3142 bp, Homo sapiens
ctggtaatgcacctttataaatttgcaatgggagacattcctttcaagcagctagaagatgagtgtgtgctagagtcagggctacatttccctcaacattgctaattctgcaaattagtcttgctcttttgagtaaaaattcctaggctgacatgctcatcaacttgctttctgagaaaagtgctcttcatatatattaagcagaattgtttagatggttgttgtgccctttgtgtaggccagaattcttcactcaggaatggaggagattagccgtctttggctttgactaatttaacaagtgatgccttcttttcaagttttcggtgttgggtgggggtgagagtattcatttgcttgctctctgtgtcatcttcatatgtgagttggcacagtaacctggaaaggtgatatgtatatgtcacttttcaacattctcttttccttcattaatattcttcagctgttagaattttgggaaggagacatggttcttagtgttgcaaagcttgtaccagcaggacttcacatttaccagtcacttggcggtaagataaatatgaaaacatagcaactcactctatatatctacatttttgtccggctcacctgcgattttctactctttgtcagtccttccccacctactactttcttaactaagtagattatcttcacactgtaagttttccaaaagaaataaaatatccacgttttaatgtatccagtttatataatgtgtgaaattcttctaacatggaaacattttattttttctgaaattaaggctacctctactaaaatttcttgaaaagctttagaattttttatattgacacatattgttgaacaacatagtttcaaaccatctgaatcatatttatgtgacttgattttctgcccagttctcagcttcagattttgtagtaaaacaagaaatactttgagagtttgaaagcatttacttcctttaaatagcaggaaaacaatgagaattaacagtagcggcagtaacatctaatttgggccaaaatctgtaataggtgttttatgttaattatctcacttgattttcataaaattcttttatctccatttcataaatgagaaaactgaagctgagagacttgaagcacacaatacagcttgtgttatggacatatcggtggagttgggaccattccatgcttaagcctaactcctgtttccaatgtcatgtgcctcaagtacacttgacctttggattatctctcttgtcctgccaccatgctcacaagcttttgtcacaacgttttaaagaaaaattacaatgaaataatgtcaatagaataaaaataattactactttttaaattttccttagtgaaaatactttttcaaacaaatatttgtctcagctctttctttagctcagttgtttctgatggtcatgatgaatggtctcactggtgatctctttctaggggatgaactgacactgtgtgaaactgaaattgctgatggggaagacatctttgtgtggaatggggtggaggtaaaaaaaattactgaagaaatattcgtgataattttggatgttttaaaagtcatcgtaatggccgggcatggtggctcatgcctgtaatcccagcactttgggagggcgaggcaggcagatcacctgaggtcaggaattcaagaccagcctggccatcatagtgaagccccatctctattaaaaatacaaaaattagctaggcatggtagcgtatgcctgtaatcccagtgacttgggaggctgaggcaggcgaatcgcttgaacccggaaagtggaggttgctgtgagctgagattacaccactgcactccagcctgggtgacagggcaagactccatctcaaaaaaaaagtcattgtaatgaaattttattcagcctatgtgagggcaattagatattagaaaactactgaaatgcttgataaatgttagggacaatcagtgctagttgtacgccaaggagacatttcttgagcgcctccgttataccaggttgtgcgtcagatgctagatcaaaggccagtcagttgatctgtgtccttttaggccctcgtcgtgtgaagaactgcaccatacgtgctggagtagggggtctgtgcatagtgcctgtgggaatttagaagagtgagaatctatactgagttggggagtgggggtggtttggaggtagagagtgaattttctatctctagaaggcggccaggagcacttcagccactctgtgaactgaccttggccaatctggcttcatcaccacccatgataactcataaatgtctatctccagtctatcatagatttctcctaaaaaaataaaagataagaaagtttcaaaagaaaaatctgaagttgttcctctgatgcttaacagacatttgtgaaaattttattttacttggaaaaaatgagggttgttctctaagagtaatcttttaccatgttatgttgacggtgttggcaaatatcagctgtactaatggttgtcttggtatgattgcaggttggtggagtccacattcaaactggtattgactgcgaacctctacttttaaatgttcttcatctagacacaagcagtgatggagaaaagtgttgtcaggtgatagaatctccacatgtctttccagctaatgcagaagtgggcactgtcctcacagccttagcaatcccagcaggtgtcatcttcatcaacagtgctggatgtccaggtggggagggttggacggccatccccaaggaagacatgaggaagacgttcagggagcaagggctcagaaatggaagctcaattttaattcaggattctcatgatgataacaggtaactcgctaacaagagaaaaaggatttctaaaagtcattttaattacagtaccacccagcagaactctaaagctttattttagtgacaagagttgaatgtttctttatttctagacattatgttctaaatattgcatacaggaatgttttaggttatgtaacttagagaaaaacatgattttttgtaaagggactttttggtaaatgtggtgagaaaataatataagtatccctgattttctagactgtatagagtatcaattagttggctgtaatgcaaaagt

SEQ ID NO: 99260 - DNA, 1019 bp, Homo sapiens
cagagtctgtctgggttttcaaattatcttttatggtggtacactgtgtgattgcctttgttttgtgccttgtttagattgcttttaaatatttcaaaagtgtttgttctacctaatctgttccagttaaatacttttttaaacagcactagtgaggtgtaatcaaaatgctttttagattgtggcatagcgacctcctccctggatgtcactatcagactatttaacagagcactgtggttttattaaatgttttatgatacctagatggattttcccccgtagctggccaggtcagaaataaagatgaagttaaatgatctaatcacagaaaggaagaaaacattttttaatcacatctaatttttgtttaaataattaacttagcatttttttttttgtttctgtgtagttcttacagctccattctcagatatttctactcagttcagatgaaagtacagttcgtctcttgaagaatagttctctccaggctgagtctgatttccaaaggaatgaccagcaaattttcaagatgcttcctccagaatccccaggtttaaacaatagcatctcctgtccccactggtttgatataaatgattctaaagtccagccaatcagggaaaaggatattgaacagcaatttcagggtaaagaaagtgcctacatgttgttttatcggaaatcccagttgcagagaccccctgaaggtatggaaagaaaaatgttcctatttgtttcagttaatggctttagaagataaacatggaatgctgtttgaatttttattcttttaaaaaaaggtttactcttggaacatttttaaatattttaaagctaacaagaactatattatgccaaatgaaatctaacaatttgtcattttataaagattatatacttctctttaattttctaccctgtaataatgtaagatcatcattacattttcaaaattggatttccttggatagcataaaaccttcttgtgttggcaaacttgagtgcgattgcca

SEQ ID NO: 99261 - DNA, 1063 bp, Homo sapiens
taatgagttaattattttgtttgttattgtggtgatatttaaagtgcatatctaatcatgttcctccctgcttaaacataactcaaaagtttcttaccatgttcaggctcaaatttgtacttcttaggagtctttcatgatctagcccagtacttctcaggctacctgtgtggcaaaggacctgtttttgtgtatttctttttattcccaatctgttgcagattagcacttttctagtatataataaaaatgccatgggaatgtcaaattgccattacaatttctaaatgcttattctcctttaaatacttaaagtctagcctacagaccagactctgagcaacattgctcagtctgccccagccctcaccacatcaagtaaggcaggaactcacttggagccaggagaaagtgaggcagggtgtgctgagaactccagagcgagatacagtattgtgcctggaaaatttctacagaggggaaattgtgtgtatcagaggtattttagagaaataatggactattagaagagattcaaactactgtcaatctgtaatcagttgagtggtttattaaggcctatttgagttttaatgtttgtctgaaccatatcaaggtagaaaactccaaataactattattttttagattgcattataattttcacagaagaactgaatcataattagtttttcccttataataggatatttataaactttctcctgaatgaactgggagatataaaaaagctagtatgcagttgttttcaaaagccttagtcaacacttaaagaattcatttagaaatgtgtttgtttctcattcaggttcgaatcatccctttacagttacagcgcttgtttgctcagcttctgctcttagaccaggaagctgcatccacagcagacctcactgacagctttgggtggaccagtaatgaggtacgaggatcagctctttaaggaagagttaccagcaatagaggaaagaataaggctggtttaatgttatctaacttcctttaattttgtcttagggtctcaacatattgtttgaatgtt

SEQ ID NO: 99262 - DNA, 1917 bp, Homo sapiens
acacacctttactttatgtgtatcttttctcccaggatactgcagtcgtatctccagaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactccaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccgtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacctaggcaaaagatctctggaagcaggtaggtgcctgcccaagagcgattcatcttcatcacttccaaagaccaaccccacacacagcgcaactcgcccgcagcagacatctgaccttcacgttcagggaaatagttctggaatatttagaaagtcagtgtcacccagcaaaactctttcagtcccagataaagaagtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctccggacgccagggcaattccctgggtgcctcagatggggtggacaacaccgtcagaccgggagaccagggcagctcttcacagcccaactcagaagagaggtaggtgtgtttctgttggttgaatgtggtttatgtgagtgactgctctttggacagaggctttttatggtaggaatctttgcgccacgtttagtgaatctcagccgaattcttacatacgtgatcattttctgagctttctcccaaatgcttttccttcctgtaaagtcagcgtctctatcaagaatgtgtccctgtgtaagatgcatcgaggtaaagcagaaagtgctcttgcagaagtttcacactttccattagaatgcattcagaggcttttttcctgca

SEQ ID NO: 99263 - DNA, 1902 bp, Homo sapiens
aaaaaaatctattggggccacacacgggactcttaagagcagccctgacctctggaccaggatttgaagctgcatagttagggaagcaatagtccccacattccctggtgcgatcaggctagaatcagctgcaaggtgaggaggctgacccttggcacctgtcccgcctgctgagaggtcatgttgggaggggggggatgtgatggcatgagaggtgggcacactcacctgccaacccctctcttaaggtcagtgccctctgccatagaataaaggacattgcaacaccaaatacttaggaagtacacattgcagaataagaattcatctccagaaaaaggcagcaatctcacaggggtgtatgtgttttcttactgtgctgctgaccagcggaaagcctgtatttgtggaccaccgacttagtggatgtacctgaaatgctttttcctttaacccaaggcagcaagtggtgtcctcttggttgctgtgttgatccagggaacagattagggttaggaacgaacggatctactgggtcttctttgtccaccgtccggttggcccctaggtgttcttgtggtctgagtataatgctagacaaagaaagctaccagcgcccctggggtaagaagttactggcaggtgagtggtgactgtggctggaagctatcctggagaccacatcaactgtccagatcttagtaggacatattttcttcccactgcccgaagcctagctggccactgtcaccacattcacacgcttgtcgacatggctgtgctaagatgcacagtccgcatcgtcaggggagaacccagctccttgcacccagttgacacctggcaacttttttcttgtaaccactggctctgatttcagtgtgcaggtaacagagctggaagggatgtacgtgtgactccgctgccttcactggcctcacctgccgtgcctgcccccggtgagtgtgacatagaaactgtatgaacagtgcgtgtttccttcacttttgttggagctgcgtggcccctcagagctgctcatactggccacgccatcatttcctggtgtgtttcatcaacataacttgttagagatatacttggatttcactggaagattaagatgtttcaaaatgagctgttttctcctccacgtctgctctttattccagtttactagcttgaaaagttttgcatctccagaagcacaggactagtacagtgaacacccttcacttgtttcacaattaacatgttgtcatatctgcgttatcaccccctgccacacacgtgcacacacagtgtgtatttatttgcatttgtgtatgcatttatccctaaatgcctcacacatacctccaaaaatcggctaattctcctttatgactacagtacgcttaacacaggccagaaattgaacattgatgcggtactgttctacccattgtgccagtgacgtcctttgcagcctttctggtttgcctgatcgtttccggacccactcaggctggtaccaccgttgcgtttagtctccctccatcaagagcggctccttggcattttctccctcatggtcacctttcatattattgcctttcttgaatagcacaggccagtaattttgcagaatgtccctgaatttggacctgattgcttcctcgtggttaggttcacgttaaacatttttggcaaaattactacagggatgacgtgtcctctcagaacatttggtcagtctgtcccattcttggtgacttttaggctggtcattgagttaaggtaagaccttacttcgatgtttctcattgcgacaggccctttttccctggagtcatctatgtgtgattctttgagatctcctaggaaccttttctctaaaagcttctcacccagtgacttaga

SEQ ID NO: 99264 - DNA, 4961 bp, Homo sapiens
ggaggggaggcctgcgtgtcggagtgaggctgggaggggacgtaggacgggaagggaaggggctctgaggactcggagcgggggttggggaagcgggactggggcttggatgcggagagaaggtggaggcggagctgggggctccggagagggaaaaaggaggcagcgccgaaggcttcggtgcggggacggggaggaaagactggggcctccggaacggggagtggggaagcaggcctggggctcgggtgcagagaggagggtttggtggggctgggggtgctcctgagtgggacgagagaggcggagttgggggctccgctgcagagaccgcgtttggggcgccccaggccagactaacggcctctcacgggctggcgccgcctcctcccgggtctggggcccctcgtggccctggaacctgacaggaagccccttcctcctccgcagtacaaccagcccttcgaggacaccccggtggtgcaaatggccacgctgacctacgagacgccacagggtaagggtcttccccaccttctgagtattcgggtgaagagtgtgaatggagtagttgaaatgctgtccctgctctcttaagaagtaaacattgttcacctaactaataggaaccaaaacattggtgcccttaaacctgtaaattacttgaattacttattagaacaattcctgaagagacataggtgcctcctggctcacatgcctccggcttaccgggttggcatccccgctggccacctccccaccatggcagcgtggggcagttgcttagctggactggtctcagtgtcttcatctgtgaaatgggaaggatgatgacaataatgtctcctgggcgtgggtgttgtaacagtcacgtacaatccctatgaaactgtgaacagtaccccgccccgcactgtgaatactcacattgactattgtttgccctgtttaacttggagtagtaactgtcttccttgaggctccaagtacttgaatagggaggagaaggcattccgtttaatagttaatgtaaacggactgaaatcttgtggattctttttggtaaatagctggtgacactttgcactggctggggtcaattcctcccatatagctttataactaactcagtatcacttaatgaaaacaaacctcagagcaagttctatgttgcattaaacggacacagaaggttcacaagatctgctccttgagttaaaagaaatcctacctttctgcctttatagccaatccagacacatcttgggtgaaaagtttacacaggcagaaactaaaatattccagtggcaggtctgctaccctttggtctctgtataacatgtagattgcccttagaaagcattcattcagtatatgggatgtagagattgcctgcgaaaagtgcttactccctctatatggtatatagattgccctctatatattttaaggacagtcgctgtcatatgttccttgttttcatttaactttttgggctaatgatgtaatttgatgagccgttttctagtaggtaggagagatttccatgaatgacgaatttgccttaaaaacctgaaactttacaaagaggaacaatcgcagggtatcagaaacctggcttggttttaatattgtaccttttttttgcctgtcactttggcatctggtgaacacagattgagcagaagttcagcgttcaggattatgtaaatggtcatttttgtttcttttcttcaggattgagaatttggggtggaagactaataaaggaaagaaacgaaggagagatccaggtatttagtgtcaaattttattgccaaataaccttgctgtggaggagtattcatatgaataaaggtgtgggtatgcccaacctctgagcttacgcagaggccaccacggggcactttttctcatgattatactctttctgtttttaaggatttagaagcatttcttctgtagcttgtcaagtgcaaggagtcactgtgtaatatttggcctttttcatcaccctgtgtttcctgtgtcacaggctgaggggctctgataatacatgtgcagaggctgggccagttgggtaaccctccccaaggtcacgtgccagcccagcgaggcactcactttgtttgggtccttacagaaaataccaaatccagttccttctagggaagaagaatgtctctcttcctgttttgaaaggggaggaagagagatgaggagaggtgcagcctggaggatcacacatctttccttctgcatttttctaccttcggaagaccctggcttccctgcctagttgatccgagggtgttgtcgctctgagacccgttattttagtggaaggtgctgttggcctttctacgggggcatccaggagcccttttgccacagtggcttttgccaggttatctggtattcagttaatcactgcctctcagatgccacatggttcctctctgtggtcacaggtcaaggaacctgtatgaaagaatgaaaaacatcaagatcaatgtgacgatattaacagcaaatttgaaatcaaatcttcttgattaattattctagtcataaaaatgttaaaagtacatacaactacataaatgagctgattcctctctgcaaagatggtcactaatgctattttagtacaatgtgattccctataatacatatctttataaatgcatttttttctccctcacttttccggttaatacatctggcaaactcttctcttcatcaactgttgtataattataaaattatataattatttaaaaaatcatgtttttttaactgctctcctgttgataggcaattagctatttgtggcttcctttattaataaataagggtcagcacactttttccacaaagggccggatgatacatattttaggctttgctggctctatggtctctgttgtaactactcagctctgtgttgcaggaggaaagtggccgaaaataatatgtaaatgagtgtacgtggcagtgttccaataaaactttatttataaagcctctgttagaaatggttttcagagaaaatcccggtccttgtctcttcccaatactgatagtcccccttttcgataaatgctgagaagtgggattatcgggttaaagtatatatactctttgaattatgcataatacagatgtccactcattagaccagtgcttaatatggtcctggtagcaaaaagttttcatttaaagatttatttaaggtttttgcttaaaatgtaggaggaaccctacctgggtctccagaatcttcagaccctttcttgggattaggaaactgggcgtagcctgagatttcagcggggacatctctgacttcactgtaattgctattggtgacagtgtccagatccgccttcaccttttcccagacgacttggtgctcctgccgccctggaggctgggggaggctgtgggccctggcaggccgggtgttgacctgtgctgggttggttataacacaatgcctgggttctgtttgtagctaccagagctaccacatagtttggggttggtgtagatcgtctgcttctctgtgattctcaaaccaggttctgcctcagacacagccacaaaacaaccctgtaaactccaccttacgtgacggtttcactggaagcaaaggttctgatattctggaagtgggcttcagttaccctgtagtgctcctgggtagccccaagtcctctgaaccctcagagttgacacctgaggaccatccctaacggtataggcctcgccaccttctcacgccctgtttttataaggctgggtggttcctaaaatattaatatttcagccaatctggtatcctgaatgcttgaatttcattactgagaacccaccgatgccatgctctgggattattcgtggggcctgctatagagcaggctctggagagctgaagcaggcctgaccaggagtgtggccgcccgaccacctctgcccaccaggtatgagctcctggtcaggacaagcagctgcctctgtgcgttagcttgggcttaaactggctcctccccgccttaaatactccagcatattctttaaagatcacaggaagttgcccaggggccacttgcctatttctctgttctcgctgatgacctcaggacaattttgttctgtttcaatttggctttttgtttgccccagtccctgtcatccctgggccactgttaggaggtgtgagcttatctgctcgtgcctgggcccctgactttccctgctccttccaagtggctttttaagtagcagcccccgctgcaacccaggggagcctcagctccttcctacgctcttgaggcctcttataaagtggacatgcagggagaagagaagccttgtggcaggctcttgctgtctcctgtgttaacagaaggattgcagttttattattttgcggtgactttgaaatgtgctgtcactcaaacaaccatgtttttattggcttctgcacttggaggactcctccatgaagcccgcggacaggacagatggctccgtgcaagctgcagcctggggtcctgagcttccctcgcaccgcacagtcctgggagccggtgagtgttgccttcgtcagagaactgaagtcaggagggaccaggtctgacgcacctgttacaacagcttaaagcctagattcctcagtagtgaagtttttattttttctaaggtatatcttaaaaactaaaatcatgttaaagtaccctgttgattccttctgagctctgccttgcccacagttacatccggtgcctgacatatgaatggtactcaggtgttttttgagtaaataaacatgcccctccatgtgaaaagttaatatccagatttagtaagacttaagatttgcccctacagggtggtgttgtgaaccctcacttctatagggcagcttcccacttcgtcctcctaggaggctc

SEQ ID NO: 99265 - DNA, 2500 bp, Homo sapiens
gaggactagagtctgcaccaagaaagccttttgcttgtgttgcctttagagaagaggagaccagctgggcagcaccgcccctcctgggttacgtgcagctgagacacttgtatcccggcagtgagccccggccatcttgatggccgattccttgttccagaccggggcctgttctcttgggattgttcttgcaggacccaatatgcacagtgaaggaaaaagtaagtgtggaggagtgactgcaaaacccgccaggtctgatggggagcatgacccagaagctgagcctcaaggctcccagcactgttgtttccggagttcctctgatgtccctgagctcctggctccccatctgaaaatgagggcgaacattcccctttctgcctcacagtgtgaaggtcagtcacatggtgtgtgaaaaacccttgtcacctgtaaaggggctctcagtggaagtgacctgtgcattcctgcagccagaatcaagcccggcactcctcaaacctgccagatgataagaaccccttggacagatgctcacatgaccagcctcatccttggaaatgctcatcagtggttgtgggttgaggcatgggaatcagtgctgagtaagttccctagggtaattcttctcctcggtggctggggaaacatggactatctgatcgggtggttctcaggcttgtctgcgatgacctgggggaagataacaaagagaaagactccattttttatgtttgaccactgatggctttcaatccgttatctttccctcccgctggaaccacatccaggcaagttgatgagaacattgatgccttctccctgggtgcctgagtgcccgtggggagttcaaatcctggcctctgtgcaggaaccctcaacctggctggctcacttttaaccacagtaagaaccaatgctactgccattgcacctactttattttctcaagccccctggactgtatggagcccaacttgatctcccaagaaagtcacattatgtgacccttttcacaacctaacaatggaagggaccagtctgggcagcctaaccaattttggatggcggttaatcccaccctccatggggcacctgcatgacagggggcttcaaaggtcaatgcctggcctgcagagtcagatgtgagcatctgggaggcagcctggccatcagtttaaaggttcctgggtgatccctggtgattgctgggtgcagtggggactgaggacgtgggtctcattctcctcacgtcccatccagttgactgtagctttctcttagctggccttgcctcagcctggtgagagcaaagtctgtgcattttttgttacctttctattcccggatcttagctgaaatgcaggcgctgcttaattgacagaaagaaatgaaaaggaattgaatgcttagaaacagtgatcgcatatcagccaagtatacaacaagagtcaggcctcccccactttgacactttctcctctctattgctattcattttggggacctttggggtaaaactgcatgttaaaatgtaaggaataagactccagctgaggaataggattttcacacctagagtttttaaaaaatgcaacagagtccggtatcaaactctaaacagaaactggatcggggattctttagaagggattcctaaaatgggtggccccaagcctaaacgacttcagtggaatcttccagtcttgcattcaccgttaccagctgtttgtaatgggagagattcagtgactcttatcgggcactagatggcgatcaggcatcaataaggcccaacaaccgcctcggacctgggacctgggattggctcctccaaccctggccgccaccctgggaagtggccattgtcatcttgattgtctgtgggagaccagtgaggctggcggtggggattagaacttcacccaaggatcacaccctccttcaacccttcctgtgcagcaggttttacattcatgtgcagtgaccgcagccgaggatgtggggcacagcccgtgagagagaccaggaggtcagcagtggtgggagtgttgtgtgcagtgcagccagggaccacggaacgggtctctgtggccgctggaccctgccccacgggcctcagggaggaagagctcttgaaggccgagaaggggctgtgctctaagcctgctgcccaggcctaccctgcagcccccaggatggttttcaggatgcctctaataacacccatgtcactcttaccactggccaagcaccattttgagcactttccacagatcaatgtatttaatcctcacacaagcacaatgggctgggtactaccatcattgtcattctatagatgaggaaactgaggcacaaggaaattacaaagtttgttcaaagtcatttgtagaccaaaaaagaaaagaaagaaaaattctgagcccttcaaccatctaaatggacccctcctctctgcaaggacattccaaagctaacctgaaaaactagttca

SEQ ID NO: 99266 - DNA, 1496 bp, Homo sapiens
ctcactgcaaccccacctccagggttcaaacaattctcctgtctcagcctcccaagtagctgggattacaggtgcacgccacaaagcccggctaatttttgttttttttagtagagatggattttccccatgttggccaggctggtcttgaactcctgatctcaggtgatccgcctgcctcagcctcccaaagtgctgagattacaggcgtgagccaccgtgcccagctgaaaaatgttttagataaattttgttcaattgaaaaaaaaaaaaacaaaaaaaacaacttattacctcttcagacctccttgagatgaagcaactgactccctctcacaggaaatttctatgacagtcaacaaaagctgtcaaattgcctgcctttgttctttgagaaattagaacagcctccaatgcctgcaggttacatttccaaccagtgactcatttcattgagatgggttctttttcctgcaacgatagcaagtttgttatactagttgggtcttggtgagaacactgactaggaaccaaaaagaattccacagcccaggacaattaggtcaagccatgaaagccctttaattctggtaaaaccccctcaaaggggcatgtgaacgtaagtcttcacagccctctggcgccagcacaatggcaaaatcactccacccagaagcacttggcccccagctgggacgttctgggttcagcctggctccttgtcccaaaggtccctggttggcacagtggggctctgcaccatctatctggtcctctccagggatggcaggcatgaggcggcatgggcagcctcctgtgccgggagactctggcttgcaagtagaaattaaattcatgtcttttgctgttggtgttatttggatacaaaatatcgtctctttcaaattaagttttaaagcatcgaattttaaactactggcaagatagtgtgaaaactacagtgattagaagggcttggaactattctcagattttagctaaaatgtcactttcttagggaagccttttgtggccatgccttcccgatccctccgtcattcagtcaagaccttctgaaatgccctccagcaccaccgtccttccttcatcgtaacatcttaattagtaattatatactaatatatgtgattatttgatgtgtggctgtccccaactccttcccccaacctcaaatacactaagctccatgcttgtgtttttaacaaccagagtggtcaggatatgcctcaaaacatcaagcatgtgaattacttaaaaaaaaatgaaaataaatgagacgttcaattaaaaaaggggaaaattaaggaaaaagtgaggtcctgtcacatgttagcctgattaattaactacaggatggcatgtacacccaatggcctattttatctaaaacatttttcagctgggcacggtggctcacgcctgtaatctcagcactttgggaggctgaggcagtcattaaaattcggaagtatcgg

SEQ ID NO: 99267 - DNA, 1407 bp, Homo sapiens
tctcattccccagctgtcattcatagaacattcgtctatgtatagagctgaaaatggtcatctcttttaagttctcacctgtcactctggggcaacatcaattacttgatcaaattaagaatatagagcttacttaaagctacatgcatttccttggaagcttaaaaggaccaaaagtaaatacaactgtgatccattatgtagattcaaccatcttataaaagatcacatacagccagtgtttacctaagggcagcaaaaacagcaatactgcaattaattatttaggcaacagcatctctgagagttgcttaagtgatatttatgatattttgccatggcaactattcttgttttgaatattattaaaaatctatcaaactgcagtagtaatgtacttgtggtttaaaaattgcattgagctagcatccccagatacagtctctcccaatgaactactcaatttcctgtcgaagatgaagaagttatgagtatggcagtttactcatgggctggctggatgtggagtccctcgagcagaaggatcacaccaccagaaaggacagctctacagcccaggaatagatgaaatgcaatttcctacacagtgtgttagtttcctattgcttctataagaaattatcacaaattctgtgaattaagacaacaacgtttattatattatagtcatgaagggcaaaagtctaaaataggatatcagtgctatattccttcaggaggctctagaggagaatccacttccctgcctttccagcttccagaggccacttgcattcttaggcagaagagcccttcctgcatcttcaaagccagtaccattgcatcttcaaattccctcctgcccctcacctctgtgtctgattttcacatctcctcttctgactctgaccttcccacctctctcttataaggactttgtgatcacatgagcccaccccaataacacacgttaatttcttcatctcaagatccttaatcactatgaacaaagttccttgtttgccacgtaaggtagcacattcacaagctttagagatcaggatgtaaacgtctttggggagccattagtcagcccactttacacaggttcacatgttatgttctgggaaacatcaggacctcctgggaactgggatctgtgaagatcagccctgaattcacatgataagtgggggatagagcaggtataatgtggcccccatagcctgcatgagccttgaagttttcattgcagggaagaagagattttagaaacttggcttgtctagcactgacaattcctgacctacaggatggcttggatggactatagttgtgagatgtgacacatagagacatcgttatgactcagtggtatccccctcaaactcatatattgaagcccta

SEQ ID NO: 99268 - DNA, 1017 bp, Homo sapiens
tgggtgacagagtgagactccatctaaaaaaaaaaaacaaatcctgcaggagctcggactccgtcctgctgggggctgactgtgactagaggatgcagtgcctcaccagtgagaatgcttgtggagctactgccatgaataaacggggaacaattttcacccatgcctggggaaggcatgagggaattgtgctgcaggttcatttatcaaacaaactaggtgaagcacaggtcttagggaatgactgtcaaagcattcatgattccttcttccaagtttagttctgtgggaacaagtggtgtaatccagacccaggggctccgagttggcattgacccctaaggaccaaaatgctgaagagaaacttattaagaccagtaaataattgacatgggctcctggagacactcagtgaagcatttccaaggcatctaaccacaaactgtaaatgttaattggcacccttagataatagactcagataaggagatcaaaggcacaggaagtcataactcctgacatcgcttttcagacaagtcaggttagaatcatcttactcttcaaaatgcttttcacagtgtttctgccctgatgggcacagaaagtttaattatagagtgatcagcaagagggtggagtctgcccttcatgatcaagtctggacaatcaagtgtgaggaatatttgtttagaataaggctgtttattctctctctggaagctgaagtgcatctcagctgtcagattaatcattaaactaagcaatttttagataaacttaatctgaaaattagccccatggcttccccagcactgaactcaagcccatcttccttgagttacgtgatgatggtgtttcatagttctataatttactcccaatgcagttccagggtcttcctctttctctccctctaggtttcagagtagcctcttcaggaggttctcagccatgaagactctaccccaagggagcttattccacagctgacccctcacaagggcaagttcacagagg

SEQ ID NO: 99269 - DNA, 1047 bp, Homo sapiens
gaaccaactactctaaggtgtgctcaggccaaaatatatctgtagacttttcacattgcttcaagggctgtttacattaagattaaaaaaaaaaaaactactcttttatcatcttacatatttagttttttttttttttttttgagacggagtctcgctctgtggcccaggcgggagtgcagtggagcaatctcggctcactgcaagctccgcctcccgggttcacgccattctcctgcctcagcctcccgagtagctgggactacaggcgcccgccatcacgcccggctaatttttttgtatttttagtagagacggggtttcaccgtgttagccaggatggtctcgatcacatatttagtttttaacccaattttgtaagatcaggtctgcaaacctgtaattacctgtgtaattaaagtgagatatatcattaaaatattcaattttttttaaaaaaattcctttttgtttctgtaaaaatcatgtctgcttattttttagaatttaagcagcgcagaaagagttgaaagagaaaagttaaagagaaaaatcatcaaatttctgcccttgagaaataaccattttagatttaaggaaaataaatacaagccccaacaaaagattcttaataattgaagatatagctaagtaaaaaggatttccaaaatacactcacactaattatatttagagtttgcagtttgattagaactgcctacagggtgtgatttgaggcctctttgctaaaacataattctcccgggctgtcagaggtgtatgaaaagcccctcccccatcccctccctaaggtttcactccagcttcaagattctgctgaccttgggcaaatcaccccatctctctagtcctcagactcttcagtttcaaaatgagggggctggaccaagtcatccctgaaggcccctccatgactgacagtctaggggctgttttccctgttaaattggaaagtgtcctatgaggtgcttggatggtatgaatggaagtggagatctcagaaatatgggggtaggaggaactcag

SEQ ID NO: 99270 - DNA, 1074 bp, Homo sapiens
tgaagttgaatttttgtagggattgttaattgccatttgtacctaatcctgtatgtgtgtgtgtgtgtatgtgtatatatatatatatgaaatatgatctgtcactatgtgacacaagttgcatatttgggactgcagtaagggcttggtgggctgggggaatagtgtggattttttttttttttttttgagatgaagtcttgctcttgtcgcccagagtggagtgcagtgacgcgatctcggctcactgcaacctccacctcccaggttcaagcgattctcctgcctcagcctcctgagtagctgggattacaggggtctgccaccatgcccggataatttttgtacttttagtagagatggggttttgccaatagtatggatatttaatgactacttgttttttaattaatgaacacttagcctttctatgtgcataatggtgtaaaggttagatgggtaggcgtttgacaaacagatgcttgccattcagttacagactggggaaatagctcagtatttgggattgaaactgtaaagactggataggttttagtcatcactctcttttgtctggtggggatttaataaatactttcaagcttctggtttgggaatttagagagttttgattttggatttgtaaatagttgattgctaaatttggtcagatttctcccgactggctgttcctcaattcttaggatatgtcccagtaaaattgcactttgtgaattaattgttatatgcgtaattgttgcattttggatatacctaatttgataatttttttaaaattccatttaaggtatctatttgcaggtcagaaagtaagaaaatgtaattgtgtaatcctctgaaatgtaaaaaaaaaaaaaaaacaaaacaaacaaaaaaccttcggggctggaatacaaaggcatgaatcatgaaccctctgctcaaggagtcagggcagatgggagctaaacaggcattcagaaggcttattatcttgttaacactcggtgacaactcctaccatagaggtaagcacatggtggcctgcctggaaggcgacccaggctgattctt

SEQ ID NO: 99271 - DNA, 1034 bp, Homo sapiens
tgggaaagatcctaggaaggggtttgtgctcatcctgccccatcaaaacttacccaggagtttctctgttgcccttgggaaagaagttgaaaaagctggtcccattagtcacccttgctggtggcctgggagggctgcattcccaagcagcatcccaccgagggtccccctgaaaaggtcacaccctgagctcagtaatcattctcggcaatgtgcgtgctgtcaggcatggcttggaagaaaagcttaggaggggttgcggtttctgcctttgtggattttgagcatcagcatccacaaaacacacaaattcaaacacattaaataattgtcctaaaactcaggcatgccgcatctgaaagacacgttgcttcctgacacaccgcccatttccccatacccctgccatttcctttccagagcaaaaaaccccactggcatcccaacgctaaatggttcatgcccccctgagttcaaggatcctttaagagtcctctgataaaaggggaaaatgccctgataatcctaatgggcttctcagttgccaatggaaatttgaaaaatgtgaaaaataacagagcaagaaagattgttcagacgactgtggttggcaataatttgcccatggagttttacaaaggcatccaaattaaatcattcctcatgatgcattttgctcaatatagctcctgaatataaagaatagtatgacttataaaattcagcaataacacgtatgcacaaattcaacatttatattgttattttcttcattcgtgggttaatgaagttgagaaaccagcaagaatggggttgtctaaaatgcctgctactttcgatggcttttggggggataatcagcacatttttcaattatccatttttataatgtaaatgactaatatttcagccttcatcagtcattgtacactggaacaaactgatcgatcagatctgctagaaggtgggagatgctcagtgcaggacaagaagagcagggagggccaggcacagtggctcacgtctgtaatccc

SEQ ID NO: 99272 - DNA, 2421 bp, Homo sapiens
ccaggcctggggagggcgccgaacatctgaggcggcttcgcgggagacaaagccgcgcgtagagacgcgatgcccgccgatcgcgagcccggccggcgagggcgcggggactgcggcgtctgagcgcgccaagccgtgcgcccgcggggacgccgagccccggggccggtgcgggcggcggcgggcggggcccaggtgcgcccggccgcgtcgggcccgtgactgctcggggggcggcgccctcccgccgcagccgcagtggctggcgccgcagccaggagccatgggcaacatctcctctaacatctcggccttccagtccctgcatatcgtcatgttgggcttggactcggccggcaagaccacggtgctctaccggctcaagttcaacgagttcgtgaacacggtgcccaccatcggcttcaacaccgagaagatcaagctgagcaacggcacggccaagggcatcagctgccacttctgggacgtgggcggccaggagaagctgcggccgctgtggaagtcctacagccgctgcacggacggcatcatctacgtggtggactcggtggacgtggaccggctggaggaggccaagacggagctgcacaaggtgaccaagttcgccgagaaccagggcacgccgctgctggtcatcgccaacaagcaggacctgcccaagtcgctgccggtggcagagattgagaagcagctggcgctgcacgagcttatcccggccaccacctatcacgtccagccggcgtgcgccatcatcggcgagggcctcaccgagggcatggacaagctctatgagatgatcctgaaacgcaggaagtccctcaagcagaagaagaagcggtaatgcgcccggagcgaccggggagcgagcgagtgcgtcaagaaagaatgaatggatggatggatggttggatggatggatggatggatgagcgagaacccgcgcccgcgaacaaagagcgaaccaaagcgatgcttcgaatttttaaaacggaatctctgcacccaaatgcaggactggtgacttaaggagctgcgaagtctgatttaccggcctactctcgacctgccccccacccccagctcaggggaccttttgtctgaacgccagagctactgaccaggtcggggggccgcggtggggagtggaagagccggtcctgctgtccgccctcccagccccaggtggaaggctcagttgtcggaaagacaaaagcgatttcttcccactcctgcagggccagaagttcaggctgccccgcctccactgggggatcgcacctgtgaattacctgaggtatgcatttcccagaaccgtgggcgtacccaccttggggggcatgttggttctggggggaccacctctccttgcattcaggggctgtgaagctgagtaattttcggtcacagggcaggcccctgttgaaatttcatttgtcctgctctgggcccaaaggtggtggtggtttgggtcatcagaggactgcctgggacggttcagcgggcacggagcgctgtgctggcctggctggggatggccgcggaggtgcccttttcctggtgctttgtggtggctgcagaagaccagttttgttgagaactgcttttcagcctggaatcagacatcttccagatggtttggaccctgtccatgtgtaggtcattatcacacaaagagaccaataaaaataaaaaaaataaaaaaaaaaaaagacgaactattggaggtggtggccaatgatgcatttactgtttgcaggatagttaaaggtgtttaaagggtaaggcttttggtgtaaatgctggatggggtgtgtgtgtgtgtggatatagggacctccctctgtactgtgtactgtgtaatcggcattaatacctagactcatatgtatggaattttaaattctcttagcctactgattggtttggatgagcacaccagctgcaggtgtgtgctgaattgcaagatggtatttttttttttaaccaagggatgtctcttgtaatactaaccgcgtgataatgggttttcagacatgatgaaaaaaaaaaacttttacaaatgaatacttaccttagaaatattcaccttaggaaaaaagactttgctctgcccttttatattcctttatgctgcaagtggtgacatgttcagatttctaatttggttcattgtggcctatctggtttaagtctttcattaaaaatgtctcgttagagtatttgatgtcatgcaccaaaaaaataaaaccccaccttgttgcaaaagctgacctcgttgcatggaattaaaagagaaggaaaaacacaaggatgaagtctttccgaattcattcttgtgggaactggccttcggagccagccagcactttgggcaaatgcaaacaacaatgagtgcttgag

SEQ ID NO: 99273 - DNA, 1057 bp, Homo sapiens
aatgtgataaacgttcacagagtctttgttcaattctgagaattctcagtaggatggcaagaataaatgctgtttgtttcgggcaaacagagagaaacatgagcagcttcctagaggtgaccacactttcaagaggctctggaaggtagcagggtagaagcacactgttatttgttttgttcatattaactgagtacccagatttcaacaagaacctggatgaaggaagggccatcaaaaaacccaattctcaaatgtctcggtctggcctaatgaaacccttagccaacagtggatccaatgaacaggtttgaaagaccattcatccttttcatagtggattaaaaaacatgtgaataagcttttcactctcttttctcactggaataaatacttaaaacctcctccaaccaacttgtacataattttctcacaaccgcaaaaccatgcactcaactcctctatccctgaccttcctgagctccgtgtgaccgcacaaagtcacacgacactccttttagctgagtgtctagaataccagtaaattctctcccacagaactcaagtgaagggcccttgtgttcagccacatcacagaattctctggcttgtgatctgatctttttctagcatgtgattccagtaaaatgacccattatgccttaagttacaaatatttacaggcctagggtcaatttccttaaatttgattttatttttggtcccactagtatttttttcagaaatttaaacagttattgccaaaaattatttcccttctatttcaaaaagcatgaccagaatatttgcaaaactcatggactgtgattgttggataccattgttagtcaacagagatagtttagcatctcttggccaatcaaaagtcaggttttcttaagattatattcatcctaattgtttgctattgggtctttttccagtttgcatttttattattttcctgtctgtatcttcccccaattttatttaaatgtaattgacaaagaaacattgtgtatatttatggtgcatatgatattttgatatgtgtgta

SEQ ID NO: 99274 - DNA, 1047 bp, Homo sapiens
actgcttcaagtcaggaattcaagaccagccggagcaacatagccagatctcgtctctacataaaatttaaaaatcagctggatgtgttgatgtgcacctcttgttccagctacaaggtagaaagatcacttgagcccaagagtttgaggctgcagcaagctatgatcacaccactgcactacagcctgggtgacagagtgagaccccatccctaaaaattaacaaaaaaagtgaaaaataattggtgcattaaattgagaggatgaagtggattacagatgtggaaataaaagtacggaggcgagaggttggaaaacacaatgaatgtacagataacattgagcaaaacagcttttcgggtgcaggctgcacctctggaattggggaaggagatgcacaaagagggcttgtgagcagtgctggggtgggttctgaaaacacccttctcagccatcacatactcgctgcaggctgggcatgactgttgagcttgccccatgatggaacacagttgctagctaggtggggcaaatgggcttctttcactgctctccgacaagacggtggcttcccaattaagcactgcatctgctgaatcatgaggtctgagcgtccctccaagcaaaagtgcagatgctgcccctgcaatacctgtgtgtcccagaatgtttgacagggggagatgccttggagcacttcctcagacaatttctggacaggatgagaaaattcggctcgtcaatatctgccattgcttacaacatacaggcaagcatgcttccgggatgttgagaaaataagagaacttctctgaattgctttaaaggaaaattattgccctccctttctctgctgtctggcactgaaatactgttttctccagtttgctacatagtcctctcttctgatgtttatcttttttttttgactaatatttgtattggtaagaggtgctttggaatttgcacacatgaagaaataaagagcttttttcctctacatttctaatattcagctgctctcttacctttcttgtccaggtattt

SEQ ID NO: 99275 - DNA, 1050 bp, Homo sapiens
tttagtcgttctttcggcataattggatgtttccgttgctttgcaattttaccagtagagaaatcctgtgtgtgtgtatttcatacttttcctgatacccttttattgcctccctttctaggtcatttcattgtggttttattttatgcaaacagtgtgcaagtgattctttctgccagttttcatatttggtgttgtaactcacacagttgatcactgccctcttctttgaagatgctgtcttctagagctctttcttcctttatgatttggaagcgagaccagccaccctggttccaggcgactttgctgttagctttagaaaggagagcattcaagctagtctcagcccagggctacttcccccagggcgcctcttccccgtagccacaggggagctttcatttgagaggttctaattttgtgttgttgaagttgccagtcttgttaggcagactgacagcttaggctatctcacttattggctttttgcagaattttgtgggtggttttggttttgtacgttcggtgctctgatctgcgggtggctttggggaacggtagagtctgggtctatgctccttcctcatggtcaagtcccctcccctgaagtttggaagttgcatgtcatcacgtgcagccctgggacgtcccagtgtgtgctggctctgagtaggtggctctgtgaccctggcctctgactgggaggccacccttgttcctcctgcccattcattcgttgattctctcagcagacacgcacaggctgccttcagcgccagttgtcgccttccagctattccaaggactgaaaacacagatctgatcgtgcctcttcctggcctgcagacttccaagggcttcgtggttgtacagaataagcctccgcttttccacacagcacacggagcctggcaggctggacttggagggttttatcccgagcctgctcctgccctgcctcctctggtgggcccctaggatgcctgtgggtcctctcagggaagcatgtgtgtaccccagcctttcccttactgcctctgcccagtg

SEQ ID NO: 99276 - DNA, 1044 bp, Homo sapiens
gagaatgcttctggaagcttctggtgacacttgacctttctcaggcactgcaggcctgtccctcatggcgctctcctcctgtcctcgaagcccacagtgttgtccccagtgtgggaaggtcatttgtcatcctggcatccagaagcccggccccggcgcattcccagaacagccccgtgtttctcttttcagcgaatccactttctgttgccacccgtggaacgttctcactcttccaagaagccaggctagcagctcccccaccccagcagccgcgggacagagcccaggttgggtggtgtgtacacaaaggagggattgttctcacgtcgccctgcgacgagatggggatggacccgcggttagaggtcaccctccctggggcgtcaggggagcatttgtccttgaaacacgctggcaaaaaatgttccaaggaagcctcagctggtgtttgtgaggaagagctggattaaatggtgttctggtaaaatgttcctggaggttttcttggctgttcttggcttttatactcctggttggcaatagaaggaacaccctcctttgtaaagtcggttggataggatcacctacctcatagggcgggcacagcctccagttttttagaaaagcaacatacaagtctttccccaccaagtagaaaggattggatctaagtaaacgctacgtttggatgctcaaggccaaagggggagttgagaagccgcagctcacagtgggattcctttctgggccacgttggaattttaaaagcccttctaaataaagcaggcagctacttgcactgtttcaggtttttctttaaatcctgtaaactgagggtagctgattggattttatttcaacttctccccccaccctttctgtcctgtctctttgttttccagtatctgcctgtgccttaggatggagagaaggtttgagatgttcaggaggaggctcagggcttttcatagtgacgtgaggaattcaggagttctctggtcccagggtcagtcctccgcccactggggcctcagcgacttg

SEQ ID NO: 99277 - DNA, 1356 bp, Homo sapiens
gccagcagcctctgtgtgggttctgcctttttctgcactggtggtgtctccccatcgccccagctgcttgtgggcaggcgtcaccttgttctgacctctttccttcccccaggcagctctggactttgctctcagtaaacacaacttgattcttttccttcttaccttatcattgcccataaatcccgtttacacggtgcccacttttgtgtctgagctgggacgtacaacctcgtctctgcctccagtttttgagaaattaattataaacagtgttgacagaggctctggcttgacttggggcatctgctgctcttcccggccttggtcttctgaaggtagctgttatcagtaacagaacagatgtgtttatcctgggctcccgggcccttggcgtggccctttgagggggtctgtgaaacccctgaaactgcatgctaaactttacgggtggaggtagttttctaaagagagggtccagagactttgtcagattccttagaggatttgcaccctcaaaaaacgttaacaacctctgagctggaggaaggcctaagacaagcctatcgcacttggagataagataagccgaggcgggacctaatggggcctcaatgtcttggccagagtgcacagctgaaacggagatgacacttgacagaaaccagtgtaaaactctccttccctttatttagcttttatttcttgtgcttttcattaagtacagatactctttgcttgcttacagaacagggaagacctggcttctgaaaattatctttaggtttttcattgaatttggtcttattctgaacaatgcctgaacgtcgaaggtgctcccctagataggttaatagaaacccacagtccagggcaagaggccgcatccgggaagcctgtgtacaggtgactggagagatgagttctcacggaccgttcgggcaacttggtgttccggcctggacatttcagtgctgcatttgaagaggaattatgaattggctctcaaaggagggtgaggtgttttgttttttgttttttattttttttgacatggagtcttactctgttgtccaggctggagtgcggtggcgcaatctcacctcactgcaacctccgcctcccgggttcaagtgattctcctgcctcagactccagagtagctgggattacaggtgtgcgccaccacacctggctaatttttgtatttttagcagagacagcgtttcaccacgttggccaggctgatctcaaactcctgacctcaggcgacccgcccgcctcggcctccccagagtgctgggattacaggtgtgagccaccatgctgggctggagggtacatttttaaacgatg

SEQ ID NO: 99278 - DNA, 1012 bp, Homo sapiens
aggtttccctaagaccttctccgccccagacatgctctcgttaggttggtttttctggattggtttgttctctaattgttccttggggtagatcattggcagaggccacagggagaatattctgtgatctggagtctatgcgtggcgtgacagcagccgtagcggagggggtgtgtgcggcttcttgagtttgccgccggaatctgtcagtgattccttctgtatgcagtgatgttgtctgttcagacgctgccctcttggttcctggggaggagccaagagcagcctcttttgtctctggatgaatcagcctttgcacagaaaaaggaaaaacttatcagttatgagctcaaatgcgccttcctgtcttcctagacctgaccccggctgggaggtgaagaggtgagatggagcctgctcttctagggggtcttgagatccagtggtggctgtcctgcccagggtgggccctgcaactgcaggctgtcctggagaagtgaccactgggacctgctgagtagacggtggtcaagcttgttgggctgtccaggtaaacccgaggtgcccaccaagggaacctgttggtgttttgagaatgtgtggcttaggtttcaggaacagagtagaattcctaaattcagtctcctgagtataatcctatcacatcagccatttggctcccttaaagattatcccagagatacctaccgagttacctctgaaacagtcatctttgttgaaaccgaattcgttcattcattcgggtttgagagccaaccatgcacatgacaggagcagaaaaagacaaacagatggtcttatgtcctgggaatgctcagattctcatggagaaattgggccagggacaagtctgtgcatggtgtgtctagcggtggtaaagggcagagaaagaggatggggtgagggccggttgtgttgacatttgagcaaagacctgaatgaagtgaggggatgagagcatctcgtgtctaggctggggccttctgggctg

SEQ ID NO: 99279 - DNA, 1034 bp, Homo sapiens
acgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggtgagtgctcagcaggtgcctgggcgttcaggggtgctgctcagcaaagcctttccgccttcccagtgcacatgggcgtgggccgtggtgtcgtaagtcaccaggacagtgtctgtggctgatgtcccgctgcctgagataggtgcggctcagcacagcctttcgccttcccaatatgcgtgggcgtgggccgtggtgttgtaagtcaccaggacagtgtctgtggctgatgtcccgctgcctgagataggtgcggctcagcacagcctttcgccttcccaatatgcgtgggcgtgggccgtggtgttgtaagtcaccaggacagtgtctgtggctgatgtcccgctgcctgagataggtgcggctcagcacagcctttcgccttcccaatatgcgtgggcgtgggccgtggtgttgtaagtcaccaggacagtgtctgtg

SEQ ID NO: 99280 - DNA, 1057 bp, Homo sapiens
tggccattcctgcgccgtctgctggaattctgcggggagcagagcctgccccactccctacactgtctcacgctgtgtgcctcttcctctgcaggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggtgagcagcggctgagcttcgagctcaccgagcccctctgtccctgggttccgtggacccatgcagtgcagccataaaaagtcttgcctcgcggcatttctgtgagggtgcaacaggtggaaatgtgcacgcatgtgcccagcactgggtgtgcctcactgagtgggagccatcctccggattggttgtcgtgagccctggctttaggatgtcaaggctgttccacacgacatgggaaggacaaacagaactgcctgtcccttgttcattttgatcttaaattaccatccgtagggttgaataatgcaataacacatacacagaggactttgtgagccgctctggactggagtgatacctggtatgttacataacttgggccaaagccggtgtggccgggctcttgctcagaggtcctttgtgttctcgcatgtttgtggagggcaccctagtaagcttcctggaagacggttcaggcttgcaagatccaggaagcaggaagtcccaaggacaaagctgtcttttatgaatgggatgaatttccaaacaaatggcacagagagaaagtgccataaagattgtaaggaaagagaagtcctttctgtttattcatttgttgcgcacctactcttgcacaaagccctgcttttccctctggaatgtgctgaccctggccccgagatggttccactgtttcttctgtgggcttgtctcactcgtgaaagagtgtcccaaatagtgactactgaagctgcaccaagtaataggaacaaa

SEQ ID NO: 99281 - DNA, 1765 bp, Homo sapiens
gtctgccttccggggctgtgccctctggatttctggtggctctcatttctctgtttccaggctgctgatttattttcttgcttcatccctttggtccggccaagactcacctggggcaccaggtggcatgtgcgtggacagtgtggagtcatatcttagccacagttgatcagcactttctcccttctcagcgctgttggccagtgatggtaaaaagcctgcagagtggcttgtccataatacagactggccggtaagacctctattgaggaacattgagaatggcccaaagccggcaggaatgtgcctgaaagcctggtgctggcgttgcccagcctcctccctctgtgagggagagggtatcagcccacagagaggctttgccttggcactatgtagtctgaactactaaccccgaagtgctttggtttgaaacttggccagttaggtggagaaagtggatgttgtgttgctgagcccttggcatttggcagccctgtagacttgaaccatgtcccagccaggctggatgactggcagactatacccttgggggacttgttaattccaggggaggatccgggtggagctccagccttatggggtcctagccctttgtgtgtatctgtctcccatgaggtcacctggctgccttgttggtgacttaagatgctctgtggattcctcaagagatgggctctgtctgcctctgcatgactcgtgatgagtggcggtgggacctggacccatctgctgatgatcaggtggtgttgcagcaaggttcctccagagctccagctctgcgtctgttacgggagctgtgaaggctgcacggtgctcatttcagatggttcttcctggctctctggctgcatccacagaagtctgatgaaacactgtgaaagccggcgtcaggtattgaaggcacctggctgagagcctcttttgctgcatgaagacctctggctgagtggggttcacaacacctcgtttttatttcccattcttgaagctgagctctggggctcaagcacttccagcaaagcagtttgactttctagcaagaggatgtggttgcattttcctttctcccttaaaagaaaaaaaaaatgcgtcgttcctagatgatggttttttttgacagcacgatgcctacctttgcgatttgagattttaggccccttcttggccgggatccttgtcatttttaataaggcttagaatcattgggtgaatcctgtttgggactggggtgatgctgttatttttctcttagaaatagggatgtctacattatgtggagctgtagttaatttagtgaggcttaagaaccactcagacatgctgctgttctttgcatgttcttctgttatcaataatgataccacttttcatttctgtagaactttaacagaaatatttttgcatgtatagtctcattgtgtggcttcaccaaccctgtgagggtgggtgggtagcttcctcatcctcattttatggaggagcgggtggaggttcagggagggataatgacctccttaacatttgactgaggtggtttgaagtctgatctgaaccaagggatcatttgaatggagtttctgtctccacactgcatgtggatggcaggaacccagtgctggcaactaagcctgcgctggaacatcacagtaactgcagagggctccctgcaggggcagagagctgcccctgcctgtgcgtgcaccttggaggttttaaagtctaactgtttccaatcaggaca

SEQ ID NO: 99282 - DNA, 1330 bp, Homo sapiens
ggcgcaatctcggctcactgcaggctccgccccgggttcacgccattctcctgcctcagcctcccgagtagctgggactacaggcgcccaccacctcgcctggctaattttttctgtttttttagtagagacggggtttcattgtgttagccggtatggtctccgtctcctaacctcgtgatccacccaccttggcctcccaaagtgctgggattacaggtgtgagccaccgtgcccggccgggcacttcttaacgttatgaagagcttttgaagatagggtttctcttgttggcacaaaattcccacatttggctgcaccctactcaaaacttcactgttttctggcatcttcaggaatttttgctgttggagtgaggtgcagccttgtccaggggaaggatgttttggctaatgcttatttcagagcgcgtggaggtgggtctgggttgtaaaatctcttaacgatggactaaacatattttagttgaaaggcccaccaaggctcccaaataaaaacacatccgtaatcctgtttgtaggcatgggatacaggtgattttgccctcagtcttgttttaaaacactagcttgtcagaagagaacagtttttttcccccaatttttgttttgtacattgagaggtttattcccccctcccttcacccccaaatcactagagtttaaggaagcattgctgattgttccagatttatctgatcaggtttctgggatgtcctatggggcatggcatgctgtgaaatgtagccacacagctgtgtcgtctctggagcctccgcagccaccatgcccagaaatgagcctgagagccatctcgcctccagtctgaacagcgtgtgttagtttcccctctggttctccttagaaaagtccatcgggggttgatggcattgaggtagatgaattaactgcctttcttgttcaataaagcttgttcttctttcaaggataaagcctctcttagcagtcacacatcgtaattcagcttgccagcagcaggaccgtgatgtgagtgatagcccagccagctcattcagccaggcggcccgattcccaggttcccacgcatcgccgggaaggttggccttcctctgaggttgagccctcatccagcccacaagcctccatccccaccaggtggccgatgagaggaaacccaggctctccactggcctggcacttggcaggagaaccctgccctgcacttcttaagggcatttccacagggagattccaggaccccttagtagtatctcagccccagtgtttgggggacctgggaagatgggtcagggttccccactttgtcc

SEQ ID NO: 99283 - DNA, 1038 bp, Homo sapiens
aaggaagtgactcataagggagagaagcagtgggggcagctgcaggaaccttcaaaacaaaacctgcagccctgttgctaccacctcttgttttttgcctaaaccaggcgttttattttgttaagacgaaaatcccttattttgcatccgtttttccccctgtataccctgcaggtgtttatagtttgtgagtctcactctggcttgttttaaccactgatttcgtttcgtcttatgtttctctacactctagcaaacctgtgtccccctccccgcccccatcccaatcctccagccttcacgtccttagcttaagtgattgagtctggcaaagcggatgaggcttagctatttttaaaatccagggtttgaggttctgatctggtgcttagctacataattccttccctttgttaagtacctttctccgagaaacaaaatgcactctacagatgttaatctctaatctttgcagcatctgttatttttattcaggggtacaagtgctttgtgtgtgctgcggtgagccctggccttctggaagctctgtgcttctgaggggctgagggggatttgggggtcccttttcatagtgtgggctgtctttcccaagatgcagtgatgacccatcagaggcagggttggtattgtccgtggggtccagtccctctatcttccagggcttttctggtcacaagagaccatggccagaagtgggtatcgtgcttgtgtctggggcctggggagggaaggaaaacaaataccaccccctgcagaagagatcgttaatggattctttgagtaaccagccagatagcttgtttgtgtgcgaggttgggacattttccgtaaagagcagactaaatataggctcgagggtggggaccagggcccgagagggggctgccactgcttgctccagtattgtttcttccattggtaaccagaacttgccaccagtcccaaacaggtggccaccctgagctctctgggaacagattggtgtttttgtttaaccaggggctcatttgcaaattt

SEQ ID NO: 99284 - DNA, 1090 bp, Homo sapiens
tggattgtctgcaggctattaattccttgttagttgaataatgacggctgtgtgcatggagctgtgtgagcgaaatccctcaccaggaagagggcgcagttcctctgggactggaacaggggcccctttggctctccttggctcctggcagaagtcagttgtcaactgggggactctttctggctgagccccaagcagcctcaatccatccctgtgctgggttttagataacccactggatctgtgttggtctttgaaagggaattcactctgtatgtttggcctaaactgtgttatggccttcatagttacgtattagcattattcagtttttgttgtttgtagcaattatgctgaagacacaaaagaagaaaaaaagctaagtgttgccaactcaaggagtaattttctttgttccagcgctgtgtcctgggagctgcccatccccctccacaaaggccagtgctaaacaaggccagagccaggaaggacacgcggggccatggattgagtgagggcagtgtgtgcgtgtgtggatttctctggtggctttgcaatggcaaatatttattttgagggatggtggtgggaggaccaagtttatactcactttgtttagtaggggaagtggctaatgtgagaatcaatagacaagattttatcaagcctctgcactgggcagagcgcagtttttgaagctgggagaacaggcagatgtgtgggacactcagggcccttcagatctcccccaggagccactgatacaggtagagatcgcagccacacaaggctgtgtgggaggggcctgggagatggggcggagtccagggagagatcctggaagccaggtagcagtcaggagggctttccaggctagtgggtactaggattggagcatccagaacagagtcacttcagcctgggaagagcggggtaggcggccgaatgataagtgatccttgacagcccccgagagcaggctgggagaccttttgttggacggtctactactgattatggatcctgcttggagaggggagtgctttttttaaaattcttttctttttttttttttttttttaagacggaa

SEQ ID NO: 99285 - DNA, 1036 bp, Homo sapiens
cctcagcctcctgagtagcggggactacaggcatgcaccaccacacccaactaatttttatgtttttagtagagatagggtttcaccacgttggccaggccggtctcaaactcctgacctcaggtgatctacccgccttggcctcccaaagtgctgggattacaggcatgagccactgtgcccggccctgttttatttatttatttatttagctcgggtttcaatattttaaaaaatttgaagccaggtgcggtggctaatgcttgtaatctcagcgcttcgggaggccgaagtgggaggattgcttgaggccaggagtttgagaccagcctaggcacagtggcaagtgcctttagtcctagctacttgagtggctgaggcaggaggatcacttgagccaaggagttgcaggctgcagtgagctatgattgcatcactgcgctccaccctgggtgccagagtgagatcttgtctcaaaaaaaaaaaaaattgaactgtgatgactatgatattgtcttttggggggttttctggacataaaattcagaattttacatagaaacttgaatttatttgtccaagagtttcttgttttgaaaataggatgccactgggaacattcttggttaggagccaccggaagccgggtctgtatgggcagggccagtgagatgcaaagccacacacgaaagctaagcacacactcttgttttcctcactcacatccatgttcatcctctttcctgtgctgacggtttgcaaagctgggagagaatgagggcggggcctcgggaagtgaatggcagagcaggtggcatagacacctcagccgtctgcccacagggtatgggcaaggtttgttttggtgactttttcttccagtcttgtgtacattatcgtctctcacaggacttgagcttggagggagctggagtggccgcttgctgagtctttctccctggagctcgtgggcagctggttacctcgcgctggggcgaccctgacttaggacctcctgccgtttctctgggtgact

SEQ ID NO: 99286 - DNA, 2602 bp, Homo sapiens
tcccgccggcagtgtgagagtgtccactttgggcttaagttcagcaggcttctggcagtgatgggatagcagctgtccttaagaaagagcatttgccctctgtgtctcttgggctgtgaagtgtcttgtactgatgaggggggtgggaggctataggagtgaggctgaggagggaaaggagaagcctcagaaagaggtgcagactgaagaccaccttagaaggtcgcaaaatccaagggagcagagccagtgtgcctctccttgtgacctctggcctcagtttccctgtctgtaaatccggatgtttggccaagatcagttttcaacaaggtgctgggtgggggggcggggggcggcggtgtatggcgtgcaagcattgtagcccccaagaggacatttggccatgtctggggcaattttcggtttgttacaactttggggtgtcatggttgttactggcacgtggcaggtggaggtgagggatgctgcccaagatcccgcaatgcctggggcagccctgagtcttcgtcatcccgagactgagagccccaggtcagatgagctctgtgaccccctcagcctctgatccacactcaccaaggattactctggtgcacgattctgtttcggtgggagctggtgtaattatctagaggtgtgtctacctgtgtgcccagaggggcccgccctctcggtgagcaaggacacctggttccctggggtctgagccaggccctcagggaggggggcagccaggagccgcagggggctcagccagctcctggccctcaagtgttctaggaaaccggcttctctgtggggatgtgactctccctcactcctcccattgcctgagtaggcaaattccacctagctctttatgactaactgcctggcagcctgagctcagggcagttcctaacgaacttctttgattattaacctatgctgggcccagggaaattactcacttgttttctggccaagagaaaatctcctggaaacttctatatataaatctttttgacaattccgcattcaagagagttcccctggcagttcttctatttgtagggtggggagaaaaacccatgtaatttccccaaactgtggattttgttcctatagaacatgcttgtgagattcagtgtgcgtatttgtgtgagtgtgtgtgaatgtgtgtgtgaatgtatgagtgtggatgtgtgtgaatgtgtgtgtgtatgtgaatgtgtgtgaatgtgagtgtgaatgagtatgtggatgtgtgtgaatgtgtgaatgtgtatgtgtgggtgtgaatgtgtgtgtaaaggtgattgtgagtgtgtgaatgcgtgtgtgaatgcgtgtgtgactgtgtgaatgtgtgaggtgtgaatgtgtgtgaatggatgtgtgtgtgaatgcgtatgtgtgaatgtgaatgcgtgtgtgaatgtgtgtgtgtgtgaatgtgtgtgtgtgtggtgatggtcattgtccacattggtggtcttgtcactcacttcttgatctgttgctgcatcagcagaatgctgggcagatggctgcatcttgtttgggagtttgggagttttctttgagtatctgttttttaactttcaggggagaataccaaggttgggaaacactggttttgctgacataagaataagaaaattggccaggtgcattggctcacacctgtgatcccaacactttgggagaccgaagtgggaggattgcttgaagctaggagttcaagaccagcctgggtaacatagggagacccccatctctacgaaaaaacaaaacacccaggtgtgttggtgctgcctatggtcccagctgctcaggaggctgaggtgagaggattgcttgagcctaggaggttgaggctgcagtgagccatgattgcaccactaccctccaacctgggcaacagagtgagaccctatcattaaaaatcagtcaatcaatcaatcagtcaatccatgcgcgtcctcccccattcctgccttgatttccctgttaggatttgccatggggtgggcagctgggcaaaggcatctgagctggaggtaggtgataagctccctgggcctcccaccctgcctgcctctgctcagtggctcctgggtccctcctgaccatgtaacctttgcgccagccagagaatctgccctttgccttcctctccaggaagttgttgagatacatgagtgaaaatattattcttttaagtgctttggatgttataaaaaatacactgtgccattaatgctcgtgcagggctcccggccggcctaggccctctgcacttgagattcctctggcagcatctgtttagaactgggcactcctggttctggtcaagtttatcctgaccagttcatttcatggcagttctggtcatttttgagaaaatctagtttgcactttcattgggcccctttgtgttttctagttcagatgtggcttctctagctttttcttgctgctaaatggtcttaaaggtttgagatcagtgtctcagactttagcctgcgtcaggatcacctcaggtcacgttttaactgagggtgggttaaaatgcagatcactgtgccgggcgcgggtg

SEQ ID NO: 99287 - DNA, 1048 bp, Homo sapiens
ccattttggtgccacactttgggtactatggctttgggcactcccaatccaggtgccatggcatggggagcagtgggtgaaccaaatcctggagcctggactgttccattgggtgcatttctggctggcagatagaggaccacccagctgtgcttgatggggtctagaagcattgaaactggtttgccgttatgatgtccatgaggttggagtcctttcttagttaaaaaatctgaagacccaacaacacacagcacccccacgctgaaccctcccgagaatgattgagctcttccaaataaagggcgattttgtagcttttcaagttttaacagtttgataactcccaggctcctgttgagatgctttgtgatgaggttgtgcgttcccctgtatctttcctgtgggtgtttatgtgtacagaacacatgtatctgtatttacgtgactgagcacaggcgatttccccgagtctcaccttggtgtgtgccagtgcatgcgcgtgcgcgcgcgcacacacacacacacacacacatacctcctctcagagaatgttgatgtggcaattcatgtttgacagctgggttaacccataaatagatcccaaaatataaatttacccagacctcaacctgcttaagcctttaaatagctcactagggcttttagaatgaagttgaaattccttggcctcacccttaagcctttttagaaggagtcatggaggaagtaaagaaatggaaatggagttgcctcgctgggctcccaggccctttgccgtggccctgcctgctctccagcctggtctcaccccacctgtggcaccttcgctgtggaggataccgtcagccaggctcacagttcctggcaggccacttcctctgtctggggccctgcctgggggtttggatcacctgagtcctgccccttggcaagcctcttttaacccacctgatgccttcacaacccagctcaggagtcctgcttccccaaggccattccgatggctcctgctggcgattccagggcctgccacctggtggcctgt

SEQ ID NO: 99288 - DNA, 1101 bp, Homo sapiens
gcgctgatccactggaatggggaagggcctcgagctgttctgtcaacacggagttgtttgtcaggcgtcatgggtatcattttgtgcatctgcccttgttcagtgtttccttgtaattttgcggaaaaaagtctgcttagtgttgaaccagacattctgcagcctttaaaagagaatggaaatggagagattgtaatgtgttcattggtgacttttgacacggatgctaacctgtaagatgtgcagatatatcatgtgcaaactgttaagatgctgtcaacattttgaatgacttcttgcaaatagtaaggaaattaaacacgcacagagctgggcaaatgctagaggatggtgttgccttttgcatcttggtgggaaagagatatttaagggggtgaggggagctcagcaacagcgacttaagggcctgctaggagcggggagaagttggttgctggggtgtgcggcctctgtagcccagtcctccgagtatcgtgacaggtggctgggtgcctcagtgctcaggtatgggctcctgttcctgccgcatgggctcctctgctgctgctgctgctgctgctgctgctgctgctgctggcccgccagttcccatggactctccctcacctgtgcttccttctgctccccgacttcatggttggaacgtgctgtcttcccatccctctgggcacgtggctcctcttttacatgcatgcctggcgaatagtatatccccagtaaatgcttgcagaatgaatgtctttcctgaatgttctgctctgctccccagcccccagaaataaaacagaaatgctgtactccttccctgtctcaggcccaggagcattattattattttttttaaatctcttgtggcacttttctactttctcctccacagtacagctgcttgttgagaggcagtatatgtcatgtctaagaagagtcctcaagtgaagtctggtgcagcttctttctagctgtgtgctttcaggaaagccttttgaatttggagcctctgtttcctctagctttactccaaaggaaacaagtgtaagtgcttggcacctgcagcctgagcgtagttcatgccgcccgtat

SEQ ID NO: 99289 - DNA, 1037 bp, Homo sapiens
tggtaaaaaggtggtaaggagtgggcacattggacttagacctcctgggcttctgtctgtaccagctctgaggtacctctcctccgtaagacgctcagcctctctgtatctgtggggtcttgataataccaatctcatggttcataggaggcgtgatggtggtgatggtggaagtgaggaaggagaggacgcaagagaatgggagacaccctggagaagccaagctggggagggaaggaagacggctcatgaggaaggccaggtttttggttgggagagacttgagcttgatgagtgtttggacaatactggccctgatgagggagcgattgcagggacggggtgatgccgatgaagaggctggccacaaggcagaggggaggctgaaagttgtgtgaagatggctgagtgggaaagacaagcaagatgggagtaagggaggatgtcttggcctttgtgcctgagcctgttttctctgcaaggctggaaagctgacctttatggtgatatctgtttggtactgttagagcgatttgtcctgcatttctgggcaacctgtgggcagaagaggagaaggatagatccttctgatatctcctgggtttggcagttggcatggtggatgtcatgtgggtgacatgccaccaggatgtcttagctggggctactgtagcaaaacacctaagactgagtggcttcaacaatagtcgtttatgtctcgcagttctggcggttgggagtccaagatgagggagccagtgagggcaggctccggtgagggctctcttcctggcttacacacggctgccttctcgctgtggcctctcatggtggagagagagagagaaaggctggtctcttcctcttcctgtaaggacactgatcccatcatgctcctcacggccatgacctcatctaaacctgatcacctcccagaggccccacttcctcatgacatcacagtggggtttagggcttcagcatacagattcagggggacacatgcattcagcccataacagggtgagggtgcagtt

SEQ ID NO: 99290 - DNA, 1657 bp, Homo sapiens
aggactgatacataatgtggaggactgatacataatgtggaggactgatacataatgtggaggactgatttataaagtagaggactgatttataaagtagaggactgacacataatgtggaggactgatttataaagtagaggactgatttataaagtagaggactgacacataatgtggaggactgatttataaagtagaggactgatttataatgtggaggactgagaggcagttggatctggatggctatttttcaaagtcaaggccactcagccagatgaatccagaggcatatctaggttctcttgattgacaggaacctgcagaccagctgtgctcttggtcctgtggccttccatgggagagggtatgggaagggctttggtgcaccacagatgtcttggcctgtctcttccgatgacttccctttgcttataactcacacctgtttacttggagactgtgaattagatttttagttttgcagcaggaaaatcatttgaaattatagactatccctcttgaaatctcattacataaaaagatttaacaagcctcttgtgaataagttagggtgacaaggaatgaattatttggagaagtaaaaaaaccttaaaaattaaaaaaagtttttacaagtaataagaactttacaaaattattgtgtgtattaatatcaaagggagatactgatgaggacctgaacaacatgggtgatgggtaaaaggtcattgccaccctgagtttggaaatttgaggtgctcgttgctactttgggttcagaatagttatgatttatgataaacctaaaaattaaaagtaccacagttttctctcaaatcgtatgtgggtgggttgtgtccagaaacaaataggaaagcttccacagatggaatgaaatagtggaacagatatggtggttttgttttggaaaggatttgtctccaaagttttggggtggaggcattctagtcttgtttttcttctgagatggaaacactggcaaacttggagtcttctgcaaaactgtatcaagcaaaagtgaaacagtagttgctgtgtgacaagttagtattttgtccatgacatgtagcaatcagtagaaatagataaaggatgggatattggaaaatcccctggagatgagaaacggtgggtgacatctgatgagaggaggaggattcagggagcagaatgaagacattggccaggcaagcatctcagtgtggaggtggggctgcttagacatttaaattgacctaaatcaagcagttattaataagtgggcaaaacaccggaaaaattgcactccattcctgtgcctgtcagggctgttctattatttggaaacagactttacttacttaccttattgattgagacagggtctcactctgttgcttaggctagagtgcagtggcacgatcatggctctctgtagcctcgacctcctaggttcaggtgatccccccaccatagcctcctgaatagctgggactacaggtgtgcaccatcatgcctggccaatttttattttattttattttttgcgtttttttgtagagacgaggtctcgctctgttgtcaggctggttttgaactcttttgcccaaaccatctgcctatcttagcgtcccgaagtgctggaattacc

SEQ ID NO: 99291 - DNA, 1338 bp, Homo sapiens
tgctaatgcacgtgtccgcaaatctagactcagcacaaggagtcttagtttgggatcacaactgattctcctggtccagtgatacctctgggctcttgttcattggctggagctctcctttttgctgggaggcagtgcttcatcttgcagttcatgagatgactggcacttttgcagccggcctcacactgctggttatgtgcatggaagaggtctcatctcactccttcctatggcttttctagctgggcagactctggttcctgtattctccccctcaactgtagtgttgaatgttcactgcccatcctttctgccctgctctgtggctgcctgtcctcatctctgcatcggtcttctcttttcatgtcctgtagctcatgagtgacccgctcccatgtcacctgccattttggccttgaaatttggtaatgattcatacatgtgtcctcgcttgtgccatatccagtgggacaagggaattgggacacctttggttctctggtagctttgcctttttttttttttttttgagacagagtcttgctgtggcacccaggctggagtgcagtggcgcgatctcggctcaatgcaacctccgcctcccgggttcaagcaattctcccgtctcagcctcccagagtagctgggattacaggtgcctgccaccacgcccagctaatttttttgtatttttagtagagacgggggtttcactgtgttggtcaggctggtctcgaactcctgaccttcgttgatccatgtgccttggcctcccaaaatgctgggattacagacgtgaacccctgcacccggcctagctttgcttttaaattgcaagctgggactccagccctgtgaagtggctgtccgcattagatcggacacctggcagacacttgtttaagttttagaattttaaaaaggaaaatacaggagaaaaagtagagttgatcacaaaaagtagattttgcaggaaatagtttaacttttaaaaaagttatcaatgtgttatatgcaaatatggaaaactataaagaagaagaaaacagttgcctataattcttctagctggaggtacctgctgttactcttggggatgctttttgtttttctacctttgtagctttttagtttttttctaagacaaagtctctctcttgcccaggctgcagtgcaacggtgtgatctcagctcactgcaacctctgcctgcccagctcaagtgatcctctcacctccacctcccaaatacctgggactgcaggcccacgccatcacacctagctaatttttgtatttttgtagagatggggtttcacccagaatggtgtcagac

SEQ ID NO: 99292 - DNA, 1875 bp, Homo sapiens
gctgcttttgtatgttggcaaatggggctttcgctttccttggtttgattctgtcattgatgcttcagactagtcatgcttttgtttgaagggaaaaaaaaatcaatcaatcaatatcagtaacttgctatagatttttataaaggaaaaaaccccaccacatgtatggtggggagtgagttgatgtggaatcagtcatgaccgcgttgagttaggagcatcgcggatgtggagttacagctctgctgtggatgtttttgttttaagaaaacatcttttaaaaatctaataatggttcattaaaaaccagaaatggtcaagctcactagaaaccgtcatcagccacattctgatgaaagaggttttgactttcttttttaaaaaattaatgaagatacatccaaatatttgtggcaggcaggaaatcaagcggattttaatgggaaattatgtaagaaagcttaatgactaatttttctggatcagacaagtggagaacggtcttagggaaatgtgtacatccattactcattagtttgctgtattataattactgttgtataggaagaagcatgtcagataattaggaactgggtggcattttatgctaaggatcaaaacaaagattttgcttggaatgttgagcaaaattatactctggctgagattaaacacatggcaagcatcctactccagtatttaaaatcatcaggcaggctttattctatttttttgggtctttgttctttcatgttttcctctaatgaaaaggaatgcttagaaaatagcactgggaggccagcaagaaatcagtgttgggattttctcatgtgtgaggagctgttactgctcctgtcgcctggtttcacccctcggttctgctcccaggagctggacccctccccgctggcccctctgtgctgcaagcatccattttgggcttggggataatggtcaagagagttggttggtttgggctgtgggctggacaagcgcttgctgcttaaaccatgttgattgtggcttaactgctgaaccaaaccaatacttcatccaaagaacttctccagggagggagtgggcttcaggggagccacatgggaagccccctaaccaacatttctgtagcacttgattggagcctccaaacaccgtcgctgtcgatgctacagcagtcctgtgggccgcagaaggagtactcactgtgtgttctccatgcccttctgtctctgagaagcagcgtggcgtgttcggattgtgccctcctgccgaccccggtggctcaggcaaagggcttgccagatggtcggtgttctttgccaaatgggaccgatagcgtgcgcatggtggggatgaggggaggactagggaagtaaatacagtgcctgctgccacgtcaccttcacacagtccatgtttaataagaggtcgctgctgtgatgatagggggtcggccagacatgtccactgtttaaaaagcagcatccatctgaggactcattggattaaatgtacacctaaaaaaaatacagtggcacctgcatgcagtgcccgaggatgggtgtgctgttttactagatctggtgttttttggaggtgcacatttggtagttcattgttgggttggtatttgtctccataacctgtttcagcctcaaggtcatttacctttgatcagtgcttcaagcttagcggtttgtttatatacatgttcatgtataaattatattactcagtctgatcataatatatgcccagtgcaaatcatttcattaaagcctcagggatacacggtgccaccgtttcctcattcagggacacggggatagtggtagtgtgtcttcagcacgacatggggaaattcaaaggcagcca

SEQ ID NO: 99293 - DNA, 1018 bp, Homo sapiens
tgcttttttcctccaaatgcctctcacctattcccagatactcgctggagttggagcacacatgtctgcagatgtaaaacgacctgctcccccaggtgaatggattctcgccagggccaatacttatccgcaggggtgtgtgccaggcagcccaggtcagcctccctccaccgggccacccgcaccaggttgcctcccatcgtttgcaggagcggaagacccgatggagcaggtttcacagtgccctcgctgctgcctcccgtttcatctgcacgtctctttcaatgcgggcgtgcgaacttccaggtagagccgagttcaagaaaatgaagtactgcatgcgacgagcaagtttattgaagagggtgtgaggtcgcggcgcctgaccctcattatgtcagttactactaaatgaaattagaacttcactgccctttttctttttcccatcgaggtgcaggaggaattgatcttagggtagtattttggatttaaaaaaaaaaaaaacatgaaatgaaatccgtgtcctctttatcctcccctctctctgttctgcgcggcaggtagcaaggaacggtggcggggccaaaggtttcctcaaagaccctgggggccgggcggggctgtgccaggcacccgcgtcgcgctccagctccagccctttaatgctctttgccattcaagccactcactttcattttctatagaaaagcctttctgccgcctttcacaaaacttgtattttcatgcctaataagtgagcgtgtgacatgcagtgggctcagtctctgcatagcccggcaggcagcggctctgctttccagaaccttctgggagtggcagacacacattaggagtccacgcgcaggtagcctggcctttgaagctctccaggctctggccacagtggctttcctgccctccttggctggtggacgtaaggcccctcgccccatctgcttcctgctctcccagagccggcctcaccttcgagactcatgctactaagttgtctttc

SEQ ID NO: 99294 - DNA, 1329 bp, Homo sapiens
ggacaggccatggctccccagttctctgctgtgggcaggtgcaggagcctgaccaactcctccgtgagtccatctatctgtgcgtgcatttattcattcctccctagtgaggcaggtccctgatgagcagctcctctgcgcctgcccaggtccagcgttgggcatgcagtggtgaacaaaacagactcaaacgcatcttcacagagctcatgttttggtggacaagtggaggatataaacaataagcacaatttagtaaaacatacggtaccacagctagcaaaggtggcaaggaaaacaatgagagcgggggtggtgtgaatgtgtgtgggtgcaggggcacctcgggagcctggccgggaaggtggcatccgctgcaggcccaggtggggagatggtgggtgctgcttccaggcccaaggaagagaaaggcagaggccctgaggaagcacagagcttgagggagagggctggcgtcagctcagggaagcagggaggccaggcggggaggccaggtggtgtggggcctcatggaggctggggagtcatgaggatgtgggaggatgggggagctctggttgctcaggcagtggggagaggacagcaccatggtaacatgcacttgtgttcatgtcttggctgccccattgctgggcacgtgtaaaataggagaaatcttaaagcttgcagctctccatgtgaaaatgatctgtttgtttcttcttattactatcaatattaatattgatcctgtagtgctttcacacttaaattgttgagttcccagtcttgtctaataattatctcagcaattgcgataccattggctgaggttcatggaggttttcaggctaatgtcactgaatgatcggaaggactcactgctggcagtcacttgtgtgttttgtgtttttttttcctctgtctctcgccctccatttttctgcacggcattaagtcagccacattttagattgtgtgcttctgtcatcagaatatctggcatgctttcccctgaatagcaggcttgacatctttttctgatattttgtaccaaccgtactaagaggcttcttgttagctgttaattcatattttctgaggctgctaatatgcgtggtagagccattactgttgcatgttcaagataaaagccaaatctcagcttataccctgttctcccaggataaattcagagaaccactatgaagtctaatccatactgtgatgttgctgaaaagaaaatagggttataggcttatttggagcctttcactgtttatggttgtacaagttgggtgttactgacttataatgtaaaatctgaat

SEQ ID NO: 99295 - DNA, 1001 bp, Homo sapiens
gaagtgtgttgtccaagataggatttagtatcctggagccaggcttggaattctagtgtgggaaagcttacttactattactttattatggcattttaaaagtttttaaaagtaagtggaaaaaggatttttgaacctgttattactttcttatagcattttaaagccatttttttttcctagtgggaggcagaaggaaaaactcggtcatgtttcactcactcctttcttaaagggagagttttatattgtaccttcttgttcacagccaggtggcagctacattgctaattgcaagctttcagggtgagaaagagaacccgtgcctacctgccttttcctgatttgaaatggtgatctgcgttggtctcaagaccttgtgcagcctcgcagagattgctctgcacacatgtgattgcatctaatcaggactttttctgaaactgctgccaggaaaatgtgtgctaggaaggttaccttctgcagctggacttttatgatgcactggattatcatggccttagatataccatcagggcatggagtggcaacagtgctttgctgtcttgacgcatctcaggtagaggatctcttagggagctttctgattgaatcccacgcccattttgagggaagggaatgggccatgggtctcatccctgcctagcgctgccttgtgaggggtgctggcctgtcacctccagttcttgctcctttttaggaagccatgctgcctccttccttgttgtgcgattattttttgggttgtgtctattttggtatttttttctctttcacctcctctcccatatttcccctctagggtgggaggaaggagacccaggtgtgaggtggtgcaggtggctgcagtgtcctcagagatactgagctgtggggtagaggtagctggaatctagatcaactcacctctcttttatcagccatttgttctgagaagagaggcttcgaggagagacgcttcggtaaggggttgctgtggg

SEQ ID NO: 99296 - DNA, 1027 bp, Homo sapiens
gacttttttttttttttttttctgagatggagtctcgctctgtcacccagactggagtgcagtggtgcgatctcggctcactgcaacctctgcctcccgggttcaagcgattctcctgccttagcctccagagtagctgggattacagacatgcaccaccacgcctggctaatttttgtatttttagtaaagatggggtttcaccatattggccagattggtctcaaactcctgacctctggtgatctgcctgcctcggcctcccaaaatactgggattacaggcacataccaccacgctcaactaatttttgtattttagtagagacggggttttgccatgttggccaggctggtctcgaactcctgacctcaaatggtctgccctcctcagcctcccacagtgctgggattacaggcgtgagccaccatgcccggccatgagtcctttctactgtggggttggtcttatttccccttgctcccgtgagaagctgaatttgcaaatgccagggtgaacttggtaatggaggcaacaggcagatgcttggtgtctgtgcgttgaacagaaaagagcccggtgaaattccacgcctgtttgtgtttagcacacggttcctgaattatttcatgagaatgcaggtatagcggtgacagctacaatatttgttagccaagctgcggacagagggttggcctcaggctgctgtttctgccccagggtcgtgagaaatagctgtgtccattttaaagcaagaaaacaaatggcacgattgctctgctgttcctgtcctagggcagagagctaagtcaagcactcagtggactgcgtctcgtctcccttggactggtagtgacagggctgccctgcacgccacactgctctcctgttcctgtagtgtcgctcatgtaaaatgcactgcaggctggtgctgctgaatcggctcactttctcccatttccttctcctccactttcagatttctttcagcactctccaacttaccttcagaaatgcaacaatgggc

SEQ ID NO: 99297 - DNA, 1078 bp, Homo sapiens
tgggtggacaaaggttttctgtgtgactcacctctggccagaaatttagggaagcttatttgtaactaataccacccagtcactgcaggagacctgccgaagggctctggggaaagtgatcttcaaaaatagaaaggttgagtgaaggtaggacttttgggagaagcagaaggagcctataagacagcacattaatttggcaggtaattaggaactctgatcttgagcatctcattttaattagcgtggtccagcctgccttacggtgctcacgctgaagcagagagtggcctgcttagctgctccgcaccatttatttgggtttcttatttgggaagtttgcatgtgactgggccaagtgacatttgttttgaggtccctcccagggcccaggggtgagctcttgacaaccccagagtagagatggggcacctgtgcccgggcattgatttcctgggaaggaaagaaaacgccaggccatgctgctgtgttacagccctttaatcagaagcccctgctgcatgtgggcctgctgttcccagtgcctttcaggaaaccaccagaagggctccagctttagggaggatggtccatttacacgcctgtggttggaggttccaagtgccttgaaaaatgccttgatgccacttggagctgtttctttcttctctttcctttcccttttaaaatcacggaaccatttctttctttctttctttttttagacagagtttcgctcttgttgcccaggctggagtgcagtggcgcagtcttggctcactgcctcccaggttcaagcagttctcctgcctcagcctcccgtgtagctgggattacaggcgcctgccaccatgcctgactaatttttgtgtttttagtggagacaaggtttcaccatgttggccaggttggtctcaaactcctgaccttaggtgattcgcctgccttggcctcccaaattgccaggattacaggtgtgagccacggtgcctggccagaattgtttcttgagtttttcaaacaatgctttctctccagccagttcaattgtagagggtcctggagaggaggtggagca

SEQ ID NO: 99298 - DNA, 1628 bp, Homo sapiens
acaggggttgctgattcttctttccagatggatgtttctaaagtctttcttaaaggagccagaggcttgcccgccctgcagtgccatccttcttgccgctcccacccacttctgtgatgcacagaacctgccgccctgccctgtctctttgtgttcgttggtctccatttctagtgtctgagtaaaggcagtccccagtccagtctgcaaagcctggccacttgcacaggaagatgctcatagatggctggttcctgccagtgacacacgtggacctcaagcaggtggatgggtggagctcagggaataggcatgtggggcacactctccaggcacatccagggctggactggggccggcatgggggtcactggctgcaagcgaaggcagcttatgtcatgttccctctgccaccgccagctgtcctgcagcaggaagaggtagtcatgtttggaggccgggctgtgcatgagctatgcaggccttggggtcttttcatcagattccttttggcagaatataaggaagttggcccaaaccacatttttgaacttctgctttggccttgtcagtctccttctgtgattcagaccgtagtgaagccctggttggctgaagtgctcaggagaggagactttgggggtcatcactcatttctgagttacagaagttaaatagtgacttggttcggggtcatgccatgtgtgtgaggcctgagtttgcaggtttgtgcagggcattgattggttggttggttgattggctgaggaatatttggggcacctgctctgggccatgtacacaatgaggcaaagcaatacttagacctcaaaaacaaagcgatgtagacctatctgctgtgtccttgtgtttctgcctgtggggcacgtgggacatgtgagggagaaacagcatcctgcaggagagcaatgcctccagcttggcttctggaagcctccagaaggatggacgggggcactgagacctgaagaagggttgtgcatgtgggagggagccagcctggtggaccgtggcctgcacacctgcagcagctcctcagagctgccccctcatgccttggccaatcacagagcaccctttctgtccaggccactgatcagcccccaggtccaggtccaagaacaagcctgtgaccccctgggtcccctttgtccttggcctatacctgccttctgcattctggggctaccctttgctccagtggctacagaagagagaggagggacactgaccccaaggcccaggccagtctcgtccaggctgcccacacctaggtcttcaggatgggacaaggcagtcttgggggactttggggtgacacaaaccagagaagggcttcagcagagggccatgagtgcctaaccgtttacctgttttctgctctgaccaggcaccttgggggagggaaggcatcaggagccttctgctgagttcagtggaaggtggtcttcctttccaatactctggttccctctctcccctatgtgcaagtaaataacatgctactatatgtaaattaacacaaatgaatgtaagatagttatatgtgtctactgccttagaaagtacagtaagatgaatattaaacttttcagactgtaagatcg

SEQ ID NO: 99299 - DNA, 1055 bp, Homo sapiens
ttctgtgctttggagacctctgtgtgtctttcttggttttggtttccctgtctcccagcatctctgggagatatgtgtatgattgattccaagaataaagtgtgaccaggaaaaccatgttttgaaatctgacctctcaagcccttgaaaatactcagagcttttccagaatgttctcatgtctccatccacttcctttccctttctgctttaaccccgctaccctccagtcgtagccttcaggagaaataaaaagaccccagagaggccagcctactttcccccacactgagttccaggaagctgagtctggttttcccataggaacaatgttatgggatggggactgcattcctcacaaaggactctgcctcgaaatgtgcgattagaaagatgcacccgctttcagccgcagcaacttacaataatgccgttatgccctcagccataaacacattgtgcaaattgatttcttgaggagccccaaggtactgtgggtagaaggagagcacatacacatgtgagtgctgtgaaatcattaccatagcctcagacatgtctgttcttaataaggaaaaaaaaagttcattacacgtcattgaagatttttttttttagatagggtctcgctgtgtgtcctaggccggagtacggtggtgtgatctctgctcactgcagccttcgcctcccaggctcaagaaattctcccacctcagcctcctaggtagctgagactacaggcatgcgccactacacccgactaatattttgtattcgtgtgtgtgtaggtggggtcttgccatgttgcccaggctggtcttgaactcctgggcttaagtgatcctcgcacctcagcttcccaaagtgctgggattataggcctgagctgccaccacagttggcttgaagattttttagaaacttgccagcttagtctttataaaaatacgatgaaggggtgatttgggtgtcccaagactgtttggaaggttgttctgacaagcaagtgctgatgttttgtacttgatcggcttctctgtggcaagccagaggcg

SEQ ID NO: 99300 - DNA, 1558 bp, Homo sapiens
cctcgcctgtgctctctatgtgaacacagagtttctgcttcactgtgggatgaggaggcttcagtgaattgtccacagacctagtcgctgtttccaatgttatttccttagggaagagtatctccaattttaaactgcccacaaacaaatgacgtttaggaaaccttgtaggtcaggagctgctggggtctgcgggtaagaacaggagggcttcctaagctcttccactgatttagggggcgaggttgggaggggtttcctgacatggtagaatttttctttattcctactcgttggttcaggtgtgtaattattaacagttacaccctttatctcctgcttcctctggctgctgacttggagggatgctgggagaaggggagggctgaagagttggggatgggtgtgcctggcttccttctaaggtttagggctgaccctggacagtcccagccccaggcaagtgttcttgaggcttattgctgtctgcctagctggggaggatgttgagaggattacttagctaattcagtatttggaaaaagtatctgtaaacttaaatagaggcccattacataccttttgtggattagaactgtaattgacttagtgtttaaggcagaaactaaggcctttgatttaaaaactgttgacagatcggagcctaagccgcttctgtttgcagaggagagccatgacttccagtcaagttgaaacatagctttctttatacccttcccagttggacttctgtcatattttacaaaattcaaggcttttcatttaacttagatttatggcttttccatggactatcttgaggtttttctccaaagcaaaccagctcataccttgacattgtcaaaatagcaaaaacacacatcttaacaaatgatggcaaaatatttgagctgagagattggggtatgtgtagtgttacacctttgcatgtaaaagattatgtcaagcaatcttctaaaggaaatcagtttttagttaacttttaaggctattcaccatgatttaaagtgattccttgattcctctgttacattaagtgtgattgaaactgtacctttattttctcatgccttgataagcagtgtagtcaaatcataacatattatgactgcaatcaagtgattatagcacgtgattatactttttgtctctgtggcgtgaggagtggaaaggtgtctttttttgcaccacttggcactaacggtggggagagatggttccccgaagccccctccctcttgtgtgttttggggcagagcgccctgttcctgaatagcacggattgcacgtgtttctgagcatggtgtgtgagactgctttcccttcctgcagtcaactcgccaaggtgcctccccagccccagcagtccggcttctctcctttccgctgccccatgctttctggtggcctggcagactcaggactatctctgagtccttcacaaaaccctcctccacatgccttcttttgtgaaaaccctcagtcctctttaagagcagggcccctggagccagacagctctggttcagtcctggct

SEQ ID NO: 99301 - DNA, 1050 bp, Homo sapiens
ccctgagaagctacctgagctctgctaatcagccccactttcctctgcccaggcagaaactaagatgcctcggctccttctgtggaggaaagtaatgtgttaattggatccagggtcctcagcacacactgggctatttttacagtcagacaggaagttgtcgttttataactttatcctgtgtaaattatagcccgggcggggggtggggggacttggattgttaagaaagtgatcatcctgttcttggatagggtgattttggctgtctgggtaagttctaggaatttgctgtattctcttgattctaatgaactttgctatggcttgggaaggggcctctgcatggagagagagaaggaagctagcgtttcttgagggtctggtatatgctaggcactgtgctggctgctgaattggactgtttgatttaatccttgtcacaacccctttgaagtggtcttgttaccctcttttacaaatggggacattgtggctccagcaggttaagaagcttgctccaggttacatggctatcagtgggaagctgggtggggggtgtggacaggtctgtgattcccagacccatcctcagatgcctcctggagcctctttgtgggagagtgcatgtgtcatggcgagtatgtggctctgcgattggaggaaatgtcaccggaccagtcaataggtcttcctctttacaattagcttttgtcaatgtacgttttttctttagtccacacaaccttttaaaatttatttatgatcgtagccctggcctttatccatcgaatcctaaagtgatctggctgctcatgaccaggggtgacagccaggatgcttttcttggaccaagaaacctggcttaaatgacagccttgagccttgctttggagcagtcagactctctggggatactgttactattagtgagcattatttgctgcagaaattgattccttctgccgtacagtaggccagggaggcctccaggtgccttcggtgggggaaggattttagttgctcaggccaaataaccgagactagctc

SEQ ID NO: 99302 - DNA, 1049 bp, Homo sapiens
attttcatattaaaggcaactcacctgggatatggcttgctgaaagggaagaggcagacgctgtagtatatagtcagtgctcaatgaagggaaaggggcttcacttccccaacagagtggccctccaaaagggtctcactttgtagcccaggctggtctcaaactcctaggctcaaatggtcctccaatcttggcctcccaaagtgctgggactacaggcgtttgccaccacatccagctgctgctccatctttaaagttgtcttgcccacactttgtgtgtgtgtgtgtgtgtgtgtgtgtatacatatatatgtatacacacacacacacacacacacacacactttttttttttttttttgaagcagctcgtctttattgaaacttcttaaaacatccaacctgattttcaaagctcacagctctgctcctggctttgggggcttagcctctaatttgggtctgaactttattgagctttgcttggcaaatgcaatgaagaaagtgttaccaggtggcattactgagagcccttgagggtggggggagattgcgtgccgtgccctgtgtgtgtgtcagctgactcttgacccccgcttgcagctcagcatggctgtgtgacttaggactttctagatgcacataatttcaggagtggtatttgagtgcatttggcaccaggcatggggtggctgagccccatcagtggcacctcactgttgctgtgcactggtggggtagttcttcaggcagtgggggtgatatccatcagcaggttccaccactgggcaccaccacccttcccccgcaggtgctcctctgtcctctagatgtcctgcctcctgcgtcctttgcaccataccccacaggtcctgccacccctgctcatcatctctcttgctgttttcatctctgaagtccctcctataggggcttcctgcccacttctctgcacctgggcttctgccccagctaaaatctcacctctccagaaaatagtggccaacttccccatcaccttggctagaagtcacccctccatttgga

SEQ ID NO: 99303 - DNA, 1060 bp, Homo sapiens
agttagaaggaagcgtatggaagaaagtgtggcaacaacactgctgacactggaggacagaattctggtctctgcaaacggcatgagtgcgccccatgagtgcgccccatcaccagcaggtgggcttggcaggtgtgccccggctcatctggagagtcaggtcaggggtggctggtcaggatagctgttaccacatggaatgtgcattcctaaatccaaatgcttgcctcaccccagtgctgagcctggccagctgagaggctggagaccccgtgtattcatggctggggctggctcctggcagagcctcccagcgggttggcattctgttcagctttcccctgctgtcgcacaacctttttattgacccctcccttcctgtgttggccaggagcccactggcttcaccagaccctgactgttagctggtcagggaggcagggcctgggtgccttggggcctgtcctatctgaggtccacagcctgcagggacatcacctaaaagttgtcatcagcttcattagcagcactcaggcccagctgggcattcagctgtgactgcattctggcacctgaagcatctgggcctggacggactctttcaggttgtttggataatcatcctaaaaacgcctctgagatccacccccactcctgccatcaggcattaaaatcttccgaacagaaaagctgaaaatgttcccttaccttaagggaaaggcctcaatggattgatttaattgtatgtgtgaagcattttttcttctttgctaaatgcataaactgtataacgaaatgtaattagtgaaggtgcattatctgataaagtaaatctcagccactgggaagagccctttttggcagtgtagtttctcttttaatagctgtgatcagattatacctttaaatctctttaaacacttcccaccactgaagtctttggtttccttgatttgatagtttttaccaggctgttcaaaaagtcaagcagtgttcttttaggtcctttttggttctgtgcgacagttaatgaatagtcatgtgcatttgacccctaaaa

SEQ ID NO: 99304 - DNA, 1588 bp, Homo sapiens
gggtgtgaagggcagaaaggtggggccatctggacccatcatgggacaattctaatggcctctccattgctccctgttgggttggcgagatggcctcaggtttgcctggcagttcagcctctctctggccagttctgcttcttcccctccttccacaggtatccatcttccctccataccccaaatgccaaactctacctctgcatcttcaccaagaaaagcatttctgttgtcctgaaatatcaggccttcctgaacccccttgtacctctgtccagtggaagtagaatgccagccacatacgtcatttaaagttttctactagctacattagaaaaaataaaagaaacagatgaaattaattttaataaactgtttaatccaacatatccaaaatattatcctttcattgcaattatctggaatttgtggacgaggtttgctataatcctgtttggtactgatgctttgggtggtgctgtgtaatgttcattcatcgcacatttcaattcggccacattttagtgctcagtagcacctgtggctggagctactgtattgggcaccacggccttagggttttgattaaaaccccattctcttgaccttctgcccaaagcctttgccagatgagacactgcctctcgctgaatgcctgcttggagcagagtcctgtgtttgtttggaaatgatcggaagctcctgtgtccctggtcgcttgctggagtcggtgggagctgagagtcccttgctgcccggagcatggctgtgtggctgcctgactacatggttcttcccccggttatttttgtttgggcagttaactctgagcattcggaacattcgccgagtggaacgtgtgtgtcgtcatcccctcgaaggcttggctgattgagccagtaaacaaaaagtgcattcaacacaggcttgtctgctggcctcccccgggagagagagtaggtttgctattcctgaaatgtaatccctccttcagcgctgcacaaaaggcccatgtctgctcgctgggacctgatagttcgcctttgtacggatgaaaaaaaccaaacactgagcctggtctgagcggggctgtttgttgaggctcctgatgcagacaagggagcagtgtctgcacagggggtctggatcgcacccgacaccatccaggtgcctgcgtgtgctggtcccgccatcaggacttcccctcgtgaggagctgggtaccactgttatcctgcctgctggtctgagggtccgagcgtgattgggagcagagacaagagttccagggcgagcctcagttctgggaccaccattgaccagtagagctataaaggacttggccaccaaggttggagctgagccccccatgtcatgaaactgccactgtcagagccagcctgagctccacggtgcccgtctcctacctgcactgtgcccccacacctttgttgacaaggacctgacctctcctcaaactacaacctaagaaccacaatgcctgttccccttacctgcccccaggtgtcctgggagaagtcagtgacatgattaagacctttaaaaatgatggtaagcatgtgccagtg

SEQ ID NO: 99305 - DNA, 2017 bp, Homo sapiens
aaacccggtgaatcctgcatggatttgcaaaccaaactacatggagaaatcagttaaattctcaggtttcagggttgcagctgccactgagaagtgtatttaggcaggttctggcaacagacttggtgttgggcttgagtgggaaggggatttaggagcttcatgagcgagtcaaatgcaagttggggaagtggctgaaaaaaatgcctcctggaaaaagcagtaaatgtaaggatttaggtcggccattgtctccgtgtaagtcaacactaccttgtgtgtgtgcgcatacacacaaagagggtgagccctcagcccgccatacgggcatgttatccagaagagaggagagagaagcccgctgcactctccactgaccagaccacccactttgccctctgcacgctcactccacgaaggatgcaggtgggcacactgctacaaccccctgggtgtgtgtggagttgggaaagagacggatgttgagcctgaagaggctgtgacctccccaaatactcggactcccctgtggaaggcaaggtggaggcagctgttatgtggtgtgttggattcacagcagtcaaggctgccacgagcaagtattttgagtgctccttatgtccatgcagaggctgactccagaggatgctgtgcacaggcctgtgtgacctgaaggcccttgcaggctgaggtctcttggtgataatccacacactgtcctgggccttggttttgcagcatttccaacttgggttgtcagagtgagactgtgcaggactgccccgtacagtacggcttctatgtgtgaacaacacagaccactaagagatgtgacaaagctgttccatcagaggaaacatagtctgggggacaaatcctcccattcctgataggacaggagggagcggttggctggggaagacctgagtgagggagctttcttgaggacgggttttgtcggagtgtagttcatataccatgcacagcctgtcagcatacagcttgaatgaactcacgtgtgtaaccagatcaagaggcagaatattactagggtggcagttttgagtcccatgaaaacaaacacatttactctgtctagctccatctctagttaattctagtgcagtttaaatgctcacaaaatccttatttgaatggatgagtcagtggtttgaattgaatagtttttgagccatttgtatggagaaggtattacccaaacagaaacatggtggtgataatagactcacgttgatttcacttgttaactgagcaaacacctcttgtctcctcattctgtgcagagcattctgggtggaaaagtcggaccaagtttctgaggggaggacggaggagtcctgtcttttaagcagatggagctgcaaacagccagagagtgacagagattgagaggcagcagctgtcttttcagttgcgcatcctccttgtagtaaccataggtgggaggctgggattccgagctcagggcagcgggatgctcaccatgtgctgggtgctgtttgaaggaccggaaatgcatcattttgtttaagtctcccaacaggccgggtgcggtggctcatgcctgtaattccagaactttgggaggctgaggtgggcggatcacttgaggtcaggagtttgcaactagcctggccaacatggtgaaaccccatctctactgaaaatacttaaaaaattagccgggcattgtggcaggcacctgtaatcccagctactctggaggctgaggcaggagaattgcttgaacactggaggtggaggttgcagtgagctgagatagccccatttcactccagtctgggcaacaagagcaaaactccgccttaaaaaaaaaaaaagtcacaacaacctgtttcacttaagtacgggcttaagaggccagtgtgagggtcaggagctaacactcagccccacaggggtctccaggtcctgctgctccttccacgcctgcccggtccctgcagcttcccatgaacggaagggaagtcatctg

SEQ ID NO: 99306 - DNA, 1032 bp, Homo sapiens
ccccgtctctactaaaaatacaaaaatcagtcgggcatggtggcacatgcctgtagtcccagctactcgggagactgaggcgggagaattgcttgaacccgagaggtggaggttgcagtgaaccgagattgtaccactgcactcagcctgggtgacagagtgagactccgtctcaaaaaaaaaaaaaaatgcacatttgcatcagtgatttcattctgccagtgttaaatgaaaattgttacagggaagttagttctcaggatccattggggataaaataccagaacaaagggaaggctagggtttcttctcctccacttctctacactcaaccacccttcccatttctttaatgccaacgcaccgtcaccttcctcacccttgatgctgagacattcaagaccccttagaacccaggactcccggtggctgctacaccctggtcatatctggcctctcacacttaacccctccaaatagtaaaatctggataaaaaaaaattgggttttcaaagagctgttaacagtcttctgtagctgagtttttaagaaattataccatattcattttgactcctaattcctttttggaaaaatttctgaattttgttaaattcacggagtaacacaaatggttatctttctgttcctttaaaatctatctttgatttggagattactagggtaaattatagatcaagaatatcatacatgtcattattcactgaaatttgcagtcagctctgtagacaccattctgcctcctttacccagcacgttggggattgtgattactgacgagacctttaaagaatcttccggctgggaaaggtcccgagtggcctgctttcctggcttatttgagaattttgcctggcccctaggtttctcagcagtctgtatttcccactgttcgttgtgctcgtgctgagttgttttcctatcgaaatacaactgtgttttattgaccttgaatagctctgccagatttcacaggtgctccttgctctgggaggccctgaaatgcccttt

SEQ ID NO: 99307 - DNA, 1064 bp, Homo sapiens
caagaccctgtctcaaaaggaaaaagaagagaaggaaaaaaaatcaatcaaattctaaggtgaatttgagagtatacataagtttaatgaagatttttatttagtaataatcataggtgcacatgtagtaaggatagttttcaagcggtgttaaggaagtggagattgagatgttaaatagcatctgataggcgtttgcttttcaaatagacttagtacttcagcttcttactctagagacagaatacagttcttacatggcttttaagatgctgcccccttctggtgactaggaagattataatatctgtagcaaataggcattctggggttttttttttttcatatttaaatattagttttattactgaacctgaaaaacaaaatgaggatcagaggtagcgtctcctcctctgtactctcctttcttccttgagaggaggaataactttctgtctcttgctgttctttgtaaatgagtttccttttggctttctttcttctgtccttccttcctctgatgggtagagcatctctgtgggccaggtactgtgttcagcatttcatgagatttatcaattttaaagaagaattgacaatatgatgcggagttttccagattgctgtttgttttgagagggagtcttgctctgttacccaggctggtgtgcagtgatgtgatctcggctcgctgcaacctccatcttccgggttcaagcaattctgccttggcgtcccaagtagcagggattacagatgcatgccaccacacccagctaaattttttgtatttttagtagggatggggtctcaccatgttgaccaggctggtcttggactcctggcctcaagtgatccacctgcctcggcctcccagagtgctgggattacaggcgtgagccactgcgcccggcccagattgctgtttttttttttttttttttttttatgatgtaaaagtatcaacatattttttaaagaaagtttcatctgctgctatctagaggaggtagctggaaccagagcaccaggctggcactggcaaggaggagagggcacctccc

SEQ ID NO: 99308 - DNA, 1042 bp, Homo sapiens
tggccagcatggtcttgatgcctggaaacagctcctgggcttctcaccagtattgggagctgactcttagaaaggcagccttcctggggagcacaccctcgaggggccggaaaccgtgaaactgaccagaagcacataggtccagtgggcactgaaatacattctcaggaaggaagtgtagctgaagtccagaactcagcttactctcactcctgggcctgctgctgccttaatgtgcctgctcctgtgtttttgttctgataaacacgtatagcactttcaattatgctgttacttacagctaagtaaagcagtactaggtggatttgtcagtgccacttcctacaaagtgaaggctggatttttgggggactcatttccagcagccaccagcaggtggagggagtgagatgcgtaaacaaactgtccctcatgcttggtgtttgggcagatgcattgctaaagcgtgctcactaataaatcccctgctgatatggcacaaatatttatagccgatgattgatgtgaaattaacaaaaactagcagttgacagcgatatgaggtggcaaaggctatttgggaaagtttccgttgtctttgaaaattaagaaaaattatacgtttacttgccttgctaagaactgtttaagaataaatcaacataaactagggcagcttcttaaactatgatggagaagcacaaggtcaaagtgtttcgtctcagaatgaagcagtaatgtattactttgcgtactgtgtacaggggccggcagatgtttctgatgttatgaagctatgctcctggaagtggttgtgaaaatcgcagccctgtgaattgtgtgccctaagagccagctgtgctcctaacagtgatgccgtctttccatggaaatcacccataagcacagccttcagtctaacttcatgtcaagtctaagtggcacagctatccatgaacactgtaaacattcccagctccatctaaggtgattaaacggagtcagaacccggccatggatgtgtattcactgttatttaaca

SEQ ID NO: 99309 - DNA, 1243 bp, Homo sapiens
ttatttagaagtttggtgatgtttttgtgaccagaaataagccataggagcttaactcttgtttatatcaaattaccctatgggaaacttggttgcattgtatgtcgtttcgtttaaagttgctgtttccaggaacctattggtgatgtgaagtgaggacttactggatgacgtgaaactaattttaactttcttttactcatcatcctgggattattcaagtataaactcagaattgccaaattaaatgcaaagatatgaaaaggagccgcttatgctaaatgtacagatgatgcgtttttgctgtaacggagtcgtccctccgggtgctgactgtgccactcagcatggtggcccagggctgtgtgtttggtgcacagtgggacgtcttagtcccactacctcagccagactcctggcaaagtctttattttttaagataatttatttttagattttattcaaaatgaaaacccatttaaaaagcacatgagaaatgagttctttattcactcatctaaatatttagggctgtggatgggctcagctgctttaaatatttggctgggcagatgagtgggagcctgtcttcctcttgttgacatttgcgtctgtggtggtgtacacagatgagctcactgctgtcctcggagcaggtaggaatgtatttatttactcgcatgccttcagatgcttgcagtaagtccatttgagatgctgcttctatttttccttgtggagaacttacttgacgccaacaaagaaatttctagctgcttgtagaagacaccccagggtacgcagccagtcccttccacgaatgctgcgagaacccacacagctgttcatttcggtggccgagggcctgtgggctgcagtacgtttacactgtgtgttgggggggtggcagtgtgctttcttcctgccccaattttgcccaggaggagtctggtgatggagaaggtgtggcgggcagcaaggaggctggggaagtggatgctgcagggtgagctctgggcgacccaggaggaagtatttgcatgaattagccacacgcagagggcagttatgtgtgatgtgggaaatgactgcaaagctatcttactctttattccatagccacaaaaataagtttataaaaagcccccaccaagtcaggatttgtccagaatggtcactctgctttggagaactgcggatcccctgccatggcccatgtggctccggaagttcctgggagtgg

SEQ ID NO: 99310 - DNA, 1023 bp, Homo sapiens
ctggcccatcggacacacttcttactgatatggtttggctgtgtccccacccaaatctcatcttgaattatagctcccataattcccacgtgttgtgggagggacccagtgggggataattgaatcatgagggtggtttcccccatactgttctgatggtagtgaataagcctcctgagagctggtggtttcataaggggaaaccccttttgctcggctctcgtctctctcttgcctgccgccatgtaagatgtgcctttcaccttctgccatgattgtgaggcctccccagccacttggaactgtgagtccattaaacctctttttgtttataaattacccagcctagggtatgcctttatcagcagcatgaaaaacgaactaaggcacctactgtatttgttttcttgtctgtgcaccactgcggaactgtgagctcccagagtgcacagatatgtgccagacaccaagatcagaatgggtgcttcgcagtgctcaatacattatttattgaatgacttaatgtagaatgactagttacacagttcaggtgctaggaggcagtataaaagtcagagagcaaatgctttaagaaactgtagtatacaccaggaaatgcaattctttagttagataccttctcctttcagtaaaattatgttcagtgctgtaaataggcaactttcagtgatttgtttttcaaacaagtggctttttatcttttcctcttgacagtgagtgtctctccatgtgtgaagtattttctcctctcatatctgtgaagtcctgcttgtaagtgtttcggttatgcaacatttcatggggaatttgagcactggaattcttggtcgctagttaggtgggtcttaccgcatttgtcagaaaggaatgcgtccatcaggttggttgacgggttggttgacggtctgcaagttgcagtcttggcacaggcacccatcaaaatgacacacggtgactctggtttcttccagcatccccgagatgaagatgaaaaactgttgc

SEQ ID NO: 99311 - DNA, 1114 bp, Homo sapiens
tatattcatgcaatctcacagttatgtggaaatctagctattatacagaattattagtctacctttagggctccccacagcaacaagcaaactcacagagcccagggcaggaggagctgttctgacttcaggcggccttgccaggagcccgttggcctgggtggagcccgttggcctgggtgtccactgtcagaggatggagattgatctggggttacctttttcagcctttgctttgtttgtcacctgaaggggctggatcctgagccctgtaaggcccccttcggctggtgcacacaagaggacagctttgagcctccaccaaggtctctggattccactttaagtgcgggcttgggtgtgggaagctgcaggccagcctcgagggcagcctcctggaggtggaagggcagcggggcgcgagactgctgcgctggtgggatgcttggattcccaggccccaagtcactatcggggaacgttctttgaggtttaatagtattttaggattttttaaaggatagataatatctagatgttgtgttctaccaaaacaaatattgttcttttggaaatatgttagaccaaaaaaatgcatctagatcttcgagttttgacttggaagtgcctcaagtgagcgagtgcctgctgtctcagacatgaggtggatgctgaagagattacccctgacttcatagtctgcctgtctcagagcgtgggcgggttggcatcgtctgcacgttgaccgggtcgtttttagctttgcccacttttcatttttggcttcacagagtgatgcctctggagcatccccttgcggagcctcagcatctcttctctgcttggcccacgtctagcagttcttcttcatcttgcagggaaagtgtgttggcaaacatgctggatactgtcagaatcagagcaggctggatccatggccgtattctgtaaaattccattgtgtctttttttcccccaagtaatctggctctgggaggaaactcgctgattggagactagctgagagggcttggctgggattctgtgggatggggccttcaggaggtggagccgccccaggccatggagacctggagatgctcagggaaggggg

SEQ ID NO: 99312 - DNA, 1020 bp, Homo sapiens
ctcttcattctccttaaggagatagaggccagggaaagtgtttttaggtaaataataacgccttcttgcctctctccctttatctccccattctccctgaaaaaactacaagaaatggtaaggaagagaataaaagaggaaaataaatcacagataactagaaccactttattgctattattccaggtgatctactgataaattaaaagaaagatgaatataagctggtaattactttaaaatattcctttgtgaatgtgcctaattggcgcgggcctccctgtagaatgaggctcctcctgcagttcgaggagaggctgtaattaacagtgaattagcatatagtggcgccgtgtggcccgcagggtggccttgtccatctgctgtgtaggggacttaggtgacacctggctagtggtagtctgcaagaaccctttgttaatgggaatattgtgcatgagtcagaattcagaatctttggtatggttttttttttttcccccttttgtgtgttttggccaaatactcaaaagcactaagttttcttgcgtggtatctgttcatatattgattcaccaaatattgattgtacatctgcgaatgtgctagataccctactggtgctggtgagcagaaacaggcaaggtctttggcctcagggggtccttggagtctagaagggatggtgacattggccagagtcaccccataatcatacagttagcagtgtggccagcgtcacttaaagcggggaggtggctggtgctggagcgtgtataacaaaagtgggatccggaaagggctgctggcgagtgggagttttctagggagccgctgctcttgcttcaggtctcagatggcataggagtgtgtgtcatcccagaggagcagcagcaaacggcctgtgatgggctggatgtatttggggagggaagaaggcagttgtagctcaagggagagaaaaggcaaggagaaacatggcgaggggtgggggctttgctctttagcccgtgagcagtg

SEQ ID NO: 99313 - DNA, 2074 bp, Homo sapiens
agtggttttcctggcggtgtggttttttaaaatttctaataaaatgcaaatgattacagccccttccatgaagagtgcaagtacgcctgactcctccgcgcagggaatgagcagcctctgctccttcatttgattgctatgacaacccacagaggtgggtgttgtcacttccactgccagccagcttgcacggtccagggacgtccccaccctcggttgggttgtccagggtcacatggttgggagtcagaaccagacttcaaagggcatgtgactacagcatccatcctccctgctctgcctcgcactgccttctaatgggtcccactgaggagcttgccagtattgttacaattggagtgatctcatatgaccaaaagttggaatgatcccattctttactcacagcctgagctattttttttcaaagcattatctctctactgtttgtaggcagagaatttattaaatcttgcctaaatttatccgtaagcatggatcaaatgcacatttggcatgattctcatctctgagccattgcaacctattttttaatgccaagagaaagtattttaaggaagtggggtcagctttcctctgctcccctgacttcacaggatagctatgcattttgcctcttggggagctgggttattgtgaaactaggtcaaattattgttttttctctttatgctcatagccattccaaagacagaatcctttcctcaaaaaatgaatttttgagtgttcctatattcttggggatgaacttcaagggcagaaaataaatgaaaggggattactttgacagcatctgaacaacagaacaccttctgaacagcacaaacacttgtagcaaaattaaaagaccaacaaaaatatgtattacatatagagcattgtcttctatatgtaaagagttcttataaaacaataagaaaaatatttcctaactaaaggaaatggacacaaaattcataaaagaagaaacaaaggagcaattaagatataaatatatttggctttgttgattaaagagtaacaattaaaatgacaggtgacttctgggccggatgcagtggctcaagcctgtaatcctagcactttgggaggtagaggcaggcatatcacaaggtgaagagatcaagaccatcctggccaacatggtgaaaccctatctctactaaaaatacagaaattagctgggtgtggtgacgtgcacctgtagtcccagctactggggaggctgaggcaggagaatcacttgaacccaggaggcggaggttgcagtgagccaagagtgcgccactctactccagcctggtgacagagtgagactccatctcaaaaaaaaaaaaaaggtgacctctttcttttcatctggttaagttcagtgttaaaaacaaaggcccagtgttggtgaaggtgatggaaaatagttccccttttacattttagtgggaaaaatgtaaattgagatagccatctggagagaaatttgtcaaacagtaataaaaaccctaacaatgtatttgacctctgacctggcaatttcatttctgcctatcttcttttaaccctagattgattaaactcgttaaataaaacacatttgtgggtatagaaaacttcataggtttctggcttcctgccccacctgtggtttcattctgcccagttgtgttcaacttgaaaacgcttggtgcctagcacagagtagacccttaataaatgtttctgtcctgaacagatttaaaaacaaatagtgaaaacaaaattctgaacgtatgattttaaaaatcattttgtagcctaacacttaggaaacgtacttttttgttgcttcgctgaagtgaggaggggtgtatcttgtaatttttaaatgccattattaacttccctagggatgcttgtaaaatgaacaaacgtgcatctttaaattttttttattttttttttttaagcttggaaagagttgaaaagtcaaagtcacatcagctctctagggattgggctgggctcacattttatgaatttgctgtaaagaagggaaacatttgctttcacttttggc

SEQ ID NO: 99314 - DNA, 1049 bp, Homo sapiens
gggctgaagtgggggagctgggattcaatcctggggctgaagtaggggagctgggattcaatcctggggctgaagtgggggagctgggattcaaacctggggctgaagtaggggagctgggattcaatcctggggctgaagtgggggagctgggattcaaacctggggctgaagtgggggagctggtcaatcctggggctgctggagcctaggatctagagtgcagtctctggcctggaggagagaagaggctccctgcagatgcagctcttttccccatgtccacccctttaatttcatgagcatcctgggctggctgcactagaaggggacaagattgccaagaggcggccagctgctggagatcagcaacaccagcttcggcgcccgaattgctgcacattgtcccagcagctcaagtgtctacctcctctgatagcacaggtgtctgggcaattctgcattgcaacaagggccctgttctacttttttctgcaaggtttgtccagagtgcgcagccagactatatgctgggcttggttttcctgagccttggccactgctggcgccccgatcccgggccagttgttcttggtggcatggctgtcccaaggagacacatgttactgtctctgtagctgcctgtgcctccaggtgtggtgctgccttcctgggcctctgcagcacctgccctcggcccccagggaccttctttgtcacagctgaagccctcgcatgctggagacttgtcattcttctcctgccgggcatggatgctgacaatagaactactttccagaaatcagcaaatgctgggctgtgccttcaaagtatatccaggatgcagtggcttcctgagccacctcagccattagcaccctggtcccgggcagcagcgttgcttggcggattactgctcacctcttcaagccgatgctgctactctcctggacagtccacttgcccagcagccaggggcatccctgagaagccgggtcagagtgtgatgccctctgccaaaacctcctcctggccctcgccttctgcca

SEQ ID NO: 99315 - DNA, 1078 bp, Homo sapiens
gcctcgttgtgtaaatatcggcaaaccatgttttggggatggaaaattagttaatttggagatggtgggttattagacttcacttggtctgcacgtggtggctttgggatttgctgcttcaaggtttcaggatgacacaagccatcgggttgagtgtgtttgtttcagcccctcttgctgagcacttctctcttcctgttcctgtgctgctgggccttcacagcatggtgctcccaagctagttgctgaagctgtgggccattgagccagcctggagatgcatggtaggttagggtgctgtgttgcaggtctgtgatgcagttgccatatattttttgacttttggatcttcactcctcccctcattttggacattttctcagaatgaatgatacatctctgctttcagcctccctaagccattaatttacatgtcagatttttttgagtattgtagtttttttcaatatttatggaatgcttagtatttgtaatgcaacaaaaggtcagaattaataaggtgtagtgcccaagaggaatattttgtttccattttcaagatgattccaatttgagctgtctcctggagaagttggatccatttgtgtttctgagtgtgcttgtaagcagtcttaggggatctgtcactgcttactactaacagaagaacaccaaaataaggccaacctgctcccaggctgaatccaggagagccagtggccaaatatcagctctgcagccaccgttgcaagtgagactttgtgaaaggaaacttctcaccattaaatgtacattttatcttaaccgttgaatgtacaggatggttcaaatactaaaaactggagaaaagaccatgatggatgtcatttctccctgatgggacattttaccatatttgctttctctgtatgttgtgcgtgttggtgtttatggaagaaacacctacagatacagtggaagtccccttgcccccttctctgttctgttgaagatggtctgtctttcccatctggatctctttcctccgctacttctgtgtccttagacagtagatggtgctctgtgtgcatgaggggaa

SEQ ID NO: 99316 - DNA, 1052 bp, Homo sapiens
atgggagggaggaagaggttcccttaggagcatgaacttaggaaaggaaatggtgcgtttggtggaaaagaaggggggcataggctgaattgggacagtgcccttgactgacacagggagagggtctgagccccccatgcacttactgggcaggcttccccccgaagcaaggtggacctgcttccagtgggaggagaagggggagcactagagccctccgtgagaccattgactgcactggggtagttcagtggtgagcggatggggagaaggcagggccagcccccagcacacgtcaggcactgtctgggcacctgtgcattgctgcctacagtcctttcagagactcggcaactcagcgagagtccctcacttgcctgtgagctgctccacttggtggaggagctgctggggcagaggatactgagcctgaccactgccctgtgcttgttcctgtccccatggaggagcactggacttgtccaggggcacctagcagggatccagggacccaggcagggccggaaaggggatgttctttgcatggatttctgggaatgtacttggcagaagggaagcctgggagtgagctccaggcagaagaacaagcaggtggaagtgcccggttctggaagagcccagggtatctttgggggaagatggagacaagatttggtgggtccttgaatgctctggaaagaagggggagccattgcccacctcttttttttttccataggttattggggaacaggtggtgtttggttacatgaataagttctttagtgatgacttgtagagattctggtgcacccatcacccaagcagtgtacactgcaccctatttgtagtcttttatcccctgcttcccctcccatccttccccccaagtccccgaagtccatgtatcattctttttttgtttgtttgtttgttttttgactccgttacccaggctggagtgcagtgctgtgatcttggctcactgcaacctctgcctctcgggttcaagcaattctcctgccttagcctcccgagtagctgggattaca

SEQ ID NO: 99317 - DNA, 1020 bp, Homo sapiens
gggccgggcgcagtggctcatacctgtaatcccagcactttggaaggccagggcagggggattgcttgagcccaagagtttaagaccagccctggcaacatagtaagaccctatctctacaataaatgtaaaaaaaaaaaaaaatagctggacgtggtggcgtgtacttgtagtcccagcccctctggaggatcccttgagccaggaggtcaagactgcagtgagccatgatcatactactgcactccagcctgggtgactgagggagaccctgtctcaaaaaaaaaaaaaaaaaaaagaaagaacagaaatcaccattgataatgtggcatgaatagacttcatgacagacattactccagagatttttatgatgctttattaattaaagtatcatcttcaaagcagatgttaaccacttcatcactgtatacaaaatgtctgattacatttaatttttttttccagcaggatggaaatgcattaagatgaaactttaaaaatataggactgtagaaagattttgtgccaaattaaacatatactgaaacaaataagttgttttttgaaaacccagggagctatcacacgattgttaatattttagtggaattcctcctaaacgtctttctgtacttttttttttgagacaaagtcttgctctgttgcccaggctggagtgcaatggcactatctcagctcactgcaacctctgcttcccgggttcatccaattctgcctcaacctcccgagtagttgggattacaggtgtgcaccaccaagcccagctaatttttgtatttttaatagagacagggtttcaccatgttgatcaggctggtctcgaactcctgacctcaggtgatccacctgcctcggcctcccaaagtgctgggattacaggcgtgagccaccatgcccggcccctgtacattgtttttttaaagatgtttgagatagggtttgtagccttattaacacattagcatttttccgtgtcgtgttgtaatattgcacatc

SEQ ID NO: 99318 - DNA, 1047 bp, Homo sapiens
tatgaacacgagtgacagccagccgcagcccgatcaaaacaaagagccgctgcacgagaggggcagattgcggaagcatattgtgaacacattctctggtaactgtgaatcgtgtcgtaaaacgcgtctttggcctgtcaaaaatattttgacagggcccacagtctagctccttcatatgcaaatgcactggtaatgcctggataccagggttacacactcagggaaaatccacaggacgagggctgatgttagcagggttcattacttctgcaaataaacacgttgaagagcctccttccagtgggtaaatggcaaactcgataactggaatgctgtcagatcccagggtaacaaaagggtggtgtcccctaaaggcttggaaggattgagttaggagagttcaactgaaaagtcaagcatggcgcaaggaaggacgatggattagccaaccatgaccggccaggctgtgcgagctagccaaggagaggccacgaggcgggagagccaaggaggacagcctccgggtgggccatcactgctggtagagagggtttctgggtcccaggaccggactgcgtggtcctggttatacctgctggtcaaaggtcagtctgccaaggcccctccttgtgaagatggacactgagggcacccttcctagaggacctatttcctcttggtgctcttctgctttttgcttcttccctgggcttgctttccgtgtgattctgggcaagttggttaacctctctgtgcttaggtgaccttcgatggcacgggggatagcagtatctgcttcacatggtcagaaaattctgtgaggtgacacacggagccttggagctgcctgtggcaggtggcggtgctaattaagttccggctgttgtgacggtctcctcggctgggtggcccttcctgctgtcaggtgtggccactctcgtgagatgcaactggaggtgttttgtggcagcttctggaaggcctgcctttgacccttcctttctgctttttccatctgttacctgcatgcatatatgatggctg

SEQ ID NO: 99319 - DNA, 1544 bp, Homo sapiens
gtaggacaaatgttttcctttccgtgctttaaaagtctcatcttagaccgggcacagtgactcatgcctgtaatcccagcactttgggaggctgaggcaggtggatcttgaggtcaggagttcaacaccagcctggccaacatggtgaaaccccgtctctactaaaactacaaaaatgagctgggcatgggggtgcatgcctgtaatcccagctacttgggaggctgaggcaggagaatagcttgaacccggaaggtggaggttgcagtgagccgagatcgtgccagtgaactccagcctgggcaacaagagcgagactctgtctcagtaaataaataaataaataaataaataaataaataaataaagtctcatcttatggagcaaaagattctaaagagaaaggctggtcctgaatttcatccagcttggttctggtttcttctcctttcttcagcgagtgcagggcctttatccttggggcacctttctgggactttatctggctgtgtgcagacagacaggaaagtgtcccctgcccccaatttttgggatgaccactaaaaaatgaacacacccactcagggagcgtttgtgggatcactgaagtcaaataatttacacccaggagaaagcccttcgctgtggatgtgttcatgcctgtggaaagggaagttggctatctggtctcgaaccctcagtcactgtcagggacggcagagaactcatccagaaaccaagtgttgatgtgaagcctccccttccagaggccccccagcgtccactcccctaggcatccctcacttctggaccctccacatcagcatcccatgacattgggctagactcactgttccaggactccgctggcccagaggtgagtcggcctgaccaagtcgtcgtgtcatcacttgttgggggttgaagtcctaacgcccggtgcctatgaatgtgatcgtctctcagaatggaaataaggtcgtcgcagatgtaattatttaggatgaggtcatgccagagtggggtgggcccctcatctaatatgatggatgtccttctgagaagggaaatttggacgcagatgcacagagggagaacatcatgtcaaggctgcggtaatgcttctacaagccaaaaagaatgccaaggataaccagacagccgccagaagccaggacagaggctcgcagcagaccctccctcaccgcccctaaaggaacccgccctgctgacgctttgatcttggacttctggcctccagaactgtgagacaatgtatgtctgtttctgaagccactcagattgtggcactttgttagagcagccccaggaaactaaaacgtcacctgactcactgtgggattcagcatcttgtacgaggcaggtgccactggtctcagtttctttgtctgtaaaatgaggctaagacctgctttatacagtggtagtgacagtttgcccagcacctcctaggacctcaaaatgtgactttttttaaaagacagagccttactctgtcacccaggctgggctggagtacagtg

SEQ ID NO: 99320 - DNA, 1844 bp, Homo sapiens
atggaaaatgttatttcactttattaagttaaaaacaagttataaaatagtaggtcacatataagctcagttttgtatttaaaaaccctcaaaactgtatatatgcccagaaaaaagacaggaaagaaagataccacagtatgaatggtggttcccaattagtaggagaactaggagccatcattgtctttgctttccagagaataatagcgtggtgtcctggagtcacatggctgctctggcttgccagtggagaacaggctgaggccggaggaggagggagcagccaggaagctggttacaacccaggcggagggctggcgtgggcctcaggggtcttcagcctcagcactattgacattttgtgccggataattatttgtcctgtgcatgtcaggatgttcaggagcatctctggcctctacctactagatgccagtaacatctcttccagttgcggtgaccaaaaatgtcttcaggcaatccagatcaaatgtccactggggggcagaatcacctgctgagacccactggttaaaatagtgtcagtaggggtggagagaaggggacaaaagagtcttagagccatttgagagggagcttctagaggacttgatggatggaatttggtcaaggcaggaatgagggtggatgtggggcatggggaattggacggatgatagtggcccacaggttgagagaggggatgggttcagctttggccatgctgttgtgagtctgtggttcccagggagcagctgagtaggctgttgggtgagtggttctcaagctcagagctgagctgggggcatccatttgaaggttatgggaagatggaaagcacgccctggaggtgggtgggtgagctcacccaggaccacggtgtggcctgagaagtcggcctgcgatagaacccggggaatcccagtgtttccagggtgggcagaggaagaggaggctgggaagggaatttgtttctctggccagagctgttgctcagcgactgttggctggtgaggatgaggctcatgaacagatgtggaaacatcgtgggatgatctcatggtgggtgggacttgtcgccgtcatgcactcagcactctctggcctttattggtcaagctgcctgctgtgtttctggtgcccaaatgttctgggcacactgttgtttggggaagaatcgcagggactctccttcactcttagatagtggcagcgcttgcctcgctgcatctcgtgttctcaaaatcagcacatgccatcccacattctagaccatccagttttgcttctcaggctctgaaaaacacttttaagagcaggttaaactgttctcggacttctttttggattatttgcaacgtcttgaggggtccacggattgatagagtcagcagggatggacagtttccccttcagcacctttatagttgtaatttgcccatgatggggttagagacccacagttgctcaaaagcagtttttgtttttcttgatagctggatttgggttatctctcaggaagcggttagcagtctttagggcaacctaattgcatttctttgtttacaagcacttaacttcatccctctcaggcgcacaccagcactgtctatcactaatactggcagttctagggtgaggtggacagttgctcttagtcagaaactcactttgctgttttccactagattcccagatagagaaggacagttgtttcaggcaagcttaagaccctgtaacatttcttgccctttttgatttgaactcccatctccctagctctggcttgttttaccctgcagttaaaagagaaaatgatctctactggctatatggcctca

SEQ ID NO: 99321 - DNA, 1113 bp, Homo sapiens
gctttcactcatttaggtgggctggcaagcagtgctggctgctccacctgttttcctgcctaataacagtgtcttttatagttgtctgataacaatgtcttttataatgtctcataactctgcctttttgtaatgaccggcctaatacctttgcctacaatagttcttttttcctctgggagtttaactcaggttgtgattagagagtatttcccataaatcacgcaaagcacatgtcctgcccaccagccaattacagaaatggagttggtcagacctacactttatctgaaacaatgcataatgggagttttgaactaaaaaaattaccctctaatgttacaaatatgattcaggcaaataaaactgcagatgtatgtgtaagtcctcagtactgcgattctttctttctctctctctttctctttctcctccctccctccctctcttccttccttcctttttttttttttttaagtgtcctggttgtgttagggtaatttgtgatttaaaaagaaatgcctctcctctccccgacccgatttttttttttcttttttggtaggatgcctccctttgcattccaaggcagcacttcaagcagcactttggtaaatgtcaaaaagttggagaggctgagtgggttgcgtggcccgtctgtgcctgtgggctcctctcccgcccacgcggctgtgcctctcactcagaaccctgcctctcttgtgtttgtcccaaggctttactttcccccccacatacgttcagtggcattatttgttacatttttaaaaatacatattttatttatttcacaaacaatgttactggcataatgttaccacactataggatataatggttgaagaatgatttcccataatctaatttcaacacattacctgattcagtattctgtgtcctctccagccttgcttttctctgtgcacaggtatgacctgattccagtgctttttaagaattattagcattttctgcattgctccttggccttcacagttatcatttgaacagtggcacaagattctctgaaactgctcctctgtcttcattcccattttgtgagcatttaagccgtttactgttgattgtcca

SEQ ID NO: 99322 - DNA, 1069 bp, Homo sapiens
acctgtagtcccagctcctcgggagactgaggcaggagaattgcttgaacctgggaggcggaggttgcagtgagccgagattgtgccattgcactccagcctgggcaacaagagagagactgggtctcaaaaaaaaaaaaaaaaaaaaaaaaaaaaagaaagaaagtttaaaggatgttaaaaattttccacacattatcttttaatgtgttgtcaaggagcaatgatcatcataatggcactggggaaatggaaaaaactggaaaactctcttggtttgacagaaagggatagatctaactgtttagtgttgccaagtgagcccccaaacatctcccctggaaaagtcattaggaatttaccatctccatctgcaggggccaagtgagataaccgtatctagtatatccatctgagcaaaaccctgtttctcttcccttgaataggaagccagaaactgctgcagcgcactgttgaaacatagcttagaaatagatactttgtggggggaaaacaacctacttatctttcccattatgctatctcttaatagggcccctggtatctgagccagcatacacatttggttcttctgtgtcctgtgatcttcctctgagtgaaaactgattatctactcaaaggaagcagatgacagagcccccgtgatgtgtgctgcctttgctctgtgcctctgtagtaagggaggcctggaatgagcagaaagatggctcccctggccacaaaggggggtcagtctattgcaaagcagccttcacgttctggaagcagggagcagtgggagcccgggaaggtcagccttgcagacttgtagatgtcataggattatttgagctgcttccgctgcaggtggttgggaagtactggatggaatccttggaggcgagatgagaggatgggagaagaaagtctggaagaacagttagatttcttcctgattagataatactgagtgagagtgggaagaacggagcggagcctgttgccagcgcgatctctgtcccgttcactgtcatgtggcctcttcacggatgtgtgtgtgtctgcaggg

SEQ ID NO: 99323 - DNA, 1050 bp, Homo sapiens
caatagatggaaagctggaaagtgatgtggcctgaattcctttctaggtaatttcaatgttggtcatgcccagggatctccttaagtgttgcagaatcacacctggacaacccaggtgcccagtccttcattgcctcatgggctctctagtcttacttttgatcccttttcctgtatttcaccagtataatactccccactcctagttgggaatatctaacctgtgttgagtacctgtatctgatgagttagtagctgtgaaaacgtttctctagcaaggctgcctgtgagtgggatcccaggccaagcagttaactgcgttccagcgaagcaggtgccccgtgtgttgctctgcaagtccacatggagcaggattccttattttgtgaagaaaggatctttagtgccacgtgtgtatttttaacacatttccaaaagcatgatttattcaggattaagtttattcagtagaaatttccaaggtatttttttaagtgaggcaccatcctggatgctggggaagaatctttgttggaatatgaccctgggttttgtatggaaaagggagggggcagtgcaggatgtggcaaggcagttgttggagctccgatacttccaataagtaactagcagggctgtacacactctaccaggaaagacaaagaaatgcagagtccagggaagcagtccatcgcacgtttcttccttccctgcaagggcactggagttctccttcaccaggaagactgcagcccccattctgattggcctcagggggccgctcctgctgatgatggctaatgaggacaagcagtagagaatattgctttcatttatcttggtgctttgtaccttgatggagacagatattcgggtttcaagaagacaactttttttgcagggcaggcattgtttgcttgttttaaggctacgttcagaagcacgagaacaaacaacagtttcaagcctaacacttgggtttacatgaagctaattgttagatatgagttctaaatttcttttcaaagaatcagtatgtcagtatgttca

SEQ ID NO: 99324 - DNA, 1091 bp, Homo sapiens
ggggtcttacaggagccagggacaggtggggccatgtctggagtagacagtgatacagtgatgtcccttggcctctgctggacagagaaggaggcgccaggaggcagctctgagttgggatggaaaggatgcatgacagtcagcttccctacagctggaggggaagttccagaaagaaaggatggccaacctgggacttgtgggcagggaaagggcttttggaggccaagattgtagggcagtgttatcctgggtgagttggggtatggccataggagggggctccaggaattcagggaaggaaaagaccatggcgctgaggaggcggcacggcctggccctccacctccaagctgaccaccctactcagctcctttagggtggagtggctgtaaggccgtgaccaggaaaaaagggacccagggtggtggcacatgaatcccagctttgtgtatccactcagttgcatgccaggtagtcacatcttaacttgtggcgcggctttagagagtgtctgtgcaggctgcctctgatccctcagtcagtgtgcagagctgagctgatgaggaaagtcttggtatgtaaccaaccaggtctcaccttcagccacactcctagggacagagtgcgtccatggaggggaggactcacagcagttttgaagtaatgtagattgtgtggccatcccaatttagtttatcattcccctacttggtctgtctgccttcatggaagttggtgatttttttttttttttttttggctctgttgcccaggctggattgcagtggtggcatctcagctcactgcaacctctgcctcctgggttcaagcgatttttctgcctcagcctcccaagtagctgggattacaggtgtgtgccaccacacctggccgaagttggtgattttgaacagaggaaagatagcacagtgtcataactcagcaaaggtgctcagcagctgcaggagttggggttttctgggctcacacccagcctgtgtccctcatccccttgctccgctgcaagaacccctcaccctgctcagtgctcctggccactgctgactggtgcatggcgagcagaggtt

SEQ ID NO: 99325 - DNA, 1065 bp, Homo sapiens
gtcgtgagacggtggccaaagcatctcataaacttggaactaagggagcgaagccagctgctgagggtgatgaatgggggttagctagggctggcacctttcctgaactctcctctgcagtcttcctctctcgcgcagcattagtccctgcagcacggaggcattacccggctgctgtttggttttgaggtagcagtgaaatcaactacatgctttaaaaaaaaaaaaatggtgatatgctccatggcatgaaaaaattcaagaaatggcagtctagtgtttaaaaagccacaggaaaataaagcataatgccacctgaacatatatagtattgtgatttttttttcctcttcaaaaaaggctggtctggctttgtagaaggggatttagattttggagtgacatgtcgggagcatgtgtcttctttgcatcgggagagcccatctctctaaggcagtggggaaaggcaattctctgtgaccaggtttttcagcacccacagttgcacttgacatggcatcattatgactggtgtggaaaataagtgcttccttctgaggtggaaatgctgaaagatcacaaacacactggctatggctggaagaggttccctggaagagtcagtgtcatctaaggtggatggaatggattcttctactccgcagcccgcatctcatatggcaaagtgcaaaacctgggatggattctcaacaaaggtacagtaattgggagacacaaacagtccagtgttttagccctgaaggaatactaccttattttttactttgggctctatgaatgcttcagataacaagccagatagatttacataccttaattatggacaagctactttcatattaaagttcatctcagtatgtgaacattgccctggtctcaaacagtgagaattgacctccccctcccacacctggctaagttaggagcccagggttctggtcccacccttgacagtagcagagatctctatctttccacgttgctgtttgtttctcagcttacagacctgggtgacctttaagtctgtacagctgcagtgataaa

SEQ ID NO: 99326 - DNA, 1031 bp, Homo sapiens
ggctcgccggtcgccgccgcacaggtgcggctgcctggatgggagaagccggcattcatcctggcgcccctccctgcctcgagtcgtctccctgttagtgctaccatctgtcagtgttgtgatgtggactcagctgactccgtggccctcggtattgagctggctgtaaggacacctcactacagtggtggggcctggggtgggacggaggcccctctctccacagctttcctgccaggtggcatcttaatgaggagagcgagtctgggactggattctgtttcctcataatgtaggctagcaaaagggcaggaaaaccgcagccctgcagcctgttctgaaacctcaggtctgtgttcccttaagtcctcagacagggactttgcatggagggatctccagccagatatgttattctctgcaggaatcagttaaccttttggtagcatttcggggtcagagcctccagaaacctcaaaacacagactccatcaactgcgcatcaccctgagggggattctgggggtggaagtggtgctagattgctacaccttattctcctgggagggggttgtatgcctgaagatattgtggccacagacaagaggccatgcatttttaccaccaaaaaaaaaaatattattcatcctcttatctgaattctttaacttggctggtacagataaaggtagttggagagtgggcttttgatttgcagttcagactgctgtgtaacccacctctggagagggtattcatcccaagtggacttaacaggtcagctgactgcccctagggtttatgttaaaaccaactcatgcaaataaatgactgtccttatggaaatatttttaaggtaaagtgaagataaaatggtcatgttctaatatgctcctaatgatcctcagaatgtgctagaggatggttgaaaccaagcagtggcatgtgcggtaatgttaaaatctgacctgtttcactagtgaggctacactgttgccacacttatgtttagcttgtcatggcacatctag

SEQ ID NO: 99327 - DNA, 1061 bp, Homo sapiens
tttaaaacaaacagccttcagtggagaacgtgaggacacagcaattaaatgaaataaaattactgaaacaatttgataaagtttgatttttaaatttgatttgttactgaaaaggacactttttgttggttggttggttggttggttggtttttttttttttttttgagacagagtctcgctctgtcgcccaggctggagtgcagtggcgcgatctcagctcactgcaacctctgcctcccgggttcatgccatgctcctgcctcagcctctccgaatagctgggactacaggtgcccgccaccacgcccggctaatttatttgtatttttagtagagacggggtttcactgtggtctcaatctcctgacctcgtgatacacccgcctcagcctcccaaggtgctgggattacaagcctgagcgaccgcgcctggcctgaaaaggacactagtaaggaaactatgtaattcagtgtttctcatttgaaacattttgaactgattagtcttttgttattagaattgattatctacagtgttttgttgttacaattgaacattcctagagtttgcttgctttttgtaaattactccagatagcaatttaggaaactcctcattatttttgtttagggctaaaatgattctcctggagacagagcagttgtacttggggtacaaggaagagctgtgctgaacgtcagccagggaaccttctaagtcaccgctgtgggctgtgtcctgctgtttatttccttaggttggagcccaagtttcagcataggtcacctgttaacatctttctctttgataagtcatcaaagagacttgggctggaatatcctgccaccagggggaatgttcaaaagtacatctgctccagaggtcctccagtgttgacaggcacattgtagcaaattattgggttatacagttaacaaataccttttgtttggagctgtaagacccaattataaagcactagtagtttttgtctttttaatgcattaacaaacatatattgcatgtttatggtgtgttctgcattcactaggcagtgg

SEQ ID NO: 99328 - DNA, 1033 bp, Homo sapiens
cagacacatgccatcatgcccagctaattaaaataatttttttttttttttgtagagatgaggtcttactgtgctgcccaggctggtctcagacccttgagcttaagtgaacctcctgtctctgcctcccaaatgttgggattatgggcctgagccactgggcttggcttaggaaggctttttgaataattatcttcctcactcttctttccacccactctccattcaaccctgatgaaccctgctggacttcattacatttctgctcacttgacatgcagattgcagatcaggtgggcgggagctgataacattctcacttggcctcagtttcctcgtatgtccaatgaagggatgcaccctagctctaaaagtaaacattgttctcaacagaagaatctgggcatttgctatcaaacagattcccattcttcaggcagttaattttccacaccacaggagatgtttgtgacatttcccatttctttgaagtctaaagtagatattgatcctttggaaggagattaagttctccggttccatcaggtgtaatgatttcagttttagtgttcctaggtggggagtgctaacccaaacctttcatatgtaggaatgtcatccctctgcagacctttgagtccagatttcatttgtagttgacctttgggggtgacagtccgatatgtgtaaatcgtaatagcccttcatcgtagataccagtttaaaattcattttaggtgagtttccaaacagatatattggatgtatatcagtttaatttgataaacatgcagataaaaacttattacatgaggaccagtgtttgaaagatggcttacatgacctgatgagttttcattttgtccgtttccaaaatacacaggaatgcaggaatgccaccttcgttcagatcagacttatcttcttcgcaggatgtggccagagatttatttaagacattagctgtgatgaggaaggtcagataatttaagcaggggcaaagtacacattactgaggattcagcgctctttg

SEQ ID NO: 99329 - DNA, 1094 bp, Homo sapiens
cgcctcccttcccttccttccctgtcctgagtgtgacctccgtcatgttgacccctgcactcctgcccgccccccattcacccactaggagaaagtactggatagggatgagcttggggacaatggccagtgacatccaggagagggaacttagaggcaaggcagggatgcaaaatcggagttcctagtagaaacagacatgcagcatattgtgaaatgtttcagagaaataacagcatcacgatagcacattctctagttgctggttatctagttactagtggtaagacagagccagttaacaaagactataaagttttctcaagaggatgtaaaccaagtaaacaaaataaattcagaccccaagtgcgcatattgagtttgaatattcatctaagaagcttttgtacatgcgttatgtatccataagccaaagccgggggctccctggcagatgcccctacctggccaggtctcgtcgtgtctaggtggtgacagccatgtagatatgcccgctgccttgcacctgttcctctggcctcgcctctgtaacagaacgtggcccctgccttccatcttccccagggtgccagtggggaccttgccttctccagcactgggccgtccactttgctcctttgtgcctgcactgccaggtgcacatcgagcctaatctggcttaggaaacaggaggggcaccagctagaaaatgtgacccatgttgccaactcccaaaagccaccaggtgacttccactgccgttagaatgaaacccaaactctgcactccagccccagcatcaaaccatacttcgccctgctgcccctatgctctccccccttgccctccccccttgccttcctgggccatccttttctgactcagcctcagtgcctagccagtgggttcccctcgctgaccctcagccctcaggcccagcacctcagagaagccgatgactgacgtgcaccccgccagcctccctgcttatccttccctgccgcctcgtgtgtcctgcatggcatttgttacagcccgcagtcacaggtcttgcggtggacttgctggtcggctgctctgctgattctcgaagg

SEQ ID NO: 99330 - DNA, 1046 bp, Homo sapiens
agcttgcagatagccgagatcgcaccactgcactccagcctgggcgacagagcgagactctgtctcaaaaaaaaaaaaaaaaaaaattagctgggcatggtggcagtgccctgtaatcacagctcctcgggaggctgaggcaagagaattgctttaacctgggaggtggaggttgcagtcagccgagatcgcgccactgcactccagcctctgcaatagaacgagactccgcctcagggagaaaaaaaaaaagaaaaaaaggaagctgctaccttcccaaggacacttgctcctcctcgtcttgctcaggcatctcctgggcacctttcggggcaagtcctgctgtcactgcacagctcaccttgtatatgtggggtgctcttctcctctcctgaggagttatgggtgattaggaagcaaacgcgtctcagacttggagatcaaatgaagagaggctgtgtaagcaccaggatgcatggggggttccggcttcttcgcagtttcacctggtttaacccaaaggcaagcaacagggatgcccagggcgggtgagaggtgctgagcggagctccatagttggagaatgtaagtatttaaaaattcttgtgtctattttactattaaatagactgtataacctcaaaaccagttaagaatctttgacattcatggtgtgaaggatgagaagctgggaaataacaaggaccttttcctcgtgtttcctccttaattatgcttgccagtgttttaagcatcgaggctgaccttcgcaggcttcagggtttcagcttgatcaccatgtggatgtggatgagtcagttcactccataatagctcttagaggtgtagaaaggaactacttctttccatgagtgcacctttattgccctatcttatagaaatagtagatgctcatcgtaaagacttacaacaggattgaaattggtaaagagaaaaaggcaatcccctacccccgtccctcagagatagctgctgttgtcagatcagttggatattcttgaagacagcttccttcacgggtgttt

SEQ ID NO: 99331 - DNA, 1009 bp, Homo sapiens
ggaaatcactatcctctaagaagttacaaacctgcaaatcctctagagcccatttgggccggcaaacttttgccttgggatttccttagaggagaagagagaggacccagtcaaatgctgacgttgttgtgacagattctaagtcgcctcagggctcaggggaaagagccttggaattgcaggcagtggcgtggatgtacctgcaggggtgggcatggtggcatcttggtggccaggtgttcgtcaccctgcactgagagggcctggtgaatggcaaggtcaggggatgctgtccggacatgtcaggatgggaaactgtcttgtctgtggatctttgaggctgctgaaaaggatctttgagcctgaacttccagggaagcctgaaaccaatctggtatccccagggtttatgttttatttcatttattatagggattcaaggatttccaaataagaaattaaatcctaccattgaaactgtgctggtgaacttctgctaagtcctacatttgaaagtcatcagcggattatgtctgatccagtttgcagcgggctcttttccggctgcgttgaaatggatttctttattctatttaagactccacttccttcctcggcacagaactgacaggctgtggcagccacagcctcctccgatgctcctctcctctgtggatgtaccatctttcttccattgttgttttgttttatatttgggggctttacggctgctttaaactaaaaataaatgctcctccccttttctgtgctaaaaataatagttaaaatccttgtgacgtttaaggttttcaaagaaaattcccaatttctgagataatatgttgtttttaaaatgtcacctgcaatttcaggttcctttttttagccttgtgtataatttcacgagttttgtctggaatgcgtatttgtggttcctggagccaaacagaattgggggctgggctgggggtgaacgtgacacgggagaccatcaagtcattctaatatt

SEQ ID NO: 99332 - DNA, 1145 bp, Homo sapiens
ggggtgtcatcagctgggcccatctccttcccggtgtctgccccccgccccattcctccctgaaggtctctgggctgtctctgcagcacttgcccgtgggagacaaagcgtctctcagtcctagtgctgtctcagaagcctggggttccgcaagactggcctggaaagagccgcctctttctgtcttttgtgtgctttgtcaccgcggcactggcagggtgtcttaagcctattgaagccgtccaggaaatgtgcgttgaatgaatggcacaggcttggcaatgctgttaccaggagattctcagaacaatcccgcagtttccgttacttcctgttaagacagccgctgccactcgggtgctgtgatgggcacggaacagtagtcacggtggtttactggtggtgatggtgtggatacagcgctggctctgtgcgggtcgtgttctaagtgctttacaaaattacttaatcctgacaagtgccccatggggagggataggtacggttatccccatttcacagatgaggaaactgaggctcagagacatgaagaacctgcccaaggagccacagtgagtaagtgggggagctgaggtgtgagcctggagctggtgcttccaccaccgcactgcctgacagaactttctcgacggtaaaaacctcctgcgtctgcactgcccagtgccgtcacggctggcgccatgtggctgttgagtgattgaaacgtggccagtcagtgccatcaaggagctgcattttaagtttgattctagttcatttaaattgaaatagccacacagggccagcggccaccctactgccagcattacagactaactgatcgtcaagtattgaaccacctgacttggcagttcaaggtgttacaggttcagagagggcccacatgatcataccagcccataatcgaggatgcttaccaccaaaaacttgtgctctgccggtattttgaaagcatatgattttctggaatatctgcccagagctgtaggagacagttgcgtttgaggcagcatgggctcctcattctgaaacggactgtcttaaggcttgcttcaatttgctgacaccgtgggcttcgatgctgttggttctacagttctcagaacggtcctgtccctggcctg

SEQ ID NO: 99333 - DNA, 1049 bp, Homo sapiens
tgccacacctcgtaatacaatcaccttggggattaggtttctttgtttaaaattttatttattattttgtttttattttttgagacagagtctcactctgtcgcccaggctggagtgcggtggtgcaatctcagctcactgcaacctctgcctcccgggttcaagtgattctcctgcctcagcctcctgagtagctgggattacaggcatgcaccaccacagctggctaatttttatatttttttagttgagacagggtttcaccatgttggccagtctggtcttgaactcctgacctcaggtgatccacctgcctcggcctcccaaagtgctgggattacaggcgtgagccaccatgcccagccaggggttaggtttcaacatatgagtttggctgggagtgtgggggtaggacggggaagcacaaacattcctaccatatagttgaaggcttgtcagaggaggtgacatctgaactgatagtaagagtaggtttcggggaatgattgatatggaaagctttagttgcctggagacagcaaggcctgttaggatggggcttggtagctgattgactagaaggccaagcagggagcgggcagatgagaggcgggagggttgtaactggggtgtaagaggacaggaccgagcataggttttagaaaggccactctggctgatgagtagagagtgggagcggccaggactgggtgacagagaacatttggatccatgagccatcactcagacagcagaccacggtggcctgtaaatcactgagaaccttttttccacactgtcatgccaaatttgttctcttatatgtttgtttgttttcttttttgttgttgtttttgttttgttttgagacagagtctcgctctgtcacccaggctggagtccagtggtgtatctcggctcactgcaacctccgcctcctgggttcaggcgattctcctgccttagcctcctgagtagctgggactacaggcgtgtgccaccacgccttgttatttttttgtagttttagtagagatgggatttcaccg

SEQ ID NO: 99334 - DNA, 1068 bp, Homo sapiens
ttgatatctggaatagcgcagtagaaccatgaaatactattgaatttatttcttatctaattgttctgtcctttcaaatgtcctttttaatccagtgtccttcttatccattgttgctcctttaaatattgactggacattcctgtgatctggatattgaatttatacataatttgtatgtaatgttacttagtcatagataagagccttccgggataagacgttcagattaccaccaccatatgtttgagtatgtttccccccttatattataaacatttaataatcattttgcatgagagtaagatttttttttttgccattaggcatttgcttcttcagttaacatgtccatattttattttttgccttaaataaaattatgataatggtaggaagcatttagctcccgtgtcccctaacgaaggggtgtagttgacaagcagttttctaaatgaaattttctctccgtgtaactttgttaaatccaactctgagacactgaatttctggttccttctttttcttactggctgttccattctttgcagatatggatgcaggtaactattcattttcttcatggcagcgcttgtcttgttttggagagagaggaaaggcaccactttgtactgtagcgttcccttccctccttgttctgtgtaccatcctgttttgtttcattttatctttttcttcagttgaacattccaccctgttttgtcccttagttgtctttttagcagtagtcccaagcagcttcacctgttccctgtaacacctgtcctagcatttaactcttgtcctgaatactgcggaaccgttcggagaagtataaaagtggcttgaggctctgccaccgttttgcagaattgtgtagtcatgtcatgaacacctcatgcatcaggaagagaccttccatactgaaatgatgatctaggaagattagaggtgataatgaaggcttgtatgtaggggtcaataggagaaagcttgcctgttcactgagaaatgcatacagatgccagaaaatggcatgatttggagaaatgagcaaaggccacattt

SEQ ID NO: 99335 - DNA, 1022 bp, Homo sapiens
cagggctctgtccctgggttttgacggcttttatttgctcctttgtgtcggaatatgaattttagccacggccagctggtgacaccttttagagaatcttttagagatttttcctttgggttttccacttattttcaagggctagctattgtagaggttatacagaggttaactcacctgcaaatgaaatgaccaccttttctaagtaaatctactttcagggccctgcaactctgtggatttcaagctgggaccacaggaagttacatgagtcgggcctggttttgttgctgttgctctggcagtctctggccctggggttcaggtgtctggtggggcagcgctggaggccctgggtttctggagtaagaacaaggaccacgactcactcatggtggcctttctgctatatggctatttggtcatttttgtggcttttcgctgttttccctttgggcattcacagtgtgttccattgtatttgggcccagctgggatgtcttttgcagtgcataattgacccttacatgttgactcacaccaaagcatttctcttgaacgtttatacatcaaaaggaaggattgtggggtgacctaaactgatcactaacatccctgcttctttgatttttcaagtaatgcattttactgcactgaaatttcatagtattgtgtatggtttttaaaaatacattatttttaagagtaggagcgtgggtgagtaccttcctttcttcatctgcaaagtggaagtagctcatcccctccatggggccccatgcccaaggcttcctgggtcaggggaaagatcatgatccctgaccttttctcatgccctgcagcagccctccctgggcatgtggcctctcaccttttgactcgaggtcccagggattgttctgtgggagtgtgaggagctgacagcagcagacacccaggtgcaccccagtgggtgtgtgtctagggcccctgggtgctgaaagaattatgaatacatggctccttgtgcctggaagcttctt

SEQ ID NO: 99336 - DNA, 1115 bp, Homo sapiens
ccagctgctgtgtgggtcttccatgtcccagggacggagagaggagaagtggggttggccaggcagaggcatgataagagtcagagtggctgggctccagggctccagccaggctattagcaggagcactggctttggagggggacctaagaggacagataggggaatccccaggccacctctggaccttgacattgactaatgggatgagctgctggaacccatcaccatgaagccccctgcactaactagggcgtgtgccccttgaggagccgcatccgcttattgggcctaagaaaaactgattcccaggtgtgtttgggccgtctagaaccatgtgacctggcagccacttcaacttgggcagcatctcggctgggagccccagggagcctggcagtacctcagtggcagatgcagctcgttccaagatgttccagaggcaggaggttcctggaagaaccactgggccttgcagggtcagctcagcctgagagccagtgaccccctcccccaggaggatgctgtaggggcagtctcacggcggtctcacctctgccacctgtggatgagaggctggaccgggtcttggtgctttccagctcagggcgttggtccacttggttattcttggggaccaaaatccaagctaggatggggacagaggcctggagacaacctgctggcctccttccattaaagccattacagtgtcaccacaggattgtaagaattacaaatgcgttttccagagtccccagagaaaaaggagtctggcagttagaagagtaaagtgcatctgtcaacaaaagaaataccaaagatgagactacagcagcgacttgtcacctcttccgtgttgctactgcctgagaacagaggtttttagtttctttaaagggttgtaaacataaaaacaaagaaggatacaacatgcaaggcctaaaatgtttactttctggccttttacacaggcagttcgccagccccctaccctacagtatggaaaaaaggcatagaacagtcaaatcacgtaggatttcttagtttctccatgcaggctcatcgaatagcaaccatcctttcttagtttcttgaaacaagtaccttattta

SEQ ID NO: 99337 - DNA, 1040 bp, Homo sapiens
ccgcctctctgcctgtttgatgttggccctgtggatgctgcaaaacgcagcaaacacggaggctgccggctttgtttctgtagggcttgtcttagcagaagttcacatggaagagaggaggcgtaagaagcagtcagaacgtctggattggagtcttggtcctgccgcgtgctggccgtggagctcttgctctgtgtctgaactccttttcctcctgagtggatttgggtgttgccagtgatgtttgcgtcataagatggggtgagggctaacggagatgatgtgggaaaacaagtgctttgtatcctgccgcgcactggccgtggagctcttgctctgtgtctgaactccttttcctcctgagtggatttgggtgttgccaatgatgtttgcgtcataagatggggtgcgggctaacagagatgatgtgggaaaacaagtgctttgtagacgatggcgttggaaggcacactgtcgttgccatagctgtcgcttggaggactgttaatgatacgttgatagctttcagttcaattagccaaaatgacagaaatgccaaacatctgttgcaatgttgactcccaaaagggccctttttttggaatgggaaaattcagttttctctttattttctttttcttaaagcagaaatgacagcatagatgatctccctctccgacttgtctctgtgtagactgcacttgtgttcaagaggctccgctgtagctcaacctcgcgtgagtgcagaaacttgaaggaacccagttgttttacttcccccagcaccccaaatttaaaactggctctcacattgtgagacagcattcagaatagtaatcgtgaaaggctatgaggacttagaaaaaggtatttaaaaaacgaaagagtgtagctgtatccttttcttcctggtgcgctgttcattcacggtgaacgcacccacttcagcatcttggtggaaataactcagttccaccttccatatacttttctctctgcagtgtgggatttagggagaaattaagacctcgactcgctta

SEQ ID NO: 99338 - DNA, 1728 bp, Homo sapiens
tgcgtcattggacaagtgaccacacctagaagaagaatgccagtgtagggagtatgcttagccacctgcgtggtgcacagaagggggcctgcacatagggactgtgtgtgtggtttttcctcctttctaaagtatgtatcctctagacccatatttaagtctttttccttctttctgaacattttaaaattgcagtttcagaagcgctcctgtaaaacaaatatctacgaatgaataactttctcttgtgtttgagtctcttagttgggaggcaaacgatgctctacaattccagattcataaactaattacatttctgctgagtaaggtactggttttccgtgttgtggggagtgtaggaagtatttagagctgtcattgtcactgtgccgttactttttggtcttctgttccagatgccataagttctgctaacccgagggtcatcgatgacgccagggcgaggaagctctccaacgacctgaaacggtgcacgtactacgagacgtgtgctacatacgggctgaatgtggagagggtcttccaggacggtaaatgcgcgtggctgggagtttaatttcagttcatgatagacgggaggcacttcaagaagtcagtcctgcctgcacttgtgcatgtgggtggtggaaatatgtcgttgatgggtgggcattagtatcgagagcagtccattccagaggcaattctcaggtatgtttcatataaacagtgctgtgttcagaagagacaacaaggcatggcttgagaacagcctggtgttgggtctgtgtgtctcctatggggcctttttgtgtacaggatagaacatttcttgagctgttactcatccatgtgctctgtaaaacttgtttgtgagcatttctttattgtaattgcccattcttaatccagtcccgtcctttaaagcagtttaaatatttgatattaggctttgagaagagaactgaaaggaggagagagagagtcaagtttggacctccccccaccaaaaaaataataaaatgacacgataccactcacagcagagggtgaggaccagccttttggaattgtttttaggttattttattcattattgatcacctaccttcaggaacagccacaaatcagacagaaaattctcctaggagagcatgaggttctgcaagagggtcacatacttgtggatgatcatagcgccagacgtcgtctatgagagaggagcctgtgcagatgcgtggggtgggcgggagaggtggcgtcaccctggggataggagggtctggggtaaataaggactgatacttctaaagccagtcttttcaagttggaagcttgggagaggcatggttctggcagagggtccccttgctggtgggagtggtggaagtcacttgtagggtcctctccccttctggtttaaatccatgggggcagagccacctgtccccctgctctggtgcccagggggttgtcgggggcagagcagggcagccacactcgggctctccagagagtgctggagccgcttcaaggtgatggaggactcgccgcgctctgaccttgaagacccacggtgaaagcagtggctgcaggactgttcccgggacttcctccaaatggggcaattttctattacatgtttaaattagtcttcagatgaaattgtagggattctgtacattcactgttcaactcagtttcaaagatgacatcagttctcaaact

SEQ ID NO: 99339 - DNA, 1120 bp, Homo sapiens
ctggtgtgtgcaaagaaccccatctcacattaaatggctgcagctgcctggtcctaattacaggagtgtccagaaccaggggagctatgttaatgagtccgtttgtgcaacctaattgcacgcactagagcatctgtgaatgtaagcagtcttctgggcctcttctcctgggtcctgcatcatcttggaccattttgttttgctcacaccacagtccttgtgctgttaaaggatgtatcagttaagcctattccattctttcctgaaatcagcttaattttcattgtcggggtggcctgttttatgatttgtttttgttgctatttttttctcctttattacagattagattggaactagtgtgtgtgtgcatgcgtgcatgtgtgtgtgtatatgtgtgttagcgagggaatacttcaaaaaataagattttttacacttgaaagcaagccatgtatatgtgtacattaggcacttgatatatgttgaaaaggtggattaatgggtcattaattgtccattttttaatcacttgtagtaatgactaataattatgcaacaatttaacggcttatgatgtaggatagtggatcttattaggcccagtttacagctgggactacattgttggaaatgctgccttcccagaggtacatggtgcagctggtgtcaggcgaggccatcatttcccgtttctacctgtggtcttggctgtgcacctgtactcatcactgtccccgtctctacaccctcaccccctccacacattgaaagtcttatttctaagacttcctgggacagatgggtggtagatgtgtattgggacagtatgaaagaggttcagctgcttaaattacacttcattaagggggttcatatttgaacattttctgagaacaaagatgacatgaagaaagtgacctctgtaaggctctggcagcacttatgcggtaccaatacaaatgggggttgggggctgagcagaaaacattcttcaagagttaaatgatcaagtcacgtaaggcgtgttgtttttgttttgttttgagacaatgtctcactgtcacacaagctggagtgcagtgacacaatcttggttcactgcaacctctgccttctg

SEQ ID NO: 99340 - DNA, 1986 bp, Homo sapiens
agctagcgctactggtgcatgccaccatgcccaggtcatttttcaaaatttttgtagagatgagggtctcgatgtattgccaaatccagtctccagctcctggtctcaagtgatcctcctgtctcagccttccaaagtgtgatgggattataggcgttagccaccactcccagcagcccaacttttaaaggattctctctcagtctatcgcttgatttgcttaacaccagccatttaatatgaaaatgtttaggtgggggagggaatatcttaattatcattgtgctccatacgctacagatggcacctgctggccttagcaatatggggtcaagtatgaaacatgatagagtgacacccaaggaacctataaggaaaggaattttgattctttcagaaataacaggaagaaattatcttaaaatcttaaggttgatgctgcaaacaaccagagacaataaataaattgttatttagtgatgttgcagaatattgtgttaatagagcctgtgatctcttctggcaatttcttaccctaagtctgggatttttcctgctgtgcttctcttactagaaacgttaagtgtgcacagatgctcatacgtgtgcagagaaatgcctgaattaactctcacactgccaacattagatcattaaacacactattagtaaatgttctctattttgattttcatgttaagactcatctcttttgctcatagaattaattttatcaatgacatagaaaatggttattttaatacttctctgcactgcggtatcatagctgtgttttgccccaggacttctctctaatgacttgagccagcttgaattagcgtgatgtatcattaatgcatacaaatggcttttatttttgttcataatctgttcataatgccacggcattctgctctttctaatgtttttaaaatgattaagtagtgatgtactttttgacctagttaaccctccatggaatcgatgatcaaaagaataagagaatattacttaactaggatagtcagaagttgttataatctgtagctgatgttttccagttattttgaagttttttataatttttttttccttagggaatatggacataggccgggcgcacagtggctcatgcctgtaatcccagcactttgggaggccgaggtgggtggatcacctgaggtcgggagttcaagaccagcctggccaacatggtgaaaccccatctctactaaaagcaaaaaattagccgggtgtaatggtgcatgcctgtaatcccacctactcgggaggctgaggcaggagaatcgattgaacccaggagccggaagttccagtgagccgagattgtgccgttgcattccagcctggggggataagaggaaaactccgtctcaaaaaaaaaaaaaaaaaaaattgcagagaatatggacatagccatgtggtccttttttctaagtaaacttcactcatcgaggagctacccacaaaccactgggttagcagcactgaatttgttcacttgatgaaagatgaggaatagtaatcctttttaagttgtgaagttctttaacctcagaaagggtggctttgtctcatggactttgatattttttgcatagtccttgtaggttgagcctggccagacactggctccaagaggatgtgaggaattcaggctccgagcagatcaggggcatccctaaaggttgggttctggaatcgggtgagtttgtgtattgaatgcagagcctcatcgaagcgttgtgacgaggagagcgatgcactgacggccttaggagtctccctgatataagcaaaagtcagctgggaagagtggatttcaactttgttttcctaagagaaaaataggccagatgtggtggctcacacctgtaatcccagcactttgggaggctgaggcaggtggatcccctgaggtcaggagttcaagaccagaccggccaacatggcgaaaccctgtct

SEQ ID NO: 99341 - DNA, 1050 bp, Homo sapiens
gaaataggaggtgacattcctggggggggctgcccctcccacctccacccctacctcctgttttcaccatttcttgatacagtggtgcctaattttatttcaagaagaagatagtttgttgctttttttctttttttacagctttaaaaaataagttgaggaatttaggtttaagaaaattaatagctacaggtaactgcaaaagatatcattggcagatgcagcaaaatatatatatatgtatttccacagaaaattggattctgcccataaaacttagtaatactaataaagacaggtcattaccagttttaagccaagtaagcaaactcaaagagatcttctgtcagtgtgattcttggtggttttttatttttttggagaagtgtaaatcagctttagtgcagcaagcacaccacagatttgctgaaatcattcctgccccttctgacggtgggtagagttgctcggccaagtaatttacagtgctgtggcaaggtatgtttatatttaagctgtgcaacggtgtagctaatgagaaagataagaaatttatagtccttggtgattgataggattactgcctaggcattaattgaaatctgagggatcacagctgtgggtttaagttgggggaaaaattacttcaagtaaaggaaaacttttagatttgcttctgaacattttgaagatagttctcccgctgacagtctggttggtggtagaaacagttgatcctggccgaggctggggtaattatactgagataatgatggtatctgctgtgtagcctcttcaaggtaggtggtttataagtgtgggaaaaaaaattaaatactgtggggtttttaaatggctttaaaattttacatgtataagaataaaattctctgcagccactctttgctaaatattctctggacaattatttaagacattttaaaaaaagaaacccaaactaataatgacagaggcaaacctgtgatattagtcattgccttaaaatttccactgattatatttaatctgggtatgtctaaagtaatctta

SEQ ID NO: 99342 - DNA, 3786 bp, Homo sapiens
cccagtgacacaatgtggttcctttcatgttcactgtttggccatagttgattggaattgttgttttaaggcctagtttaactggacagcaggactaactcttcatttcagaaggaaggcctgcagcccaggagatggagctgggcaggtgccctcctcacgagaggctacaggccagacgcagggcaccaagagcatggcatttgattcaaagccatggttgagtggattttcaatctatttgaaggataactttggctactatatagtatttacactcctgcccattttttttttttgtattttttccatcaaaagagaaatctgttttgaaaacagaggtaatgtctttaccatctttctcatgtatattattttttggaggaaggaaatagccagttttctatactttgacaatgtcaccatttgccatctaaaatttcacaagctgtaatttgccttttacttacatatctcatccacagatgtatttgagtgtccacagtgaaatggttgcattactttcagattacttcctttaattctttagatgggtgctaatggtttgggttattaactggcacagatctgagttctttttgtctatgcttgttgtttttttcccccttcaaaatgaatttgcaaaagcatcactagaaaagcttatgtgtaaacatttatgctagtaatagataaaaggtgctgtgtagcagtaccagtgggagaacgctgaagcccagaaggaaagtctaccttctttggaataactgaataggagtcccagtcacctattcccactttctctttaactatcacccttggatggtattgaggaaaccgtattgcatgcctaattttcacagcgttcagtattaaggtaaacctactgattgtgtttaagttgaagtataccttttccaagtagctgtgtaactggcagtgacagaataggtgttgtatgggaggcagcattttcagctgtaagtgcaataaattgtggtttgtttattttagtttttaaccttttagactactttgtgatcggcaggagattgtgtgtgtgtgtgtgtgtgtgtgtgtgtctaggttgcagagtgaggatctggtcagtgattgacacttgttttcaaagtgttcaccatgaattttttttcttaaataccatttttctcagtgagctttgaaccatgatgtcaccaaagacaaagtgtttctcaggcttttcttagtgaaagatactttcctaaggtagtttatagcaagatttggggattaaaaaaaagagttgaatttatggcctgaagagtcattataaccttttacctatagctaacatttacatacctcaggtcaaataaatttagatgtatgcttaatgttctaaaagctctttgttccttgctcatccttggccggaccagagaagttattgataatcaggtgttgctttctttgtggtaggacatcaccatgttctcatagagtcctgttaggaagcagaggacggactgctgtgtgtcactgtggagagaaaaagaccttgtgacgtccctgtcatcacaggattctagtatcttgttatgccagagatgtggtttgaaaacttgtttttatggacgtacccacaaaacattatgctctgtggaaagaggcacgcacagaaaagaatgattccatttatatgaagttctacaacgggcaaactgattggtgatgaaagaaatcggaagaatggttgccaggaagtgagaaggagggattggttggggttgggggtggcccagaggaactcctcagggggatattttcatcgtggcttgggttacacggcatctgtcaacattcatggaccggtacaactaagatgttttgcatttcacagtatgtacatttaatctcaaaaaaagaacctaatagttaatcacgtgcatgttgaaatgtgtgggagtgaactgatgcctgcaccgtagttgaattgcatcagaaaatgaaatggacggacggacggacggatggacggacggatggatgggtggatagatatataataaagcaagtatgtagcaacatgttacaattataaaatgtagccggagtggaaggaggtgttcgctttcaaattttttttgtatgcttaaaaaatgtgttaataaaatatagggggaaatcaaaaaaattgttactacattaaaaatgtcattgtaggtctcgtacattaagatgggtccagataaacctaatttaatgtgatgtgctttctcacaagtagaagtgtacagtataatgaggagccacaatttttacaaaaatgaatcctgccagaattaaaaggcatacatgattctttgaagaatttcactaatgcatagaaactgcggtaacagaaaagaatactttgacttcctcactattcctaaatcacagcagattacagattcaaaatcaatcagtattctctgctgaactctaattaacacttaacattattagtcacaaatgtgaaatcttgatcggagatggcctcaggtattctaaatgtaaataaaattaggtttagatcccttttaattacctgaggtgctgtgagcgattacaatggcaattgataaacttaatttcttattaaagcaaaaaaaaaaaaaaaaaaccatgaaaagtttctctctgctatatacttaactcttcagtagccatggcctatgcaaaaaaaatttacctggtttatatgttaatcatatagaatttagatcgttttaaaaatgtttatgtggaccctcaaattcatcatgcatctcctaagtttgtgggtaatgttactataacatcacaaagggcaaaacttccccagaggaacttcacgtatcagaaaaggtaggtttctgggaggtaatgctggttaagtaataataatggatgggtgctggggagagtattacaatgacttaatgcacaaagccctgttgaagaccaagtggaaatctgttttgtcatctcatccttcttcctaattgcatcacaatacattgtataattcaacctgtgtgtcactgtcacttcttcccgtgcacagggccaccgctgctggctcattattaacagagcagggaggagacgaataattctctcaggttccaaccaagacatcttctctcccccactttaagaagaaaatgtcttttttatgtagattgttgtaaggataattatttctggaaataggaaaacagcttcagttgtggtagatacatccatttttcttaaaagtgagaagctatccgaaggagagtgtgcctgtgagaaatggaaagattacagaagtttctaaactccttcttctgttggtgttcatatctaaaaataggaagcaaattagacctgataagttgttaagcctatattaatcaaactgtgttaattttttaaaaagaaaaccaattattgcacttaactggatctgtctcaaggttcctgatttcaaaatcgacttttggcctttacgtcttacattttcccttctttagaactcttgcgtctcctgttcctcatttatcttgatcttctcatctttttttctttataattttgtgtagtttcttacctggaataatttagcataatctatttttctttaaaattttgtatagtttctttagctggaataatttagcataatccatttttctttaaaattttgtgtagtttctttagctggaataatttggcataatcagtctggcacgctatcatgttgttggtggtacctttttctctttgtatgttttaaaa

SEQ ID NO: 99343 - DNA, 1047 bp, Homo sapiens
tgtttcattcatctatctgagtttttcctgctttaagtgcctcttctatgtctgtgcaacattcattaatttctcagtatttcccccttgcagattattccttctttgtctgcatcatagacacacgcctctctttatagcactttctatatcccacatgctgccacttatctaacacattgggagagaaaggtgcagacaaggtgtgcaggaggtggatgtgatgttgtggttggttggttgacattttctagatgatgcagctggcagatttgtctggatttcacaatctcccacatctagcaaattgcctggcatatactagttgctcaataaaaacagtcagtaaatgggatgagtgagggatgctataaagcatagtaaagaaaccttccttgacacattaaagggaaaagcagccaactccacatattaaagaatgggcagcaacttgcttggtttctgtgaggacttgcttaattctgcattgaccaagagcaagctgaagagcattctgggatcaagaagatgaccaagtacattgtgggaccaagagcaagatcaagagcgttctagaccatgagcattctgggaccaagagccatgaccatgagcattccgggaccaagagcaagcaaggccaagagcattgtaagaccaagagcatgaccatgaacattctgggaccaagagtttgaccaagtattatacattctgggaccttcctaggccattggcatcaacgctgcagcctctgagtcatgcatgcctcatggggtcatcctgacttaacctgatgggtaggacttacttgagtagggcaggaggttttgaaaggacatgatcatacacagtacttagctcaagtgcacagagaagcagagtgccatactgggaccctacggtacagccagccggagacacagggttccagacacagcttaattccttcacgctggagtatgacttggatgtacaaactcctaatccctaaggataggaaaagacctagaagatttgaggattttaattcaggaaagtccacca

SEQ ID NO: 99344 - DNA, 1096 bp, Homo sapiens
tcagaaggtaaggcatcaaaggattactttgatatacgcaaggtaagtcaacaaaggattaccacccaccgaaccctttctcctgctggcttgcttggggcatggcatgtcctaatgacttactcgagcagttgaatcttggccacagcttctcattaggctttcagtgacaaggaaccaaaaagcaaatgcatagaagagcatttcctatttacacacccctaagttaaatttatgacctgtttagttgcaggatgtcttaccttccttgttagtatttgttctgattggaaaattactctgatggtttagaatttgtcctgttgaaatgtggaagtagctggaccagacttgttcataaatgcagcatccatgtgaaggatgggtgggaatcggtagatttggggtgaatagctaagtgctgattttaaaggtagtggcaaaaaaaatgatgaaagcctcttctagaacaaggataatgaatttctccttgtggggtcgccgtgcttatgggaagatggaacgtacattaaagaaattttcggagtttagctaaaactgtatcactgagcttgtatcaccttatcagaactcattttggtagcttagaatcatcagatgacacataattagcctagaattctgtgtgctgccaaaatactaatccagtaaaagggtagagggacagttttagatatgggagtctcaaaacaaaatatatgtgtgcttctcgggaaaccgctggaaccaggctgctgagttcagcccctgaggctctttcccagcccctccgctccccacacccctgcacactccctttcttgagtgtccaggtagaaatgacctgtatcttctaaccaccccaggtatctttccaaagcatagatctcttcacttctctattcaatttgaataaccccccattgccttaaggacaacttcacacttgccactcttctctgcatatcaggtccttagaaatgcatttctagttgcctgtttcagcatcttctcccactaccttcttataaccttcccaccccagccccactgttgactcatccattcattcatccagttgttgtgtgcccactga

SEQ ID NO: 99345 - DNA, 1053 bp, Homo sapiens
ttcctccactcacatagacacaccaagcttttccctctaggagattacccagcctgctgctgggttgtgtggggaaggactgcggatgtcttggatggcagttgtcatactagttttttgcttccccaaacaattcatttagggatgtctttaagtgaggcgcccagagattccaccccgtccctgggacatcaagcaaatagcagcaacagccgttggcaaatttgtggctatttgcagcattgactctgtagtcagtttgcattttcaagatgggggagacatgggcagacattacaaaggagtcctttccccttcctattcctcatgctcccgctcctcctcctgaagtcagatactttttgttcttcattaaagttttcccttattcgtatgggttaccctgtagttttaaagcattcaagcagtccgtatattttagaacaatatatttataaatcattttctttccttgatttgtgtatggaagcaggaaggacataacaggtagaggggaaataggacaaatatgaaaaaaaaatagtagagtttaaaaactactaccagttaccggatgttgtgacttcattttattttttaattaatgtggtagaatagtaattaaatggacagaagaattttagcagttaacaatgctaaatactcatactttgtacatcctgtctgtagtttgatgagaggctttgttgtagaaatattctctttactcatgaactgactcttcctagactccatagaaaggatagaacattcatttgcatttgaagtttcatacaacagtcgtttccataacatatttgacttatcttaggaagtttctcgcatcttcccttagtttctacaaatgaaaatgtctgcaaagctctcaaagcatgcatcctagtcctatttaattctgacatctgcacatttcttacgaatgtaaagtcagtgtggccatccagctgaatagtaactctgaagctgggagtaaaatcagatttcagtgtaattgataatcaaagccccttattgctatttttcaaaaacaaa

SEQ ID NO: 99346 - DNA, 1066 bp, Homo sapiens
gtccaccagttgcccagaagattgttgccacaaggaagaagcagcagctgtccataggaccctgcaagtcgctacctaattctcccagccattcctccgtctgttccgcgcaggtgtctgccgtgcacatcagccaggtacgttaggtgacatgagaagtcagactcttagaaccaaagacaatatgcaaatagtgttcccagccaatgctaaggttgattttttttttcttttcaactttataagtaacagcatgttgtaattgacttcacattttcttcagaaactgctgtggccaagtgatttttatgggaatcattcttttatgttttctgtcttcatgctgcctgtgttatgaggcatgctggcccgggtggtgatgggaggtgtgtgctgcagtcctcgctggtgatttaaaccacccttctctggtcttggtcctagtctgcttataggttgaacagttgtgagtaaatcttaatggccaatctcgctttatacttaaatttggtagtggcattcaattataattaccatctcccttaggtcccatagaaactgctatctttccataacaacattttgcaaaagtatttacttggaagcaaatgaaataatggtcactttgaagaactcaaccaacaacctcctaaggaaacagttgactttgtttttgtctgtgcttgttttttgattacgtttcttgggcaggtattctattggcactgtttttttaaggacatggtggaagggttcggtgtcgtactttcagtttgcttgggaagccagtaagttatggcatgtattgtcagagcctgtcaaggtacagtcatgaatgttcatgctggctgggctgagtggcagttgcctgtaatcccagcactttgggagctcaaggcaggtggatcgcttgagctcagtagttcaagaccagcctgggcaacgtggcagaaccacacctctgtatctacaaaaaagagaaaaattagctgggcgtggtggcttgtgccttgggaggctgaggtggggggatcacctctgcccagcagaagagctaggctgcagt

SEQ ID NO: 99347 - DNA, 1213 bp, Homo sapiens
ggattctacacagttgagccgcaaactccaggcacagctgctgtcaggtgactgaagcatttggacttgagaagaacgcttttcctccctggatcacgcattacaagtacatgcttttgaaacagtgcttctgaaccagggtggttttgctctccaaggacatttggcaacttctggagaaactttgggctctcacaacaggagtatgggagtgggaaggtaaaggttctgcagacgtctagtcgtgggtagcaaccaggggtgctgcaaagcatcccacagtgcataggtcagcccctcacagcagggaattatccagccccacatgttagtggtgccctgttttaaaccatctgacttccattttggttgattactgctgacccagatgcaaagctctagaggggtggctgggagtcagatttgctgcccctttgtgaatctgatcttgatgttacattgcgattcctgccaagtctgggagatcccccgcccctctgccacatgtctggggcagtctctcattggatgctcatgactgcggaggcggttgccagctgcacacaccccctcgtccccagcctccccttgcttttgctagttgccttgcgccacatcagctcccacagaggccactgctgggcagcagggtgaggactgatcagacagaccaagctcccatcccggcctccgctgctgacggatgtttgaccttaggcaaattacttgacctctctgggctggaaaccatagtacttctgcagtggggcttccgggaagacttcctggaggaggcagaagagatctggtggcattgcttccatggttttctcactccattgatgctataaaatgatttctgatcgtgttaagcatatgtgatagattaggaggtgggtatttaggtttctgtaaaatacaggtgagtatctcacatgcttaaattagtgcatggataacatgttttattgggcagtttcttcacacacaccgagaacagcagcagtcacctaaatagctgcttcccagctccgtctaacacctggagcagcccctgtctacccccaggctggggggctttgggttgaagtgtttcctgctagaacaggctgcacagtgactcggtggcttgagaaaccaatagccaaagatgcagctggattgagagaaggtgggctgtgggcaggcggcctgtgccccgggaggaggggcg

SEQ ID NO: 99348 - DNA, 1052 bp, Homo sapiens
caagaaataagcaaatcctaagtaaaagttgcagctccttccatgtgcctccagaacacgtttctcctgcctgtctgcctagggatcagcattaacctgaatttggtctatattatctgtgtccatgctgtaaacttgttctagtgtgagtcttgaaattatacattacatggccttgtccattttcaagctttataataacgatgttatttatgtgatatttttaaaaagcttaccatataatgttgataccattaaacagagccaagtgcacccaggaaccaaagattgtgaatatacattgcccagctcagaaacttgccataaaaaaataaggcagcaaaattcatagtgcgaagagaactgtttcaatggcatttatttgtttttgcagaggagctcctgggtacctcccctagtgtgttccagcagccgttgacttagccactggttgaaagggggtaaacgggcttctctttgatacagagggctcttggcaatgatgcgcttgttcctgtaggcaggtagttagttgatgggagtgtcctccatggcttctctcaccacggcaggggaagttaaacatttttgtaaagaagcaggtgataattggattaccttaacctttctttcctctgcatcgagtgtttgttggaggctaagcagttactatggtggcttgctgtgcgttgacttaaaatctgcagcccttctgggtgtgatctgctgctgttccatttctggcagtgtgcagcaggctgtatgcagggcagggtcactcctggcagacgccgtgggtgctgagggctgccttgtgtctgatgattcctcggatccattccagcatcacggaaggatgtgccattagtgatgaggtctcccaagttagcagagaaaggaaaccttactgggaatttgtatatgctggggtgtctatgtccattggatttgatttagtctggttgttggatttaaattttatggatacagcctgatgtagacaaactaattgtggggctgaggtacagcaaactcttttgcctaacatcttg

SEQ ID NO: 99349 - DNA, 1837 bp, Homo sapiens
tctcatgccatcgagagaggagactgagacgatggagctccttcagttttacccaagtcaaggtgcgcttttggttggggcttccctgggttaaaggtcaccacccttcctgcccggtggcagccactcgtcgtccgcagcacgtcagcagtgcatcggagataattgactcaggaccttgtcaaataaagctgttcattatttcccaaatactgacctttcgtccaaaggcgattatcaggggttttttttccccttcattattttttgtggtattgtccactagcttaacttcgaatttgccattttccaaccatccagaagcaaaaacggaaaatgttaacagcaccttgatactaatcaagagtgtgccgttaaatcgcacagctgactagtcaacagaattttaaaatcattcaaacattaattaaatacatatgttgatgtagtagattttccaaataaacattgagcagccccttttttcctcggctgtgtgaactgcagctttcaagtgtttttctgttgggcgttactttcccatatggcccattggtttctagtagttgaattttgaactttttaaaaaagaattaaaagataattctgtggtggaaaagtcagggggaaagtttagatgattctctttaaaaatgatgagtcagtggagatgaactactgagctgtctgctcgtcggacgtgtctgtgcgcacacatagatcgcgcatgttttctaaatgtgtattggcaggaattctgcaaacaggggcagagccccgtctgtgaaccacagcccttacccagatgccaactttccttttgctttgcagtctcggaaagggagcgacccagacaaagagaagaaaggcctggagagtcgtgcggacagcattgggagcggccgagccatcccaattaaacaggtgagcagcctccccatccttccctccctgtcgccggagatacacctcaggtcttcctggagatgatgctggctctcgcaccaaggtctgtctgatgtgctctgttgatgaatgtagaagtctctcacttgacatcaattagcagagttcctgtgtgtattcaaatgggatcattagaatgagaagagggaacggagacaacagacctaatgaagtgcgggctgcccgcctgcatatggagtgcgtttccaggctgagagctttcaaaggctgcctttgtagcacggctttgattgggccgcgggccgccgggcaacaggggtaactcagatcgcctacaagagccccttgtgatcacaggaacagcccgacgtggccctaatttgctctcacagacggacatctgaacactgtttcaggctggtttgtaacaacgaggcaattagttgtgataatcatagccggtgtgtcagctgtgcgctcttgtttgtaatttgctaatgaaggaattgtaactttgattaggttcggtttcatttagaccttattatataaaggaacatttacagctgtaatgtggggccttaattaaactttctcattacacaacaggacttgaattcaaccatttgttttggcctatgttgctagcctggaacagggtttcattagcccagaaaccagattctaaatcactttatatctccaataagaaaaaaaaaaaaccctggagtccacgtgtgacgtagattgtggtttgatttccaaggagaataaaaatagagttcaaccccacacagtggcttctgaaatgtcatcttttggtttgttaaagaaagccaattgatttagagtgcatccttcttgagcagaagcctctgtgggcaggagaatggctccgcctctcaggcac

SEQ ID NO: 99350 - DNA, 1066 bp, Homo sapiens
tgcaggtcatcaccaaggccctcaggcatctatgtaagatacatgatcatctactgggccgcaaatatatggattggcccggggcacctttaggagaaattctcttccctccatatattcaaagacaacaacaacagaactttccactttgatgatgggtggtgttttcactataaaacacttcagaggtccgtgcacatagttgcttattctttcttggtgcctttatttataacctaactctgcataagctaatgttactgtgtaatttttatgccactgatacctttttcaactggaattataaaaatcagttataaaaataattctttttcataaactggtaccaggacatttcctttggggaatattaaaacttaataatagactgttttcttaatgcctgtctgtggttgatttgggtgatttgggtgggagcgctcaccagcctggcgggagtccctctgtgcgagccaggtgggcccccggtataattggaaccttcattcaatttgtacctgctcatctgtggagggggctagctttgcaggctagcttttcaatatgtgtgcagattggaactgaccatcaagcgtaaaatgagtattatccagtccttggatgcctttcgattgtgaatgttcaaaggaatctcgttgaaatctaaatcatggtctgatttcccggtgactcctgggcacagggagctccttgtccctcctaattgtccccctcttgcagccacagacagctccctcctcacatccacacctgtcccagcaaagtgcccccgtggccagctctccaggcctcgggtgcctcgtctgtaaaatggggaactggatgatgtctgaagcccttgaagcagttagatgtggaggttccacagagaatttttaaatgttagcaaaactggatttttaaatcggggcacccttgtcaaagcctctctgtgcatcggacggattgatgtgggtttgcagacggttgtatcgatctatctcacatccctgtgtgtacccttgtttctaaaggaacatagatcacttcaggtagcctgaattcc

SEQ ID NO: 99351 - DNA, 1383 bp, Homo sapiens
ttcccatccttaccgtgtttgccgcaaacatgttctctgctcttgtcacttgctgcagagaactgtgtcttaatgctcagcccatgtgaaagactcgggtctgcatgatcgaagcctcacacaccagctaatggacctttgcctaatggcagaggagtcgttttagaaccccagcaacctgcgtggagttgctaatgcagactcttctttcccccagcaggagtcttgtaatggatggtttaggatccaggcaaggcagccttcaacactctctgcaatctaaccccagagtttacagatagtacgtgtcgcagtggcttatgttaaccccctttcacttccatctgatacctcgttcgctgtaagcatccaggctccccccacctcagtgtgggagcttgccaaatcatgatggtcaatgacgttgtctctttcttctttctcccgattaaagattccccatcaagaatatgacttattttctggactataacttcatttcttgtggacctgggtctacttctcctttggtgtcctttctggggtcttggaggaggttggttcagagaattcggtttctttttttttttttttttttttactaataaggtctattcgagtaaaaattaagaagcaaagcaagaaaaagccagaggcccggctcagcggcaagtgggtttgtcacgtattaatttttcattgctgtggagagttgtacatacataatcacttgattgcagtgggagttagggagctcctatggtgccatttgcataaatcttgttaagtcaatggcagttaatgaagtacaaatgagcccggagaaggtgacatgcaaatcgtgggtggcagatgggaggtctgtttgggggacagcagctgtgtgctctcctttctttctttctctttagcattttttaatctctatatttgagtacagatacacagtcatacgccttggcctcctccgtgcccttcgcagagccccggccagagaacctgtccatcccctcctgcctctgatgtccaggctgcataaaccgttcaagacttgccttgtacttggtagcgtacgctagaaggatttgaattttttgaaaatcatgctcagtttatctcatcgtgcttacgcaattgaaagcgtatcatttttacttggtggggacacacagaacctcctcactacatcttttgagacgttgtgttgtctcctgaggtttcagagaataaaaaagaatagaagataccatctttgccttatcatgcttccatttgggagtcttttcttcctttttcagacaggccaactgtatttactgattattccccgtccctggttcgtggttggaccatcaggggattggcattcctagggttagtcag

SEQ ID NO: 99352 - DNA, 1083 bp, Homo sapiens
gctggagtgcaatggtgcgatctcagctcaccgcaacctccgcctcccaggttcaagtgattcttttgcctcagcctcccggctagctgagattacaggcattcaccaccatgcccagctaattttctatttttcatagagatggggtttctccatgttcaggccggtcttcaagtcccaacctcaggtgatctgcctgcctcggcctcccaaagtactgggagtacagccaccatgcgtggctaaaatgtcttttcttcaccaaaacagattttgtttgtttaaaagaatatgttatattggagaagttacagtattcattaaattgtattttcaggaacattataatttttaagtcaacattctttaacttttatgtatctaagatagtatgtttaggttacacagaagtggtcacatttttttaatctgcaaagaagaaagcttttgccagtgacccaaaataatttcagaaaactggtttcttgtacaacttttctacttttgagtatttatccagaagaagatttgtttaaataaatgtcttcacatacaaaattttgtttataaggaattcttcaagattaaacccacaaattttagtaacaccggactgtttttgtaattgccaagtttttaccatattgttcagtctctatcagccacagcctctgtgatttcattcatgctaaaaacaagaatgtttatatttttagtgtacataaaaattaattttatacaaatatataaaacagctacacagaaatactagtggagagacgagtaatgtgccaagtaatgattaggcaatgaggaaccacgagaagcagatagctctggttgggtgtgttggccttcctttgctcatatctaaagtattggagatttaagacaatatgaaatcattgtatactaaaatgtatcattaacaaagaatgataaaatcctactctaagaaaaataaggaagagcagagttgtggaaatgcactgctatagtcctgaaacttgacccagtcttcttgaagggcaatctaacagtcatacatgatggacataagaaatttgattcactttgtcccag

SEQ ID NO: 99353 - DNA, 1078 bp, Homo sapiens
gccaatcaaaaagagatacttgtaaactcatttacagcgtcagtgtgtgttaggaccatcattgagatgcttattgcaggagaaattaaagatacaattttgtgctaagaggcaatgtagaaattagttcccgaattacttgttaattgatttggtgattccctcgggtctgcatgctccttttccccctttttgttgttgcattcagttaacagtgactattcccagagcaataaaaatatattccacatgtagatgagatgtgcccttatatgagacggcctgcattctttcgcggtaccaagaaatgctcaacctaaaacacaactgtgtttttctcaggcatattgttgttttatgtatacccatcaaggtaaccggtgcattcacgggtttggataatttcaggaaaaggaaagcatgtttttatgtctcacgtttacaggcgcttttctgatttttctttccccctaatggaaaccttcctttttttatcaacagtggaggagattcaggagacttgatttatggaagctttttcttatttgcaattcagcaagaataaccatatgaaagaccatttgtagaaaagtgcaaattgctactgaaaatgatattgaaagaaaatgagacctgtttctccttgttgaaattgagtgtggatagaaggagagacagccatcgtgggtcagagggagcctcccaggcttcctggatgcaggctcccgtctccagaccccttccttcttgaccgaggggagaggacactgaaatgatgcacatattggtgctgctaatgtgaaagatgcagaaaccgttatccttttgaatttccagtggaagatccaacgaccctttgaacagctgccaccatggtggctgtggcttcattttgaggaaaacatttttaatatcttgttggccgtgcttatggcctgaaaagcagcattaacgagtttttgaaaactattattattcattttaggccagtccgttatttttttctattgcccttcccgtgatcacttatgcatataaatatcattatgcttttgcttaactggggcaaaaatcatgt

SEQ ID NO: 99354 - DNA, 1048 bp, Homo sapiens
ataactgaaacaaatgttctatgaaatgatcctaagtgcatctcactccaatcctccaatctggtttttttttttttttttttaaagctctggttgcagctcactaaagtaatttcatgacccactaattatctcacatattttgtaaaactcacattttttttgtaaaaaaaaaaaaagccagtagcagcactggctctttgtccagtattgacatgttaactgtcatcctagttgagccagccccctccatgtaggccagtctggcgaaatccagtgctgtgtctctatgcagtccacgggcacactgagttctcatttgcccggttggaacagctgatggttagttctcagcgtgatcaccgtggtcagatgggcgccccatgtggtgccttgtgggagaaaagttccaggttttctttagctacttccacaggtacacagaggtgtgctggccatggggtttgtgtctctgcatgttcttccgcatagtatgaggtgcaggcttttatttcatagggacacaccagtgtcagacagaacatggggacaagatcacactgcagattcagatatgccttctgtcctttcaaagggtgtatcctggttcatcctctgtccctgcctgctggaataactgcttcccccgctgcgtcctgtcctcgtgcacccacccaggccacagagcccggtctgtgagcagcaggagggcagagccctgtcctcctctgcagcataacccataattatggctcttaatttacatattccatgcctgccttgagaaaatattttacctggaatgtcagttttttgggtaccatccactggagttcacattcattttcaccagttgttcacttagcagaccattagaaaggaggtccctgcgaggtccccgtgagaggataggaaaatgccatttaaataaaaggtcagcaagagcgagagtctccgaagttagacaggcatccggagaaaggtggatgtggaaagtgaggttgacttctgggcgcatgtgtggaatatccaggcccttagaggctcg

SEQ ID NO: 99355 - DNA, 1151 bp, Homo sapiens
tgtgcacatgtagtcccagctacttgggacactgaagcaagagaatcacgtgaacccaagaggcggaggttgcagcgagcagagattgtgccactgcactccagcctgggtggcagagtgagactgtgtccccccacccccccaaaaaaagaaaagagggaatgccagggttactttacaaagctgtagtttgtttaacacatttaattgacaatcaagccatctcacaaatgtaagtaaatggcactattgataaataacaggcttgccattggtgaatattttgcctccaaagtgattttgctaaaagtatgtgtatatacagtttctgtaacatttcatatggtaggaggaagaagaggcactgtgctttctgaagcatttattcctccttagaatttttcccaggggtaagtgttcagaaaatctgaagaattcaaaataatttgctccaaaatattatgatgtgattaactacgtattgtaccagccagcatttactgaccatatgtatgtattagccaccatcagtagttataaaaaggaaattgatttagtgagatacagtctacacttttaaaaactcacaacctagcaagaaagtcaggcttgtctcagtaactgctgtgcagatctgactgtactaggtatgcactagaatgtgccaggggaaccccgaagggatcatttgcttcgctttccatgtgttacatccatccccaaccttctagtattttctacagatgacatttagtgaacagaaagcctctctctctgaccctaattgattaaagactttttttttttaagaagcataaattagaagtgaacacaactttttggacttacaagtgaaaaatccagtgcctaagactttctggtgaaatgttgccgctcgggaatttcagttggaaacataaagccattcattaagctaacgcgggtgtacgtgaggtttattcaagagataaattgctggtgtgttggtgtttagaacatcaactctgtcggatatttcatgtgaccgaggtctgagcatcagaatccatgcccatgccactgctctccccaggggcctgagtctgcatttactgtgaagcaatcttttatggaaaaaacttgcaaaaaatagaatgagtttgaaatagaaa

SEQ ID NO: 99356 - DNA, 1039 bp, Homo sapiens
ttcccatttaaaggtgttcatcagaatcacctggagagcttaaaaaagcaaaaagcaagccgggcacagtagctcatgcctctaatctcagcacttcgggaggccaggagctcaaggctgcagtgagctatgatcgcactgctgcactccagcctgggcgacagagcaagaccccatcttaaaaacaaaacgtgatgttggaggagccagactctaggctttgggaaggggctttcctggggagggcagatttgttgagaatccattttcccagcgagttcgtttccacccccttaagaacaaccactttagaagaacattaggcagaggaaaggggctcctacgtgtacctcctttccaggagatgtgggaacaggaggagtacttgccttttcatacatgaaatggttttttatttgcagattatcatttgaaagacattttggtagcctgatttccactcagaaatagatgtcaccaacacaggatgagagactcttataaagaattacgaacttctgttaaaatgagaaagtcaatgaagggaggcagcatacccagaaaaggggaaaattaaaatctgaaataatttatgaggaaaataattttccatctaagagtgtattagctgtttattcaaaacccttgatgggaatgtttgtaatcaggtcatattgtgatcttcccacagcctgtggtttctgtttttcccctcctggccttacagttaggggagttagggcaggttccctccagaggtgacacctgttgacaaccagtctttcatgacagcaagctgctgtccattctgatggcttcagcctctgtgcattctgatggcttcagccgctgtccattctgatggcttcagccgctgtccattctgatggcttcagtggacattgcagtgaccattaaagtaaagtggcttagagacataacacggcgacatttatgtaggggcagagaagacaaggctgttcctctccttgttctcacctttgcccagaaagtgttagaaacagcctcttccttagcc

SEQ ID NO: 99357 - DNA, 1024 bp, Homo sapiens
ctgtaggaggccaaggcgagtggatcccttgaccccaggagttctataccagcctgggcaacatagtgaggccccatctgtacaacaaataaacagattagccaggcatggtggtgtgcacctgtggtcccagctactctggaggctgaggtagaaggatcacctgagcctagggaggttgaggctgcagtgaactgtgatctcgccactgcactccagtgtgagctgtgagagagcaagaccatgtctgaaaaaagaaaaattgtagcttatcatttagcaattcataaataattacctgtatttgtcaaacacttcgtacatgttaggcattgtaatttggctttatgttatgaatgcatttaattttcaccaagggacgattccttccagacagctctgagtttctgttttccttggttgttgctgagagcataagttatattcctgcctataggctcatccaggccgcatttcctcctgatttcctgtttcctcacccgtatcctgctgctctctctcttcccctgaagctctgggaagtcttccctacacgctcattagtgagttaaggaactttgatgtgtctccgtgtttagaagaaatcttgccgtcaccactccatgcagacgctgggatactaaggttttcacctgctgcttcctgcgggatgtcgctcatgtggaggagggcctctcgttggaagcccaggctcactccatggctgcccctctccccagcctgctggcgttgggcttcctccgctcctggtttcttagttctggagcacagactccgtgctctggagcaagagttcttcactgtggttctgtagatagaattcaggggtccgcgaatgtggctggggggaaattcattcgtatttccactgacttcgactgaaagttaacgtttccttcagatatgaatgtaggcaacgatccacagtggtgttttgttagcagaacctgtgactttgccaccctcaaaatcacagacatgttcacagcgcattgccgttgtc

SEQ ID NO: 99358 - DNA, 1140 bp, Homo sapiens
gcaaatgccattcacagcctcctgagtgatacctttttctaggcactgcttggtttctgggtgccctagacagggagtatcccaccggttacactctctgtcactcgccatcatcctgaggatgctgtttccataagccatggctcatacagccgtccccactccaggttaaggtcccttgcctggctcctcacagtgccctgggcatggtcctatcttggcctagctttcactaaactgcatctgtccgtccacctattagagccacctgccagtgttgagcctctttagggattggcctgtgccctcatcactccacccacacccagcacagtacctgggatagagtccatgcaaggtaaatgaataaggaacaaggtcctactcagaggcaaatctcttctttctaacactgggagctattcagctgcctgtaccatatcagaacatgcttaagaaaaagagggaaataattattgtctcaacaaagatttgggtttagcaaaaactggaaataattcacagtgaaactaataatccattgattgtgatgtccatggtgagatcattactctcgagaataatactggtaatttagtttgctcggaaggtactattttcagagtacttttacattttccaaaccctgctgtgtgtgttgaaatgtaaatcacacagcacccagataaccagatgattttcctcgtccttttaacagaaagatcaggtgagaacacacagttgcaccttgatcatttagtgctttaacttttccccccagctagtaagtatttgaggagtttctctcatttgggctctgaatgcttttctgatagtggggaaggttttaggaattgtattcggggctgctttgttgttgctccttcctgcccatctcagtgttaagggttgtcagtatcccaagactgatttccctgtccgtccgtgtgctttggaggtatcctggccatgttgttccttaaagctctaagtagaaatgactttgttccttggcactatgttaaattggctggttaattctggtgttatttaccctgtaattcattagtttcaccccaccattggcagctgacaggctgtaatttcacgccttgcaataaaagatgtctcataatctgc

SEQ ID NO: 99359 - DNA, 1043 bp, Homo sapiens
ttttcatgtgtgactctggagggtttctggagtgagcagaagcccgggcccccttatgcctgtacgctcagagctcagcctctgcagccacgacttctccatgctgcggggatgctaggcctggataagggttgccacctgctgggcatggagtgtccagcctcacccagcccctcgcctggcccttctcccttcctcatggccgctagggcaagccctcacttctccaggacagatggcctttccctgctccaccgtccactctgcttcccgcccctggaggggaggaagacgagcatggtctgggcgcccagtgctcctgtccccatctcacacatgtgtggaacaagccactcacaccctgacatgctcccctctccctctcaccacgactctttcttggtcctgcctttctcacttttccctctcagccttcttcatagcctcttcctcttccatggaggacagggcagaggaaaggtagggaggagcattgatgcctcctgagcaggtctggcctggcacctgcctttcccacccaccccacggtgtcctggccccagggctctgcagcccacagcacctcttaacagtgctgtggacaaattccggcaaaccgtgggttagtaaccggacgacgttagcaaacacagaggctgcagttgagccaaaggaatggagattctggaaggaagatgtgcgtgttccaactctgcagaaaagcagctgaagcagtgggaggtggtctgttatatctaaatgcaatggaaatctccatagccacaagtgactggcctctacctctcttccaatcttgctctactaatgcgtggcctttctgtagttctgaaaggagccatctcccctggggcagtgcctgatgtggtctccttggtccccttggtcctagcacctctgcattatgcaccctggcaggacatcagccggctggctctgccaccccgcattagtgtccatgcaccttggtggagaagtcgctctgagcagctctgatttcagaggcctcacttgggaaatgaggg

SEQ ID NO: 99360 - DNA, 1087 bp, Homo sapiens
aaacggagatgtgcaattatttaatattgttgatggggcccataaaacaaatagtaccaaatctctccctgtgtacggccgtcagcctccaagggctgttctcccactgcagacacccctcctcttaccaccacaatatctgaaccaggcaaggagacaattgttacttgatgactgagcccactaatatgttacaggaaatggggcatgaaatgcaatactttatatatagtatgtactgtgtgagtcttccattgaaacaaggccatttttagcttgctgatacaatatttgcagtggttcatcattcgattgtcctgattaacaatcaacttctataggggaccatttgagtagtttttttaaatgtgatgaatcagaggatttgttcaacatcacttcatcctcttctttaaatggtaattggcacttgggaacttgggagtgaaataaggtgtggtctgttctatgtggtcatttccagaagtgccgttttgaccactgctgtgcctttcatccagatttttgcaactggtaaaggtgtcacaggcaccattgaaatctactccctcatcagggaacacactcttgttgatagcaacagcatgcaatctctgttacagcctctaagttggaacagagaaggctttcgtagaggacatttggtggaaatgaaacacatccaagctgtcccacgttaactgtcacctctgtcacccacatgcactacctatgtttagcagggcagcctctgcctgtgatttgcagggagcgcatgctgacagctctcttccctctccttagttccaggaaggtccaggcagttgaactgactgcttgtctgtagaaagacccactgtgtccctgggggactggtaggtaccctgattcctgcttatcaggggattgattctgggcatgacccttcaccttctctgtgcatatctgtatcttacctccatctggtcactagttccagtaacttggcatttccttaaatgaaacattaacatctgtagaaaagatctctctgacatgttagatgtaacatgagttaaaaagtcccatttgggaggaagagaaccat

SEQ ID NO: 99361 - DNA, 1031 bp, Homo sapiens
ccagcagccattaagtgcagatactgtcgtccctggtgtcgtccctgaaaatcttgtgacagggagagacagagtgaaaggaaagaaaaacgaggcgatcaagagataatattaactagaaaaatcaagaggggatctgtcagtcctggtgggaaaaaaaaacattttgtttttcttagtttccttttccttttcttttctttcctttggatggaggaggtttggtttggtcttagtaccccagcatacagtagcttcattggctttttttctgcccatattcaaaattcctttgattagcatttggttctggttgggacttaataatgctagccagacctaatgtgaaccatacatctcgtcggcattactcatcgtcaacatgggtttttaaaagggaaggagagaaacacaacaaactttttatttctttccctgtcattgttcttggtcttgttattcagtggacgctgtattaaattggattctgtgtccatcattattaaaatgtgaagtgtgtcggtcacaaagcatacatttcggggcagttagctgaataattcttttctttattatcccaaattactgctgagctctggagaggggagcagtttagccaattattgccatttgagctggatttgtgggtgattagctcctggccgaatccagtcccggccggcgctttgaagcctgtgctgtgcgattttctcagcagtgaggtaggaatagacgcggctaatgacaggaaggtcgcgcgggtgagctgacctgtgtgtggcgcagccttgggttccgcaaatagggcacccacagtaacacgtgtggcgccgaccccgccgtgcgcaatcggggctttatacgattgctggagatgctgacagctcaattaaagtgtaaccctttgtgccctgcaacctggcacaacgacagaaatattactcgccggaaaggggagggggtctttggggagctggttaaagatccagaatcggcccctcgcccctttgcccctcccccaactccctcca

SEQ ID NO: 99362 - DNA, 1029 bp, Homo sapiens
cagtgtgggaggatttatttatacagggacaccagtgccacgaagtgtggttcaatgggagccgtctttggagaacagataccacgctggctgtgcatgttgggcaagttacataagcagtctgtttcagtgtccttatccatgaaatgagaatcgtcgtggatatcagttgtgattgcagttgatgaaatatgcagttgtgaatactgagagattggtattcatactctttggaacccagttaaaggtgtcatatcaattcctgtccatgaaatgaggataatcaatgaccatctggttgtcatgcactttcagtgggttaacagttgcaaggcacttagagcagcagcatctggttcagagtgagcccaatattgcatagaaataaaaaaaaaaagttctaaataaatgccgaagccacataggagtcaaagaaagcgttaactgtaattgatgtcttcactgtgacagctggacagcaagaaagaatcttaagcagagatggttttcacatgtacaaaagtggcatctgaaagatggacaaagtatgcatggtgacatgccaccatgccgctggccctgggttatgcagaatcaaaaagacttaggatcacaggggccattggcactcactgacaggaactctcttcctgagcatctcaggcagagccttccggcctctgtcatcttctggccagtaggatcacggcttcatgtcctctaaaagtttcaaatgaactatttttagggttttccattttcttggtccttagagtaggaagtgtgaaagttcggactgattgaacatagaggaggctgtctgcgcgctcagcccagaccagtgggggccaccttagtaccacttcctccctaaggaaagcgacgggccccctgtcttccccgattggtttccatttagctgctgcacatgggggatgctgagtgtgttcagaggggcgtcccatggtcgaactggaacttgctttgggaagagtgtggactaagaaggggcttggcttgtgttgccac

SEQ ID NO: 99363 - DNA, 1016 bp, Homo sapiens
cgtctcaatgtgtttgtgtcgtatttgttgaactaatggcatatcttttagcattcgccagtatcacagagtgaagttctgcacacacacagaacttgaatgtatatgttgcctgtgtacctgccttttcttttttttatttacattagaatttctatttggctctttttcccttgtagggcatgctgttgaagcgaagtggcaaatcgttgaataaagagtggaaaaagaaatatgtcaccctgtgtgacaatggcgtgctgacctatcatcccagtttacatgtgagtatagccccctcggagcaattaacagctgcagacctcaactaaacactgtggggaaggggaacctaccagcagcccagcctcttgtctctgtttgaagtgaaagtcgtatttggtctcctgctcaactgtgagataaataaccctgttcctcacactccactagaccatatgtctttctctctcttcccctccctaccagtcaatctgtggctttccaattctacaaagaattacaataaaaggcacagatgaagtaaaattttagatgagagtaaaaagacaggggcaaggagaaaagagaaaggagagaagagtggtctatctgaaaatcgagaatgaaggaaacaattacatttgaacccaggatttagctttgaaaagctgtgaacaataatcagaagtcaaatgcaattcatgactcagcttttattgtcagataacacattccagtgcattaggcaaaagaaactctcctctttgtgttatatgtaagtttatgttacatataagtttgttatatccgtggtgtataagatagatgtataaacaaaattaactttattcttggggaagaaatgcagacgttctacccattgataaaatataaaaaaatgcagacattctacccttgataaaatttaaagttggggtgttctagtttcatagcaaaccattccataactcttacttgatgcagagaaatgtgtagattagaatatatggtgg

SEQ ID NO: 99364 - DNA, 1066 bp, Homo sapiens
tcaacattgacaatcctggctgtgctctacagattgtggtatgattgagactaacagtactcaccatgtcttacaacatgacctccctaaactgacatagggttgggtgaacacacacacacacacgtaatcactgcctcacgtggcattattacaaatgctgcaaaatctaaacacatcactggaatccaaaaagcaatccatttagaggcatatgaggagattgtacggatattaaagaacaaagatctggaactatggcaacaaaccaacgttgctgttctagcctgagctgcctgttttaggcaaatgggaatgcttttggaaacaatatgaaccgcaacgggtatttctgcaagtttctaagactggcaggagtcagctcgggggaagcaggaagaatccccagttggttggctattcttgggaccgaagagataatccccattgaacagagcctacactcacatccttgagtccgtgatgttcttcgcttccctgggaacagccagagtccagctttccgtgtggattgctttcacagggatatctggcccttcaagccagtggtgtgaatgtcaccccaagaaccttgacgtgtagatactgcctacttcaagtcatactgcagctctgcctcttcccaagataggatttgaagcagcttccaacagaaaatggatgtgaaaatgtattgtgaacacatgcataggaccatacatacatcatacacacacacatacacacacacttaaacatacacatgcacatgtacacacacacacacagctatgggcacaacttcatttcaacttgtagattgtgaagtaaaggcattggaactttgtggcttgcaaatctaaattacctccttccatcttaagatctcttccctcctttattctaaagtgtgattcggctcctctcttagctgatccttctggtgtgcaggtcaaagaacactgagctgggaatcagttgtggtttccgattctgccgttgccccacccgcttccatgttggttccaacgtggctttgtggagtcctgggactcaggcacagtgt

SEQ ID NO: 99365 - DNA, 1049 bp, Homo sapiens
gtgggagtttgtccgtgttaccttaggtctcatggcagaagacatgatgtagcaatcgatattcacctcagaggacagatgtatatgctctgctgtcttaaaactctactgtttggccgggcgcggtggctcgcacctgtaattccagcactttgggaggctgaggcaggcggatcacttgagatcaggcgttcaaggccagcctggccaacatggtgaaatgccgtttctactaaaaatacaaaaattagccaggcatggttgcaggcgcctgtaatcccagctacttgggaggctgaggcaggagaattgcttgaacccaggaggcggaggttgcagtgaaccaagatcatgccactgcactccagcctgggcaacaagagcgaaactgtgtcttaaaaatatatatatactgtttgttttagcgctgcacattttagcaaattcgtccaaagaaatctgaagttttaaagagacccagacaggcagtatcaccatggtgaacatttccttataagtcaaaatttctaggatctaactattgatccagttgtttcaagccatattcaaatattaaaatactaggacagcaaaggaattgtgttggctccttgaagttcattgtaatgagaggcctacagtgactgtgtagagacaagcagctgttttcatatccgaggcatgcatcgtacaggctaggtttgagcaggcatgggttacaactgcgtaatactcaatttaacctagaatgagaaaaatctttcaggcagtgtaaacctcaatacagtaggtcagtcaagacagatacagtcaagaagcaaaaggtgtattcataattcgatttagaattttctgctttttgatttgtagtagaataacttaaccctttggactggtggacttgagcccacgcatgttggacactggcctccgcagcacatgaagcagagaagtctgcttttgccatcatgtagggactctccactgtacatgaagctgccaccactggtccccaacaaggcctcaccagccttctcgtttaccacgtg

SEQ ID NO: 99366 - DNA, 1032 bp, Homo sapiens
tttttccatgtcatacctgagaaaatgaagacatggactcaaaggtcgaaatgtttaaaaatcggtagcacttctttttttaagtgtattcagagcatctgtgagacttttttgtttgtacttaaagagcatgccagtgaataatgtgatgatgactagtacagtttggggctactactttgattcatgttaatcaccagcatgtttgcaccatcaaaacaaatttcaacacagcaataaaaaggcaagtactgtatctgaattgttttgaaaatcttattgatttgtctgaaaagtgatctatcttttcagtattatatattaatataaaatattatatttctcaacatacatgtacagttataaactagaacttaatggagaaaacgaattggaacagattgccactattttccattatttttttccatcatttaactatgtaaatttaaagtcttaatacttttttgaagtatacgtaaaaatggagtatgctgattacattttctatccttgaagaaagttgagcttaagcactgtcagattttcaaagccatatggttatttctgatctaatgttgagatgccaatcatatagtgtatgcatttcagtttagctttaagatcttgttaactgcttttagtacccctgtgaacacatcagcaaaccatcttttcaccagacagccaaaggtaacctccggatgtgaggcagtgagaatcaatatagtaagggtatttttagggactgttgatggattgctgtattttgagcttaacttcaagtgccaaaggccccagagctgactaagatgaactcaccatttactgaggacgggagaggccatcaggcacatagtgggatctgggattgccaagacaagatgtacacacctttccctttgtagttttggggagaattcttgtatattttttagtagcctaatacggtattttgatgaggactttgtaccaccctccttgctggagccaagtgttactcatttggtaacctcccggtcctgggaacac

SEQ ID NO: 99367 - DNA, 1095 bp, Homo sapiens
aacaggattacatgcagaatgttcatggtaaggagattgaccttctgagaaccactgtgaaagtcccagggaagaggccaccccgagccacgtcagcctgcgcacccatctccagccctaaaaccaatggcctatccaaggacatgagcagtttacacatctcacccaattcaggtaagcttacagcaaatgcactaacaaatcaagttcaacagcaacaggtggtccaggctcgaggataatgttggactcctaggttaagtggagacagtaactatcacattacagattaaggtttagaaacctgatcacttctgtggctgatcatttcctttaaactttcagttccgcaaatgccagcgagcaaatggtgctttgagtcacagctgcaaaaaccatgcatctaggcctttccagggctgcatagtggaaagtgaagttaacatgtgaactgggtttttaagatccttctgaaaaacgtgaattaacgttaaagtgtcaaagattaactcatttctgataactgtatgtatgaaagtggaaaaaccattcggagcaagattcagaggaaaccatttgacctatataaaatgtaaattctgtgttgttatattttaattatctgccattctttaatgcaactttagttctctgtattctcttttaaaggagattttttttcattcaggatcagagaaagctgtattttctcaaatgttgatgtgtttagaaattcctggcctctgtgcccagttgcaagccatccaaaatgacattgttcattttatttacgtttttgcaaataattgccctgtgtcatgaaccttcccatgtctgctcatcagagataaggagaagatcctcttgagccctcccataaacacacacacagagtcaggctccttcaacatggggacatcccttcaagaatttgcattttctcctgcagaaagtccagaactttcttctctcccacctacatccagtcttcttaaaacagatttctggctaggcgcagtggctcacacctataatcccagcactttgggaggctgaggcgggtggatcgcctgaggtcaggagttcgagaccagc

SEQ ID NO: 99368 - DNA, 1017 bp, Homo sapiens
gcagaggttgcagtgagccatgattgcgccactgcactccagcctgggtgacagcgagactctatctcaaaaaaaaaaacagatttctctcctatgagagtttctggtctttgatgctgcactttcctcttctgaaacatcaagtgcttttaaagagggatggtgctgactgcctggttctgaggcatgaacgacactggtaggtgagagcaagatggtacagaggagttcaaatttgggtccaccatcctgggctccgctgcatagtgttaggcagtcactgagctggttccttcccaccacattggggtgctcttgcctggcctgcctgtgttgcaggggggcggtgtcagaggagacaacatgaaagtgctgggaaagctggatacaaacacaagctgttgtttctaatcaaagttaaaactggctttatgctaaaggagtctttagtgcctcccaaaaaagtgagaacagtatttttccaggggcttctatgacctgctgacctttcttccaagacatccgtgagatttttcttattagagcggtgtgctaactatggggtgggaagagagaaaagaagggcacaagaaagaaaaaacaatccgtagtgagtaaaatgctgaaggctttattacattagtacgttacataaactcatgcatttattcaaaaaatatctataggccaggtgcagtggctcacgcctgtaaccccagcactttgggaggccaaaatgggtgaatcacctgaggtcagaagttcaagaccagcctgtccaacatggtgaaaccccatctctactaaaaatacaaaattagctgggtgtggagatgtgcgcctgtaattccagctactcaggaggctaaggcaggggaatcgcttaaacccaggaggtggagtgcagtgagccgagatcgcaccactgcactccagcctgcgcgacagagtgagactccgtctcaaaaaaaaaaaaatctatcaagcacctattttgtgccagaagttgtgcgcact

SEQ ID NO: 99369 - DNA, 1428 bp, Homo sapiens
tttggaataactgtccatatatggaatgattcattcggttggtataaccatttacagggttcttgatacacatttccaaattaacttctaaaaggttttacatgaaaactcttcccatccatagccatcaccagtttcacctcacacacttgctaatgctattaatattattgttagaatttatgctaatctgatgagcgataaaaatgcctcatgttttgtttatttggatttctttaatcggtaatgaagttgaacagctcacatgtattaggtgtatgtgtttcttacgttgtaattaattgtttaggtgtatcctttgcccatttttgcactaggttctttttcttattgatatctgagaactccttgtatatttaggatatgaatatattttgcaggtatttccccagtttattatttgccttttaaattttatggtcttctttacataaaaaggttttccctcttttttatttataatcagattatcttttactgttgtgatttctactttaagctatttagaaaacctttcataatcttgaaaccagatcacagtttacatatatatacttctaagttttaattttattgtttttttcccttaaaaaatatatgtatgtgtttatgtgtgtgaatatatgtatatgcatatatatctgtgtgtatgtgtgtgtatacatgtatatgcatgtatttagcccctaatccacctttaatttgtttgtgtctattgtgtgtgatagaaatctaattgaattttttattcaaataaataatcaactgtcgtttttctctttgttgaattttttttctttccctattaattccatatgttgcctttgttgtagaactcaatcacttcatcaaatgggctgtgtttctggcctctcagatgtgttccgagacctggtgtccctgcattgtcttaccttatgtagatttaccacagtgtcttagatgtatgactccgtttgtatctggtagtataacacagttgaatatttctcttttatcttccagtttttcttggctactgctgcctgcttatttttcctcaaatgaactaaagagtaacttgaaaccttctcctccttgataaaaataatcccctcattggtgcacatgacatcaggacctcccgaggctgtgatacgggcacgtaaataaaataataaaaataattctatcatggcttttaactggcattgcttttaagctatgaattgtggaggaagtggcatctttactgtgtggagttccttatcgtggaacactgttctttcccagtttattcaaatttgtattatagcctccagcaaagttcagcattttttttttttatttagctgctggacatgtcttgttaatctattctgtttataatttttggtgcattgtgaagctaatcctttttagagaggc

SEQ ID NO: 99370 - DNA, 1960 bp, Homo sapiens
ggctcagtcatttttcctttgagtgacagacgcacagaagtaattggctgtgcagaatggcagctcattggcggtacttaaggatacattatccccgttgtgtggcccgcagaggctgtttatcaaaactgctcacactgcagacgcggagtcgcgaagctgctgtttcagtggtaatagctattaaaaaaaaataacgtgacatcaaaactagacccgttgttgtctcatggaaagaaagtttttctttgtttagtttcaaacggtctagaaaacattataataactctggagtccggagtctgttgtgggccctggatgagcagtgtcagtccacacctgtcccctgccggcatgcggtgtggccaaggcttggtggaacacagatccttgcttcccactcatgtcgaccaaggtcactcgggagttttccacacattggatcttggttacaacatataaattggaagcttctgctaagtacccttctagcaccttggtagaccatttgcaaatggaagccttactggtcgagaattatttttctgaaataaaacctcaatatcagtagcatgtgatatctgctttcataaaccaggttttgttggaattggttttaatgtctatttgacaatttttagggaaaatgttaatgttttgtgaggcttctcagacatcagaaagttagctaaatctgacattagaggacactaaagttcatcttagttctttttaagaattgcagcatcttcagcttttatgagcaatgcgttctcactattagttgtttccgtgtttatacattgctcccactgaggtttaggcaaattcgtgtggtattgtttccatcattaaattgtaaactctttgaggcatacactgttacttctctttctttgttatcctctcttagttttgtgacctagcaattattttctcattaggtatatattcctgcatgttacccatcatgttaaatgtaagtgatggatgttgaggagattagttgctttcctgcagataatgttcccctgtagtagctctctgtggtcctgagcattggtgtgtaattcagaagtaagtattgtacttcctaaattaaggatagcttcaattatttgaactctaagtggagtgttcttttctgaaagaaccaactaaagcaacttgattcctgatgatttcagctgagacatatcaggggatggccaggaccttgagttggatgtggtaacaggtgtgcctacaagtaaataaaaggtgcttcaaacactttttttctctcaaaaatgtgtgtgggcagggaggaatagtgtttcagctgctgaactgatgcttccgagaccagcgaagtggtctgcagggtcagctgtgggaaagaggaggtgcccggaagagcctctgtgaattacccgcgccccctccaccagggagccagctgccagccccgggggccagtgagaaccgaggccttgggaaagggcttctggttcttccaggctagagttgagtccgtggcttccctgcttcctgcagtcctttcccacactggcagaggagagtttttcgaagtaatcgtgacatttttccatctcgaaaccttgtggcccattgttttgagttaccactcatatagtgaacgtttgcgtttctggagtatttctagggagtggtcaaaccccgtaacatcccaaccagcaaacctgtaaaacccgcctcatgttatcagacttgtgagcccggggtactccttggtgctttgtcttccctgtgtcattgctggattcagttgtgagatcattttgtaagaactggaaagcagagaaagaagtagtagtgaatacttctcaggatagagctgtggggccacctgctcctggaaggggactgtaaaattcagagatgaccggggaacgctcccctcaaaacagtgttgtcaaatgaaaatgaatttcatgtt

SEQ ID NO: 99371 - DNA, 1042 bp, Homo sapiens
caacaaaataggcccccattatttttttccttgacatcataatttagaacagggagaaagcagcatacaatgagctgtttctacgttgtaggaaagagctgtgtaattccaggatgtggaatcctaagcctggccacgttgctgtatttagtagtaattacatctgtcattgtgactaggtctgaactctgtactctgtcttgataaacataacatggaaaatctcttaactaaacaaaaggtatcaagaaacaccagatttgtgtcttcctagtagatatgttgaattgtactcttttacaaaacaagtatcacaggatgcagagtcccgaatgcctacatcttataagatactgaatgtgtccttggaaaaaaaatcctctcagcctgaaattccacttgccaaaagcaaggcagatctccaatgcaaatacaggagcgaatgggccccattcacaggccttaaatcgtgtgtctcactttttatggtagtgttgtgaattctgttctttttgggtttgtaattagaggacagaacagatggcgaaggcctagtttgaagtgatgtgactgttaacgtcgcctccttcatccagttgtgattccagggaacccggttttcccacacatgcgcacaacgggcgtggtgcagctgtagggtttgcaaggtagccgctcacgctgagtttttacagcatttgaagctgcctgtgaatgagattggaccgaagaaagccgtccctggatgtttctaagggtgaaggctccataggggaagggtgaattcttgtcaatcatattcctgtaattaggatttgttaaaatagaaggtatacaattctgcagtgggaataaacgtctgttttacactcaagtgctcatagaatcctttttggctttttccccgccctctttctatgtacatgaaagttcctatcgccatcaccaagagttgctcctcttttcaggcttacttaaccaataagtcaaatgccagctattattttcctagttaaatgctttggtgaagttaagtcctatt

SEQ ID NO: 99372 - DNA, 1016 bp, Homo sapiens
gggatataagtacagctaaaattattctttggaaagaatctggcgcttttgacacatggaagcttgcactaatcaaggcagctcagtaagcacacacacatatccatatcaaggaagtggcgcagcgaggacatggattagcatggtaatgcagtcaccccctgctaatcggggcgagtaccagctgatccgtagatggggtatttgaggaaacactctttctgagttcagaatgggccatgtcgtcagtcatgtatttcatggtaacgcaaataatatttgggggacgatgccgaaaaggtccttttatgactgccttcctgtggaagccagcatcctatactgtttggggctgggccactttttaaggacttattgctggtacagctgtttccttgtacaaccctgttctgtctcttacacttcctgacctgacctctgcattcacaagccattccaatgacattttctaggtttttggataagtgttactggtacaacatacacataagacgcacagaatcataagtcatagccacgtttacaggggccgccactcacatccagaagcagcaggtagccagccctcatggaccccttcctgtcccgtgcacccccaccccaccccaccccactcacaagggtgaccaccatctgatttctcactccgtagatgggtttcgcctgtccttggacgggatcctaacagttggcactctcgtgcttgtctccggctctgtgttctgtgtgtgatgtcaccgcagttgtggcccgtgtcagtagttccttgttgtcattgggtaatgttccgttgtgccgtgatgtacctacagtgatggacagtgccgtcattcccagcgtggggctgttatgagcagtgctgctctgaacattctagcacctactttttggtggccatgtttatgtgcatctgtatgatttaaatctgaaagatgtgaaaggagaagagaaatcttaaaggaggaaaaaaaaagaagtggacttgaaatgtttta

SEQ ID NO: 99373 - DNA, 1016 bp, Homo sapiens
atagtttctgtctggcgcttccgtttgccatgcaggcaggacaggggctgctctcggtggtaaggtgcactatgtgccagcgtgtgggtcccatagactaactcgcgctggtttctgtggtctgcagtccgcggtggtgttcacctgacttgtttattcctagggaatgtcactagtgcatctgggtctcagatggcaagcggcatcagcctggtctccttcaacagccgacccgacggcatgcaccagcgctcctactcagtctccagtgccgaccagtggagtgaggctacggtcattgcaaactcggccatcagcagtggtaagagggggctcagccccacggacccgcagccacctcaaggtccttcgttgtaagccaggggctggacaggacgccctaagctctcatgctcctctgggagcgcagcaccctgtggggcggctgcatcagagactcacatcttgcctttcatctgtggaacgttttgtccttgctaggctgtcttgcccctgtcatctcatctgttcctctttggcacagggaggaggtagtcatcccatttggtcagtttggaaactgaggcggcagacagggcaactggcttacccagggtcacgtgacagaagtggcagcgctgagaaataagatctgattttatctccccaatcacactgccctacgtggcgtggcccacactcttccaccactagtgcacattttatatcattagggtgaattcagtctccttgtctgttttccagaattcctggtgtaccctctaaattctggagtcccctttgtaatccttcagttttcaaattcctttggcattattattattattattattttgacaagtgtatccagctttttggggaataagcatgcacgttggaaacgatctcgccgtctgtgtggagcgtgaatgacgcagcaccgagggcaccctggtggctgcagcagggtttgcctgtggcgttttgtctctggcctgttcaccggtatttaaagg

SEQ ID NO: 99374 - DNA, 1053 bp, Homo sapiens
catttcttcacgtgactcttccatgtggctcttgagcctcacttccctcggcctcccccaggccaccacgcagcctcgtcaccatcgagcacaaacaccatgtccatcttccacatggaaggagtgtatcacatgtgtgtgtgtacgggtgtatgctctggtccctgtttccttctggccacgtaatcattatatctttccagtagactctgtggttataaagcagccgatcctcaatggaaagcatttgagtttttgccagcttttaaatgtcttttctcattataaaaatgttttgcacgtcgattttgatgatgggggttcgaaacatgagtttcagcttcggaagctgtctgtcccacacttactttcggagccaatgcatttgaaccacactttccagcaagcatgtccacaccattcatcaattttaatcattatagttggagcattttttttctcttcttggatattatactgacaattttagtgtatgaccagcaggcggcggtaatgtgatactgccggtctctgacctggaagcttctttgatgggagggtatcagtgaagcgtggtggggaggaaatacatgtgttgacagcctccgctgttgtgaccttcatgcctaacactcgtttccctggggatcatcatctctgataactgagcttccaaaaggctgagaaaccaagaccatacttatcattattagccaaaattcaaacccagatctttctgatttcaaagcttgtaatcattcccctctgcttttttttttttaaggagaaacgcatgcttagtactaaaacattgtatcataaaaattgtttgtcttttgatagcgcttgcttttcaaggaaatatgttctaagatggatagacattttgtcttctctcactgatgctgaagtttcctttatcaattcttcccaaatcttggctggcattcaaaagcgttccctgggggttgtcatcaaccttcagcttagctcagtgttaaaggcccctgggctctcatctctcaaagctgggcactccctgcctcaccgccg

SEQ ID NO: 99375 - DNA, 1054 bp, Homo sapiens
tttctgtggtttgctcagttccacaacctaggaacccaacaggttaagaaccgtcaatcatactgcctccctggtgactttgtcaactgttagaataacattggtcaaatctttttcatttcctccctcacttccttttgtagattttataaacacatgcaaaaaggcaaagacctaaaggacttaatttttttttttttttttttgacacagagtttcactcgtcacccaggctggagtgcagtggcacgatcttggctcactctgaggttcaagtaattctcctgcctcagcctccctagtagctgggattacagccgcatgccactatgcctggctaatttttgtatttttagtagagacggggtttcgccatgttggccaggctggtcccgaactcctgacctaaggtgatccacctgcctcggcctcccaaagtgctgggattacaggcatgagtcaccatgcctggccacttaaaattttggggggtatcgagaagaaagaaaggcatggaagaaatgagtgttggagaagagtggtgtttaaaatgaacaagttgttacaagatggttataacatggctaggtcgagagacagccagagatgggtgacagagggtggggtgtggctgagcaagcccactgtccagcttctccgttaggatttgtatgttactttggttttgcattcttaaacttctttcaatgaatatatcatgttacatcttggctttattatgtgacagataaggttattaacagaaagtgatattaatattaattatacaatgatactaaaaattttatatcacacagaagcagatggttatttttaatgacttaaaattttactcttttatatgagaagaaacattttaaacatatttagttataaatgctattttaattgctacattatttctgcagcgggatttttaaaatcttactatagttgcagggaaatatttctatgtatatttcagatcctcttaaattatatacttatttacaggaaacaattataattacattgagaaaacagaatggggggc

SEQ ID NO: 99376 - DNA, 1033 bp, Homo sapiens
cctgtgtctgtaagtcagtctgtatcagtatagaattaggattggattagtgtgaagtgtttgcactgtaaattttatctgtgtttttttttaaaaaaaactggaaatattctgttttgttccactactatttccccagggccttaaacagtgcctccccctgagtggccctgggtagttgttgatcatatctgtaaatatctggagtttccgcacacacagacttcgagtgtgccatcaagatggtgtccctcggtgctgagcctcaccatcctggtggtcctgagcagttgcatcccctccttcagctcagccccagggccttctgttcagggtcactgtggataaattaccagtggaacccaagccctcaaagctgccctatgggctgggcggctccaagagccagagtattgctctgtgacctccagccggttgactggggcaattgttagagccaggtgtggcggaaggacccatacagcctctttcaagtggctgggccttctgtacgaggcacctgacaccacgatgctatcaccatcctcgctgactgggacatgccacccacctccaataaaggcttgggagtcgcaaggatcccttttcataatgaaacttcctgtccacagtttaggagagagtcttgaaatcacctggaacaagaagtttttcaaatattttaggtgtttacaaaatatttctatgaggacagataagggggaatgaattttgcaaattagcatttgatttaacccccaaaaaagtaccccgatggttcccacagttgccttctaacataacaaaaggttacatgtgatggccaagggaaaagaaaacgtaatttatcgttataagatgttaattttttattctccaaaatgttcagactgcaaggatatttcatacagatttgttagctggtatttaaataatattcaacactcctaagccttaaataggcaattagaagtatactgcatttttttccctccagcatttcaaagacattactcaaattttgtttgttctt

SEQ ID NO: 99377 - DNA, 1902 bp, Homo sapiens
gatcaagtgcacctacgcccagcacctcccccagcggacacatttagagaccctcgggagcgcgagggatatgagaatcacaagcacagagactcatctcttgaatatcacccgggatatcaaaaacctatcagcacacctggcgaggaccctcaccaaggcgagctccctgcaatggttcatcaaaaattgcccagctaatgatcggctgggcagataatcggaggagagttaattgtaaggttcgatatggcatcttgtcagcagagataagttgtcacgttttccacttgagctgaaactaaatgattgtaaaataagttatgagtgtccttgggcctgtctgccggaatgatagctaagaatacattcctggcccatcagtctcaagcaggctgcttgatatttatgcggacggaatgttattttattccccctctagtcatgcttgtcagctctccgagtgaaaagtgaaactgcttctttgactcatacttcacgttccgaagctcggagagactgcagattgtgatcattattgctcgtattatatattttttggggtgtgcgttgaacattgatgcccgattgggaagaactaatggctgacattgaatgtgcgggatggtgccggcccatcccggctcagcgccgcgcagctcgggaccccagtccctccgtcagagccggtttagatgtggagtaatgaggcgctcgcttttttaatttggcatggcttttttctcttagcctctcccctcccatacttaacgccgtcgacagtagtcgtctgtcccggtgcccggtaattgatacaaaataaaatgcattctttgtatgcagccaggaggagcggatggcgctccgtgggccggctggagctcatttacagtgtctcaggcggggctttcggggcctcttcaatttgaggaataccttgtcaggcgaggggagtagttggaatggaaaagcacagcgtggaagcctagtgcgttgtgattgctcatattttaaaccaggggaatgttaaacaactccttgaaagcgagctctcgacacctagaagccaggggcattcatattcccgtggccgagctcagcgcccagtggacgggaacccggtccttcttgccatgagaacacccagcccaggagaggtcagggcctggcctccaggtgggtcctctctggtcgctcctcactggtcttgagtcccaggtgacacttcctgcccgacttctgtctcctgccacggcccccctcaattcacatcctaattcaccccgccatcaccttctcagcaccatgatggccactccctcgtgtagccggttcccctgctgctgcagccgggccctcccacaggcaagcatctggaactagcaccagagcttcctcctgtcaaagctgtgccactttccccactggctgcctgtccgctcctgccaaacctgctcccacccgccccagcccagagcatgtggcttctctaagggcttgagtgcctcccttttgggccaccgtagacaccccacctctgagtggtcaggcgccactggttgtctccttccagcaagaaagttggagtaaaatgtccagggcctgggctatggagtgttggagcattgccgtggcaggagaacgcagtgggcagagacgcaccctgccctgcctgcagcatggcctggaaagtcactgcctcaactccatgcctccaaatgggggcggggagggtgcttgcggacccaccctggaggacctcggccctgtaagcagcagatcagagcgtgggctggtgctgcttccaggatcacaggtgctttgcacacgtcagttactcgagtcatagcctcctgaggacgactgcaaggagctcatgaatgctggcctggctttctgttt

SEQ ID NO: 99378 - DNA, 1194 bp, Homo sapiens
ggcatagaatttttcactgataataaaacaagatgaagttatagtcatctgtaatattgaggccggaagaaaggatcaggaatcccttatcctgtgcacccacaggagtcaaacccacttaagatgatatttccaaatgtattcttaaatgcatcgttttcatttctaatatatcaaggtaattttaagaagagaaagataactaaaaagcataaactcacccctttccttttgcagagctccagtcatgcagaggagagaaggagaatgcatccatagcatgctgctgatagaaaaagaaatgcttgtgttttaatagcgggaggcacagtagagcaagggggactgagcccatctcataccagaggctctaggcctccaactcagcaatacagtaatgggatgttatttgcagggcctgtgtggtatgagaggagcgtggctgtgctgtttctgcgcattctgctttgtaagtgctcactctgcatttttttttttttttttgccttttccggtccaatggcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaaggtaagggttccgcggtgccccgggagagagtctccactgcggaaaattctctgttatttttcaaatgcgtgaaattagacacccttagcacaacaaatgcacagtaatgctggtcaccgtatgtgctttctgtttgcaaggtggcacgagagggcccttgggaccttttcatcactgtctgattctcatattacgcaaccaaatctgctgtcatcactcttggccgccgtcgctggtagcgggtaggagtgctggtctcccagccaccagcctgatccagttctgaggtctcgccccaccctggcagcctgggcgagtgtcctctccagccaaggtgggccatgctgcgtgactctgctggggacagtgcccacttctagtttaggaatcatctctgatattggttactcttaactaaccagacacctgccttgatttcagcttttagcaacgtgttatgataaacacttcttctgttaatgtccatcagctctttctggtatgtg

SEQ ID NO: 99379 - DNA, 1062 bp, Homo sapiens
ctaatttccctgtttccccagtgaaaaggctgaagtagagagaggttaagtggctttcttgtccagggtcaggttgctggtaggtgacagaactgtctcttgattctctgcctcaaactctttccaccaggcaaaaagcaagtctttgaggtatgtggagctgcttttgaatctgggagtggggcacactgaatagcttccttgatatttctcagattccatgtaaagacactgacttttatatggctcataacatctagaagttgtgtagcaaagatctttctttaaaaatgcaggaccagactggatttacccaatcttattatacaagagggtatgcagaaatcctggtgttatcccccccttgggttcacagcgctttgttctgaaggtctcagaagggaatttattttatccttctcatcttgttcctttggttgttcattctggtctttatcgcaccattgtgtggttgatcctggatggatattgaaagattctcctgtagagggtaagtcacaaacgggcctctcactgttatggtagaaaatgaattgctcatcacagctgcactcactgagcaatgaaatgttgacaaatttcattaactccagagttgcagaggtcacccaggacttagtttcccttcactctttcaaaggagaacctgaaattgtagatcattttattctttcatcaaatatgaagcaaccaccacagggaaagcactgtgtgcttgcctccatgggagacgttgagaaataaaactcggttcctctctctctccaaggagtttagagcctgattatggagataagacatgcaagaaactgtaacgaggatgtcaggcagaatattcgagaaaggcatgggaattcagaagaagcacaaatacacactgagttgtaaaagttagggaaggctaacctgttgtagagcttaatttttattgtgcagatttagcacataatggttatcttatttaataaaactgcagaaatcattactttttcattaaatgttgcctacttacaactttaaacaccagtggtggtgatttaa

SEQ ID NO: 99380 - DNA, 1039 bp, Homo sapiens
tccctcccaagtcttggatttgttgtcaggagacatcatccagtgcaaaggaagaacaccatggatttactgcctgcttgtgcgctacctcattgcatccttaaaacaaccctgtgtggtgttggcaggtgggtggtggcatttctgttgtcacaaatgaggaagagggttgaataaagttgagtaatttgcccaaggccagtagatgagtggcctctgggacttggaagtctgtattttgctttgcatttcatctgttaacctggaaaaggcttcagggggttggagtgggaggagagccttctgcaggcctcttactctcaatcctgtggctctcagagttgcttctccctctgtgcatgtccatttctgcagcacagcagggccatgcccacggctccccaccactgcccttgagaactgggaagcagtcattcctttgctggttttctcaggaggcctgttgtgttgtggtatggcttccttgcaaacaagtgcatgcacactctgatacgtttttaaaaaaaaaagatgcaaatcactgcttcagctgctttgcagacagttagaacctacaggattagatgggctctgttataaggggacatctctcttgaaatttttttggacttacggacatttaattcagatgcagtgaacccagtttttctgttcattttaagattgatatgctttttctttttttggatgacagaagtgtatttgtggggtttttttgttgttgtttttgtttttttttttttgggatatgatctcactgtgttgtccgggctagtctcaaatccctggtctcaagagatcctcccatgtcagcttcctgagttgctgggatttacaagcatgtatcaccacagccagctagagtgcacatttttaagggcagtttgaggttggagggaggagggtggtgattgattaagcccccctgtcgttcatttgaatcctgcatcgctgatttaagtgttaatcaaatgcctgtctcgcctggctgcggggtccgatcatagttactgactcg

SEQ ID NO: 99381 - DNA, 1042 bp, Homo sapiens
cataggcaccaaggtgtggagccagtgaaagaacaggcgcagcgaacgttccggcaggcattgccgtgcacggacacacaacttcacaagggcctcttgtgcacgtgggacatggagaaaattggccatttgtctgtggggtaatgggctttgctgcaatatgaaaatctatcaaatgggtaaaatcaatgacattgtatcagagttcatgaaaagtgcctactgcacacagtttaattctatttaatttttttaagtggaaaaaagcaaaggaaaaatgttttagttttctcttaagctgatttcgctctgctttttcttaaaagtgcctttctagttgccacacagtgatgtgatcattatctgccacctcgtcgccttgctgcctctgcatgcagtaaaatacaaaaaaaagagagatagagaaagcaggggagcttgtgaagtatgactccctatcccaagactcattgcctgcgattcgtaccgcttgacagtaatgatcttattacagtactgtggaccttgaagagatttcatgaggagagtgaaaggacgaccctccgtgtaatcaagtggcgctgaatattccacgcgtttttgatcacacactgattgggcacagttttagcccatcttctagtcaattatgcatggcccctgtgctcctcgaatagtcggaaacattgatggctgttgtctgggttttggcaggcagccaggggtttgaagtgccttgtacatcgtcatcccaggataagtgctttttagttggaattgattacctttctttgggttttgcttaatagcaaaactgcatttggagagggcttcaggtgaaaaatggacatattagccattgagagcatccgaactcctagtcaatttttaggcttcccttgtttccgtctaatttctgtttaatgatacagtgtttgataatatttaagatatctcaccgcatttgccgctgagcacacatgttgagcgtcgaggacaggttcaattatgtggccactgtgttcaggttcccggattgatc

SEQ ID NO: 99382 - DNA, 1186 bp, Homo sapiens
agtgctcgccgcctctaacacatctccacggtgaccttcccttcccttggaagggggcgcttgtcttttcagcggtcttgcctccgaatcttggcttgtctaggattcttcctacagaagaagttcatataaaataaggggttttattatgggttatctgaagagtgtttcttaattttaataagttaatattccaaccataaaaacttctgacattttacccgaggctgtgcttcagcagattgacagaatgcatttttacagcacttagaaaataccagatccacgaagaacaaatgatcaaagtttcaaaggctgtaattttggaaagctggcatatataatgatgatctcttcgcagcctggtaattttacctggacaagtaaatccatttctcacatttaaagagaatcaaagagtcagtaaacatgcagaaacacttttagctgtgaatgcagagtaactcttacaattaacatataattacctcaacgggccaattaattaagcaatttaagatctataactattttcatgattttcccccaaaatattactttattctgcacaccgtggggacatcagctgggagggtcatagctaggaggtcagaaggaaggggggacgattcatgcaatgaggcactgctgttgtggggtgttggtttgaagaactcataaatggtaaaagtaacctgtattatcattggttctaggggactactgaagataagaattttcaaccttcctcttcgttgtctgctctcccaggctcattgaaggaacatagagaaggtttaggccctgtttcttttcgagcagcacagaaatacttgcccagtccgttcgtggaaggaaagaaccgaagccagcccttggctgccattctttccagacttccaccattgtgccctgagtggttccagaatgtcattgatgggaaattggttttctttccttctggacattcaaagattaatatgttactgtcatcagtgacttgttaccttctgtttctgattgccagctcatcagcttagtttgcccaggagagccactttttcccacgttcttttacttgagttctgagacaagatttgatacccattcatttataggccaaatccagttcttattttaattttttttcccaacccctaaaaagcatttgcaaacactcctccac

SEQ ID NO: 99383 - DNA, 1099 bp, Homo sapiens
aggccaaactcgcctcctactgccccttggccgattggagattcgtatctgacaggtgtcttctaatttttttaacttacgctctgacacatagttaagttgtgctgtagttaagagaatagtaaacaggtgagcattattctattaccacctactgatccttttatgaaaatattcttgccttttaatttaaatgccaaccatcttgattagagaaatagtgttattccttcctgcacccaagccctgacgtcagcatgacctggcggtagagccagcccctgccagctggctgcccccggggaccttctgttcaccatcaagcggcagttcatctggagtaaggagagaggctggagcacagctcccagcctgcaggaacagacctctggagatgccaagggcctgaaatctgtgtgtaggtttatgtagacagaagtaaccatatattgaaattgtggttaatggaaagcaaagtcgttttagaatgttgccaaattgtgctcatcaaaagacgcctgcatactttttaaaaattgggaaccactgaaagagattaatccttgccaattttttcactttttcactcaagtctaatttatcagaaaaaataattccaccactagctaagtgtaggagaagaaaaaaatcactgaatgtatgtatcattgagacctatttaattattctaccagtgttctggctttacccataatgaagacaggagtgtgtgtgcatgcataggtacatagatacatgcatattgcctttaatgaagatcttttttgttgttgttgttacggagtttcactcttgttgcccagactgtagtgccacggcgcaatctcggctcactgcaacttctgcctcccaggttcaagtgattctcctgactcagcctcccgagcaactgggattacaggcgtgcaccaccacgcctagctaattttgtatttttagtagagatggggtttctccatgttggtcaggctggtctcgaactcctgacctcaggtgatccgcccacctcggcctcccaaagtggggattacaggcatgagccaccgtgcccagcctaatgaagatcttttaaaatata

SEQ ID NO: 99384 - DNA, 1627 bp, Homo sapiens
ctaactcctcactcaatgtcattcatcaataggttcttaaaacttcgacttgaagcgaaaggacttataatgaagccagtttttttccttatcagcatcataatgaaacaacgtgggaggaaacaaagttatttgaggacctgctgtacacagttttgcttaaagtcacacatttccaagaacctgtcaatggcattgaggactttctgtacaaaaatcactacgcgtgacagctcaaataataaacagttgttcagagacagtggtactgcgtccccctcctccagtccagtcccccaccctgagcgttgatggtggggtgtgcatcccccaccccccaagcctgttcctagaaggccatggcgcacctgctctgtgcagaggctgggcgaacaccagcccgagcctgacttaagcaggatgggcatggacatcgttggcactcacttccctgcagggaggtgcacagtgaagaataaaacacaggtgatttcagatagtggcacatgcctgaggcaatcagccccgatggtgtggcggggcaggtactagagattgtgtttgcagtgagggccactaaggggggcggagaagacccctgacagcaagaaggagccccacttgtgctgttctgtaaggagggtcttccaggcacagagagtggctgatgagaaagggcctgtgtggaaggaaccagggccaagcgagggaggcagatgccgcgtggcgtgaggagggtgagagtccatgccataaaggactgtcatccatctgtcattggctgaattgtgacctccagaaagagatgagttgtcctaacccccactacctcagaatgtggcctcatatggaactagggtcatggcagatgtcattagctatacaggaggggaggggatggaccctcagaggcgagacggacgtacaggaaacaccacatggagactctggcggtggctggggcagcgcggctgtggggcagagaatgctgagataaacgccaccatcagaaaccaagagaaaggaaagggacaggtcctccggggagccttcatggggagccctggcatggccttcaggcctccgaggaacccagaggaggaaacgcatttttgtggtttcacgccacccagcgtgcggtgcattgtggcaggtgcaggccgctagtgccccccacccagtctctgtgtcctctgcacagtagggagctggggaaggtgtgtggctactaacgtgagcctgttaacgttgaaaatttccctctggcggctgggcagagtgggctgcaggggctgaagtaggcagtggtgacagtggcttccccaggcatcagcgccacaggaggagagacacagactgtggcttgcaagcagagctggcaggacttgctgaaagagttaatatgggaagtgagaggacacagaggccagggccgggagaccaggaggccgagagcggtagaacgtcacatcctggaggggcggggatttccccttttgttttgtttctgtataagatcataccatgtatattctggaattttacttttctaatttaacaccccgtgggtctccagttcttccacaagctgtttgaaaggccacagggcactgcgtggaatgcgtgg

SEQ ID NO: 99385 - DNA, 1062 bp, Homo sapiens
cctcagcctcccaaatagctgggactacaggagtgtgccaccggctaattttttttatttttggtagaaacgttgtttcaccatgttgcccaggctggtctcaaactcctgacctcaaatgatccacccacctcagcctcccaaagtgctgggattacaggtgtgagccaccatgcccaccctctcccctgttaatttacctctttcattagtatggtacatttcttagagttcatgagtcaatattgatatgtttttattaaagtccacactttatttgcatctctttagctttaacctcatgccgtgtctctgttccaggatccaaatcctattccattgtcatgcctccttagccttctcttggctgggacattttctcagacttttcctgtctttgatgaccttgaaggtcttgaggcatgctgggccaggtgtatgataggaatccctctactggaatttgtgcaatgcttttctcaggtttcatcttgagttacaagttttgtggagaaggaccacagggtgaagtgctatttccatcctatcctgtcaagggtatataccatcaactttatttatggctgctgatgttgaccttgatcctttgacttgaggtagtgtctgtcaagttattctgctgtaaagtcattgtgcccctccacagcccatactgaacttttggaaggaagtcactgtgcacttaaggagttgggcgttagaccccctgtccttgagggtggggtgtctatgtaaattttttagaattcttttgcaggggagatctgtttctctcccccatttatgactatattcagttgtctatttgtattcatgtggacttgtgaatatttattttgtattctaggctgctatccaatactgctgtggcccagattattccacccgtggctcctgggggctcctctggctgctcccacaccctttgccctacaccccatctctgtggggtttcttttgtttgagcactttccttcctttctgtcagtacaaggtgcattttgtatctttcctgccacaatcttagaatcggctgtttcc

SEQ ID NO: 99386 - DNA, 1052 bp, Homo sapiens
tccaaaaaagcctttcctttgcaaaatgaacaggtactccgtgaaaacagggagagaaatttctgtttttcaccgatgcatttctcacgttcatctgacaatgtgcaaaacaaaaagtctacattagaaatttatcatgaagttatactctacttcaactcacttcttttcagtccctgtgaaaacttaatactcttggtgttgtactgaaatacccagtggatttggggtgcacctgtacccttgatctccacttctgcgtgtttctaggccaaagggaaaaccaactctctacctaattggaacttctggttttattgcatatcctggaggtcttgcttcgtttttattttcccgggttgatggtctttcccatgtgcacctacgttagcccactatgtagaacgccttggcagttttcacagagtaagaggttgaaggaagccaccaatgtgaaaatcatatttgctgtaaagaaagaaccattgtgagttgttggaaaccagattaaaattccataattggagattgatgacttttatttcatgagttttacttagttaggtgttttatcttctgtgttttgtggctccaaattacgaagactgttggccttgcaagaaactgatcacggcaaagttattttccttactgaacacgtgtcctatatatttgcttggcctcgggttttgtttaatcccttcaaaggccctttgaactgatgtttcaacatgactccttctctgtgagctctccgctaggaagcggccatcatgtcaagccccttcacagctaaagtagtgagttcacatagtcgaagaatcttctgggttgcatcttatgaaaaaaagaaatccactgcctttttataagagaacagaacatttacaccgtcttgttgagcaaatgaacgttcaaatggccagcacaaaagaaatccccaatctctaacctcacaatgaaatcgccacggacaaaagatcacgggataccgggagcactaaactggaagtgacacaaaaccacagcagaatccgctcacacctgccgag

SEQ ID NO: 99387 - DNA, 1040 bp, Homo sapiens
gttccatttaatttgcagactaaagtgagaagagatcagtctcgttgtctacactggagctgacagtcagtttgtaccacatctgaaattatacttgtgggatttcatgtccattgagattcgcgtatgtgtttttaaacatgtaagacagtgctgagacatcctgccgcatacatagctatgggaggcattgtgaaactctgtttaccaaagagacttttgcttacgcagcaagcaaaatagcagaatggaaaacactaacggaatgctcacaccctgctgcctttttgtttaataacaggtgaaattttgatactagaataatagattttgtgagaaataacattagtaacaaaatcaaaataagttagcctgtgtttaagaggaagaaactgtattcctgaaagtagaacaggaattttactaaaaattttaattaaaataaagacccggaaagttttagtctattgctagtccccctgaagtccccgagaatcgccttttattccaaaggcctgagaccagagggaggctgccagtggtgggcagtggctgggtggcaccaaacatcagctcggagcctcctggttccatttggcacagtgtctccgtagcccctcaaagtgattccaggcagcagcatccgacataacccaaggtgttattgatgataataggattgtattttcttgttgagaagcttctaaacaagggaacttagagcaatcaatgcccccggagaccgatgcacatatcaggaccttggtatcagctagaaaacatccatttgtttaaggggaagaaacaggcacgacattttgcacattaaaatggattatttcatcaataggttaatagaaagccgggctgcaagttcacttcctgcttatacatcctgtggtaatgggagagcagagtgtgaaaaatggaaggcataaagcgggcgaggaaagaggctttctgcactcgggcacccctcccctcccgaggggtgcccagcctccattctgcctatttatatgtaaatattgctgcaagag

SEQ ID NO: 99388 - DNA, 1032 bp, Homo sapiens
gggagctgaccgttggccagctcatgctttgggaaccagagggccagcctggctgcctgctttgcgggcttaagacctgcctctggaagggtaagggcctgcccgtccagataagtgctgctcacctgcattaaacaaacggccacacagagcccagtgggagcctgcactggtttctcttcctgcctgtggcagttgagagagacagacggtcctgtgagaccccttcttcagaaggtgaatgacagtgaccgccactaaacattccattccacctgcctgcacggcagtccaagccctctagccctgtgacctggggctgtgcctttgcttgcatttgcctgaagagttgagccaccctgtttaactcttgggtttttataaaatgtctcctgaagggcggagagaatgcctcaagtcgatgtcttccctgccacagatgtcagcatttctgagttgatagttgggagggtaagggcctggtggggtggagaatgtgtctctggagggtgggggccccatctcagtgagccagccaggcactgcacacagcctgagtggtgggcctgctgcgcccttgttaaattggttctcttccgaacccagcgtcccactgtcggtgacttggcgttttgtcctttctcctgagaacctgaggtggcatttgctcttctggttcctaggagctccatttagagccgtaactcccccgagtgtcaaagagaatagactcctccctccaggacagcagaatggcactagggggttttgctgctgtaggtattgcctgaatcaaaatctgtctcgggaagacaacttcacttttaacagctcttggttttaaaacctaccttctccaacacataggcatgaactgctcataaccagggtctcttgatttgacatgctcctaatatttggccgaatcaaagggcttgtggcgactggcatcatagctccttcaaagggtgtcatcatttcccaaggcagaggccagtttttgtgctgttttgagtagccacgtgtgaaacc

SEQ ID NO: 99389 - DNA, 1745 bp, Homo sapiens
tcctgagttcctctgttcaccgcaggggagttggagggctcagcccagggagctccatggcacccacccgcttcgcgcagacagctcggaggcaacgtcacgtgctactttgacctttttttttctccccttttcatttgttttcttttcctttttgttttctctctttttcccctctcccctttctgctctcgggatgcagccaaacgcaaagcatggaaactaaaccgtgttggtagcctgcgaaatatatacagcagcagcaccaacactgaaggtaacgcctccgcacctccacccgcccacacctccacctgcctcttcccctctcatcccctgcccgccccttcctttccaacacaggcatggaaatgcaatttgcccaaagccgcatgctcccttattgtgtttgcagagtcattcctgtggtcttttcatctttttgtttgtgtgttttattttaccattcgtgttcctttcagcttacttaaattttgacctttcccttcagtcgtagagtagtgatgtttaaattacttcagaaacctattttctcctcttttttcttttcctttatacatgtgggcactcagtgtaatatttcccaagttattacagtttttaaaagtgttagtatcaggtgtaatgatctgtagccaaatacaatagtgtgccgtgacatttaagtaacagtcttaatttgttttgtggaagcattctccataatgctctctgcagctctaatccacaggcaggcaggcccgggccatttgcatgggctgctatttgcttgtaaagtcagtattttgttgtgtttctaaaggtcgtctggtgccaaagttcacaaattgacttgcgttgcttttttcaccgaagacagccgtcattgcttttgtataatagcagattgaatttttcccccaccttcatttgaacaacataattataaattgcctttttttttatgattacaaatgtcaagggtcggaattactttgatgccaggcaagggaaaaccaccaccatcagcccaagcgcacataagggaggcgggggcatcgggcgtgtgatgcaaagcaggtcacaatccagcgatcttggtataatagggggacattttttttcacttaagtgcaagccaaatgggtcaagtaatcgcaagctcgtgccctaacactaattgacttatttggggattattataactgtaatatttttcttaatgtcactgttttctgggctgttgattttagcgattgccaagcaatggcattaaatctcttgtaaattttaaattgcacgttatttctgtaaacaagtccctctcttcacatcctggtcattaacctttgccgatttatatcaccatcctctttttttctttctttcacaattactcctgtcttgccgctgaacgccctgctctcagccaggaaaaaaaagaaaaagaaatctggaaaacaaatctacattttcactatggcttgttaaagagccattttttaatcataattttttttttcatttctcaagggaaaattgttgtctgttaagataccagtggagcttggcctcattggtatcttctttcaaagcactcaagaaataaccaaatgaaagagggaaaagaatagaagttaagaaacggtcattcattatcatttttgttgcattttaaagggtattagtatactcttttcaccgttttttaaatgtttttcaacttagcgtgcatatcatttctc

SEQ ID NO: 99390 - DNA, 1718 bp, Homo sapiens
ggagaaagaggcgataccaagcacgcatttgctaaatgtgtggtctgtgtcagcccggtgccaaaccctcccatgcgctgtcttttcattctgcaaccctagtagttggtgcccctgtgggccccacttaaaggggaggaattgaggagcctgaagggtcaagtcatttgtctgaggtcacagaaatagcaagtcccaaagcaggattcaaacccatctgttgtccagcctgctgtattttctcaagaatggaaaggctcagaagatgtagcacattggcaaggatttgttaagtaaaaatacccaattttggttaaagtaccgggataggtacagtgcccacactgatgatgaactgtaaacacctccatggggcctttcgacaatgtatataaaaagcttttgaagagtggatgcccttgactccagctgtatactccaggaactaaaccaatgggattgagtaaggcgggtgcagagatctgtctttccagatgttcatcacagtgctttacatggcaaaaaatcagaagcatcccaaatgtctaacaattgaagagcagttcatggtgatgtcttgtctttgctacctttaaaaatcatggaaaaagacttaattgagcctgggcacggtggctcacgcctgtaatcccagcactttgggaggccaaggtgggcggatcacctgaggtcaggagttcgagaccagcctggccagcgtggtgaaaccccatctctactaaaaatacaaaaattagccgggcatggtggcatatgcctgtaatcccggctacttgggaggctgaggcaggacttgaactcgagaggcggagtttgcagtgagccaagatcacgtcattgcactccatcctgggcgacagagtgagatttcgtctcaagggaaaaaaaaaaagtggggggggtgcttaattgagataaagaaacttcataatgtgttgtaaaatgaaaaaggggtatgacaatgagtctagatgaacctaacgagtatttacaggtatttagaggggaaagatctgtaaggctgcactctggaaggttagcaccagttgtgtctgagtggtagggtcttttgaggcttggggattttcatgcagcgtggaatttggaattgtggtaacagctccctgacccccagttcttgcagagaatgctctagaccgccaggagccccctctgtctgctcactgggcacatcccagagcactgtttccagagtggacgctgagcctctggagctttgggggtgcctgtctataaagggattctgagagccagtgaatttgggaaactcttaacaacgtccgactcccaggaagttgcagccttcggacacctgtgcttccggggagtactgctctgaagctacctgttcagcatggcccaacccagcatgtcccaggcccatcggacagtggggcctttgtttagggtgcctgttgcctgccttctgccaggaacatgccaaggaaagtccacacctgagggcccctgagaatcctagggcttgggaccctcagtggctctcaccagcaggtctgaccttcatggacaggccctgagaggcagctcaccgtttctgctgctttctctctgcccatccatgtcgcccatgaagccctggttggagctgaccgtgcgctggtccctcccaccctgctgcgtggacctcacaggtgcccctctctcctgggcctttc

SEQ ID NO: 99391 - DNA, 2512 bp, Homo sapiens
gactgagcactggctagggagcattttttctcgccatggatgtggttctgtcgttgtgaagtttgactgattcgtcgccttgtgtttctaagaacggttggaatgatgcatgatggtctgattgcgtttagcgttctgttcctcttcccgtagatcccaactgggccagtttgaacttgggagccctcatgtgcatcgaatgctcagggatccaccggaatcttggcacccacctttcccgagtccgatctctggacctggatgactggccagtcgagctcatcaaggtgatgtcatccatcgggaacgagctagccaacagcgtctgggaagagagcagccaggggcggacgaaaccatcggtagactccacaaggtaggaactttggaagatgcctggctcccgacacgtttgccaacagttaggcaactggaagtgatcataatgacagccacggttgggaaggccctgataacctgtaggaattcgggaattccgattcatccggcataggaatgtctgtgtttaaagttggtcttgagcagacgtggataattcacactccttaattttttatgtttgtttttaggcctggggatttctctcccccctcttagaaatgtattaagcttctaaccttatgaatatattactttaattaatacatttctaataggcataagctgtgccgttaacactaattatgaatttttgatcctttaattttgttattcttatagcttggataagcatctgctctgtcgatcccccccccgcaccatcacacaaaagttatttttatggtaacaaaatctattttattttctaaaatatatctcaacacatttagtcaaccaagttcagcataatgtatgatgtaactcctcattaatgttaattgttatccagtgtaaaaaacgcatttattttgaggccatttagtttctcatttttcatttacagctattataaactgtttttgagtacacatgcatatttaatgttcctaaggggtgataaaatggagtgtcttctgagaaggcgtatggcatggaggcagaatagagcatttcatctccgtacttgtctaaagcaagtggcttccagggttgctcattttcacccacaataggaagtgggaggttgaggtttgctgtccgtgtttgcctctcaggtgtctgaagagatgaagggagaggagaggtctcccatcactggtactttttaggttcctctgatttgttttgctgctgatcagataaaatgaaagttcaagtggtaatctgtggttacgccacagaaaccggtttctactgcagagcagtaagaacgtgagaagcgttcgtggacttcagttcattaacactgaaaaatgaatttgtggtgccacctttggctcactggagagaatgaagctggtgtgttactcatctggctctccgtatgagggattctttggtagtggggaggacaggaaaggtgcaaagaacatatttgtttaaaattgcatggttttgatacgcgacctctttatgagttatgctctatagtgtagacaggggtaagtttcttacaaaccgaagaaattatgcactttaaaaagtatttatcttgatttgtttaatgctaccatagaaatcagctgggtcatcaactgtgaacaagcttaaaagatgaattcatgttttaatatctattttttcacagataatgataacattggaggaaacttgggtctgaaaatgaaaaatgattggaaattagattgagcttaatatatgaatgcagaaaacattgaaataagctggaaaaatctatgcatcttactgtttatatgtaaaagaagcacattcactatttttaatatcatgaattattagaaaagtttgtttatccatccattaaaatttagaaaccatttggaattattcgaagcaaagatacgggttcatgttttacctgataaatgttttataatttcatcttcattcataaatgaagattgtgtgtgcacaggtattttgtagttctaatttgcatccttgaattaagttcttgagtgcagagccctgtcttttttccagtgttacatacatcacatcattatattttagagacctattgcagagacttgcttactcccaagtgcagtggttgcagttaagtcccatcttttctttagtcacactggctttcctaaagagcaggccgagttgtaattcctctccaagactgtggtgttggtgatgtggttctgtgctgttgctgaaggtaactgtggaatttctaagttccctttgcacctaagaagataaacacatacgagaactgaatatttctttgtgcctgtagtaattttcctggggagttttgttttcagtgaaaatcagcaaataatcattgcacactttctcgtagaaaagcaacggtgagtgatgattgcagttccctggtgattggtgaaggctctcagggctgcctgaggatgccagggctcgggagggtgcattc

SEQ ID NO: 99392 - DNA, 1042 bp, Homo sapiens
gttcaagtgattctcctacctcaacctcccaggtatctgggattacaggcacgtgccaacacacccaattaatttttgtatttttagtagagacagggtttcaacgtgttagccaggctggtctcaaactcctgacctcaggtgatttgcctgccttggccccccaaagtgctgggattacaggcatgagccactgtgcctggccaaaactcgaccttacaagtcacacagccatgattctaaagtcttaattctcttccatcagtgctaatcctaagagcttccacagaaaacagcactgagaactgtaaaatgttgagatccacccacacaagtgcagggttagagcccccccctcaacccccgtgtttcacgtaaccacatcctgctcatgtccctgacccaacactgcgttttgggaatataaagcctgtattgcagagacctcacaatcatatttattatctgcatggtacaatatggagccatgtctcaggccatagagttcctggttctggtttcatggccagcatcttctgccattttaattttaaaaacagggtaattcctcatttctaagaagagactagtcatttttccacccacttaattatgtagagttagtgctaaaagaaaataatatttatgaagtttcctgggcttcctttttatccagaagatacaatcagctttgaggcctgggtcatgcatactagcagtgagagggacaggtggtccatgccctccccgggggttgtggagggcctgctgatatagaagatgtggcccatgtttattttgctttgtatgtatataatggtttattgcagcatcagtatcacatggaaaggtatattcttgagccccacccaagcctacccagtcagcatccctagggggtagggtccagtggtgtgttttaactctctaggtaattcttatgcacattaaagtttgagacactctggtctgcactaagtagtaaaaataaaagtccacaatcttgcctgtgaactcactgtgttaatccaagtccctggac

SEQ ID NO: 99393 - DNA, 1033 bp, Homo sapiens
acattttgagtatacaatcaattcagttggttttgataactgcataggtctatcaataatattcctatcaccccaggaacttcccctgtcccccctcctgtttattctccctgttcagaagcagccatgaatctgacatctgtcaggataggttagttttgcctcttagaaaattcatggaaatggaattatatggtatatacgtttttgtgcctggctactatcactcaaaaatgtaattgaaaagaattgtttatctaccaatgatacattttccccatgtaagggaatatctgaaaatgtcttcttcaccaaccaattttttttttttttatcactgagacctaagagtttactgtaagtcagatgtactctgtgtagatctgcttctggagttggggttcagagttccaactcaggtcagactggcagcatccaacctggtctttaccactggcttgctgtgtgacccgggctggatgttcaccctcactgtgcctcagtttcccattctgccaagtgaggggtaagtgtagtacctgcctcatcaggatgatttcaagaattaaatgaacaatatatataacacaatgctgaacacctaatcttctcaatagagggctaagttctaaatagaagtcatctattagtttttttaaggaaaaatcactacgcttttaaaggagaaaaacttgtaagagtgagacactctgagcaagttcagaaacatcgttaaaaattataatgaaaaatactatgtctacctgtcatatttgctataatgctaaatcaggtgggcaggacaagtcttcagtatctacagaaatgcctagtattgagctagcccatttgagaaagtaaagatgtttctggaaagacaatctgattattttcttaggaagtagtgtgaaataatctatgttactatgcgctagatgatgtggccaagactgggagtaacacgtattggaagaagagaatggggtcctgtcttttctctgttctggggaagaaacctcatctcttaacagac

SEQ ID NO: 99394 - DNA, 1945 bp, Homo sapiens
acagtgggcacaaagcacatttgccctgtgctctggagggagatgctatctccatcatccaaggctgtttcctgtgcatgttcttggaaagatagttgggaaaaaaggcaggcagagcctctgctggaaagacacagggaaaggagagagaagaattgttacccggcaaagatcagactgcctcctccaccaagtctctggtctagattctgtgagtccagaaacctccatctcagtctaggagggacagctaggaggaaataaggacgtcagtttgcaaccagacaagtttagaggcctgtggaattcccaggccaagggaagagttgttacggagactctatggccaagagggacagatcacactagacatcaagctcaatggatgccaccaagggcagccacctgctgtatcttgtacacgtttcatccatccagcttttagcctctcaatccttctcttcctaatagggtaggtataagattcccattgctgctgtaacaaattaccacccacttagtggtttaaagtaacacggaagtattccattacagttctggaggtcagaagtccaagctgggtctgcatggtttcattccttctagaggctgtgagagagtccatgcccctgtctgttccagcttctagaagctgctactcatcttggtggccttgcatcccctctgacctgtttctgtcctcacatcttctgactctgattctcctatttatatgaccctcttataaggacccttgtatattgggcccacctggataatccaagatactctcccctctcaagggccttgtcttaaccgtatctgcagttaggttgccatgtaaggtcacatagtcacaggtcctggggattaggacgttgacatctttgggagccatttcccttctaccacattattctgacctctgtagatactgtggcccatgtcatcaaacccccatgacagtcacagccctgcctatttctttccatccagacaggtggtgcctgtgggtacatctcagcgtagggtgcagacagagttgtctgttggaaggaaaaccacatcgaatcgggaagggagggtcctggctagagtaaggacagtgggcaggaggccggggtcctgtcctgccacaacactgaccacctagaacctcaactttcttctttaaaaataaaaagagagtaactacacttgccatactgaccccccaggttgtatggaagctcagtggagaaaatggccggggtgcgtgtctgaaccgcgctgcatttggacggacactttgtgtgtcacatgttagtagctgcagtgtgtcctccacccgactgagagtctgtgtatcaagataggggtaaatcctttctgaccacttgcagacagaagtcacgcctcgtggtccaaagccaccaagtcattacttttcaaagcttttccagtagagacacatgactccttccttaaaacaacttacagtgaaaatatgtggatggttgaaaaagtaatgtttccagtctgctgaaagttctgtgggttttttttttttttttgcagggcaattatctgtataaaatactttttttcttttaagtagaatcctattgctaatgaaaccatattttgaacatgaaaattgttacaaagaagaaaaaatgtcattatccagaaaagctgcaatagctcatgcatttgatggtctaaatagaacatttttcttctcagggggatgaaagcggtcccctcctattagcctatgaaattattttagaattgggttttaatccctggaacgagaaagggggatggaaccctaacataggttccatgcatgggaagtcaaacctgaaatttagagacaggaaatatagcacgcctagtcactaatccaaaaggaatgtgaaaaaagagttgttttaatgttggaaaaaggcagcatgaaagg

SEQ ID NO: 99395 - DNA, 1038 bp, Homo sapiens
gggcacaatggctcacgcctgtaatcccagcactctgggaggccgaggtggccggatcacctgaggtcaggaattcaagaccagcctgaccaacatggagaaaccctgtctctactaaaaatacaaaattaggcaggcgtggtggtgcacgcctgtaatcccagctacttaggaggctgaggcaggagaatcacttgaacctgggaggcataggttgcagtgagccgagatcacgccattgcactccagcctaggcaacgagcgaaattccatctcaaaaaaaaagaaaaagaaaagaggcctcgccttccatttagactggctcatgaacttgccaaagaaagggctgttgtcagtcgccgaggcttcggtctcaggtttttcaggtcagtgtgtgcctaataatgcagatgtcatgtgatgagctcggtttgttgcaaggaagcgtcgtcctcctcacgggctctttacgttgacattgtggctttggaggctgatattttctctaaaggaaagattaaaggattgttttcattttattataaggaagagacatttttggtataagcccatcaaagttggtgcctaaatgctgcaactgattcttctattattttgaagagcctgtttattttccagcagttaccagcttaactaagacattgtcactggaattccgtataaatgtgtgcatgctcacacccatgcctacattagaaagagaagtaccccaaatttgggaggctttcttatgatcattcttaaatagtttattgtcttataataatgtgggcttttttgttttacttaatatataggaagatttttttttaataccttaaaaatactgcacattaagtctgtttttttacagaaggataaatggatgaacaggtgttttaggagccacaataaaccatcgcagagcaaggagtgcctcttctgagatcccattcgatgctctgccctcaattaaatgaatccgagataaatgggcatgtgcgtgtgtatgcacacacacgtgcacacatacacaca

SEQ ID NO: 99396 - DNA, 1076 bp, Homo sapiens
tgattgacaggccttctcattatggagcccatcaggggacagggcattccagtgttatttaggggtcgaggtgggaatgagaggaagccagagcccggggtgggggcgggagcgggggctagctgtgggtgttcattgaaagagtccaggtccccgacagccctgctccaaggacagacaacctcgtcttgcaggatcatttaccttttatattatgacctagccacttctcatggctctaccacaccatcttcccgagagagcctgtgcccgccccacagtcccggctgaaatggcaaatgcggtgtaggactgtggtgcacactgcccatgacgggctacttggacggctcatgcccacctctgactagtttgatgttctgaatcaggccccttggttaagcgtgataacatgatcacctggtgttttaaagcttttctctgtttccatgtggtgccgtgaatagtctcataagccatgtaagtggccttattggttaagtgacaaccggggacatacccattttctttgtccatgaagcaccaaataagaagttggcgtccattaaactagattgattatttaatatcacaaggcttttgaatgggctatggggaggaatagaccagaggtctttgccaggaggagacgttacagcaggtcctctctggttgggacctgcttaaagatgtgtaaagaccttgaacatcagcatctggcacagccaggggagggacagggaggacgagagacctgcttggtatccttggccccggggtccaggttattcagtttgttgatggctatctggcaggactccctcctgagcaagaaagaccctcagtctccacgatggttatttccagaaaagtggggaccttcaccaatgtgcctttcattgtgaaccttacccagctgggctccaggacacctaggcacatccccgtctctgggtccccagccttatcatgtgtctgagtgtcctcagacagtggaatccttccttcaccttactgagagaggccagcgctgttttcattttggaattggcaaaaggcaagttttctcctacaat

SEQ ID NO: 99397 - DNA, 1036 bp, Homo sapiens
tccttgcaaatgaactgcatgctggagataaagcgcctactaggctgccgggtactggcagaagagagtgagcgtagcaactgggaggtggcctgatggcctgcgcctgttgccgttgatgagacccaaagtctggaacgaatctggttccatatagagttcatgctcaccccgaagtccttctttggcactggagaacaaagaagagtttgcacagaagaaaagggaggttgtttaaccagaaaggccctctgcaaatttctgattcctgtacagtcagcattaatatgctgcttttcagacatccaaatgggggattgaactgtgagagtgcaggcaataaagagtgcatttgtggaatgataacctgactggcatccctgcctcttgaatggctgacgaggtctaattggcatgtaacgccctataaatttattagcatgcctcatttctcattggtggactttctactgttaaccaccaagaaatgaccaattttcaggagttagtcactcaagtcgtacttataactaggttggaaaaaaaaaaactcacactgctcctattataaatcaaccttatgcctgtacagcagctccctggctgcaaatgaatccatcggatacagaagttttgaggtgagtggagttgcagggaggagcacgtgtttaccaggaaacccactgctctcctcaccttgccctgcgcgcctgagcccttcacagagaccggccgtgtcctcacccctctgtcaccattgtgggctccagctgcacaggctggggatgggctgggtagaaatggcagttttgtggtcgttcgcacccaggactttgatgttcctactgatatattcaaccctcaggcgtaccatgcaaagaggacatagccaccctcttatttcaagagcatgatagaaatattcagaagcagacataattatttcaattacttctctctggtttttgagacgcacactcaagagtcacaaattagaaaataatattcacatgtttcttctaattggtaacagatt

SEQ ID NO: 99398 - DNA, 1181 bp, Homo sapiens
gggtgatttggcaatgactattaaagtcaatcggagcggaatcaaatagttgtgggattttaatgtctaccaaaaaatgagagttagcaaattggaactggaaaatctggacgcatccttcaccgtcatcccttttcatttaattgacgttttgctccttctcttttgtgatttatgaaatgcatcaacaaacgtttaatacattttaaataaggcctttaaaatagtatcagaactgcttctttttgtctgtctcctgaacccgtatttcccagacattgtcagtgcttttgtgcttgtgtttttgcccgagtggggtgcaggggctgcctccgctgcatttgtgggggccggtgtcagttctcagctgtagccaagtgtttgtcctggaaatctccaaatgaaaagagtcgggggtcactctggggtcactcacatgtaccaggaagtgaagcaaaactaatccagatttactcctggaagaatttgtttgccttagtatttaaaaacagattagggctaacccgacactagatcactaggtgcaatgtaaacacgggtaaaaggtgtaaacaaggcctttcctctgtacttcggaagcagaaatgtcatgggtaatgagttttctttctagactttcgcggaagccctgagtgatttctccgtgtcatttgtaactgtgtactctgattattcccctggagaaacctgaattttggagagggcgattgtgaatcagtgcgttattaaagtctctatgggtaactgcagtcccttcttacatgtagggcttttctttcttttctttttctttttttttttttttttttcgagatggagtctcattctgttacccaggctggagtgcagtggcgcaatctcagctcactgcaacctctgcctcccgggttcaagccattctcctacctcggcttcccgagtagctgggattacaggcgcctgccaccacaccggctaatttttgtatttttagtagagacagggtttcaccatgttggccaagctggtctcgaactcctgacctcaggtgatccacccacctcggcctcccaaagtgctgggattacaggcatgagccactgcgcccagcctcttttctttgtcatcctcatcaaaaaggcaggcagggagcacttccctggctgggcttggctcctggg

SEQ ID NO: 99399 - DNA, 1018 bp, Homo sapiens
caggacaagggtcctgcgccatgtgctatcatcaaagggccgaggcccgtcgctctctcctgtgtgtggtttaggggagtttatgaaaaggagccacttctgcagtctcccggccgcctcttcgccccttgagggatgtccaggttttgtgattttgtttggggtgagagtgggtgggcgggagggaggtggccaccaggaagagggaggggatgcgacgggactcacgtgctgcgacttctgagcgagaatgcggcgaggctgccgcgtcccaggtgcggcgagcaggcgggcacggctgttcctcagatgatggtgggcaccctcccactgctgttgttccggttattgtttctcctggacaggttaggggtggccatgagcacgaagcgctcgtcggggcagccgtactgcagcagcacgtcgatgcactcctggctggaggcctgccgggcgtaggccagagctgtgttcccgtgggcatctcgggccgtgacgtccactccgtactgcggaggtaagggagcccacattagtatcatgggggatgtgatggagggagggggcagggaagctttctctcagcccttgcatgtggcttgtgcttggacagcggggccagctacacaactggctggggtgccaggaccatccagtgctggtggcacagcctgcacccgtggccagcggattcttttaaggaaagaacatgtctttttttttcaactgaaagcccctcctttgtgcaacattaaggaatcaaagataactttagttttgctgtttctattttgactttccaattgcacaaagaaaatcattgttttgatctcagaattttcattataggaaatacacaaataacacataacagctcaagaagaaaaaaaatcacccataatcttactacttagagataacctttgtgaattagtgtatttcctttcaatgagttttctttgaatctacatgtatatgtacataattgagataagactgtacaaataatttgtatttt

SEQ ID NO: 99400 - DNA, 1044 bp, Homo sapiens
gagcacctgagcgctggggaggcccttattgagctcagcctggagaggggagggtcgcacgggtcccgggggcaggtctcctgcactggctcttcccttctgccagcttggaatttggttctcatcttgccacaggggtgcgtttcctaaagggcagccggagcagctcaaaggtgacaactgagatgcatttctaggcaggggcagggaaggccaacccaccttgcagccagttttctgtttctgtaaatagcagtgtatagagatggaagggcagcgtgggtgtatccacagatgggtttaggttttttttttggatgttttctattacctcattcagcaactttatgtttcacaatgactcaatgatgctttatttatattgtttgtactgtaattaaaaccattgacagacatttcactttgcttgttatttcatatgatcttgttttgattaaatatgccagtttgtattttcctgccttgggatttttttgtgtccgctgtacagtattctaagggaaaaagaaaaagaaagatgtgtaaagtaacagagagaggtggctatggtgtagagacctctttctaataaagaaatgaaaatatgtctacaccgcttccgtggagttgttgttttttgttttttgttttttttttttttggtggcgttggtcatttgtcacaactaattgtgtttctaagcccaggaaaggtaaatcagagagaaaaggggctctgtctgctgcgggcagggattgccccaggcccaggctgccccaggcccgagggactcagcacacgagttcacagacggaatgaagaaagagaccaggagtgtctcttctgacttcttcctttacaaggacagaaactccaagagaatgttctttgcccagccagggttgactgggcccagaacttccagatgcttctgtatctttgcactgtgccacactgccccaggtgtgtcgtaagaactattcccagcaggtggctagcagtagaaccatcccaggactctattattaagaccgttattatcat

SEQ ID NO: 99401 - DNA, 1053 bp, Homo sapiens
gtagacagaggaagaaatacaaaggagagattgaaggctaaaaccgagctagagagatggggcgccgggtattgagaagcaagaggattttgccaaatacgggggtgactgggaaatggggtcagttaaaagctgtccaagcagggtgcacggtaggcgaatttaagtgaggaattcacgtgttccaggccctgagttagggcagcttgaaagaggaaagtgggttgtggaattttcccgaatccagcactcccttagctgagctccaaacttgtccctttatcattaagaagagacaacagacaaaacaaactgacccacacatcaccaaggttgttcaagaaaaggactcagagaaagtttagctctcttgcaagtggctgagttttcagaagcacactttgatgtggtggtccacattcagcacaatcctggtttgtttctttgcgctttttaggggtgtgtgtgtgtgtgtgtgtagggttgctctttcttgagggatgaatggagcaggtgctatacatttttacttctctgaaaactttggcactttcaaaaagcccgtggaaggttgttagcggccaggagcgctcgtggaaatgggggatgtagtccctggtgaatacacatcaaggggcaggatttcacatggcaggaaggccttctgataatgatggaagaatcgatactgtggctgtaatgagccgcagaggagacccttttcacaggccacctccttcccaggacccatgctgagcagccttgaaagtccattcattaattacctacccgcatgtggtgccgagttccagccgccctgagtccccaaggcccagcctggagcttgttgtgcactcagtgggggaaggggggcctgtgggactggcatggaatggtggtggccagaggccccagggacatggacctgcatgggtttgagctgcccttcccagtgaagaccaggtcggatctggagggggtgatggatgtagtctatctacattgttatccccgtgataacaataacctacattcctgcaggtgccagctctt

SEQ ID NO: 99402 - DNA, 1006 bp, Homo sapiens
tgcagttctccttggcaagcaaaataggatcctttcagagagaacctccaaaacgtccaggggtcatctgggcagagcatcttcataacccatgcatgccgaaacacaaacaggttttaattgagccattatcccctgagaatctaattctgatggtgaatgtttgacagtgtttctttggaaaatacaaaagatcaagcccataaaatgcatgtggatagagacgtctttagttgtttgctagaacttcctagaatttgaaaaggcacacggtggaaatttgtctttatttcataattgacacacaacaaaaaccctctagtgatatttgatagtagcgaagagccctctactggcaggtgacgtgaactacccgacagaactctggaaagttcaattacgaattaattaatgtaattgtccgtgacctcaaactatctgtgggtaatttaaatgaagccttttcatagctaaatgaaaattagaaaagcaaaggataccatttttcattagcaaattggcagagagttttttactattaatacttgtcgaggagaagagtgtagagagccagagccctcatttattcctggggagagtgtaaacagatggaacccctgggggggcagtgtgacagtacgcataaaaacgacacgcacagaatgtccaggcccctccacctggaagcctctcctggcagtcattctaaggaaattctcagccaggtgccctaaataagtactatttggggtagtaaaagatggaaaccatctatacattcaaaaccaggggattaattagaaccgtaatgctggtgcttcctgttaaaatgataacggagaaataactttcatatgacatgaacaaggcagcccgtaaagcagtatgtgttgaacaagatcccattttcgtaaaggatctgtaaggacaggaagtgttcaacggttgattctaggtggagggagaagaggtgttgtttatgccattcagtatattctgagatttt

SEQ ID NO: 99403 - DNA, 1056 bp, Homo sapiens
aggaagaaagcatcagggaaaaaaatccagacatggtgattcgttcattgaatatttttactccagattcagatacagatcaagagagaatcatatgaacctataaaggtccgtcctcatgacaaatggagacagccaaactaattttcttggtgaccttatctaaattagttagaaaataacacttcagatttatgactagttacaattaagccctttgatatcttctaattaaacctgtaaagatttatttctgcattattcctttggtactctcttaaaaatgataaaaatgtaaatgaatattaccctcaaaaggagatgtttctatttatcctaaattagactcatacccttcctttcaaatgactgcattttacactcagatttacactgctccaatacaaattctacatcgatcttaaataacttatttataaagtttgcacaaatgttatacataatctattggaatataaataaagcagagccccctatatttcagccttttttgtgtgtccttctttttagcactttgtcccatttcacataactctatattcaaatgttgttttagaaagtattaggaggctaatataatagtcaacatcattcccagtttactctagctagtagagcagggctttcttgcctggatagcttttcttcaaacctttatctgagaaaagatgtgttcttcataatgactctcctaataggattctctttgctctgaaatgttcaatttgtattctccgatcgttttgcagatgccaaaattatgcagctcagaccagcgctgttttccatttattgttcctctgtttcttttctctccaggtgagtacagctacctggggactactcttcgccaggtgtccatagaacccatgccctccctcctggatgtcagacagctcatcacattgtacggaatctggccattaggtaaagactcggcgtgcgcggatgtgccttttccaaagcagcttgcaccgcttgctggtttggacagtgtgttcctgtttgtcatcaaaagtacagtgctccttaact

SEQ ID NO: 99404 - DNA, 1101 bp, Homo sapiens
ggaaagctgcccaggatgggggtgggaaagcgaaggaagatggagaaatggctgcagtttgctgcccatcagcttttctcttttaaggggcagacattgcagacgtagttttaaaaaagttccataaagcatcgccaaggcagcatgcctgtgcgacacacgcagggctttgggggtgtgttttccccgtattaacagcaagtcgttgaagcgttgagaaggtattatgatttctaatcaggcccagaacaggccaagtataggctttctgaatgaaaaaaaaaaaaaaaaaaaaaaaacccaaaacaaaaaaccctgcttaatcaggaacagtggctttttgtgtgatcattttagggcgagagctcctgttttcaagtcgacgtgagggaaattggttgaagtcactcaaacctgaggctgaagggcagtcactttataaaccttaagagtaaccgaggggaaagaaaaagacctcaaagattgcaaaactttagattttttttttgtgattttgtagaacatgaggggaatctggggccagaaggcatttgtacctttaaaccaggcaatcaaataacttagttttattattagaagcaagaatagtattaaaacgccttcaattggattgcacgtgtgtaggcataattcaggaagaaactaaagatcgtgtcatgtcaagtgttactaaagttcaggaaggaaaagacaaagctccaggacacgtattttctgttgaaataaaagaaagcaagccagaaatagacagatcaggacagggaggcgtgcaggcggtggccctgattttgaatatttgatggtttccttcagggaatgtttgatgcttttatcgactaatttggaattgaaaaaaacaaaacaaaacactattgcttcaatattaaagtgatcagggaattgcataattttatggtgacaattttaaagagccacaggtagttttggaagcagactgtgttttgttccaggcactgaaaaagtggatgggggccgagactatctcaggtggccttgaaccactgttggcaaagggacagataacgagcccagggcagtgtgggggactttgcgttttga

SEQ ID NO: 99405 - DNA, 1006 bp, Homo sapiens
aagcaggacacttgtaatacagcagtgccaggagaggacaaccctgccattctttggggacctagataaaatggctccactgtcccctgctgagagtgagcaggccatcagcatcgcggtggccggggctcagctgcctgacgtttctttggcccctgtactgtgttgatttcacacactgggcacagccatgctggcggtgtcttgagaacacagccatgaaaagatggagaaagcaaacacagtttctgtcttggagcaccacatggatttagattcagagtatgatttattttgttttggagagttttattatgaattttttttctcccttctttgcaaagacattacagagctaaacccaaacagctgagcctatcagggccttggaaaagcatttttgcctgaaacttgagtttttcctaatgaagtgactttcctcttccatcttttttgtttgcttggttttctcataggtcatttgattgcccgcctcagaacgatggatctgcatctcttcgactactcagagccagggaacttctcggacatcagctggccatgcaacagcagcgactgcatcgtggtggacacggtgatgtgtcccaacatgcccaacaaaagcgtcctgctctacacgctctccttcatttacattttcatcttcgtcatcggcatgattgccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcggcagcattttcttcctcacgtgcatgagcgtggaccgctacctctccatcacctacttcaccaacacccccagcagcaggaagaagatggtacgccgtgtcgtctgcatcctggtg

SEQ ID NO: 99406 - DNA, 1131 bp, Homo sapiens
gtggagaccccagctggaggcagaacagagaacggctggggccatgaagtctccctacctctcaggggatggcagaggtttccagagagccacgtgggagagccaccaaggcagggagctctgccaagacagagggtgtgttcagcttgagcctggggccctggagttgggtgagagcttcacagagctgatgtttattgatgccgttttctgttaactaagttaaacctctctctgaagcagtgctggcaggcagagctgcctgggggggcaagggggttgagagggggcgtctattttcccaggtgctgggtggggttcaagccaagggaagtgaaatacaatccccccaagtgtgaaactcccctaaaagtaaccttgcccttcatgccagaggcctccctctctgtcaccagggctgcacttggatttcagcacacgtgcttccattcagtgctttgtccatgaaattccacacagaaaaacaaaaccaagccataatgattttgattggaaattactgctctctaacataaagcatatttaatgtcattaaattttgtggattataactccctagtgaagaacacagcagtcaggctgcacagcagccccgtgttcagaaaatggcaatttagtgattttagagccacatgatttatctaggagatcagaaatgtaatcaaaatgacatcaacgaaaacctgatttgctggtttttaattacagttggccctttttagttgggatcacatatttacgaattcaccttctctctaaaatcaacacctgaggtgcttttgaggttattctcccatgcaccaaaagcagcaagaactttgggtcacccccagcgtgcgcgttgttccccccgagatcgggcaggcagcactctgccttctttgatggccctcaatactgaaaacgtgtccttttggcagtgccatttttgttgttgttgttgcatttttgtgcttttttggtgattccactgctttaaatggcccctgagtgtcatactgacaagctcccaggtgttcctaagtgcaaggcaaggcgcccacagggaacatgcattgttaggcaagctgtgcgcaggcagggctgcagtgcccttggtgccagagacac

SEQ ID NO: 99407 - DNA, 2252 bp, Homo sapiens
acgctgcccaacaagcaggtttgcggagactcacaccttagattctgagtttttaagcttgtttcctcagagcagggaactcacgaacgtttcgtgagcacctacggtatgcagggtacggtgcggagccctagcgtcactgacgaccgggacagccgagcagctgcaggatccgtcgtgttccccagcaattttaatatttaaaaattcgttactgttgctgttacttgttttctatgtattggatgtcttcgtgaagaaccctcaaaagtgcaacgaactcctccctgccagagggcggccgcgcgctctgagtacagcttcccgcggagccggccaggtcctccagggcaccgagaaagccggccagaacggcggcgccctatcccggccgcagcgatgtctgacggcgccccggaactgacggtctggtacgcaggggcgctcggcggcaacggcggctttaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggtaaccctttgcgtcgcgctgggagaaactgcggagtagtcttaggccctggggcggcaccagtttccagggtaacggggtctgaggctagcgggctttgggagctcacggggcgggcgtgggaggtggacgtgtggatccctgaccgccgcaacctgctccgaccgggcccggtctccccgaactcgccgggacctttttgttatgtgtcttcagcttgtgagcccgaaaaccctgtgcgtctttgctccagcacctaccgatgagctcatattaattaggcatctttccttcccagtatcgggttgggagagggtagtaaagtgggttttattaaagatcttggtatacacacacacactaacacacacaccgcaactcacacgcacaccaagaaaaatgtgaccattgtaacctttttttaactcacaaagcctttctcgtaatgttgtcaagttagcttgccattttgtcttcagtaagacagatgaaagttatgcagctgttaaagttaatgtttttcttagacacttaaaaagggtttatatcattagttttaaaattaaataaaggagacaacatccagaagcagcagctcactaatagataatagatactttccagttgagttaaaatggaaagaattgtctttgcaacgcagctgtggtgattttctgtctcttattcaggacgcttgatgtaatgggcagaatcagaatgcttcaggaatctgtcgaatttgtttcttataatagtaagatcatttaaatgggaatttgagaactggggaaggggatccacttacatattcttgaatgtataaagaaactgaagcccaaagggagataaatcaaagctgatgacgaatataaacttaatactcagaattttcgtgtttgatacttctctaagctgtttctaaatctataataggactataagattacttatagtcttagactaaaaaggcttacttttaaaattagcatttataaaatattattttaaaaatgaaagttaaagggtaaatgaggtttttaaaattttgtgttgttttgttttgttttcatttttggccttctaggcccctggaggaattgctacacccccagtgtatggtcagcttctagctttatatttgctccataatgacatgtaagtatgtttaacctaaagctaagagcaacaggtttctcaaagttatatggaaatatttctgcactgaagtagcaccactaaacataggcacaacgagctaccttttttattacagtaattgttaacgtctatttcctattgaatcataggttaatgaattatgattaggtcgtcattgtcttacatatactttctagaaaacatttcaatttattatgacaaattacgtcagtaaattcatttaacctttttgtctttttaagaaacttttatgacctctatttacttaacttcatatataatcaataaaacaaaagaagtgaaaagagaagattgcagccaagaggaattcgttacaaacatgtatgagattttttaagttttttttgtttttaattattcctatttcacgttcacatggaaaagtcagaaagcataactactctaggccgggcgccgtggcacacg

SEQ ID NO: 99408 - DNA, 1006 bp, Homo sapiens
cccagaaagtcaaggctgcagtgagctaagattgcgcgactgcactctagcctgagcaaccaaagtgagaccctgtctcaaaaggaaagcataactgcaaaaaaaaaaaaaaaaagtctcctatagttctgtgactcactgatgattcctgataacattttattttaaactcttccaaaacctttcttttatatctttttaaaaactaaattgaaatttttattacacatatgtaaggtttttgtttttgttttgtaaaactgtcattatatgtttgttgtagttcaagcctccaaacccataaaaactcctgcctcagaagctgtgtcccactggtaggaggggctgtaatcgggagagaagtgttgtgtaccaggcttattgtcagggaatgctacagccttgatagtacataaatttgtttacttttatatcctaataaataatttgggccgtctataaatcctcgtgtttttagtgtgctgttgcctaaatttaggatatggattattatttttaaaaaattcactagaaatggcaaaatattactttggtaaaaatatttcatgtcctttttatctggaaaaccactattgtttccccaaaacaaattcatataaaactaaattttactttgtgttatgtgaagtatacttctgtatgtttggcttgggacctggtagtttttaacatttcctgagatgattatgtttttaattgattattcttctttgtggtggcgtaaattaggaataatgcaagatatctttggaaaagaataccacctgctataaaatctgtaagtatcctttaaacctattttactgctttaatgtaatgacattcccttaaatggcaaccttttataagcttatgttttctatctgacgtcctagtaatagtcatcagattggtattaaggattcgaaataaatcttcagagtcctctaatcagaaatttgaattttgctgggatggtgtagaatttctgctcagttcctactga

SEQ ID NO: 99409 - DNA, 1281 bp, Homo sapiens
ttctttggctaaataaagaagtactataaatcatgcacataagtttcaatggcgttagtggaaactcaatccttagagaggctacaatgtatgacatcttagattgagagtctctattgttaaccattttgctattacttttgacctaaatatatattcataatatatctatgaaatacaaatacaacatctttaaaaacaatccttaagctaattagtccccaggcttaattctgaaatgttttttgactactttctcatgccttaatttgctattgtaataaatttatatcagccctacagataaattttaccttactgctcatagtgtttaaaaaccttttgatagtgattgggctgaaaaagtaattgcatcttttaaaataaatgttgaattaggttttaatgatgtagctaacaagtttttatatcatttctggtattttgttttaagatacaatcattggtgcatttacagagtgaataccctctaaggcaataatatttattgcaggcaaattctgaacttgggggaatttggtcagtaggacaaagaatctggcagagagatttccctgggatctatacaaccatcaacgctcaccagtggtctgagacggtccagccaattatggaagcacttagaggtagtgtttctttgtggttaaaaatgaaattagatgagacttagtccctaagtgctgcagtgttgaagtaataaatcagtggtgtgtgtttaagtagatatttttgataggtgaaaagagcagttttcagaattttttagatttgccctaatcatgcttcttcattttttgttgcttgagattacattggctgctgtgcttttgttgtttcttaattctagacagaaattgctcgtcagttttaagagttttttttgctattaaaacgagatcttgtaatattctaataagtttaaggtatgggtttgtagagatgtgaaaatagagactgctctttgaattttgtcagcctcagcctttgataggtgttgtcttaagcttctggattttataatttatcagtttaatacatagatgctcaaatgtgtttttaattgctttgaaagattacaagcctggtgtgacagagcactgatcccacaataaaatctcattccctgcctctctacagtctctcacccctagcatttgcttccagtcctcctggttcactctttataaaattatataatcttgttttatgttgtcatgtactgttatttcttattgttacccttacttccatagttaatat

SEQ ID NO: 99410 - DNA, 1100 bp, Homo sapiens
ggatgggagtgactagttcatcttcccttctgtctccagcactggcagtgatggatgagcagcacttgagtatttgttgaacaactgagtttgcattctgttagcatttgttttcaccaaaaatgtgttccatcaactactgccacagatattaggtgctggctcaatttattccaccttccagcgtgtcattctagggcctgaggttacagatttcacaacttgaggatcacagagtgactagtcggaatgtagatgtgattcgtgccaagtggatattgcagcttctgagacagagaacacttagcctttatttttgctttgtcaactcacttctcccatcacatgtttttctttccttttccagtgatatctttttacttttctctcccttttatctcctccattcttactgtattcctgttttattccccactctgaaaatatggccagaatatttgaactgaagtaaatgtttttgaaatacagttgacttaccaaatgaatatagttttatggtgtatacttttacttctctaaaaaaaaaaagtatactttccattgttggctcttttccattgttggctcagttcttttccattgaatgtatgcagccttaatagaaaacgtttcttggtattgcaaagtctgttaggttacaggctggttgaaggaaggaaggaacctacaataataagtgtaaagccacagaaggaagagcagacagtggctgagtgaaagctggagaggatgtcgggctcagatgaggggaagggatgggagtgtcggcagtttttaaggaatctgagaaaacaaagcctaagtgttggagtcgtgccccattttggtcctcgtgatgccatcaacaagcatgtatttggcatatatttcactggagatgctaggtgtttgggggactttgaggataagagataccccttcctgtcgagaagtttggaatataattgaaaagaaggggataggtggaacagtgtctgccgtagtggaaagttgcttgttaaagtagaagtgtaaacaatactgctgagtttagagaagggcagagatcgtaatgaattataaacagacttaggaatggt

SEQ ID NO: 99411 - DNA, 1046 bp, Homo sapiens
tcgtgagccctacctaagtacacgagacgtttaggtgcacatgtgtgtgcttcagatattttacttaaccgagtgtgtgttgtgtttggccgggatcacttggagaacctgggactcccttccattataattaatgtatttcatgacttctcagtacagttgggaaggtggaagaaaaatagacaggttgacattcccttttcacattcctcatttgaaactggctgggatcgtgcagccaaaaggagtcattattttgcttggcaggtctgcagtaattctcaaaacttccattgggtgattaacaggagcagcaaggaagcaaaacttcacccggatgagggtggaggaagggtgtctgtgtgtgcgagtttccccagggctgatgaggtgtggtttctggttcttggcacgatgtgggtgcttgggaagattcccctgagtaaccgcagaataagagggtgaagtctgaaagagctctaggccccatgcccagcgtcccatgctccccctcacagtttgtgggactttttcttccacagggtggctttggccgaaggggaccccccggagctaaggtgagcctcatgcagtgccccctggagactctcttcaaacagcccagatgccgcccagcccaggagtgaaaaacactctctcctgtgaacccaaagcttcggagacagataccaatcaatttagaaagttgatttcgccaaggttaaagacatgcccgtgacacagcctcagaaggccctgatgacacctgcccaaggtgttcggggcacagcttggttttacacattttagggagacatgagacatcaatcaatatgtgtgagatgtacattggttcggtccagaaaggtgggacaactcgaggcaggggaggaggcttccaggtcataggtagataagagacaaaaggttgcattcttttgagtctctgattagcctttcactgaatacacagtttaccagaacagtcacctatgccttagttaggcttagtgaaaaacagggcgaaggaagcaattggatatgcc

SEQ ID NO: 99412 - DNA, 1030 bp, Homo sapiens
gacagcatacaaaacaggtggctactaaaactaaatttgtttttgtgcaactattttgtaaaaagtactgactgggcagggtggaaggtgagccagctttcctccagcaggtggggaggcaaccataacttatgtgttcattaggacaaattccctttggggtggccctgtggtcacgttggccacagtaaatgagggtgtcctttaaatggagttagctttgttgaaagtcattgttgattgtgcttggtaaggccattctaattgccttataatgttgccacctacagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaaggtatggtggtgatggcttcagacacacaatggggtggtctccaggcagggcctttaagaacaaaacaaaatgaagtgtgtttgtgtttagctaagagacaacaaatgatgaaaacagcagcaacgaacatgatttattccaggtttccttttgca

SEQ ID NO: 99413 - DNA, 1087 bp, Homo sapiens
atccatcgatgtcactcaaggtgcagctcagagatgaacttggggatcactgtgatttttctttcaggactgagcctggaaacgggtccaggcacactgaaacgtcttcattaaagtttcctggacagagtttattgtaactaagatcatgtttggtgatgaactttacctgtgacaaattgaaggcgcactagaatgggtatttgtacaaatgcctttttttttttccttccgcaaggattctaccttaaggctaaagaatgtacatgacatccagaaagccgtacagggacagagagcagcagcttgggaaaaggggagccaataggttgcggccccagggggacaaaggaagcttaatttttgactgtgttccctttgtaccatttgaactgtgtgccaggtgggtgtatgaatgcaaagaaagtctctgccttgtaacccgccttacaggttcttttccgtgttggcttttccacatgtgattcttcccacaggaaacacctccaagccatttggactgtggtgtctggctgtatccgtcagatattctgggggatctactctgtaaccaatccttaggtgtttgtagttgtaaatacctgattttgctcttacggacatgtggcagtcactcagtatttgttgactactgagtgaataaagacttctgtttttctctgtatgatacagaaaagggctttccaggcaaacccttattcattcctggaagcccactgtgacctccaggagaccttccagactcagccctctcacatcgcaccaggcctaagtctccctggctccacggccctccatggcatgcccgcgcctggcatggcagtcaggataccttatcattatttgtccacctgtagaaggtgacacccagacaggaaatatcttacttttgtatcccaagagctcagcacagagccaggcacatactaggtgtttgtctatgtctgttacattaattaataaacaaaagaagtacaaggcatttaaaggacctttggctaaatatagacatttgctaaatatagtagcttgagtataactccctcctgtgaagacagtcacttat

SEQ ID NO: 99414 - DNA, 1006 bp, Homo sapiens
ggacagcgctgggagggcccgcaggcagcaggatgccagggcctcgccaggaagccatggtaggcgcccggggggagtctggacgtcaccccattctcaaggtgaagcctcgccagggtctcgccaagagagctgaggggtcagattcaccttctccctgcacctctgcacttccctctgggtttcctgtctgtacatccagtgccgcgcgtggcgtggggcgtggcgtggggtggttcctcacagttaccctcgctgggtgtgcggttgtctgacatcagtcctccccagaaagtgcggctgcccccggtcggtcgttctgtctgtagctggcgtggtatctggcacggcggaggccctgggtccgtgtttgtggatggaatgaatcaatgtgtgaatgaaggaagtcacattggcagcagtggcggggagggtaccgtttggggacaattcagatcattctgaggagacatgctgaggcctgctctaagacagcagctgtgggagggcacggagtggcattaagagaggaagctgactcgatgacgggcggagaggtgggcggaggctgtctcaggagcgccagcagctggcagtgagtggtgggcgtttcctgacactaaggctctgtgcagagcgcgtctacaaacactgtctattgtctcgtttcatcctcacaacaaccacccctatgaagttgtcactattattgtctctcctttacacatgagtctgggcacagggacttcaagtgaagcctgctaggaggcactgctgctgcccccgcgggaaggaaatgcagggaagggactcagggggcagcaggaattctgctttggatctgtcacatttgaggtgcctttggggcttccaggaagaggtgtccagacggcaggggctgaggcttggaggagtcaggattggaaatatgaactgggtgcccatcaacatctaggtcgtggtcaaagtgggtggtggggtattacaggaaagagctctgcagccc

SEQ ID NO: 99415 - DNA, 1059 bp, Homo sapiens
ctgtaagactgagaaatacataatggattttagctgtcgtgtttttagaaggtaattggtagatatttgcagtgcattgtcttcatgaaaaacaaaattgggcctggtgcggtggctcagacctgtaattccaacactttgggaggccaaggttagtggattgcttgagcccaggagttcaagatcaccctgggcaacatgctgaaaccctgtctctgaaaaaaaaaaaaaaattagccaggcgtggtggtgcacacctgcaggcctagctacttgggaggctgagttgggaggatagcttgagacaaggttgcagtgagccaaggttgtatgtagtgagccaagattgtgccattgcactccaacctgacactcaacagtgtgagaccttgtctccctaccctcccccccccacacaaaaaaaccccaaaaatcagaagtggttttcttagagatgctttactggaggtgtttgtggccatttccttggctactgtgtatagaggaggttactgtggtcactctggtatggacttaaaaagcatcaattctgtggaacacactgggaaagcggatacatttaggattgctatagacttattcctagacactttttgagatgagtttaattccagagtaaaatacattagaaattattttaagtatgcctcagagtgtatcacaaaacaacatttaatggtgtaatgtaacgccatggaagggctctgagctcaggtacagtgcaccttgactgggacacatacagctctgaggcaggtccttcaatattgggtcctcctgctccttatcctccctcaactctgccatccactcttcctgcacaggaagctctgcatctagttatctgccctctcctggccactttggtgtcctcattcccatggagctcacaatcggatcaaatcctgagtcagtacaagatgccagtgcctgcagctcccctccccgctccccacacccagcctttggtcggcagcccctcaggccttgccccacccactccatcttttctcactgtcctttcagcctccagacagg

SEQ ID NO: 99416 - DNA, 1068 bp, Homo sapiens
acaaaccatgaataaatctcccccatgcaaagccttttccttggtcccgccttccttcaaggctgccgtctaccatttattacacatgcacaaatcacagaaaatgtttaattgccaaattttaatggcagaatgtaatgaccagtgtttttctagttgcaaattaaagtctttcctgaccttgctctcttcactctgtggcttccaggagatgtctctattttctgactctctaactaccccttctctgtcttgacttgttcttacacacctcttatccttcccatgtaagtgtctcaaggttccttccttcaggctcctttctgttctgtgcatgctgcctgattttatcatcacctttaactaatcggtagtgtgtgctgaggtgcctgttagactcctccactgaggctttctgcctccaattcaaattcagttcaatcaataatcaaacccatcaccttccttagaaaatctaaagagatttaaaaagcaaaaacaataaaagacctattagatgaaaaataagtgtgatgaattgctgggtgctaggtagttatgaaaaaatatcctaaagacatgtcatttttaaaagagtttctattcccaattgctacagaagtataaaatactgaagatcaatgagaattaatgacaattcatcaaagtcctccattttgttaggaaaaccattcatccatctatccatctacccacccatcatttataaggcacctaccatgttccaagcagtgagaacatgcttttaatcgggagagcccattcataacctgggggtgggggctgagggaggtggtgggagaggttcagtacccaggtcacagggcagctgtgggaaggctgcatgctgccatatgtaagcccggcactggagctgttgtggatgctggagacaagctcactgttgctttccagacgctcttgctcttctgtccaccggaggcagtcaggaccctggcctgagggccaagaatactttgtgcctgagctggaccagctggccgtggggtaccaccttctttgcagacagcaggcagggtctggatc

SEQ ID NO: 99417 - DNA, 2254 bp, Homo sapiens
aggatttgggaaggtgcactgacgacacctccctcacgctcttctttgcatatcacatctctgggcctggctattattagaaccagctaacataatttgaggttatacaatctggtagcttggggcactggcattttaagttgttgattaaggggaaatgaatacgttttggaagaccagtgtttaaagggtagggttgatactttggtgtaaaaattgagaaacctgatccctgttttcatcggggtcacaagccatcccacctgcatgcaggcgtttctgagcaggctcagggttttcttgagggggccgctctgagaacaccgagaagggcaggaagctgaccggggttggtatcccccaaggaaagcatggagcgtgtacggagaggggaggtggcgaggagacaccagtgtcgggggcagccctgtccccacagcattatcagactccaggccagctctagcccaccctgagctctctttcttgaatggttcttttcagcacacagacggcgagaacccactacagcttactctagctgcgttccggggtctgtttaaaaggatatgagctcttttttaatggatttgttaggggagaataatgtacatattcttgggaaattcaagtgaaccttgaacttcttagggagaacctacactgatagaagaaaatggtgatcatttctcttttcttgctgctgacttgataaacattttggttagagatgctttgtttcttacagtcatattgttggatgtagtcacatgtgttcccccatataagactagaaatgccaacttcttggtctcgcagttttggcagtgccttcaataatgcctgatatgacaaatgtcttaatgaatgaatgaatgaatgaatgaaaatgagtagctatctcagttttatctagtgattactacaaaattaaaagaaacctctgaagcaaacgaatatgtcaatgtatgataataacctcttttaggaatatttctgttatattctaatgatcactccatttagctggaattttcctgttattctgtgtgtgtctgtgtgaatcagaacatcaaagcctctttcttcattatttgtgaatttgaccagttaactttccaattaagtttctgtactttttgattaaacttttattaccgcaaaaagaaattctgaattaaagatgaaggaagtactttttctcattgatggcaataggttatacagacttctgtattagaataatagcagtatttttggtaagattcgtgtggctatgcccctatttccccaatgtatctaaaatgaaatgtaaagtaagtgataaaattacaaactcttgtcagtgggacctcacctgttttcttattcacattttactgtattcgttgtgacttgattcatatgtctagttacttacagaacctttcattctgatgttactgcttctttaattggattttacatttcttttttcttctgtccttctctatagatctatcaggtccaaaaggtaggctcttctttctttattttctaacttgcatgtactgttttttccttgccaagggcctggtcacctttcagaaataacaccttgcactgaagatacatagaagttcttactgtttattttactactttgtgtatgaatttgtttgaacaagaatgcctagatcctcatcttgccccactcaaagcaacagtcagacacatttctgtgtactgaatgcttttgtcatctgcattttcctcaagaaatgtaaaaattgtttctttgagaagaaaagtaattctaaggcaaaattatatttcagaatgtggatagccttctgaaattatgtatggaaagaaaaagatgattttattagaaaacttaaaaaattccatacaaattaccacacattgagagattattagatattgagttaaaaatctgagtaaaaggacagtgatgatataaaatgaacctgccattcatccctaatgctcagagatcataaaatgacgtgcctctctgtttcctagtattttgtagaagcagctgaggtttagaagtaaatacactgggcaggccagatacagaaaataaagacaagcaagtcagtgattcaagatctagcaaaaatgaagtcagaagtgagcgagttccttgagaatttatagaatttgtatacacgggagtctttcccataaatgaatttagtttgatacttaaaacatctgtgatagtttccttttataaatttagttt

SEQ ID NO: 99418 - DNA, 1076 bp, Homo sapiens
gtccttgtcagtgtccttgcagtgccaaaagcagatccgtagtgattttgccaaaaaactgtggttcaaatgtgaggccccgtgagggcttccttgctgtttgaaaccttctcctgagatgtagcctcagggatgctgttgtaaccgttacctcgggaccgtctgaccccactcaccccagaagagggaagatttatggatccaaaatagaataaatgcaaagctcaattgacaaagtctgtagacaaggcccagacatcacagctgttgagcaggcccaggagaagcttgagtccttgaaaccagtgaagaaaatgctgtttcagggatgagggggagcgaccgagagaggaggaaactcagacttagcggtatagaggatgtcagtcactttggcaggagaacttttaacggaaatattgagggcaaaacctggttaatatgggttcaagagagaataggaggagagaggcacagaatcccaaactgtctctctcaaaatgcatcattttcagagccacaccctcctgaaattgtaggcacaatttcagatgtaagatgtgtgcacttacattttcctgggaaaagaatgttcagtttcttcagattctcagagggtctcctgaccctgaagagttgaaaaccattgcaatatgaacgagtattacggtgttatgtaacagcattcatttcattttcaatgatttttaaccagaaataagttgcatctttctgctggacaccactctttgccgagatatcaagtatatttgttttaagagctgaaatttcctataggatgttcaccattaggacagtacataagatggggaggaagtggatgggattttcattttcagccacatgacactttcccatcaggtacttgatctgaagaaatatattcctcagaacttaagaacttggatcctggagatgagagtcaaacctcctaatgtttataggcaccaaacaagcccagagtggtgaagaggcctgcgtggggtcacagttcttaggaacaaggccagtgcctgctgctcagggccctggtgggctgtgtgtcctccgtgcgc

SEQ ID NO: 99419 - DNA, 1090 bp, Homo sapiens
attttaatattatgaactttttacatttttgattgtaagatcgtatcttttatttattgactctgaaaacacaggccttcttcatttagctagaaaaaatgataaaccctaaaaaaggtggggaggtgatttatactactctggaatttgtatggatgcctcctcagaaagtctagattttggattttctagaatttctcgagtttagattttctggaaaatctagatttttaattttcctttttgaaaattgatgacagtgcatctgttaacctttgcccttttgtaactaaaatggattatgtagaagaggaaataagatttatcaaactgtttcagactttgtgaattatagcagcctttgccatggaagtttattgaatgctactggattctgtggtagctaccattctgacataattctttttgtaaatacatattagatcctagaaattatggaaaaatgcatttttgttaagattttaaagattgcttgtatttatgttttacttagcttttaaatttacttttggcaactctctttgctgttgttttttttttctgccatctttcttctgacagtcgcagcctgacttggagtatgggggtccttacgcctgggtgagatggtcggatatactttgctgtgtgaccttaactgtgtggtgtgaccataataacctgtggtatttccacgaatctcatgggtgctttgtctccagtttttgcctggggggctatgaggccaggagggcaggcttaccctgcagagtgagcagtcttcctcctggggcctccagggtgcagccctgatcctgccggaggggaggagcccaggcatctgtgcatgaacactccctcaccagatggcctttgagcaccagctgtttgccacgccttgtgttagcagctgtgcataccaagatgaaaaagatagtgtctgccttcaaggaactcaaatcagatcaagaattcccaaggcctctacatttgctttaaaagattaaatgtaaagccattttacctaatgaaaaatccattattttccagtctatatccattcaaattaaatgtacaatctgactttttt

SEQ ID NO: 99420 - DNA, 1031 bp, Homo sapiens
aggaaaattacccttaaaatgggtgttttctgagcagtgtttgctgtttgtttgtgtctcaagaaggacctcgcaaggatgttgcttcggtgatccctttttccatccaagtctggtgttgcctggctgggtgttgaggacaggttccttttgtacctgggcccttgagtagggtctctctgggtacgtgaacaggtgccacatattctttctttaggaaaatggcaggcagctggaacatggaaaacttagcgttttagcctcaccaggcatcgtgtgtacaggagcctagatagcaaactcctttagacacagtgttagaaagttggaattaataaaatatttaatgtgctccttgaagcatttgtttttgaaaggaaacttgacgtaaactaaacttccacagacgtgttttagaagtgactgtttccagtagattttcaatgatgtctgtatacactcagctgtggctgtaaaatacaacacacatactttgtaaacctgttagtgtgacgttttcaccctgacctgaaatgtttagtatcactcagaatacgagagtcatgaagctaacaggctgcaatgtgttcggcgctgtcgcccttcccgtgcaggaggccactgtctgcggggtccggtgctttcccgtcctgggctaaggtgggtgggcagagcagcctggaccgtctgcagccaccatgtcctctggacccctctctgcaccatgcccacctcctccaggcccccacaccatgccatgcagtggccgtgacagtgtttagaatcctttcttgtcttccatttcttcatcattttagggaggaagtgctgtgctttatgtcaagatgaaacacaacatctgattccttacctggctctgctagggcttaggaaagggggcttggttaaggtggactctgctgcctgcggcttctgtccgggcccggcccctgcagctgtgacacactgccatctggtggacacgagtggggctgcgtggctttccacggggctgaatagccttcctgtgt

SEQ ID NO: 99421 - DNA, 1115 bp, Homo sapiens
gagacactgtttcaaaaaagaaaaaatgctgctggggagccactgaaccaaccggagacccgctggtcccacgtgaagcagctgtcctggtgtggaggtacagagctagaccagcactggtccctccagccccctggtagcctctgctgcacctgaactggcagctcttgccgctgcctttagctctgcatgtatgcgccctgaaggttctgcctctctgttttggaatcgccttcccctcctcatgtttggggacctgcaagggtgtgaggcacgtgagggcatcgccatgcgtattttacaggcctctttctctggactgtccttcaaagggaatgacctttgtctttccaggacctacccagtgagatctgcctgccattttcctatgagtcaaaaatctgaactcactactgctcctttcctggttcataagccagagtagggctggttggcagtcactggcttgtggccctatgtaattatctcagccatcacacactggctctttcacaagggctggtcacacgcctcgagtgattcttcagaaatctgttgaacagcctgacacccagccctaggacgccgtgctggggggattccccagctactgagtggggccagagactctactgcctctgtgaccacatccctttccatactggtatctcgtttgttctaatgagtgtgtccattgcttttaatagtgaattttctgagcaatgagaatttgaccaaattgaaaagggggatttccatgcatttgaaattgccatgtgtttcttcttctgatccatttgctctaagaaatatagtctaagtttaggactgagggtttttttttaacagaatactgaatgattctttgttttgatttttttattgcaatttcaaaaatatgacctgctttccacaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagtaagcattagtatgatacagaatgtta

SEQ ID NO: 99422 - DNA, 1479 bp, Homo sapiens
ggttcaggtgaggcctctcttcctggcctgcagacagccaccttcttgctatatccttcctccaacggtggagaaaaagcaatgtctctgatgtctcttcatataaggacactaatcctatttgatcaggaccccactcttatgacctcatttaaccttaattacttcgtaaaaaccctatctccaaatacagtcacattgggcattagggcttcaacagatgaatttagagggacacaattcattccatggcaattactaaagttttcagttttcttaaatctgagagtttaggctaactctccatccctagatttacgaaacagtccctctcattggtgaacattcctattctttggtgatcttgtatttgtttggggaggtgtggtagacagaataatggtcccccgaagttgcctacatccagatccctggaaactgtaaatatgatgccttacatggttaaagggcccctgcagttgtgatgagagaccttgagagaagggattatcctggattatttgatggaacaagcatccttctaagaggaaggcaactcaaaggcagaagtagaagatgtgacacaggaagctgaggttggagcgatgcgagagaggggccatgagccaaggaaagcagctcagtcttagaagctgaaaaaggcagggaaacagattctccctagagccttccagaaaggcttgattttagcccataagactcattttggacttctgacctctagaattgcaagagaataaatttgtgttttaagctgctgaatttatgacgattcattacaatggcaataagaaactaatacagggttggtttttaattttttgacttaatcggttctttaactgctgccttgaagtgagaatttcacccaaagcaggttttcttcctgcacttcttgaagccggaagtaggacaaggaaaaaaatcctagaatgctgacaatgagttcagggttgatgaggtgaaagagtgcttgcggcctcactcactgtcccagctctcaggttctctctcgggctggggtttttcttcctctttaaccctttatctgctttctgtctgttcctttcctcaggaaatccgacagctacagcagaaacaggcgagttctatcagggagatttctgatcttcaggaaacaatagagtggaaagacaaaaagataggggtaggattcccaagtcttgaaaatctactcaaatgggcagcctgcttagcaaatagagttttttcagagtctttagtttgcaaaaccgcttgtctgagtatgcatgcaactcccacgtgacacaaagtcgtattaatttatttaattttattaagtagtgaatacactaacttatccaaattgatatgaacttggattgtgacacggactctccatggagggtcttgtgaatgcgtagctgtgcgctctgcctgccccgtggctgggccgggccggtggttgttgaaaca

SEQ ID NO: 99423 - DNA, 1053 bp, Homo sapiens
ggaataatcctaaattcagaaatagctaccaatggagagacttccgacaccctcaataatgttggataccaaggtcctaccaagatgacaaaagaagagttaaatgccctcaagtcgacaggggatgggaccctaggtaagtatttgctttccttcggctcctcacacctttccactcagcattggttcaccctccatgcactgctggggttggagccaccgtcgctgatgggttaacagtcaccagcatgccatttgtttcatcacttcatggtaatttccttgcccacccggtgtggtcacccacgtgttgtctggcatgcatctctgtgtagtgcaccatcaatggctcaagtgaaccttttcttttgctgctcaaagctaccaagcaagactgtgaaggcaaaaggaaaacagtctcaaaattaagtaacaatgtggagagtactatttggttttcctcagacacatatatatctgtacctataaagtgtggctttttaaaccgattctatgacagaattatcaaaagatcagaatggttgaggccgtcaagtcagttggccatatttgcaagccaacatcgacatcctgggcagcattcagcgctttgagggtacggggtgcctgtggacagcaggtccgtctgtgttgcctttttcaagccaccgctcgaggtgggcaggcggccgtggtagtgggtgtggcggtgctgagagtctgagtatgcccacctttgtcagaggggatcctcctttgtatgccacgtgtttgcttctgaaagaatataaaactggggaatccagtagatcagaggaatattttataccattttcaatgatctgatttgtcataatttgtcataagagttggctttgggagaaaccttcagattctggcgtgcagcctgaagttgcagcgtgcaagtgaggcctcatctgtcactggtcaccctctgcgttccagtgttttacaaagaggctggaataaggtcagggtccgtgacttttcattttaatgtagaagctttcatcttatttctttttatttatg

SEQ ID NO: 99424 - DNA, 2063 bp, Homo sapiens
aaaatgtacgttataaaatatatgcaaagatatgcaaagaagttttagagtaaaactctaaatagaattcctaatatttcccccattttccctgggatatgggcaccccaccatggagatcactgggctataaaattatctagctttgactttcagtaacatagtaccatatctaatctgctggggttttgtttggagagtccaaaaattccaaaacagtttgatgttctttagacgatgaataatttatcatttaatttagtggtcatcttgatcttgaacatttgcctcctgctggtcctctctccctagtcccttagggaatggagcagaggtatcagggcatggacacagggtgttttctcaggaaaacaatagttgagtggcagaagatagatttcctttcatatgagctatttcaaaagcatcttccttgagactgaccttgaggctgcatttctaaaagtgcactgaatattctttttaaaaattacttgaaagctgcttttagggctgtgtgacatggagtgcagtttgacagctgcaaaagtacaagttgtcaagttgttcattgagaagtgagagtggggaattgaaccttcagtctgttcctaaacccatcattgtggattgtttggctgcctgatccagagttctttctatttgttgaaacttaacgtcacctttaaaaatctgtccacacaagatggcaccagcagccactctggcctttgatgtggtggcagtggccctcactgacccaaaatttactaatgcaactgctgctttgccgcacagaactggcaaaggcttgtttctcatgactctttgatgactctgtctttaggaataggggtgggtgggatttggaacgtgtgtttacattctaatgtagattatgtggccgccacatcatggggtcccttcaattttctcaatggtcttttaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctga

SEQ ID NO: 99425 - DNA, 1015 bp, Homo sapiens
aatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgcaagcctgtggttccactctttgggctgcttgaagtctgagtctgactactgttgtatgtaataccacctttgagtaatatctgcttgggggttgctgattcctattggggttccgtggaagacccacgcctgatgccctccctcagtaaggaatgcacttccctcctggcatcgagcctggggctagcatgggcattactgggagaactgagacgattgtcacgcaccatcccctgtgatctgtggttctgatgtgcagcctcagctgaaaacggtcttcacctgtggctgtgcttacctgcgccactacttacagtgttttgaagagcaggatgaaaacggcaaaaaccttgactgtttctgctcaagtgtcctgaagtagaggatggtggggatgat

SEQ ID NO: 99426 - DNA, 1144 bp, Homo sapiens
tcccccgcagtctgaagactctaatacttgacactcgttcagagagatgtttggggaatttatagacacttaacatttatgcatccttatatatcgggtccaggaggaattacagacacttaaaccattactgccttcttcctcaaaagaataacagctttggtaactgggttagcagaggtgttagtggacttagggttgtaaacagatactcatggcactgacatcgatgagtctatgagggaaattagaaagataaatacatctgggatgtaaactcggaaaggcgaggctgttcaaaatgttggtgctattgaattgtgattctcggtgtttgtacattgctaataatgttaaaccatgaagcctgtgagatcttgtgttgcagcgtggtttggccctagcgttcttgcatgctaacctaaggtagaagattagcagcctgtttgcatgcagccggatgctgcccctgacgtgaagcatgttctgggaggttgacccaacctcctttggctgtggcctcattcaccccgtcctgtctgtggcctcattcaccgtggtacgtgtataactacttccatcattcatttcactaacctgaacgatcattcttcagtttagcaatgtgctgaaaggcgcggcacgcggattcacctaaacctgtgtctttgtgatttctttagatattaggttgaaaaagctggttgatgaacgggaatgcttattggaacaggtaacaatctttttattactttaccggttcatgaacagggcacctgaaaccacctgcccatccttccttcttgcttactcagaaaacccctaagttaatcatgtctgaaagtctttatcaagccaactggtgttcttaagattgctatccaaatagaacatcaaagttaatattttcatccaaagagaacatcctgagtcatatgaggtttaataaggatgtctcaaagacccaaagccatggaattgaatttggtacattttactgaattgctgcttaaaataaatataaatgttgattattaataatattaatgattaactgttgagagacaagagcattactgagtcattccaaatagcacttctcttgtccatatgggttgtttgtccataaaagtcagttttgtac

SEQ ID NO: 99427 - DNA, 1022 bp, Homo sapiens
gagaccaactccctgaaagctggcaaaccgcctctgaacacacctgcagctggcctggacgctgagaaagcactcgacttttgggggacttaattacaatatattggagcccagaaggctccaagtggccctttctggtttcttagtaaataaagagaaagtgaatagcatggtgacttactgagtcttaaacattgcaggtatttcatgtacagtctcctcctgagtcctagaagaatttcactttagaaatgacttttctctcagagttacagtgtaattcatttttcattcattgtacattgaattgtgtttctgagaagagtactgatggacacaaagtgccttctgtcatttgacatgctgcttcctttctgatgggctctaacttcagcttttcggtctcattcagagtagagaaattaacagattttactggcgggtgttttcagattaagaaactcaaagggcagctggaggagagacagaagattggcaaactagacaatcttcgatctgaagatgatgtcttggaaaacgggacagacatgcatgtaatggacctacaaagtaaatgtcaattcttgtgtagaagtaaatgctttcacatgtgctgttttagtatacttgtgctggcagagaaaactgtcacggcaaagaatgccctcattccctcacatccccacaaaagcccttaaaaataaaagcacaaggaggggtaggtagacagaacaatggtgtttctctctgagcctatgaaatagaacaggtacccaaaaacgtgcaccaagataccaccacatgttgtgccgatggaaaccacatttactttgctggatacagcaatctttcgatctgttgattgtatgaaaaaaaaaaaatgaaaggcttttttcatgctaataaactagaaacagtcttaagggagataaaattatgcccagtctctctccgcccttttccctaccccctaccatctctttgtcttcttcactcataggcactctcttgcctgaggtttc

SEQ ID NO: 99428 - DNA, 1005 bp, Homo sapiens
cttgtagatggctgccttcttgctgtgtcctcacatgagagaagggggaggcaagctcttttggtcttttcttgaaaggacactaatcctataattagggtcttgccctcatgacctcatgtaaacctaattacctctccaagtccccatttccaacatatgggtctggccttcaaggcatcatttgggaggacatggttcagtttttagctgctactgaaagggatatttttcatggatgatgtaaattgtaatcccgcattgggaagagcttaaaccagatcatgtctaaggtttttctagtgtctagattctgtaatgttgctgttaatgtttttatcctttttttaatcagataaaccttcaaatccaaagaaagaaaatttgttattatcctccaatggttgtgatgaagtcaaattgacttttcctgatgatgactggaattcttcgacactagagcaaagagctaataataaagaaatcagcaatattgacaaaatggatttattagagccatttttttcagtgagtcaagatactaacacagagagtactcagtttcagtcaagtgaacttgaagacagtactgactatgctttcttgaataaaacatattctataccttattcagagtcaaaactaaagaaggaaagtcttactcctttaagttcagaattagatcctgaagtgcagaaaaaagaggaggttttttttaatattttggaacatcaagataagactgttggcttggaaagaatctacaatatttcagatgctaattatagagaaagtgctgaagatacacaaaagcatgatacagatgaagactcacagcaggaatatcacagtgcagaagaacaagaatacataagtaaccatttatcttttgaccaaacaaaagcattagatatatctaatccagaagttgttgaattaggaaattcgggttatgaagttaaatgtgctagcaatgtagaagataatcgtgttaactcgggaagt

SEQ ID NO: 99429 - DNA, 1050 bp, Homo sapiens
gagtttttgcatgacatgctaccacacgttctctggcttatgtgtcaagagttgtttgtactgcctttagaaaaacatatttactgtggttcatttttttcttttactcagcatttaaaagaaaatatttagagttctagtaaaattagaaccaagtggggttgggcaaggtggcttgtgcctgtaatcccagcactttgggaagctgaggcaggagaatcacttaaggccaagagttcaagaccaatgtgggcaacataataggacccccgtctctacaatacatttttttacaaattagctgggcattgtggcacacatgtagtcctagcaacttgcgaggctgagacaggaggattgcttgagcccaggagttcaagaaccaagtgtataatataatattagtgttaaatggatgacttaggcctaaataatttagttttgtgcactcaacttttgaacaggaatttatcaagtaattctgctaagaaggaattgggatcagcactactgtctcttttgggggacttaaaagttagatatgtgactttgaaagaaaaaatacacaaaggcataccactggaagagctgcccccactgtcactagaatcaaaattattatctaccttctctacttttgcttccagggtatgtatatatgttttagaaataaaaaattttacttcatttagacaaaacattttaaacaaagattttttttccttttctctccttccagctaatgaaaaaagaaacacatgtgtgagttatggtttcatttgatttataattcattagatcctaaaaattgcttaattcagttaactttaaactttgttttgttccctatttagaacattgataaatgttttaatgaagtgtttatcttttttcttgacatttaatattgtacaaatgtatggggtacatgtaatattttttgcatgcataggatgtgtactaatcaagttgatattcaggatatccatcaccttgtgtatttgtcatttctatgtgttaggaacatttcaagtcctctcttttagctac

SEQ ID NO: 99430 - DNA, 1050 bp, Homo sapiens
gggaaaaaatcaaaatacaaaagcacttatacatttttctcagtgtctaattagtctctggagacctggtccttaaccctgctttcattgctgtctttcagggtaaaggcagcagtaatgctaacgctagcaagtaaactgaagcgtgacgatggtctcaaagggtcccggacggcagccacagcgtccgactcgactcggagggtttctgtgagagacaaattgcttgttaaaggtaatgatcattcgtgtgaactgtttttatatcctataacaaaaggaagtttgactggagagtctttggggatataaagcaacctactgctgaatagaaatacctgtttaaaagattttaaaatataattgcttatctcttatagtgaaggacattgtaccacgcaggtgatatgagcacactgttgcaaggagatggtattagaaactgcagtgtgtcttatacacttgggatgttctttgtcacgtctgccaaaatgctagcagaaagaataaggtgctgagagtcagcaaagcctaagactggtttcagagctgccattatcttcctttctttctgattctcagcaccatagtttctgctctgtaaaggggaaggagtcaaattttgtaatctcttaggatcttttcctgttttattcaggtcaaagcctacggcgaatcttgtgaaaaattagttctcttcacggaattaataacatatagtgttctagagttttcgtgacttctgctatccatgttggtgaggagaaactttatccttggagaagggttggtaaaatgtatgagagtatgcgtgcatgcagatatgcattcatttgtatgtttgagcataaattttgcatttattcatttagcaaactcttaaaattttcaagtgctttgaagtcggtttcttgggggtcataagacctataaaagatgaagaaacagttgcaacctttaaggagattataatttgcttatttataataaagttaactttgtattttatttatttatttttttgagacagagtctcactctcacccaggc

SEQ ID NO: 99431 - DNA, 1007 bp, Homo sapiens
agcttctctcccaggggaacactttgtcctgattcaggcctcttatgatttggaccagtgggcacagaacattgccatctgggtcagtagagcattattttaccaataaagcaagctgatttaccacttaggtagtaaaggtattttttaaaaagacaaaagattatggtaaactctggctgggtgggagctaagtcctgggcgcactcttcttcttcttcttcttcttttttttttttttttttgaggcagagtttcactcttgttgcccaagctggagtgcaatggcgcgatcttggctcactgcaacctccatctcctgggttcaagtgattctcctgcctcagcctcccaagtagctgggattacaggcgtaagccaccatgcctggccagcacccttctttataaagaacttccatttaccatggtgactgaatgtctgtggtgctagggcaacagagttgacctgggctctttcctggttttttcgtgtttagttagcctttgcctgcatgtattaatctccctgagatatggtttcttcttgtcaaagtacagtagcataattcttgaaataaatggtttagtgaccacttaaaggttgaaggaaaacatctctatttggaattaactagtaaaacactgtaaggagaaaagcacatgacaaaaaccactggtttgcaattttagagtattggcacgattattatcagacaaatagggagggagatctaccaactttccataaaccatacgaatccctgtagcaccgctaactttacacgtgttcaaaggttagcgtcaacatatggactgctgctcactgccagaccttcctgatgtgctgtttcttttgcaggtacatgtaaagtgcattttcctgatccaaacaagcttcattgttttcagctaacagtaaccccaggtaatattcttacataagtattaaagtgatttcaaacagcgaattataaaggctgcccaaacctgtaatctttgctttgg

SEQ ID NO: 99432 - DNA, 1373 bp, Homo sapiens
aaacgttatgccagatgataaaaggggacgattgcaggcccatggactgtgttacagtttgtctctaacatgaaacagcaagaggtagccccctctcccgtcctcatgctccctctcagtcccctggattgccccagtcctgtgaccatgttgccctgaagaagaccatcttcatgactgctcattgtagatggagaattcaacataaatacagcaagaaaatgtgtttgggcttctgaagagttgtctgcttaccttaacatgtttacttttttgaacttgtactgtataggctgttggtgaaattcttaagaagttgtaatgaactcaaaattgaggccagagcttgctttcccttttcccaaacaaaattggttttctgcacaagcgatgctaatgatgtgttcagtgtaactcgcagattggcaataagatacccgctacaaactgtgattggatgcaaaatctcttagcttctttcacgaatgttggccctgcctagatgttgtgaagcctcccagaatgcatagagtcattcactgtagatctcttattgaaatgcgtattttatttaatgtaagtatattttggaacagatttgtaatttgtacaattcaatgctttaattattttttctattctcatttagtttgtattttcattgtatagagcagacagaaagatgttgggtcaagcaactattgaagagaaatacaaagaaaatatgaaaggcacattattcattttgtccaaatgcaatgagaatctcactcttaaaaatcagctcttgctttcgggtccggatgtggtgagcacattttggagccctttgaagctagatttggatgatcaaaacaaaaaggcagggagcccattctaacatgctgcccagaggaaactggctggagcctggaccagctggggttgatgcttttgcagtggtcatgtgattgtgacctggtagctacttatcagagagccagaccctgctgtcctgggagacaggagcgatgcctcaggaatcagcccaatgtctgatgtcactgagactgtacctgtggccttcttctgagtttgctatggctccaggccctgccggtggggtgagcctcctaggccttggaggaccaggagtcaacagtggcatatgccatcctcggccaggttaatatactgcagaggaaaagccctgaagagaggcaagtggatttactccagcatgtagacatttgaaccagtgaaatcaaacacaaaataaatgtctgtctagtttcatttgctgcctgcctaacactctcaaacttaactgccagcttccttagacctctggattcccccatctgccatctactgggtttagtttgtttttctta

SEQ ID NO: 99433 - DNA, 1056 bp, Homo sapiens
gtgctgtggctcacacctgtaatcccagcactttgggaggccgaggtgagcggatcacaaggtcaggagatcgagaccatcctggctaacacggtgaaaccccatctctactgaaaaaaaaaaatacacaaaaaattagccgggcttggtggcacacgcctatagtcccagctacccgggaggctgaggcaggagaatcccttgaacctaggaggcagaggttgcagtgagccgagatcgtgccactccagcctgggcaacagagcgggactctgtctcaaaaaaataaaaagaatggggtttaaaatagagcttcagggacctatgagacgataacaaatgatataacattcgtttcattgaaatccctgaaacagagaaagatgacagcctgaaaaagtgcttgaagaaataatggctaaaaaatttcctgaatttggcaagagacataaacatacagaatcaagaaactgagtaaaccccaaatagcataaacgcaaagaaatctatgccagagacatatgattagacttctaaaaatgaaagacagaattctctaaagcagtcagagaaagatgacacttcaccagtatgggaaaaagaatttggatgactgaatttctcatcagaaaccagaaagaccagaagaaagggacacaattatttttcttcaagtgctcagagaaaaccgtcaagctagaatcctgtacccagtgaatatatctttcaggaatgaagaagtaatcaaaacattctcagatgaagaaaaactaagaatttatcaccaaatacaataggctttccttcttctttagagttttctgaattacgtttgatagcagaagcaaaaatcttagcaatatctgatgtggttcaaaatgtacataaaggacatatttaagataattatagaaaggcaaaggtaaaggaacataataggagatgaggtctgtgcttcactggaactggcaaagtgacaacaacacaggctgacacgatggctcacacctataatccccctgctttgggaggccaaggcaggaggattgcttgagg

SEQ ID NO: 99434 - DNA, 1056 bp, Homo sapiens; identical to SEQ ID NO: 99433

SEQ ID NO: 99435 - DNA, 1073 bp, Homo sapiens
accttctccgtgctcctgcagctgcatctgcacctgtaatggcacaagtgccacagctgggtcccagccacagcaccacacccccactggttcttcagcttcgcccagcccagaccccaatgccaccagcgctctagacagcccccctccgccacccagcctagactccatcctgcacacgccctccccagcgtgctttccctcacccattcctttctgccttggttgcgtgctggcagccctgcacctgagcccttgtgggtccgtctgtcctgtcactgtgatgctagcttgtgctcctgcctttaaacttgacatctcagctaggccctggcccatgtcctgagagatccattcctctgagttcaaaacctgtcccgactgctctcctccaaccctcttcccaccctgggcacctcttgctatccaggttctcacctctgaagtccgggggatgccctcagtccctccttgtcatcgtcccctgcctccaatgcagcaccttcctgtctgtctggattccagaatacacccactaccggcctcatgtccattttcatggccaccaaccctagaccaagggtctggatgcctgccatggcctcctgggggcctgctgctgccattttccacacggccacagaatgaccaacagacaggccagtcagaccatcgcatccctccctcagcctcactgcgtctgccccgtggccgggcctgcagggcctgtcgatctgtccctgcgccttcaccccctccacactctccacccgccacgccaggcccctctgttctagagacagaatgtctgtctgtcccctgcaaagcccttgctgggacgccattccctgcccttgtacagccatctctgtcaccaccccaccttgggcctgcgaggtgccttcacagcgccaactggtgggtaggagtctgttcccctcttcccctgcttttgtccgtctgcctctctgggatgctggctcctcgagggagccctttcagggctgctttgctgaggcatctccagtgcctggtgctgtcaggaggtacctggtgaagtcagtttctggggc

SEQ ID NO: 99436 - DNA, 1073 bp, Homo sapiens; identical to SEQ ID NO: 99435

SEQ ID NO: 99437 - DNA, 1123 bp, Homo sapiens
ctgaggatggacaggaggcggccggacaaggagtggggcccaaagcaacttcctgaggggggcacaggtcattcagaggcggggagagcctggcccatggggcccgggggcgggcaggaaaggcagacagaggcgctgggaggaccggggctctttcctgagggtcctggggagccacggaaggctcggagccaggagcagtaggatctgactggcatattggaaggtcactgtggctgctgatggagaagtgagagctgcctgcccccagacctcccatgcttgcctggggcctcctgtctcctggctcccacccactcagtccagctccttctccagcaagccaggctggctctgcccccggggcctttgcatgcactgcaccctgtgcctggcacacagctccccagctgcccctggggccttccctgcccagctggtttatggggggagccgcctgccccgaccatcctcactcctgctttcctccccaccggcgcaccagcaccaggcacacggcgtgtctgactcctggccttggtggtggtttccaccagccggcgtgtaggcgccaggagctccgtgggtgcaggacttcaccacctgctacgttccccgcacctggcacgcagtcaggctcgggagatgtttactgaagcaatgggtgggcaagtgaaggaacagggggcctggtcccttaggatggcgcctgctgctcaccatggccctgaggcccttgggacgggtcccgcctgctcaccgtgtccccgggcgctcgggatggcgctggcctgctccccgtggccccaagatcctcaggctgctgcctgcctgcccactttgtccccaaggccgcctgaattggcctctagcctcccttcgtggagactgcagcccctcccggtgcctcgcctgcaagtgcgcccctccccaccccggggctgcctctccagctcctcctgctggagcagcctaccccaaaggaagctctctggacctgggtcccaccctggccatcctccctttgcccctccagcagttctgacccattcactccagacctcagcctcccaaactatgcctggctcctgggatgagcggcggctgcacacagtgggcagag

SEQ ID NO: 99438 - DNA, 1383 bp, Homo sapiens
tgcttcttcctgagcacctatgggtgctccagtggtcggatcctcctggtgactggaggacggtgtgatcactgcagctcctctggaggaaggaggcccagcagtacggggattcaccccgatatccaagccctgcaccccattttccctccaggcatcttgggtctgcctctcccatgagtgccaagtccaggccgaggtgtggcccgttccctaggagtcatcctccacgggccgggggagaagctgtgaggggttggggcccctttgggagctgcctttgagggcaccacaggtgacaaggaccagggtcccagagtacagaaggccacacagtcacctcctgcaaagtgtcccacctgcttggtaggagcccagtgaggccaaccgccctgctgggctggctgtgttccaggagcccaccgctgagcgtgcacacagcgtcgacccccgggacgcctggatgctcttcgtcaggcagagtgacaagggtgtcaatggcaagaagaggagcaggggcaaggccaagaagctgaaggtgaggccggcatcccgtcagtgccaggccgtggggggttccgcctcctcgctcctcatccactcccactcctacatcctgaacatttccaatagcacacccctcacgcctcggcctggggacagagaacagagagaacccaggcagccccagggggagccccgagttaggggcctggtcccaaccatttccccacacccctaaaatgccaggctctccctcttttctcctccctctgcatccaggccagggaggctgggctagcccaggctgtggtgagaaccttgtccacactggaggggcctgcaggagtgcctggctcccagggactaggggcacagggtccctctcaccctcactcagccttaggtcttggcctgggcagaaacttggtgcttggtcctggtgctgcctcctgcttggagcccccaaaatggaaaatacggggtgtgggcttctctgtcccctgggggccagtatcacctgcctgggatctgaacacacgatggaaggccagctcggagtgcatgaggcaggtgcacaggccgcgctgtcctcgtggcctggccttctacctctgcccagcctcctggccctgccctaagcttctccccacagggggctcactggcttctggttcgggtcccaacccagcctagtggggacctgctgatggtggactcgggcccagtgcagaccctgagatgcaagtccccaaaagcagcctagagtcttcttccctccacgaggcctggccgcaggagcgggcttcagccctctgcctccccactcagagcagagtccttccctgccaaagccccgccccgagggcccccacctccagc

SEQ ID NO: 99439 - DNA, 1055 bp, Homo sapiens
ccgagttagcccaagttcacacagcagagccagaaatggaggccaggctgtctggcccagagtctgtgcttgctgaaaggcatttagaggtcccttctgggtgccacacagcatgcttggtgaactcagatggtctctgccccacctggatcttaagatgcagatcctgaggcaggtctgggtggatcccagattctgcatttctgggagttcccagggaatgtgacactgctggtgcatgaccacgctgctggtgcatgaccacgtttggagcagccaggctagagtgctggtttcacggaaggctctgccaaatgactgcctgtggggaagggccaccctcccacctgacttggagcccttgcaggctctgagaagccctgcagctgagaaacctgttggactcttgaatcccactctggccttgagcaggggcccactcccacacacgcgaactgtagggcgctgcagggaaagcagaagaggtgctgggtggggcccaacccgtgcgggcccttgctctgtgaccttggcggccacattcttctctgggcctgagcccttcccaaaagcggggctgagtgggcaggagggagtgtggctggctggcccttgggtcacctctgcaggctgttggggtggcccagtgcctcaaaggcaccctccttgcagatggggcagtggacctccgtgttcttggacaacgccagcggctgctccctcacagtgcgcagtggctcccacttcagtgctgtcctcctgggcgtgtgagcggccaccacaggcccttcctctcaggggcaaatggagcacagatctagacaatgtgtggacagtgtcagagtagcagtggccacatggaggaggaggcccacccggaactctgcccacactggccactgcagttcagcccacagagccactgcaggcaggcctacggacgtgacacgcacgctggtggtcccggagccagggttgattcaggacaccatcttgggctcttatccaggaaagaaagagtcggcgtgcctgggggcacctgctagtctccagct

SEQ ID NO: 99440 - DNA, 2764 bp, Homo sapiens
tgtctgtactgtgttgtgcagtaccagaagttgctggtagctacttggtcttctgggacctgccattgcagacgtggtgattgtaatcttaatcttgttgaaacaggatggatttatgactgggatggccggaagccacaccagacacccagtcacctggtcatgggagaggtactttgttggcttttcatagtacttacactgtgagctgcttcctgaagtggcactcttaaggccaggtgcccccacccatcttcagtcctcagctcttcccctgtgcactgtttcctcttgctatttaacagtttgtatcctagaagatcgctaggctttttgcagataccagcagaagtctttgaagaagaaaaaacatgtttgttacggatactgacctgtgagccactgagagggtaactggggcccagagaagggccaggctgaattctgcctttaggacagcagcccaggaagcatttcctaccatgtgcagccatctgcaccgcatctcctgaacttgcttggtccatgatttgggagccccgtggtgatcttaaacgcccatgcgcagccgtggcatttgcggagtgctctctcacacgttgagtatggttctctgccttgcctttacaaacaagggcctgaaggggagagagcttgcagctgcctaaggtgacagtgctgcagcctagaccagaattgttctttggggcagtaggcttccccaaatggtttttccttggcaataggactgtcccttagatgtctcttcccatttgtagatcactgccccatctcctccatatcccctcacctaaaatagaatgggtgaaactatgatgctatgcaggatactgtcatttacattaacattaaaccgtacctgtacttgatgcaaaggacatgtgctccacaatccaggaatagccactttcagggattttccaaatctaattagattgaaatgcaaaatatccctctgttctagctattgttaaccctggctgcatgtgggaaacactcaaggagctttaagatacaaaacactgccaggctcccttacccagtcagtcaaatccgattctggagttgggacctaggtgtgtgatgagaactgctgagtcctgtcgaaggttaagctgggcagcactgcttggcagccactggaggtgctgttcccacccatgtgcagctgggcagggtccctaccccagggcagcagttaatggcctagacacccctgcatatttgagatcaagaaatgtcagtagtggttaataatgtgaattccacagtctgtatctttcacacttccattctctgcttttaaggtgagattctaagtactgtggacccataatctgtcaggtagagtctgaaatgtttttcctctcattttagggatgggcgtgttttgggcgtgctagaggtgtcacgctccattggggacgggcagtacaagcgctgcggtgtcacctctgtgcccgacatcagacgctgccagctgacccccaatgacaggtaaaaggccctataagaggcacaggtgtgtgtgcatgtgggtttatttctcttcctcacttccagtttctatcaagcctttgttggagggaaggtgtgcatggtgctaggccctgggggtgcagagataaacaaaatgtggtttctgctctggtggggtccacagtggtagggggggacacatggggatgggcagctgcagtccagtgtgtcctaggcatgtgctgtgtgctggggtctttggcagtaggggaaggggttatccctgtcagagagaggagaaggggcttcctggcagagggaacacacagtaaggcattaaaatgtgacagtgtgaaagcatggccagacaggcgcttgagggacggagggagtggtgggaaagtgatagcagggtactttgggggcagatcctgaagggccggccctcagccccatgctggagagtttgaactttagttgatcattggtggagaatcataggtttttacacagagccaggatcggttgagaaagagacagttcacctgttcatctcctgttctccatgcctaagggtacggcaccgtgctggctgagggcagggcctcaacaggtgatggttaaagatggcattatggggctagggaggcctgtgagcagcggtgcagcagccctggcctgatgatgaagggctgaactaaggcagtagcaggaggggtcaaggaaagctcccggaagcaggattcacagcactgagttgatgaggggaggccagagacactagtggcactgtggcgagtgggcctccgagtgctgctctgagtcccgccccagtgctgcggatgaagagcgcgtgccttgctttggcactcgcctgcttggccttgtcttgagccactgccccattctccacatcttcttcagtgtgtttgtcatgttctcacgtaccgcggggtcctccatcatctctccagcagccgccgcctctggtgttctgaaggatgcaccttctgctttgcttcctagctcgccttcctgggttgtagtcatgggtctgtgtgattggttattgagggtctgagtctcaggacactggaaggggtgggagcctgccaggactaggccccacggtgttctcagcatggacgataggctcggcaagtagcggccgagtgaaagcctagttaaacgaggaaaacaggctgggtgtggtggctcacgcctgtaatcccaacactttgggaggcggaggcaggtggatcac

SEQ ID NO: 99441 - DNA, 1062 bp, Homo sapiens
gagtgagacccagtctcagaaaaaaaaatttaaaaaaggaaagaaatagggattgttcttaatcatgcttgaaaatcaattgatgtgcagaaattacaaaaacaaaatggccagccctggtgacccacgcctgtaatcccagcatttgggaggccgaggcaggtggatcacgaggtcaggagttcgagaccagcctggccaatgtggtgaaaccctgtctctactaaaaacacaaaaattagcctggcatggttgcgcgcgcctgtattcccagctactcaggaggctaaggcagaagaatctcttgaacctgggaggcggaggttgcagtgagctgagatcgcgccactgcattccagcctggtgacagaacgagactccgtctcaaaaaaataaaacaaaaaacaaaccaaaatgacagtgggaggaggataatcttccctccttgagagattgttttcttttggcccttctgtaataggagatgtaatcagtgtagagaaaaccgtgaagagatgccttttggacactttcaagcatactgatgaagagttccttaaacaagcttccagccagtaagtataacttgatgatgaagtttgagtggactgtgtgtggtgttttcctaaatgcatttcagtcttctgatgtggtttaacactattgctcactgtctgaaaagtgcgtagcactcagcttttataaccgttagctaaatctaaaacagaaaaaaagcaagtatcaaggaaatggttcattttgaaatataagatacttcccattgagctctggaaattagtctcaaagtgctgggctattggtggtgactgtgtttctgatgtgtttccccccaggaagcctgcctggaaagatgggtccactgccacgtgtgttctggctgtagacaacattctttatattgccaacctcggagatagtcgggtatgtggctctggagccacccacttagatgacaatacgttttatggggaaaagactttagcacgtacttgttgaataagattaaagtgatggtgtctggttgaaacctttcttctgggg

SEQ ID NO: 99442 - DNA, 1050 bp, Homo sapiens
agctgggactgtaggtgcctgccaccacgcccggctaatttttttgtattgttagtagagatggggtttcaccgtgttagccaggatggtcttgatctcctgatctcgtgatccgcctgcctcggcctcccaaagcgctgggattacaggcatgagccaccacacctggcccacacacaagtattttttttttaaaaaaagataaaatgctgtgaaagttacttaaatatttgtctcagttaaagccttttttttcccatttgtaacagtgtgactggtgtcttaaccagtgtgacttcctctgacttattaatgttcactctttgagacgaaatttaaaagctttaatggaaaagtgtggtttttgctgtgagaatttgattaactctcaattcgttctttcagtactcgggtttcatattttgctgtttttgatggacatggaggaattcgagcctcaaaatttgctgcacagaatttgcatcaaaacttaatcagaaaatttcctaaaggtgagactgagaactaaatcagttgatactcaaattggttattgctgtttggttggctgtgtgaagcagtcagatgtgttattttggctttagcagagaatcattgatgagtcttaaaagagtggtgctgaggagtggatgccaaggcttccaggagtagcggccatgcaggtgtgacttagaatggcacttctcatgattctaagtgataggcaccttttgtcaatcgtctttgggttcagttagtgtcttgcctttactggaaaactagtaaaccaacttcaaatagcactgtgttatatgtgaggaaagaaacagagattgttctggctgggcacggtggctcacacagcactttgggaggccaaggccagaagatcactcaagcccaggagtttgagaccagcctggcaacatagggagactctatctctataaaaaaaaaaaacaaacctaactggacatggtggtatgtgcctgtggtcccagctgctcaggaggctgtggtgggaggattttctgagccccaggaggttca

SEQ ID NO: 99443 - DNA, 1046 bp, Homo sapiens
attttcagggcatcttaagggcttttgagataaactctcctgacttgcatttgtccttattcaattatcacaagactaatttgcacatgatccttttgcctgatttgaatctcacttctctgggatggcagcacatcccttgccctgatgctttgacttacaccctagacagagttgttttgtgctcactgactcctcttttgtgtccctgtgcaacctcttagagctcaccctgtccaacagtgctccgatttgagttatagacttgcagctgggggagatgccttaaggggtattgcttatttgtttgcgccattaggatattgctgagtcagacagtcatagttccctctcatttgctctgggactagggtttccagagggttgggcacagttttgtattggctcttttgttctcttttccttagcctcttcggtgatctttggtctgaagggctatgtggctgagcggaagggtgagagggaggagatgcaggatgcccacgtcatcctgaacgacatcaccgaggagtgtaggcccccatcgtccctcatgtgagtctcatgtggtaggaagcccggctggcattaacatctcctgggttctgactggcattttggactggctagtttgtatttactagaaaatctaacacatcacttgattgtacatcagtgattctcagctggggttgattttgctccccgcccaggggacatttgtcagtgtttgggtacatttttgtcacaactgcgggagggagttgttactggcatctggtgggtagagactagggatgctggtaaacatcttagaagcacagggcagccccacaacaaagaattgttcagcctggaatgtcagtagtgtcgcggttgagcagccctgctgagcgggagatgacgcttcatagcatggctctgcagcgtgtgttactccttaccagcaactgagcggcttctggcagagaatatttttaatccatgacctagaagataagagttggaagccactaattaaagtatgaatggtgatcaagcagagc

SEQ ID NO: 99444 - DNA, 1673 bp, Homo sapiens
taaactgtgatcatgccactgcattctagtctgtgtgacagaatgagaccctgtgtcaaaaacaaaaagaagaagaaatgtctggcaaagagtaggttgagtaagtaaataagtacttgcatccttttttttttttttttttttttttttttaaagagaaacgtcttactactttgcccaggcaggtctcaaatgcctgggctgaagtgatccttctgcctcagtctccagaagtagctgtgactgcaggcatgtgccactgcatctggctgttgcatacttttatacctaaatgcagagaacatttcaagtcatttattaggacagcagctgcccttattggagattgatgtgttaggcactgtgacaaatgctcttcctacttgtcctgacccattttcaaacatccctctgagatgacagtattcttaccatgttacgcacgggtgaagacagctgagactgaaagattaagttgcacacctctttgaaacttgacttttctcatttcaaacacatacactgcagattcccttagctttgagtacagattcatccttttgctagtgggaacagctgtggcagccttattttgcctttgaaaggatgtattacagttcttaaaggctgccatttacctcattttgagccttttcgagtacttgttactttttggaacgtgattaggatatgttagtttgcttacagattttgtaagtgtttgtttaacactaagagcctgtggatataaaaacatgtatatgctacaggccaaaaaaaaccatgtatttttaccactgggaaaagtcttttacaaaccccttcagcagggtcagtttgactcagggcctggatcttaactttatgttctctcactgtgggacccccctccccctccccgccaaccatgaagacacaactcctgggtctgcctgtgtctgccagtccttgcttcaaatgaccttgtctttgagtgctaggatgaagcccagtctactagtgactttttccaacagtctacagctgtgtttctgtctggcttttactttatttccaggttctcttgccacatcaatatcccagatggtaaagactgaagggaaaggagcaaagagaaaaacctccgaggaagagaagaatggcagtgaagagcttgtggaaaagaaagtttgtaaaggttttcagacaatttgaaaacaaatgtattagacttcatattttaaaacaacccagagcaaaaccagtttcagctttctaataatactttctttttatgtctgtatttaagaaataagtagggttccctttttgcaaatgaatttccaagtttctctgtgctttctcctacttttcatgtacatctatctctgatcctacctttgatcagataggaaacctacatttgttcctcaagagttaaaaaatacaggtggtttttttcttagccttctgcagtgaatggttagttttttgaccacctagtctctctctgacttccaatctttgtttgcagtttgtcaattagtgctttgaattacgtgatttagcttagtaggcagcttccctaagcctggaaaaagccgttgaaatttgtagtcagttgtgtaacttgtcaaagttagtgaggaagaaaacgaaaagtattaactaaagagaatacttcagttgtggta

SEQ ID NO: 99445 - DNA, 1058 bp, Homo sapiens
cacagtgtggcctgaaaccttcccaataaagatagtacccttagttgtaatgaaagttaatatgttctggctgggcgtggtggctcacgcctataatcccagcactttgggaagccaaggcgggtagatcacttgaggtcaggagttcaagaccagcctggccaacatggcgaaaccctgtctctactaaaaatacaaaaattagccaggcatggtggcatgtgcctgtcgtcccagctactcaggaggcagaggcaggagagtcgcttgaacccaggaggcagaggttgcagtgagctgagatcacgccattgcactccagcctgggtgacagagaaagactctgtctccaaaaaaaaggaaagttaatatgttcaaagaaggctgttaagggatttaatagaagaaatgaagatacagcatagctgtctcttatttatctacaggacaaaaggcaaagtagtaaaaaatttagaagatttacataacactattaacaagcttaattttttggatatataatcttgggtctagtgttttagatttctagagaagttaacacattttttttttcttgagacggagtctcacactctcacccaggctggagtgcagtggcacaatcttggctcactgctacctccacctcccgggtttaagcgattctcctgcctcagcctcctgagtagttgggactacaggcgtgtgccaccatgcctggctaatttttgtatttttagtagagacagggttttcccatattggccaggctggtctcgaactcctgaccttgtgatctgtccgcctcagcctcccaaagtgctgagattacaggcgtgagccactgcacccagccgataacacattctttttttttttttccttttttgagactgtctctctctctgttgcccaggctggagtgcagtggcgcgatctcagctcagtgcaagctctgcctcccaggttcatgccattctgctgcctcagcctcccaagtagctgggactacaggctcccgccaccacgcccacctaatttttttgtatttttagtag

SEQ ID NO: 99446 - DNA, 1371 bp, Homo sapiens
tcttcccaggattctattttaaagaaagacttttaaatgtttcatgctttcaataatgaaattatcaagaaaatacttgttttcctcaaaatattcagtggccctgaagatgcctgttagggcatcaatcattgcttttatgttgactgtaactgttggaaacagatgtccatattaaaaaagctgttaagaaaatatgttttaaaaatttgcccaacaggaaggagaaaattagaatctaatagcaaacttgtgtcaaagcaggggagaccacatgatcttcctctttgaaaatctgtcctgggtgatgaccatatgctctctaaacaggttttctgtgttttagggaaagaagctcagaaaggacccctgctctttgatgacctccctccggccagcagtactgactcaggtacagtcttcaggctctcccaggtgtgtgtcaacgtctctactcatcctgggattgtagttgtctcaatctttttccctttcccccattttcaacacacagatgttttaggtgttggactgtctttaagttttgaatccatggcatcaggtaaggcagaaaaatctgctagtcgctagccctgagaagtactgcgaggaaatgtggagcagttttctctggttcatttgagtatttattttactacctgaagtacaatttaactttttaaggcagatttttatttcctttgaaataataggactttaaaataggttcaagatattattcattgcagtatgagttgccactggattgacgcaaagttttgagtttatttcagtaacctacataggtgtcctggtgggatggattctgaaacttaagtcttacatattttttgtgggctcactaagtgttctgctgtgtttcaggatcagggggacctttgctttttgatgatctcccacccgctagcagtggcgattcaggtaagtggtaggaaaaatccaaggtgctgatggaaataatacatagtattttactcttatgtgaaatttatgtataggttttaacgggattttggatgacattaagtcataatacagcataaggtttactaaaactataaacaggcacattaattggaagcacaaagataatactgtatcactttctggtgatattaacttcttgaggttcagattgttggaactgcctttaagaattaagagttcactaatttactcttaactttgttattaacattttttaaaaattcagagttcattattccgatttgccttgttaaacagagtgcttgactcaaatgtatcgaggctagtagcattggctctacctcctcctgaaaatgttccttttcatgtcctaattaagtagaagggaagaatagagcagat

SEQ ID NO: 99447 - DNA, 1032 bp, Homo sapiens
catcataggattgttgtaagggtaaaatgagttgatgtttatgaagtttctggaagggtgcccatgtatggaggcagcatagtacctcactaaaagcacggactgcatggctttgaatccccactccactccttactggctctgtgatcttgaacaggtaattgacctcagtgcctcagttttttcatcggtaaataataatagtacctatctcataagaattaaatgagaagatgtgtggagctcttagaatagtgcctgacaggcaggcagtattatcatttttagaagccattcccagttgtggccagcaaaatgtaggatggtctcattgtgtttaattgaaatacctctcatagtattccagagtgagaaagaaggtgataggcagttctctggggatggggctcagtttggggcaccatctgactgaattgtagccagaggagaggcggccaggctagtattaatactaagctgtaagttgcattgtgaggaatgcttacaagaactgaaaatatatttattacctgggtaaaagaagacttcctcccttgtacagtggcagtggaaagacctgatttagatgggcaagttaattcaaaagttaaaatatgacctggtacaagcggaagggttgtttgctcttcatgttgggctgttacctgtaaatgtcccctcccttgtcctaagacatctggctctgtgacaccactgaatgcagcgtgattgtctggaacatctcatgtggtttttgagtctgtccggagaacgggcgttgtgattgttagacccaatgtttgggcaaaagtgacctacttcgggatattaggaattcttgtaagtggattaatacattgagtaatggttatcctaaatactttttttgggtgctggggacagagtctggttttgtcccccaggctggagtgcagtggcgctatctcagctcaccgcaacctccgcctcccaggttcaagcagttttcctgcttcagcctcccaagtagctggggctacaggcacccgccac

SEQ ID NO: 99448 - DNA, 1035 bp, Homo sapiens
aggaatacatgtatcagattgttgattgtggcgtcacttatcatatgaagaactgggaaaagcttgaacccatcagtaaggatctggtcgaatgagtggagatgcttcccatgtgtggctgttggagaggatgaattagacttgggtgtgttggcctggagcatgccttgatgggttatgtgaacactatatgtggagtattgtgtagagtatgactctgtcttctacaaattaaaatgcatgagtccatgtgcatgagcattaaggaaagtggaaaggatacactaaactcatactgtggttggggggtgtggcggaacctgtccccccttttttctgataatacctctgtggtgtttggaaaacacctggatttattttatagttgaaaaaattgaggtataaaaaacaatttagccaaaatattttaacatccttttttaactttattggatacagcaacctttaacctgaatatgatcaacccaagggtatttttctcagcatagtatataacttccagtagacttagctccagaatgtagataactgaggaaaaaaaaaagttctagatgagattaactatgattaatggacatttttagtcttgtattcttattagggttctaatatttttaagattaggggaggggcctcttccagatttttaggtcagggtcacactttgtccaatgattgcagcccccaatgctttgaatttcagtttattcaaaatagaatgtaagggcctggagcagtgggtcacatctgtaatcccagcactttgggatgctgaggcaggaagattgcttgagtacagtagttcgtgaccaacctgggcaacatagtgagaccccgtctctacaaaaagttaaaaaattagctgggcatggtggtgtatgcctgtagtttcagctactcgggaatctgacgagggaggattgcttgagcccagaaggttggggctgcagtgagctgtgatcacaccactgcactccaacctggctcacagagcgagactcttgtctcaattta

SEQ ID NO: 99449 - DNA, 1053 bp, Homo sapiens
cgcccaggctggagtgcagtgacataaacacagctcactgcagtctcgacctccgtgggcacaggtgattcttccacctcagcctccttggtagctgggactacaggtgcgcaccaccacagccagctaatttttgtatgttttgtagagacaaggctttgccatgttgcccaggctgctctcgaactcctggggctcaagtgttctgcccaccttggccctcccagagtgctgggattacagtggtaagccactgtgcctggctgagccattaacagttgtttaaaagtggaaaaacgcagtcttaaatgaattatgggaaagcactgagtgtccaaagggagaatactacactgcttatatcacatcaaatgtattaatattttgtttagatctttttatttttgttttaaacgttgcatctaatgttcccacccctaaacctcttaaatgtttataatctagaaaaatacatagaatgcactaaatatttcaggtattttgctaaattagtagttttcatccaagcccttaaaagttttaattgctgaatgaatcaagttttttaaaggagagatgtatatattttacctaaaaaaaagtgtttgttcatatcaggcagaaatggaactttcctatgtcatacccataaaagtgccgacctgatgtctttaagattggcagcttatattgacaatccatgtatgtcagttgaaggtgtcatggtttaaaattgcttcgccagtaacttgatttcacttttatagggtggttcttttacttatttggttgctacactagtactttaaaaattgatggtcagttgttgaggaggaaataaaatatttgatggccacaccatcttaaaaatactttaaaaaaattggaggctgggctcgatggcgcatacttgtaatcccagcgctttgggggaacaaggcaggaggatggcttgaggccaggaatttgagaagagcctggcacaacttcgtgagacccctgtctctacgattaaaaaaaaaaaagaagaatatttgaacataaaggttaagg

SEQ ID NO: 99450 - DNA, 1004 bp, Homo sapiens
ctgcgtcctgtgggttacagtctccgggtttcatctgtcaaaacgcgtgaatatttcatatgcaagacttccagcttgatgttgtagtttagggccttattacaaaatttaacttgggggcagaaaacctggaaaacttaagacgttcagatttccaggcccacctcagccccagtaaatccgaatccctgagagtggggtttccgaatctgttactaaatccccaggccaacccagcgggggctggagaccagtggtttgggagctgctgttgtagggtagacggaggtgagtaaggcccagccttcgctttctaagagctgctttctgaagggtactaattacggtaattaaaactggcaaaagttaatgactgtgggaaatgctgaggactcttgaggagggattgtcgggcaccgagagactggggaaggaggcagtgtttgaattgagcttccaaggatgttcaggcttgtgatttgcagtaattctgggcgagaaaacattttattttattttactttttgagacggagtctcactcttgtcgcccaggctggagtgcaatggtgagatctgagctcactgcaacctccgggttcaaacaattctcctgcctaggcctccctactagctgagattacaggcgccgaccaccacacccggctaatttttatatttttagtagagacggggtttcaccatgttgggtagggtggtcttgaactcctgacctcaggtgatccgcccgcctcggcctcccaaattgctgggattacaggtgtgagccaccgtgccctgcccccactgaccgttctgatggtacagagcatctcagtaactggtcctggagtctttgaacttgactcagccattcattttcaaaataaccacggttttagctgtgggtaaaaattggatttgtgtagcagtcttttttctcttgtcaatggagtataatttctatctgaatatatttgggacagcatttggattcaccagtgt

SEQ ID NO: 99451 - DNA, 1158 bp, Homo sapiens
cgatgaaagggcagttttggctgcgtgtggttggcctgtaatctcaacattttgggaggctgaggcgggcagatcgcttgacttcaggagttcgagaccagtctgggcaacatggcaaaaccctgtctctaccaaaaatacaaaaaattaaccaggcatggtggtgagtgcctgtggttccagctaccctggaggctgaggtgggaggatcgcttgagcccaggcactgcattccctgggcaacagagccagaccctgtctccaaagtagaaagaaagaaagagagagagagagagacagagagaagaaagaaagagactgcagtttcattagtaacagaaagagtcaaatgggtgctctacctgatggctgcagcgccccttgtgcgtgtgcttgttaatgcgtgacagcatccctctgtttgccagcttcgttccagagcccagcatgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagaggtgagttcagcctctggccagatggaggctgggcaggttgttttctcagtggctcatttctgctgtgatttgattgcttttgcaatctttaaatcatgattaccaagtttttcaagatttttgaaaatacctaaaatgtgccagtgtctgtccttcctcataacgaggccctgtcgagttcgcagatccagttgccaacagacaggtactgggtagtgtaaggagatcttgggaggtagcagtggtgggtaacccagccagtggctgcttatacaacactgggcagtttatagaaaaggaactggctcctgttatcatgtgtttctgtgtcctggtacttagtttttctgatgtctgaaggttttatattccagttttatcttaaccttgtatttttaaaaaattgtcttaccatggtattatctagcctgttatcactggtaggatggcaggggaagatgtgtctggagcatacaattgt

SEQ ID NO: 99452 - DNA, 1052 bp, Homo sapiens
gtaagcctggtccccatctaggtatgattcctccaggaagggttccctgccactcctgctccctcccggattgtggattaggtaccaagcctgagtgcttccttagtacctgcatggtgtcatctttacctgtctgtccacacagccagactaagttctgagaggatctggctggcttctgccctgcacagcacgtgtagtagacatcaaatatttcttaagtggatgattcaaatctgggctgctagtcaattctgacatctcccaagtgtggagttgagtggatgaggctgatgaggaggctgtctgtgaggtgacatggtggcctttctttctctcttgaaggtgattagaatgactggtttcatgaagggcctctacacagacgccgagatgaagtctgataatgtgaaggtgggtttgagtcgggcttctcctattgactcctcgccttaacggatgggattttttgtaggcctggtagtgtggcttgtgtcatttctctgctgcatgtggttggaatacaaggtcagtgaattcgtaaattgatatatataccctttctcatttcattttctcattgtggcaactggatgtcatgctagttttattcactgaaaaatgggattagtatttcaaaggttaatgctagcccatcaactaaattaaaggctttaatgaattgtttttgttttgtcagtaaaaggtcagtatttctagatttgttatatatctaaaaacagctttgtatgtaaacagaaactatcctatgcctggtaaacatacagaagataatgcacactcttcaaagtattgtaatatttgtattttcaatggaaatgtttcaggataaagatgcaaaaattagcttcctacaaaaggccatagacgtggttgtaatggtgtcgggagagccactgttggccaaaccagcccgaatcgtggcggggcatgagcctgaaagaacaaacgagctgctccagataattggaaaatgctgtctcaacaaggtactactgctgtcctggcattttgaacttacttagtacttg

SEQ ID NO: 99453 - DNA, 1206 bp, Homo sapiens
gagcagtgctagtttctgaaaaatcatccttttcctaaagtgtgtaagttaaagaagggtggcaagatgtagtagtgggaattttcgccttagaaaggaggcttagatggtaggttccacatgtgcacaataattagtaatgcgtttgtgaccagcttagtgccagaagcctttgctgtcttttggttgaccgctgtggggtaggtttccagaagcgcagtggctggcacaaagggtgtggcattatggctactgcgtgcccttaatgacccttcaccccacaccttctccagtgttgttaaggcatgctgattttgatggacgaaaaacaaaaacgttgatgaccagtgaaatggtccttgtcatcgcgtgtgagtgttttgggcgtctctgacctgcctgttctttggtttctctgggttcttactgatttgcttgcacgtgctgtatgttaaggacatctgccaatttgccagtttttgcatgagtgtttctttttcagtttgtttctactaattatatttggtttggtttctgatttgcctaagtgttaaactgttatgtgcttgaggcctctaatcttttttttggtaatctgtccagagatttgagaggtgaagatttgtgctttatcatacatttttttttacttaatttcttatgttatctcttactttaattcatggtataaggtgaggctctgaatctattttgtcagaataatccatccgtggttccaggatcacttattcattgaatgcttctctcctgctctgtgaagccttttgtagtctgggttacgggcttttttgtgtgtggtgttttttacttccacttttttatttttactattagttttctatcattgttcttttccaaaaagttttaagccatcttatttgcttattcttccggatgaattttaaaaactcttcatgactcaagaattccactcttgcaaaataaactaacgtctcagaatttaactggacttgtgttaaatatatgctttcattagtttaggaagtttaggcacctctaacttcagcttagtgaaggtgtccccctcttctgagaacacgttgcgtgtacttggttgcgtatgttggtcacagtggttgctcgctggtttattttattttattttatttatttatttatttatttatttatttatttatttatttatttattttgagacggagt

SEQ ID NO: 99454 - DNA, 1007 bp, Homo sapiens
tatattttcattgtgcaattttatgtcaggaagaagggaccctaaaaccagtgaaaatagtctttcccctgaaaaggaacataacttttcctactgtaaagctaagaaggaacatagcatgaaacagcttggtaagctaagtgaaccatagtggaggctgtgagtgaatgttgagagttgaaagctttactgcctggtcctgtgcttctgcttggtcattgaacatgtggaagtctgtgggggtggttggcataggtgtggccctgcttgacctggggcctgcgctctagaacactgccttctggccagggtggagagggggcagagggacatgttggccccatgcagggctgcccctggccaggtgaggatttcctaccctgagtcaatcacaggcttaaattgtccatttgagccttccttcactgattctgcagacatttatgataataaagagaacacaggggtacatatgtgcatgttagtttgtgatgaatcttcaaggaaaatgaagccaagaggagcaggaatgaggggcgtgagcagggagggcctctctgagggaggacatctggacagagagctgacttgggtgaaggaggacatgcaggtgtgtgagtggtgaggtgggtggagagaggaacagtgataggggaaagggccgggccaggaagcagggcctggagctgctggtcccggagctgctgttcccggtccacagcagctgtgtggtttacagtgagtgcacacagaagtccttgaagagttttaagcagcaccgaggcaagatttgacttaggttgtagaaggcctccttttaaaactgtggagtggcaggagtaaaggctgcagcgcagcgaggagggggccatggcatctggatgagaggaggtgatggtttggaccagagtgccagtggtgacagcagagtgggtttactgtgctggcaggttggatgccacttgtttgaacggaaaggaatcaaagatgagattcattgtgggagg

SEQ ID NO: 99455 - DNA, 1041 bp, Homo sapiens
ctaactactttaatgttcatgagactttttcatgatgtattgaagactggacataacttgaggttttatttgctttaatatgctaagttatgtaactttattaactcagcttttagttaattatatgcctttttatacatagattatttttacatttcagtcaaaatgctttcttaatcttgctgtcgggatctcacagtggtgtggctgatgacatagagaaacggtttttatgtcttcgtcctgctctgctttattctactcagaaaatgctcgcagtagagatgtttaaagtgctagttaggcacgttggggaagttggcctgtcacagccaatcacattcagtccagccgtgtggtgggtgtgcccagccctcgtcctgctgcctcagagggggtggtccttggttcagtatcagtaaccactgtcatctgtgacttcagacggaattcttcaagatgctagaattcttcagtttcacttaaggtaaaaatagtgtaaaattagactttaggggaagaggaaatttttgctgggcccaacttgccttgtatctgtctgacttttacacgttctggagcgtagctggaataccgatcagcacatccttctctctctgtgtgcgttcccctgagagctggcatttccaggagtgggcgcacttggtacagcagccgcagtgtgaaagatgatctgtggttattttattccaagtagggtgactatatgggagttgtctgggtcttcagtagcatgggatggcggaggaaaaggtgactgagctggagcagggtgtttccactgaagagagcccctgccatacaggcatgcatgttaccattcaaccacatcttggtgatgtatgttttctttttgtgggagctttcctcatctccaggcgcctggggggaaacacccaggcacactgcaatcctgcactgcaggagagggcagcaggcagtggcgaaagcctgaggggtggactcctggtagcccccacccagctagctaggacctcatctctgaggccacagggatga

SEQ ID NO: 99456 - DNA, 1812 bp, Homo sapiens
ggtgtgagccactgtgcccagcctgttttttttttcacagcaaaaatattttctcaggtatttgatattttttctatcttcataaactttggaacatcagtcagtaattagtagacaatatgtggaagttttcaatatggccaggactgtgcactgtgtccaaaatatttttcttttcttcctgcattcctgaaacagccgcctacttgcagcctctcagctgctgggtctggctctactggggaggtgagtggagactggcagtgtcaggtagctccagaaatggggggcgggggcagtctgctcctcctggcctgagtagaccaaggatccactcatagtctggggtgtcctttccctttcaccccagagccgcccatgggggaggaacattctagatgcatgttttctaaaagctgcctttggtcagtcctttgtcagtcctaacttgcagtgtgggaaaacatagataagtaagtgtgctctatgttaatgaagccgctgatcaccggccctttggtgtacagtcttaatgactaattttaaactgttttatgtcaggaacaaaagaagctaatattaactcaactagtatttcagatgataattcagctagtctgcggtgtgagaatattcagcccaaccccacagagaagcagaaaggtaagaatggtccagtttcgccctttcctggcgagagcagagtgagccctccagaaccttcttctcaaagggccgcagcccagagcccgaggttttcctcttgggtctgaacgtggcaagtgattcacagtgattcacttctgcctttttgcataaactagaatcgaacatggtggtttcttgatagcatgggacccactcgtgtgctcccccgtgctctgtaagtgagaggaggtggcatgtttcatcacttggggggtgtcatgagtggtccctgaaaagtttcggggtcactacttggagagccccaccagtcaagaggtgtaccccccagacttcatggtcacagtgctgtggccaccatgatttttctgtctgtcattttctttgagtgttgaattatacctcagtgggattttactttcaccataaattttctcagcctttaaaaaaactttggtaaaatagccattcaatgtttgtgttttgaggccttggagctcctaacaggcctgcaagggtaccagtgcccaggtaaccaaggcttgtgcaggtggcagcggcagggtggggtgtggccaggggagggctgatgtttgttgatttgttcaaacagaaaattatctgttgaaggcctactgcatgtcagccctgaggctgggagcgcatgagccagtgaagtcaggctggcctcctgccttcctggtgcagatgaggctcgaagatcaaccgaaatcgtttgatggggtggcagtctgggacgggaggggccttggttggtgagggtggcccagaaagcctgcagggcagaaggggctgtataaaccaagatcccggctgggatgcgactgcagcagggctggctcagcccagaggaagggccagagccaggtccctgtgccagcttatggagtttagcctttattggaagagcagcgggaggctaattatatctttaggaggagcagtataatgatatttagattttaaagagtggccatgttaattagggagggttaaagattgtgcagagaagagagagaggcctggactgtggaggcgccctgggaggggagaagtggtaggattccagggctgctggcacgtgctgggggagctggcctggagcgtagagggaaggcccaggct

SEQ ID NO: 99457 - DNA, 1150 bp, Homo sapiens
gaggggcctccagctggctgtgtgaagagaggtctggggtcagccctggtcagtgggaccccaatgtggcccctgccctgaggtttgtgacccagggcaataagcgcctccaggtagaaagcagcaggtgaagggctggtgtcactgagagcgcagtcaggggagaggcggaggccctgagggtctttgtgcagtagagggcatgacgaggctgtggggacgggaggccaggtgtggaccaggaggcctgggcagcacagggacgtggggaagctgggtgggggtggagggcgaggctcacagggactcaggcctggagggcttgcagaggacactgtttgcagacagtccatcttagcttcagcgggtagcttgagatgctgttctagctagagatggttggtgattagattcctctctgccgacctctgacacagtttcagatgcttgggactgatgaaaatgtgtaattctaatttaatctaatttctttttatttaggtcagggagtggtaaaaccgtttcaaatgtgattacagagtcacacaattctgacaatgaagaggatgatcaatttgtggtggaagctgcccctcagctctctgaaatgtcagaaattgaaatggttagttaaccgaaatatgatgttttttaataataatgttttaccttcattgagattaatagtctagcttttagatttatgtagacaaaaatgtcctgtaatttttcagttagttttctaccttcgttaattttgttgttctttttttgagatccacagaagcatgatctttaaaattcaacaagcctgaatcttctttttcccccttcctttcctgctcaggtaacagcagtggaactagaagaagaggagaagcatggtgagtcctgggcacgagtgtgcatgtatgtccatgtgtgtgtgctcatgcaccttctccacgtgggcctggaaggatccagtgcaagggactgttgtgtgccaggttctggtctgggtcacactggcgggatcacactggtggtacataggaccctgcgggcatggattactcttaaggcgatggctgctgctccccatccttagaggagggggagggcacagttggaagctggaaactcactggcaactgtcctgcagatgaca

SEQ ID NO: 99458 - DNA, 1112 bp, Homo sapiens
ctcagcctgtctccatatcaggtacctatcaactggattgttttcatttttgttttttgacctctttgtaattgcatgtacttctctatgtaattttcctcttgatctctactatcgtttgcttgtgtttctagtccttaaagttcataaatttaaaaaggagatttcaggatggcctttatggacgttgtctggacatacatcctcactttcttccgcagtttaccctggttttcctcagacagaggctagcgcagccccccggagtccttgttctccttaagagggtctcgctctgcaaagcattggcgccatggcttttcctttgcatgggtgtgcataccgagagacaggcagcttaggaaaaacaacataaggaagacttaaaaggatgcactgatttacgacgttttttgatgttagccatttttttggaaattgttttttaaagcaaaagttttttaaaaacatggtttatagtttttcacttacatatactattgtaaatacttagcagagtcttaagttactgtataaaacatttcattgtgtttgaagacatacttatgggtcttgaggtctgggtcctaatacttttaaatagtgtatttattatgtaaactgaggagtgccatttaaagtgtgaggattgcctgaaaaggttttgtttctttcttttttttttttttttgagatggagtcttactctgtcgcccaggctggagtgcagtggcgcaatctcggctcactgcaaccaccgcctcccgagttcaagtgattctcctgcctcagcctcctgagtaactgggactacaggcgcacgccaccatgcccagctaatttttgtattttcagtagagatggggtttcaccgtgttgaccaggatggtctccacctcctgacctcgtgatccgcctgcctcggcctcccaaagtgctgggattacaggcatgagccactgcacccggccaggttttgtttctttaaggattagcacaaatggcaccgttgggtttttcttcatacaatttccaaaataaattctgtactcaggttgttatatgattttctgagctgaataagttcaggagcagattattaagatctgcca

SEQ ID NO: 99459 - DNA, 1064 bp, Homo sapiens
tactggcgctgcctgcagcgcacaacctccacagcggggcgttctctgatcgaggctcagacttgcgagaacgaagaagccgagacggtcaccgccatggcctcgctgtccgtgggcgtgaagcccgccgaaaagaggtgagcacctgccctgccgcccgcctgcaggctcacccagccccactgtgcccactgacacactattcagggtcagaacctttatggcacatgccctgcccaacagactagagacaggccagtgtggccccctccttccagtgccaaagccccttagagacgcatgaggagcattagatcctgaacagatggacccggggctgccaggccagggctaggctggcgggtggggcagcacacagcctttaacccacgttctgttctctcctctctgtggtgcacctgccccacgcccccatctccttctcttgcgggatccacagaccagatgaggagcccatggaagaggagccgcccctgtagcactccctcgaagctgctgttctcttgtctgtctgtctctgtcttgaagctcagccaagaaactttcccgtgtcacgcctgcgtcccaccgtggggctctcttggagcacccagggacacccagcgtgcaacagccacgggaagcctttctgccgcccaggcccacaggtctcgagacgcacatgcacgcctgggcgtggcagcctcacagggaacacgggacagacgccggcgacgcgcagacacacggacacgcggaagccaagcacactctggcgggtcccgcaagggacgccgtggaagaaaggagcctgtggcaacaggcggccgagctgccgaattcagttgacacgaggcacagaaaacaaatatcaaagatctaataatacaaaacaaacttgattaaaactggtgcttaaagtttattacccacaactccacagtctctgtgtaaaccactcgactcatcttgtagcttatttttttttaaagaggacgttttctacggctgtggcccgcctctgtgaaccatagcggtgtgcggcggggggtctgcacccgggt

SEQ ID NO: 99460 - DNA, 1847 bp, Homo sapiens
ttttgtggcgacttgctttacgggccagtgcgtggtcagcctgcagagacattccacatgtgtttgggataatgtgtcctctccgtctgtttcccagagttctgtttgtgttcattaaacagaacttgctaattgtattgttcacgctttggttttcctgaccgacgattgtctgctggatctgagaaagacatggcaaagtctcccacgatggtgggacacacatattcttgtcttctttccattgcacccatttttacttagacattttaaagctgctttactaaatatagacatttgacatcattatgccctttcgtgatgaattgaagtcttatcacaataacctgtatatccagtaatggcctttcccttacatcttttgtgccagatattggagctgtgaccccagctgccctttggccaggtttgcctgcctagcgtcagttttcctttgggacttttagccttcccctgaagtttcagatgtgtctcctataaacagcaaaagcctgggcaatatattattttcacgtcctatcctgtggtctgtgctttaagtggaaacgtgggtcatttgctgttagtttgatcccttttttcagatgccttcttagcatcttattcattgtttgtccccagtttctgtggctctttcctttttctcttttctcgccttctcttggggtaattgagggtttcctgcattccatttgttccctctactgagtccaaagatatgcaacctattttcttgtttttcattcgtcatctttaacaattggagcatgtattgtcaacacagtcagcatcctcactcccacctccatgcaaaccaaagcccggactgggccagccccaattagggtgccagagtagacacagagcacccaggtgggtatccttccactgcaaaactacttgtttatcagacactgaaatttaaccagggccgtgaatggttttgtttgtttttgttttactaaatctggcagccctagcctcagtgccccatcccaggttatatcactgactggtgtttcatttccttctttcttttgtttgatttcactgataagacaccattattattgctctatgtcatccctgttcatccaggctttcctgtacttatgtcattttcttggctcatcattccttctcatttctcacactgtcttctaggattattttcatactgccttaagtataatacatccactagagtgtcccttgggaaaacactcatgtggtcaacttccccagctcgcgtttgtgaggaggcaggtctttatctcacccttgttcttggatgatagtttcactggataaacaattctgggttgacaaggatttgctcttgacacattgattggcttaagattttaagccactgtctgcttgcctccattgctgttaaggagttggtgtgtggctaatggctacctctttgaagattctgttttctctagcagcttttagaattttctttttgtttttgatgttctgcagttttactctgatgtacctaggtgtgcattcctgggtttttttgcccctggcttgggtctcacatcttccatgtcacgttcataaatctctggttgtttcatcatacagaaatgtcatttatttttaatacatactcactatatttactttttataatttataactgatcatttcagtaactgcgatctttaaggatctaatcaattaaaacttattaaaagttaataaactttttatttttggatagtctgagatttacagaaacattgtagagatcgtgtacaagttcctcatatcccccctcagaaaacgtcttctactgtgaacatcttact

SEQ ID NO: 99461 - DNA, 1044 bp, Homo sapiens
aagacccccacctttctagggccccaggccgccacagcaccagaaccttcctccctccccttctgttgaggccgatgtgaggggcagcatcagagacggcggaggtgggacctgggactgcaggtcccgcctccagccaggggcactccagtcaggggtctccccctgcgccagaagtgggagcagcacagggcatcctccgggcccctcccccgcccccagcagggctgctgccatggctttcccagaaaggccagcactgtaatcctaaattttgaaagattcactctgagacaaacctgctttattttccaggaaaggtctcattcagacacaggcctgaaggccaagcacaccagcaatatctccaggtgacacaaactgcccggcacagcaaggggagcttttccaggccagggaagccagggcggtgcgcgtcagctgtgtgttcctccagcccttgccattagagggagaggggcagcttccttagaacctacgaggctccgtctctctgcagtgactcctgatctaagggccgtgggtgaggcctgcagatgatcggcagggctcagtgccttgccccggtgaccatgcgcagccgctgagggaggcccaggaccggcagcgctgagcctcggctcacccaaaggctgccatggggcccatggggccttgacccagacttgggaagccagggagctggcggtcagggaagtgggcactggccagtggtctcccagacaggagggaggttcggtggcttgaagaagtagaggacgccaagggcagggtgaccctgggggtcagtgagagcccagaagtgcaggcacctcacgggaggacagttgggctctcgcaggtgtgggggaggctgggctggccaagccaagagcacgaggcagaaggggaaaggggagagagggacgcatggccaggcctgaggtggtctgttgggccccactgaaacccctggatcttctgaggggtgggcgcatacgtccccttgcacacctccgccgacagctgacagtgctgccttaa

SEQ ID NO: 99462 - DNA, 1250 bp, Homo sapiens
acgtcaacatggctttcaccggcggcctggacccccccatgggagacgctgagtacttggcggccttcaggtgagcctcccggcttcacatgacacctgaagtagcagcttttcctctgtgcacacattccaggaagcacttgttggagatgagcgtgtctgaaactggtctgtggctgaacggggctgtggggtccggaggagctgtctcagttcattcttcagtgccaagcgtggaatcttggcgactatcttcttaccatcagctcttagtgctcccttttgtgcatgaaataaaaccaggagctcactttgggtcgatggtgagagagtgatggagacagaggcagggacttttgtgcagagtgttatgttcatgagaaacgaaggcaaagacctgcagggtctcatgatctcctaattcttcttccgcaaacctcctgtgatgtgatgtccaatggaaataagtatttcttctttatttattcctaaaaatcaaaggcagttgtcgccctccctcccatttccttcgtgtggctgtgacccttcagcatttagccgcagggcgcgccgtttaaagacgcagtgtttgcttttgtcatcaagcggttccttctcctttggtctaggccagattggggtcattcctgtgacccaaaatgggatgctgagcagcgcaggttttcttgtcatcgttttaaaatggcagcttcacctgccgtggtggagtgacgggcgtccagggcagcagcccacagcccacatcggttcccagagccacgtgaggagaagggttttattagcgtggctgagcctgacatgccgtgtctctgttagaaaacgctgtcagtatggtgtcaaagccccatacagtcttcagcgcttttctctttctctgtctccatggtcttgttctgatttacatacatataaaacgcacgtgtgcagacgtgtctttgtgacgtgtgtgcatgtgtctgtgtatggatgtgagtgcacgtctgcatatgtgtgtgtccacgtgcgtgtgtgtgtttgtgtgggtcggtgttcatctgtgtgtgtgtgtctgtgtgggtgggtgttcgttcatctgtgtgtgtgtctgtgtgggtgggtgttcatctgtgtgcatgtctctcagtgcttgtgcaggtgtctacagccatgtgcatgtctgcaggtgtgtgtccatgcctatgtgtgttacacacatctgtgtgggtgtggatgcatgtctgtgtgcatgc

SEQ ID NO: 99463 - DNA, 1039 bp, Homo sapiens
ccttcctgacagaggctgaggaagtggctcacttgtcagagacacggcaggtgtaggaaattgatcagatggcttcgtctgggaaatggtggcctctaggcctggctgaactccagccccatcggctgctggagtcaggattgtgccatggcgctaagggcgagggaaacagtgctgcagacgcgaacattggcccttagaacccctgcgaccctgcaccacgtagccctgacccacacagccccagaatcgcgcctgccgggtacgggcccagctggagggtaatgtcattcctgagcaggagccgttgtcactaagcacaactggggttggggacggccctcaggggaggccaccctccaatacctgcctcagccctgaagtagttgtccctgctctttaaggacgtgcaccatggaaacgggacccagcaggctttctacagcgaccccagcgtcctgtacatgtccctccaccgctacgacgatgggaacttcttcccaggcagcggggctcctgatgaggtaggtggggtatataagggcctctggggggaaagggggactgcggggagccgctgtgggggcacggggcagacggtccacagctgcccggcagcagtgagtgcggccttcgtgctcacttaagcccagacagtaacttcagtcagacgtcagcctgcatcgtatcgcgtgtgcacaggtggcctgtgttttgtctgaagtacaaatgagaggctggatattgtttctggttcccatccaggcagacagaggtgtttgtgaaggaggaggtgtgtggtgcccgttttcctccgggcagggcccaggccactgtcttccacaggacaccctccggcaaggggctctgtccactgtcctttgcccggcgcggggctgcatggcggccccaggaacggcaggcccagcggctccttgacaacgccccaggtccccgttcagagcctgcccactctgaacagaggctccaacagcagggctttcatccaggaagacgctccgtctgcctctggatatta

SEQ ID NO: 99464 - DNA, 1246 bp, Homo sapiens
ctaaaattaaaggtaatttatgtattggaatataggaaggtcagcaggaagcaactgagatgaacggctgccatgtctcctggggcgtggcggcagctcctgagaggaagggttccaggtgaagatgagggaaatgttggtaacatgtgaaatagggttccctaccagaggagcgtgggggacctccaagcaggagagtgtgtgtgtgtgtgtgtgtgtgtgtgtgtgtctgtctgtctcagtatggaactgtggatgtgtgtgataggtatatgcttatgtgtatatgtgtgtgtgtgcttgtatgtgtctgtggtttgtgtgtgtgtgagtgtttctgtatggggtgttcatgtgtatctgtgcatgtgtgtctacgtggggggggtgggtatgggcgtatctgtggggcatatatgtgtgtagggcgtttgcatggtgtgtgtgtctctatctgtggggtgtggggtgtgtgtggggtgtgtgtctgtgtggagtgtgtgtggggtgtgtgtctgtggtgtatgggcgtatctgtggggcatgtatgtgtgtagggcgtgttgcatggtgtgtgtgtctgtgtgggagggtgtgtctctgtggtgtgtgtgtctgtgtggggtgtacgtgtgtctctgtctgtggtgtgtgtgtctgtggggggtgtgtgtgtgtctctgtctgtggtgtgtgtgtctgtgtggggtgtgtgcatgtccgtgtcggttagccgaccctatggcattggctaagattccccagtggcttgtttgggagctgtgtgtgtgtgtgtgtgtgtgtgcgcgcgcacgcgtgtgagtgtgtctgcatgtggggtgtgtacgtgtctgtctgttaaccgattctccggcatcactgagggttccctgcgacgtattcaggagctctgcactcacagagacctcttaggtctgcgtggaccccgagtggctctctggcgggccgtggagaaactggccaccgcccacctgcgcttcgtctccagcgtcagttctctcccgcaggggcttttgctacttcaactccgtggccgtggcagccaagcttctgcagcagaggttgagcgtgagcaagatcctcatcgtggactgggtaagcagagccgccttggccagcgcagctcaggttgctcctttgccgtccccgagcggacagcagcgtgtggacagaggagctgggctcttggatgtgggaagcttaggtttctggaaacggtctcaaa

SEQ ID NO: 99465 - DNA, 1040 bp, Homo sapiens
gatggaagtatactgaagcaattgagggaaaggaggatgcctcagaacaggtcaggacacatgcatctttcttctggtaaattctcttgtattttcctgtttaaactttttggcatgtcttaaaaagattgaaggctgaacgtgggctgcagctgccctggctctggtaggccctggggtttcagaagcagagcccacggaacctgagctgctctgcccagccagggctggtgatgacggtggcctgggagggtgacctcactgtggggtgttgtttccacaggtggacagtgacaccatatggaacgaggtgcactcggcgggggcagcccgcctggctgtgggctgcgtggtagagctggtcttcaaggtggccacaggggagctgaaggtcagtcggggcctggacagtggtggccctccaggaggcctgccatagattcccagtgtggggaggggccgcccactccgtctccctctcatcaggctgggaggcggctgtgatggggaggcgtggaccccactctgtcagcacagcctcgctattgaatcaaagagacattgcccacatttgtgatagggtatgtgcatagtacagagattctcaatgatttgggtcttaagaaccctttatactcttaaaaatttatactcttaaaaaaaaaaaaaaagctccaaagagcttctgtttacatgagttatatccacaatattgactctattagagattacaactgagaaattttcaaaatgtttattaatttaaaaatagcgaccgggcacagtggctcacacctgtaatcccagcactttgggaggccaaggcagggggatcacctgaggtcaggagttcaagagcagcttggctaacttggcgaaactccttctctactgaaatacaaaaattagctgggcatggtggcgcatgcctataatcccagctacttgggaggctgaggctggcgaatcgcttgaacctgggaggtggaggttgcggcgagccgagtcacgccattgcactccagcctgggtgacagagt

SEQ ID NO: 99466 - DNA, 1169 bp, Homo sapiens
tcgctcgcctccgtgttcgtccggctcccttgcggtggtgttggggtaagtgttcctttaatgtgtaaataatgtcctgtttcttctcgagtcccagtggtcacagaaatcgcagccttgcttccctcaaagtgaataattgctgccaggtgttttccatacgcaggggctgcccatgtgcggcttcaaaggccgtgtgagccgagagcgttttgatcgccgactcgggcacctttctctggggaaggttgtctggcgcaggtggctggggctctggggtgcagtggctctcgctttaagaaacaggatcctgtatgcagccagcatctcatccccttcgaagtctgtggcagtaatctgctcacatcaggccacgagtatggtgcgggtaggatgcgtgcttctgtattctgtacctagtttccacccgaagctacaggtggggctcccagtgcagtgaccgtgatactcatgggccacgtggagtctgtagggctactcgctgggctgtgctggcttctgtgagctgatgatatggacctggcctgggcatatgaatcactggtctgtgccagcttctacgaactgatgatatggacctggcctgggcatatgaatcactgggctgtgctggcttctacgagctgatgatatggacctggcctgggcgcataagttcacaaggactttccagtctgggcatctgcccatccgtccacacaggaagggtcaggtcttgcaatcaaacttctcaataacaaaagagttctcccctggcccctgacctccttgatgcagcctgggcaggggtggcaatagcgagggcggccatgagaagctgaggcggagcgtccgagcagatccgggccatcatggtcctgcagtgccgcgaatcaccacagacggttacaggcagggaggacgggagccggtggacagcaggagccgctgcagccgaaacggtgcagtgtgtgtgtaatcactgatcgcagggtgaagctcaaggtctggattctgttatggaaatgaaacaaaattgttttcttcctgagtttttataaaaatcactgctttgaaaattatcccgtcagaaagagaataaacggcatttattcataccaccaccaagccctcctagagttattttattttgtattgtaaataggctg

SEQ ID NO: 99467 - DNA, 1058 bp, Homo sapiens
gccagtccgaggaaccacagctctgtaggatttgattctatcctccagcagcagagctgctgcctcggctgcaggagccactggctcgttccctcccttctctctggactccatgccggccgtgccgttgagcacctccccagcttcctgactgccagctgtgtggccagacgctgcatctccacccccagcagcaccttggaagccaggagcaggacgccctgcagtaaactgttccccttaattctcagctacagttcttaaatgcttgccactgaatgaatcagtgtggggccttgtacctggagcacctagacccaagcctgccacacacgggatcagtgctcagtggtctccagaggcttctgggtcaggagcccttctccaccgagcttcccccagtggctggcattgggtgctatttctccttcttgttcagaggggggcctgtctctaatttctgggccttcttaattagcaccccgggcactaaacactacaaagcccagcagaactaacgcttggcaaagacagagagagaaagccccgggcctctctggcacacacacggtgcttcatggtgaacactcgtccacaggtcctgtccgacaggcccagggtgggggcctcttcctgtggtcgggccttgtaagttgatgaagatctgaaattcagtgtgctattattaggctgataagaaatgggaaactatttacattaataatttttagggctagtttctcatagatcagcctttactttgagaaaaagaggcttgttatattccaagcatgagatgattattagaaacacttattttctgttctctctggagagtaataggcagaaccccttatcagggaaacgtcgtagtacacggagcaatttgccgaggtaaacataaggcggggcacctccagcccgcgtcggggaggattgcttattaaccacttaaccgcgtggggcccacggcaatcccagctgaatttggtcagcagcagactgggggcctgtgggtgctggctcctgctccagctcctgctgcagctcctcccact

SEQ ID NO: 99468 - DNA, 1054 bp, Homo sapiens
ccggtcgctgcctttagatccctagtgcttcccaaggcgggcctcgcgccggaggtttgggttccagatgcagatgagttggggaccacggtgggctgaaaggtgtagattcgcaaatggctctgtccacacaggcagagctgttcacagaaaccgacccacgcccagtaccttcaccctgtggtcagatgaaaggtgaagccggcgcagatgttgggatgggctctgctgagcctccccaggtcggggtggggatagcagcctcacgctctggaggcctcactgactgacacagctggggcgatgcatgggcgagcaagaaagtgtgcaacgtggacaccatcctcacatccctgggcccagcctcacatccctgtcagtctttctctgattttagagcaacacagctatgaagataggggtgtattatctagaagagcattagttacgagacatcgccattaagtgacttcacacctcagcagcctcctgccacgcccagtaaatcagcttgtcagtcctgtttccatctcctggtaaacagtggtggcctgattctgtgaagacagtgccagcgcttgcataatgctgtggccacagaaatttatccaaagcaccagattcgttttattcattatttgggactgatgaatgggatttagaatcccctgcttcgtgagctccctgcgctctcccctgcagcaacacagcagtgttgagcaaatatttactcaccagagtgcgtatttttaaaaaaccaccaacaggataaccttgagccagtggtgtctgcctggctgtaatgacatctcctttttgtgcagcttctgaaccgaatctgaaattacggtccaggctaaagcagaaagtggccgaaagacggagcagccccctgttacgcaggaaagacgggccagtggtcactgctctaaaaaagcgtccgttggatgtcacaggtatgtcggctgagcaggtacacccgccccgctgccctctctgccaggccttcctgccataggcgatttctctcaggagcttctgaaaacccacgtgt

SEQ ID NO: 99469 - DNA, 1035 bp, Homo sapiens
tggctgttggcttcccatgctgccttgtgtttctctggggatgattggaagcaaagtctccaacaccttctactgtgcttctaaccttgtgatagcaccaccctccaactccctgctttcttgagaacggaagagagaattctgttttcacactccgggaaatgttatttagaatacatagtgctccagaagaacttaattaagatttgattgcattatcagttttttaaaaagtcatcactaccacattaataataataacataaagatttccgagaaaacgtttaaaccacttaagagaatagtgtgtagttacacaccctgtatcacccttgacatctactttcaaacacatgacatcgctcattctaagtaagttatatctgtgcttttctgcagtaattggtaatatgaaacacgtcattaaattttagttatgaagttccttgaatgaactgaaatagtctttaataattgtgatgtagacttaaataattatatgattttgattttacattaacttatcctgacccggcacacagtttgcccatttctgcatctctaaagggcaattgtatgacctgtgaacatgtgaaaagctttgtcactgtcttgtgaattttgtcgtcaccccatgcattttttgcatgtcctttgctggctctgctgacaggtaacgcctgtaccagctcaaacgtctgacctccctggtgaaagcaatgcagtgactcctattcggagcttgggcatattctgggcattcacatcgcctgcacctgtgggcaggaccaggtgcctgagtttctacccagctccttcacccgccaccttgggacctggggaagctcttgaacctctctgtgcctcagtttcgtcatctgtgaaatgtacctttaaattgcttctctcctggagctatcatgagatgtgaattaattaatatttgcaaagtccttcgagtaggaccagatcgaggtgttttctgctcttgtttctctacgctgttagggtgtttttgatttttttctccatcca

SEQ ID NO: 99470 - DNA, 1089 bp, Homo sapiens
tctctggcaaagtttatttaacatggatattactttttccataaatatcttgtgaaacttactgctaaagccatcttaaccctaagatttcatttgtgcaaaggtttttgattacttattcaatttttaaaatagttcctgggacatttttcccccccggctcactttagctaagttgtatttttttaaaagaaatatatgcctttgttatacatttttgtatttttgacttagtggtttttggtgtcatgtccttttctggtgttttttatgtctgtcagacctttaatgatgtcctcttttacactccagatattggttgtttgtgctttttctctttattgctgctgttttgttttgcttttgtttttcttggtcactctctccagaagtttatcagttattcttttcaaagactagcttttgactttatggatgttgtttgttgaatatcgatttcattaatttctagtatttttatttctctatgttctgttttcttagggtgtattgtggtttttgtagctttttgatatagatacatagagcattgatttcagctctgtcttctaacatatgcttatatagctatacattttcctctaaatgcaactttatctgcatcccacaagttttgatacgtagtttgacaatctttgtctttcaattagtttggcccatttacatttaatgtaattattgatatatttatgcttaaatctatcattgtacaatatgaattataattatctcaactattctaatgcacttgtcttgcctttagtgtatgtttttagtgatatatatatatatatatatatatattttttttcaccagcttggtaatcactattttgctgtttctttactgattatcagtaggatttcaacaactgtctttaatctatcacagccttatctaaattaatacttttgccaattctggcaaagtaagggtctgggatactttaactcttaatttatatactattttgacctgtatttaactctaaacttatctttaacatcacaagacattgttgttattattttatatagtcaagatttactcataaatttatcctttcc

SEQ ID NO: 99471 - DNA, 1209 bp, Homo sapiens
ctgatctgctctctctgctgctgtaaatccttgctgtgtgtgaccacaggtgtgactgggcagacctgcctagagcccgaggtcccactgccctggactccaagcgattcctgtggggctctgccatccaggccacttccgctgccatgggacagtggacggggaggctggctgtgggctgcaggctgcaatgacccagcccaggtgggccgggaaagaccagcgctgtggtctccgtcctggaggctggggcagcctcagtccagagctatctgctggggtcactgcaatggggcaggcggtttctgcctggggactcttcctcggggtgggccatggggggcagcggcccagcacacccttccatccacatggggcactcatgaggggcaatcatgttcattttgcttgttcactgccagcgccagtttgaggttgccgaatgccatttggttggccaatgcctgtctctgtcccttgtctgggctgggggctttacttacagaatggaagaatgaggagttttaccttacaaaattacacagttgatgttacgtttaacatcgtggacacaatgtgattcaaatttcacacaggtcacagacatgcggggtgactggcatgtctcatcttgagtaggaagaggctgtgagcaagctgaaatcctttcttccctatttacaagtggttctgggtggtcgtggaaaccggctgagtcctcagcagtgggaagcgaggtccaggaacgggattgatgccctggtgaggccattcctcatcccctgcaccgcctgtgaccatgaaagggcttgggccaggctgtttttgcaggctggatcttcccagaagcctaggggttggaaaggtgtgtgtgctgggtgcccgggggctgagctggacctccaggctctcgcaggagagggtgtggtggccacctggaagctggctgtgcaggggcagcaagggtgtgaagcttgccagtcggctcgggcctctcatgtgaagaaggacccagcaagatgcaggagatgttcccggacacacaccgcctgcccccgtcaccttgccaacgccgctgaaggttggcgcccacagagaagggcagcgcccttgcacgctcacagttacctggagcacacatgctcaatcccacgcgctcactcacattcagaacgcacacttgggtgcacaagcacgttgatgtgcagg

SEQ ID NO: 99472 - DNA, 1045 bp, Homo sapiens
ctgtgtgcctgtgaggcgggcaggagcgtcacccaagcttcagaagagaattccccggcagcagcgtggcgctcagcatgttccgtgtctgactgttttgattgtctctcagtccagttgacaaattccttttaagatgaaatttgaattaatttgcagaacttgtacaaatctccaagaaaacagcttaaggaacagattaaagaatgaatgccttaggaattaaagcattaatagctcttgagtagactggatggaaagatgagttgtgtaggttatccagatgaggctacatccagggagcaattcttaccttcagagggcgctgcctgtcctccttggcatccaagtgagcgcatctcctccacgctcaatgatgaatgctggccggcatccctgtgaggaaccttgtgatcattttccatttctgaaaactcccaggtggtgggggcccttggcccacatcagcattgaccaccccgggctcagatctggccaggtgcctgcgttgtgatgggaatttcagtacactgaattttgcctctgaccctgatgaaatagcttcggtggcatttgcatcaagatcatgttagtgtcatctctattagatgctttggagcaaacatgaacttgggtttccttttaagatgtcctgtgattccagattcaggggaatctgagaaaagtttgaagaaagaaaattccactcggccagccaaccttgggtgtgcagagcctgccccgccttccccactttgtcctgagaagctgggtcctccccagcaccagagttgctgctgcttcccctcgcgctcttggctgctctcccggccccaagcctgagtgacactctaggattgcagatggcaggctggtctctgggctcccccgtccccatgaccctccacctgcacccagacctctgggtccttgctcaggcagcccctgccctcggtgagacgcagcccactgtgggcccttcccctgggcctgccatcagctcctgtgctcctcggcgccccagcggctgccctgggcccgttcc

SEQ ID NO: 99473 - DNA, 1045 bp, Homo sapiens
aagcggaggatgcactggtgctggtttcattactgttcttttactaaacatacttgttcttcagcatggatggcacactgcacaataaataaagggtgaaggacattgtagctaagtcatgcatttctgatgtgctgtctccctcctcttctgtcccatcctctctcttccccccacccccacatagaggcaaaatatcagtgtaagaggaaatcatggttacatagttgaaatatctattatttttcccttgatttgaatgagtcattctttacttgaagagaccctaaacattgactgtgttacctaaagaatagtgcctctttttcttccatatctgtatgatggcatgaaatcgcgtcctgagaagaggacctaagcatgtcgtggaaaatcagtatgcttctttatgaacatttattttaaaagagcgagagagagagactaacaggtttttctgtttgtgattgagaattcattcacagcacactgaccgtctcccattggactctgaatgcggcctttgtgctctcactgacgtcaggagtctgattgtcttaatatgtttctcaaggcacaacctataaaagccgttttctgctgtaccgtagaatattcatgagaatacagacttttttgttttgatgctgcattctttaaggagagaaggttttattgttttcttcagggtgctttgggtcaaaagcactagcagcttctgttgggaactcgtggcattttgaatggtttttgatacagaaatagcacaagtcacgtctgacacagccgtaggcgcacgaatgcgtgaatgcgattgtggttctcatctctgcagctggtgtgtggggccgggcctgggacagcttgggcctcatccccacccacccggctcccaggatcctcattaggaagccctcaggagccctggggtgggtctccttgccctgtgaacgctccatttgtgttattgaatccaacataaatgcagcattgtcttcagaggtgagcaatggccgtggccggaggtgcgcatgggatgcaggcg

SEQ ID NO: 99474 - DNA, 1025 bp, Homo sapiens
ttgtggaacagaagcacacagatggtcttgctccctccagatacagccctggctggtacggccagcacccagggactctgcacacggaattccacgagaataacatcacgggctgccgtaaaagccagggaagcgaagggaggcgtttctgatctgtttctggccttgcgctggcacagggtgtcatcccttgggtgggaagggtctttggagccccttatggcagcaagtttacagccgcatttggatttaatgctggcaaggaaggactttattttctgttcgaatcaaatttggaatacgtttttgagtaaagcttgctgcgttgttgatacagcttattactcagaagaaaaaaagccttttaagtgacctgttaaggaaagttttatttcctcaaagttcgtgatagcttcaatagtttcggcttgtcatttaataggaccttttgaaagaaatattcaccagaaaagaatcacttcaagttgtgtgtgcattataaaaatggctctcgtccacgatgactggctgaaaaatgagatttttgagtttgtcatacatttaggggacccttaagaatgtggacagatgtggaagtagctgttcttcagttgaaggctgtgtgtgtgtgtgtgtgtgtgtgtgtgtgtgtgtgtgtgtgtcccactctcagcgcactttgaggcgcaactcgaggtgacacagttgagtccaggccttgcggtgagtgctgaggacacagagatgggcatgggccgtccttcccagctggccactcttaacccctggggaggggcacagggtctccgaagctcctgccacactcctgtcttttttgttttgctttgcaattcagtagtccctgtggggtaaccagatgctcttagctttgttggttggagctgtgatttttttttccagagggtttcccagaatgctcccatctcctcccctgatgtggtgtcaggtggcaccatggtgtcccccgctcctgtgcacagaccttggctttcctcagcggttta

SEQ ID NO: 99475 - DNA, 1028 bp, Homo sapiens
gtgagccgagatcacgccactgcacttcagcctgggtgacagagcgagactccatctcaaaaaaaaaaaaaagtgcaagaggagtaagtctttcaacccaaggggcgtgttggctgaagcaccttggagcagacttttgctgggtgaagccaccggcctgtcacttgggtagctgctggcagggtcagcctgactcgcacagaacatcaccgagtgttatgggcgctgggggagccccagcctcactctctccccatctcactggccactgaccacagattggtcacttccgaaatgctgccttaaacttggcatcaaaggatcctttttctgcacagagaatgagcggtgctttcaggtctggtttggtgagaggaggagagggtgtggtccactgtggtcagcgccctccgttctccacctcgctccagggagggatctctgctttgatgctcccagccgcgcagttaatgtgcctgcctagactttccgcaaatggccactttgagtttattgttctaaattagtgactcatttttcgtgagctacttattaacatgcacctattttccagcttcctgccacctaaccacaagcacctttagcgagtttgtgatgttcagcagtgtggaaaatattctgggagaatggttcgtctgtatagtggttttcgttgctgagtcacgtttggtgagcagcttgttcggctcagatgccctggcgtggagggcacgggccccggctgcggcactgaagcaaaggtgaagcgggaggagcaaagggagtctctcgccccgcacgtactgtgtgcctcgttctttatctgtgttcgtttattcactcctcatgtcagcctcgtctccactcgacaggggggatattccaccccaaaccctgcaggactgcctcccacacgggttctacgtccaggtggagggtagatgcgggtaggaattgtataatatttgttagaattctcgggagtgaaaaggtgttagtttagaaagtaggatgcctgcggggaaaca

SEQ ID NO: 99476 - DNA, 1126 bp, Homo sapiens
taaagattcttagatggctgggggtggggctctgcaaataccaacaggggaaaatcagccccaaatgccatcttcaccccccagcctttgtctggtcctgtaattcttcactgtttttttttaacttagtagtgtcatcaagaagatgtgtttatatttgtccagcttttgtgatttttctctctgctaaggctggaccacatggcctatttcaccttttttctttttttttttgcacttgtgttttttgaagcagtcatgtttattaaatatcgatattcagagtttttttggtcaaaaacaaaattcttctataagatgattagcagtatatatggaaaatcaggcaatttgaaatgaaattaataactaagataattattaaagggtttataggaatgcttattctgttatttacccagagttatttgtctacatggatattttagagttttaacagcaagtttatgtgagaataggtgtttctgttgagggacatctgaaaatacccaggttcttctgtcttcttaggctatcccacgtggattcttggtctagtggatccgattagcagtatacctgcattctaacaaatggaatggtaaaattagtattattagcatgttaaggtcaaactgtttccaggtactcttgcttgggtagagatttggaagttgactatatttgaaatctgaagggtgacaagtcagtgtttctccacattatctgtttccccataggtagcttgatttattcatccagtcatctgcccatccagtcccttctgctgctgaactagtcattgcttcagggtcatggacacaaaaacagacaagggtatgcccctcttaggggcagacacagaacagtatcagtggagcgatctgaggaagccagtgttggcagggagccttctagatggccaacaccttctatgaaagaggaggatgctgctggggtgaagtcctggccttctgggaggggctggaacccgcctcggcgctgggtcagtgctctggatggcagcctggccccgaccagcctgtcctttcccccatgtgttgttctgaatctctttcccctgcgacagaattcacagaaaaagcaaacctaattttttccttag

SEQ ID NO: 99477 - DNA, 1034 bp, Homo sapiens
catcccccactctccagcccctgtcaggctctgcacccctgtccacttcagcccgcattgggcctgccctgctctgcagggggaggggcaggagagtccatcttcagggttctctgaagctggacagttctgagaggcagcttccagctcatggaaaaaagaaagcccattgccacacctccagcagcatatgggggccttcaggtccccggaacaccgagtaggaaggaaggggcaggaccctccgacggggcagcagtgggccaggtgtcccccctgcacagtgtttacaccctgggacctgccgcaaggcatggctttcagaagagcctccccccaagaaatgctgcagacaggacggggcttctagagaccttggcttctacccaggaaggctgatctattcttcgactgttgcatcagcttcctcaacctctgcaggttcaggctgcgagccctagggagcatcactcaaagcaccctgttggccacttaggatcaggagggcctcggctcacccaagccatctccctctggtcgcatgtggttggctgtcctgtcagagccgtgggcagccacacttctttttccaagataaaccgctgcatctgcccagcgaccttcatgtgtagtcttacattagcacattcttaacagacatttagaaaccaaccaaacaaaatccagtttcctgcccccacggtctttcgctcttttgccacactcacaaatgtgagctgcatttggaaatgcctgtgcttccatttgcaaaccgaagctgaatggaacctggcaggcgcatctgctcctccgcagtggaggctggggcggcccgagcagaaagaggtgaagcctgtgcctgctgggagtccccgagcggcaggaactccggtgtctgggatggcctttggggtgtgaccttaggctgaggccagagcccgtctccccacgagctccccgcctggcctgggaaagtcagccccctcctttccagggctgtgtcttcccccttttgttttcagtcattgagcccc

SEQ ID NO: 99478 - DNA, 1046 bp, Homo sapiens
attgggggtgagtgcagatggttggctgcgagaggttccgatgctgggtttgacagtcagggtggtcttgtatctttttgatcctggccatccttgtggatagaaagtgacatcttattgtgattttgatttacattttcctgaggttaacaactagtgatgacagtcatcttttcacatgctcatgggccattgtgcatctttggagaaatgtctgtttaaatcctttgctcattttaaaattagattatttgcctttttattgtttgagttgtctggccctttatattctagatacagctccttgatcagatatatggtttgcaaatattcttttccattctgtaggttgcctttctggatggtgtcttttgaagctcagaagatttttattttgctggtatcctgtttggctatttttttcttttgctgcctgtgttttggtgtcctatcagagacatttattgaactcggattggattggaacgatgatgtgggccccctcttggggctcctggcttttggcttctgttgaatgtaaatgctaaaaggcttctctgggctgttaggagagaggcagattttattgcccagccagcttctgcagtgtctaatggctagattcgcttttcccacagttgtttttaattgaatgtccgtgggaaagtggccaagtaaatggaaggtttcacagagagagctgggtttctttgttgattttttttgaaactgtgcttttttgtcattactgtgcagagtttgttggaatctggcgccaggttgtgatgtctgctgagacttgtattggtcttgttgagtatggcagcattgtagtggcttttcccccactcgaaacacaagttccaggaaatttcgaagctctgtgtaacttccaggtggacatcttccctgttgagaggttaattatgggacgtggagccatcagggactctgaatgtgggacacacatcctgaggagagaggccacgtcttggaaggatgaagggcaacctgtcttcggggtccagaactggactctcactcag

SEQ ID NO: 99479 - DNA, 1005 bp, Homo sapiens
ttttgcatggcatttattgcttaaatcattcattgagggttttcttttttttaaaatgcatcaattacacttattatttttgaaagtctactttgttcttttcctaaaatgattaattttgacaattctgttgcttcctctgattcattacttaaaatttttcaagtattttcataaactttttatttaatcaaaacatacatggggaaaatgatagtgaataaagcattaagagattctttgaaagtttcagaaacagtaatcgtaccatttctcatgatatgagtaactgaagaacttgactgtcttttgatgtgtttgctgccttttttcacttctttctgtgttggcttgtgtttgcttgggagcgtatgtctcgctggtcttactgtttggaaatagagggatgggagtgaggaggccgttcttctgataggcatgccacgtgcatttcctgggagctgccctggactccagcccctgcatcctgaacgctgcagctctgggctcacctcggtcctgacccccatgcagtcctccacccgctgccctcaactctcctgtcagctcgagttgcttttgtttcccttaattatatatttctggcttgttggagggtttccttactgctggtgagcccagcagtgtgacagaaggtatgtcttatgcagaacctggggtttccacagcacaagagcctgtaagatgacttgtctgccacgtccccagaagaggaagtttctagtacttcaaaagcccaacctttggccagctttctctcagccccttttacccagcttcgttttctccccaccagctgggatgacaggtcccgcggcggagacacttgctggcagccggcactgctcctctgcctccccgcacactagcgaagccccagcctcggtggaaccccttgctgtaaggcttctccttccttacccaggaagtgcaggatgccagggaagagcaccggctcagcattctggccacgctgcacagccg

SEQ ID NO: 99480 - DNA, 2095 bp, Homo sapiens
cacgggagcgtgtgtggtgtgtgtgtgagtgcgtgcgcgtgtgtgcgtacgtgagtgcgtatgtgagtgtgtgcgtgcgtgtgtgtgcatgcgcgtgcgaactgaatgcatgcgtgcgcgcatgtgtggttgtgtgtgcgtacatgtgtgtacgtgactgcttgtgcgcacgtgcctgtgtgtgtgtgtgtgtgtgcctactcccatttcaggagcttgccctgcctgtttgatttttctaaagattgacactctaaatcccctttctctccaaaactctcttggggtgatatggaagactcctagggtctccagttttaccatattctccctagtccacacagaaggtgtccttcagccacataaaatgggccactcattggtgctggacatcctcacgccattggtgctggtgtccccatgtcgctggtgcttcatgtcacgtgccgttggttctgggtgtccccacagcctggccttagggtgctctgtttctttatagttaaggaattagctcagctgacagggaactaggtaagagtaaagtctgataacatggaaaatgttagtgcacatttgaaaaaaaataaatttagtaaaaatgttgatatattttaagtttgaatgacaagacttgagtgaatttttcctggttaatgttgtgtcttttgattaagccatttcaatggagtgtacatttatattaactcttgatgccttttttatttgccgtaattggattagaaaataagatcttttctgtagttgatagaactttgttaattttattctctcatttgttttccttaactcaaaaatggtgagtaaagatcacgatgctgttttaaaatttaggaagtggtgaaccatcaagaggataaggttaggtgtaatttgaaggatgattatgaagtgagggtttatgcagatttgtgcaccagtgtgtacagtagggaaacggagggttataaccaggggcattctcagagtttgggcaggatcaggcagcgggcagagctctggtgccccatcaggcggggactttggggggtgctctctgctctccgtgggctcccacatcagatgagccaggtggctgggaggggccctgcgtgcccaacacagtggctgaggggctgctgctcctgccctgtgatgtgtgctctctccccagcctggatttccagaagaaaagacctctgctcctcctgtctttttattctttattggcctggtgctgggcacttagttggagttcagtaaaggtttagtgagtgaagaaggaaaaaatgttacttagaagtgttttactcgacttccttgatctggaaacacacacacatattgtaacataagaaaagttatatgcaaaaacagttcttaaatgacacctcgactaagacaaaacacagaccttttcttttgtggttagtgctttttcgtatttcatttaaaaacaaaacaaccaccaaaaaaccttccctacctcaaggccataaagataaccttgtatattttctcttaaggcctttgacgttttgtctttcatacttaagcctttggtttttgtgtggggtgcagggtggggatcagtttcattttcttttctcattttgagaaccataatgtttgacactttacaccctttctctgggatagctgtgcggccagctcatcctccaagttcaatctgttttggaccctccctgtgctcagctgctccagagcctgtcctggggccagcagggcactgtctccttgacaggcgctgcagccgcactcccctgtctcagccccctccctgcaattgtcccagctcctcctaagctgtgacttgtctagagacaagttcctttaaaaagcctagcctgaaacttgattggaattgcattgactctatggatgaatttgaaggcagggttggcatcctgacagtatatttgtgtgtgtggcttctctttccctccatcaggtcttctttactgtcttttttcaatagatttttataattttctctataaaggtcttgtacgtgtcaagttagatttattctttattctttggtagattgtagttgttttgtttttctgttgca

SEQ ID NO: 99481 - DNA, 1011 bp, Homo sapiens
taaagtcctcctgttacttttagagttctagggccctaacaggtgcttagcaaatacttgttaaatgttttcccactagaaaggttttgtaaggaggaaggaggctggcgttctcgccgtcaggtttttatgccatccgctgagtgcaggtattttgggagcacgtaaactgtatgtccaggtgatacaggttagcctcccagtatagggtgcagtggacccaaaacaggaaaaccacgtggccaggcacagcagctagaagcgcatcagctggagagagcccagagatgccctgtgcgtagccactgcaggaagcctggaggtgccctgtgcgttggtctggggatccctgtgtccataagcaggtgggcctcgggctcctgctctcagcttctgcctggctcttgaccccttaactacctcatggtagcaagaatgtgacctttctcccacgctcctttgctgctctccgcccttgttaatgttccgcccctgctggggtagattgtatccccctttgattgtggagggtagggcccttctcaaatagggttttctgggaccctgcggttttgcaaggtgtttgcagttattcaccataaaaaccgagggcaggggacaggccctggtcaaacccctttgggggaagctcagagaaattcagaaggcaactgctacattcaagctctgggaagctcccgagtagagaagccagctgggatctgtcgagaagagacttgtccagtttattatttcagggaatttgtatcccatggacacaaattcctcacgggatgccctttgggaaacgccttgtgaggactgacccagctggagcaggtacctgggaaggaaagtcatttccaagggattctgggctacctgggagctggccgctggcctcacacctgaacctgaaggccaggtgggtggtctcatttcatgtctatagggacattcagctgttatttttttaagtaaaactgtatctaatggagcttgctatttatt

SEQ ID NO: 99482 - DNA, 3573 bp, Homo sapiens
ctctgatgggacccctcttccttctctgtctcccctgtctcccgagccccaggactgccggtctcccatctgcttagtccccagctgcgtccctgcaggctctccgctctgttgctggtttggttcgtctggtgtgtgcctcccctgtgacatgccgggagcagagcggaacagctgtgccagtccctgggccccagctggactgtgctgggtccagggtctatgagagctgctgggaggccaccagtgcaggtgggcaggaccttgctccgtgattctacccatgacgcttctcactcaaggaattggcttttgtttcagtgcatcctattgaaaatcacttagccagtaagcaaatgttggcccttagtctgttaaacattaatacaaataagcacgtgtcgctgccctcccgttgtacagttgtacagctgtaataaacaccactcgccctgcctcgtgtgcatgtctcttctggtttcggcaccccagtgccgtggttgtgcgaggggatcagaatatctgcttgagattagcccatgtcagcattttattgggattgttaggcacctccgtcctgatcattgcaccacgctctgtccctgtacttaaatatctctacttggcatttgaaacaaaacaaataaacctattgtacaggatggaccaatcatgaggcattttcactctgatgttggcagtggatgtgttgacattgagaggatattcatggtggcaggctgcccccagttccaggttttggatatttggaataaggtaggctatgacaggccgggtgcaatagcttatgcctgtaatcccagcactttgggaggccaaggcaggcggatcacgaggtcaggagatcgagaccatcctggctaacatgaaaccccgtctctactaaaaatacaaaaaattagctgggcgtggtggcgggcacctgtagtcccagctactcgggaggctgaggcaggagaatggcatgaacccgggaggcggagcttgcagtgagccgagatggcgccaccgcactccagcctgggcgacagagtgactgcatctcaaaaaaaaaaaaaaaaaaaaaaaaataggctatggccatgaagggttgcttccggattcagtacatttaggaggaaataatgttgttcatcatatgacacagttaagtctccgagagataattaaatgaaaatcattctaaaatgtttgattaaatgcctttctagcctagcccctgtaggtggagtgtcatgatttccacgttgttgggtgctggataaatgatttagccacagtctcacggctctgtaaagagtggcaggctgttcctatcactgctgatcctgtgtgtgctgtgcaccggatgtgggtggaatgaggctgcaggggcacctgcatccccagtggctatgatgactaaatgaggaggcccctgtagagtgcacagcgttcacccagtgacagtgtgattgtaatagctggggttgctgggaccctagagtatccacggtgtgcatgcacttgaacttcaggataccctgtttccctctgaggtgcaagagctctggcgattccggatccctactgtgtgtcaggttctggaagcatcttctctcatctccacgtgatgcccaggggctcccccagcttctggaagccaccgcttgtccagggcaccagcccagtctgtcgtcaagcctggatttgatcttaggtctggctgcttccggaataccgagacgggcctctgctgttccctgagcttgctgtcagcaaatgtttggtgaggagaattatttggtttggaatttcttgtttatgttttagtccattaattttttttatcctgtgaaatattttagcaaccctaaagacccatgacacacaggtatctcttcaatattgtgctaattcctgcctttttttggtgtcttctcatctcagcatcagtagtggtggccatgtagggacagaggcacttagcagccgcggcaccgggaataatgatttgacttgggggccctgtggaagaggcacatgttgccgcttgaattctaagaacactatttacctttctgttttgaaagttcactttcactttcaaggtctcaattttctcaaaagttctaaagtgataaacatagtctttctaagattttctttttgcatttgtggccttcgttgtggcacagccctgtgtcaggtggggctgagcccagagggtgctgaggggatggggctcatggtgacagcgtggtgcaatcccgaggcaagtccttggcactgtgatgggcgctaccattggggcctggcatccccaggcctcattagccagcagtgaccacaggtgatgcacaggcgttctcatgtcctgctttggattccctccgttaaggaaaccgcagcacagcaccgctccacagtagctcatagccgggcagccagggagccgcagagtctggacttgacctctgcaaccccgtctcaaccctatgctgtcacaccagtgtctgagttaaatggcaatgcaaagctctgggtcccatcttctagcggggacctttgtggcttgcccacaggttggtggcacggatcgctgctctctgggacagcatgggaccctttctggagcgaagtccacttcagagaccctgggttgctgtctgacagagctgtgggcctgcctcatcctgcggccaaggtttgggtgagcgctggctgctcgtgggaaggttgggggctcaggcacctttgtgattgccttgtcttcagtctccacttctgtcagagcttacaaagagcagcacatggggtccagaggcttctggggagccacccgtgcccctgacccaaggatgcataggccagcccttgtaggaagcagcataagacttaattcctttttttttttttttttttttacatgaaaacaaacagaaatgggagttttatttgttccctgcagccccacgaacatcttttggagccatctggagagctgatcacttctttggcggggacaatcaaatattgaatgttgagggaaattagggcaaatggctccaggactgtccacttttgacagacctggtgagtgagtttaatcattaatcattaatccacgctttctaaatatatctgccccgaagaatctcccgggcggaggtgaaagtcctggttcccatgctcccttgacctgactgaagcacagctccggggcccgacagtggacaggcaccccatttcatccctgtctggggacacatttaagcagtgctgcctcggtttgttatttagtgacttattttcaaggaaaaagatccagaaatgattagataaatgcgaagtcctaaaaaagaaaacagcgcagtttctcttaaatgccggccagcattgtgaccctgatctgctgaggccttggaaggtagttgaggctgcaggaaatgtcacggggtgacctttagaattagagtgtcagcactcagctggctgcctgcatctgaaaaaggagccattgtagccagtgaaatggggaaaaaccagaaaaccagctgggccagggcgctg

SEQ ID NO: 99483 - DNA, 1101 bp, Homo sapiens
gggacccggctgagcagcagcagcaggaggaatgagcagtgctcttggagcccggaggagggggcagggcttgtccttctggacgggcagccccaggaaaagagaagcccagagctaagggcccttgccctagggaggggtcccacatggaccccgaagacgttcctctctgcagcccttcctggcactgcgtggacacgatgtacggaatgaggaaaacgagcttctttcccttctctttcacttctccctcccatcacgcagcgtgcaattatggaagaggataaagaaggaaagagcagtcggaaaaattctgtaagaaccggagaggggagttcgggtgtttttacagctcctggggttctccgggaaacaaaggtgtgctatttccacttctgtgtcttcattcctgttctgcagggaagctcagcctggcttcatccacatgggtggagcagagtcaagttcagttgggaattttttttttttcctgctcatttggaaaaagaggaaaagacactgggatacaaagagggctttataaagaagaggcctccttggtcctccactccaggactttctgcgatggcggaaatggtccatagcagcaatgcccatcggggcagccactggtcatgcctgactgttgagcttgtcagcagccacatcaacacatggatggtgtggccgaggaactggatttcaaattaaattaaattaaatttcaatttaagtaaccacatgtggccagtagctacctacagcgcactctcaggaaggctctagactgagagtttgaggatcatcctttatcagtgatttgaatggatgaggcttcatctgtttgaatttcccagttggggtaaaaagaggggatgcttgtactggaatgggagtaggttcacagcgcacagcctgggccagcatcagtgtgttgctgaatttatgctccttcccaaggttgttgaggagactggaagagaagttctgtgttagagagagggacgccctagaggagttcacttagtcacaaggagcagaaatgccctcagtggcatggattgaaaggcacttacggatggaattcgggagaaattcatg

SEQ ID NO: 99484 - DNA, 1051 bp, Homo sapiens
acaaagaaagaggcagaagccagggctgtctgtgcctgcagggcgctgttgggctcacagatgacccagactcccccgtaatggagccgcggacccacagcgagccacttgcaccaggcttagccaagctgacaggccagcggagtaaggaatgttccctaccattgtccagaaaatgtaacgagggtgaaggtgtgccaagcagactccccgtgtcagccctgaggcgactgccatcgctttcagaaacctgactaccaacctggatgaaaaccgactgcttggtcatggccatgcagttagaaaacacagcagcaatcctcagatgagtgtggccgtatttgtgttactcaagctgctttgtcatctgcatttgaagaaacgtggtgagcctcctgtgtgtgcccatgtggcagtgggcacctctgccccctgcaaaggctgtctaagaacacagagcctgcagtacaggccctgcctcctgacatgccccaggccggctggaagaaagcgcgggactgtcctattgacgtggggaggggacggctggactctgtgatgctaactgtgttctctgctgggccatgtggctccccacagagaccctgggtgcccagtcattcgcgttctcctatgtgtgtgtatatatattatatatacatgtatttactaactttagaaagcccccaagggggccttgtttctgcttggacagtcagcgtccatagcgtgtcattcctaagctccattaaggagattcagaagcaagcagttacccctggagtctgcacgctgggcacaagggtcacaccttcgttgagagctcctgaccccaggagccgagggcaggacacggtagtgtttacaggacctggcaaaggggcactgccttgtgtgtgaggttttttcaccagtcagtcccttttaaaaacagcatatcttttgaagaacaagaagtttacgcaggcataagcaactcactttgcacgtggagctttcaggacgtttcatgtctgttacgttatagcctctatcctcatgggggctctga

SEQ ID NO: 99485 - DNA, 1035 bp, Homo sapiens
ttggctggggtggggtcctgccttcgccccttagcattcaccccctaccccttttcaccatgtaaaaccctgtgggccctgggccctggatgctctgcgcccgaggacctgggttctgccatcacctgggcagtgtggggggcatatagggggaacatggggtgcctgatgtagtgcctgtgtttgaccttgtttaggtgaagagcaccctttccagcttatgttttgtatcatgaccgggaaaggtacgaaacaagtgtgtcggggcccagatgatttgatggctctacgggccgagtatgggacacaggatagcttggccctgggtcaggtattagtcagtccttgctggcacctgggcagggacacatccgtggatggggcctggccaggtggcctctgaggtcctcgtgtccactggaaggctgtgtcctctgttgtagtcactgacttgctggacctgggtgggagctcacccacctgtggatgggccagggagctcctggaatcactagaaagatgaactttttttgccttctaaatgtatgaaaagatgggaaatgataggaaaataagtggaagtcagatctattcaggaaaatgacttcccagggaagagctggggtgcctccaaacccagaatcctcggtttctagaagcaaggctgaccgaggtgggcagcattctttgggaccttgagtgatgaagtagttacttaagcagagtgtttctcatgtgaagccaggcagtctaggacactaggaatcatttcagcgtgggggagacgcagacactgtgcttgcccagggtgctgcattcatctgaaatgccggtggctaccagctctttgtcacggttcctccgtggtctccttgaatgctgtcagattcagggcccgtgtgggcagcggcagcctcgttcccagtcgtgtttagggaatggggtcagagaagtacttgctaaagcttcctgtgtgcacgtgtaattgtgtgtgcatgtgtgttaaataaatgtatttcaactcgaaatacacgt

SEQ ID NO: 99486 - DNA, 1037 bp, Homo sapiens
aggatacttgctggcggagctctgcctgcggtggaggccctatgacttgacctccatcttctccctgggcccctcgctggccctcactggcaggggctcctgcacgcctgcaaggccagagcctcccgccaggtgcaggagaagtaaatgcaggccagagataaatcgtatttccctctaactcggatgtggagtgagaggaaggaagcaggagtggagctgagtgttagtgagaggtggctgagaaggcggggtcccgcttcttgcttccttgggcatttgctgtaggtgctgggtttcagcctggaagggtgcagcctctgcactaagtctggtttggtgaacgttcatggcccccaatataaacagtgttctgggcgttctttgtgactctcgagccgaaacactgtggtgatctctcgtatcatctgcttgttatgtaatgtgacaacatggatatgaaatagaaaccagatgtcagggtggagcggctgaattcttccccagcgaggccgccgggagagcaggacttgggtttctcctgagttacggcgccgaacgccctgagaaaaacgcctttggagcagtttccgggattaagcgaaagtctgggctgaaggtaaagcaccaagtcagtacgattaactcttttttaagaaacttgtaagggattttctgtgctgttatgtaactgctcagtgtcttccagcgagccggcggcttgttatcaagaatccgtttagaatgtttgaactcagcctctgggggagctgggagcactgtggcacctccaggggcctgcagcgtgcttccgagggcttgggtgtagaggaaggggaacccgtctttcgcctgtgacagccttgcccttgggtctgggagcaatgaggactcggaacgtgagcctcctgctacaggtacaggccctgggggagtgagggcgctggcggacagcagtcttggcacttcacgttagcagattcggagtttctgcagcggctgaacccctgcactgggctggaagggggggacacccg

SEQ ID NO: 99487 - DNA, 1108 bp, Homo sapiens
tcccttgcaggcctgtcttctggcttcccctgccaagggaactacagcccctccccacgcacactcacagggacggtgcagtggtaagaggcagtgcaggtggctgccccaggacaggccctgggctccaggctggctttcatgttctatttgccctgccttgaattcctgtctttggagtatattcctcactcttcagccaactcagccctgagtataattagacgtctctaaaagtgcgtgtgccatattgccaggcgtgaaggcttttctgaatcttcctttctgtcaccagtgctgtacgttggctttcttttgaggcgcttattttcataagaaactttctctgtgtccttaacttccagcagagagtctgggagatcggggggtcaggaggtgctaagggcctgaccagctgtgtttgcgaagtgccatggaaaactgggatgattccggtcatcacctctcgtgaggttaggaagagtccagcctgcggtatcagtgctcggtgggatggccagcccccaattggaggagcgggctcctgggcagcctggggatacttggttctaatccagatcctcacactctttggggaggaggccgtttccagcaagtgagtgtcccttgggtttctcctcaaagccccttctaaaattagtccctggctgctgcagggacatttacatcagcgcattttgttaagtacttttgttgctttccattaagagcatatttaaaaatatgaaatgaattcaggcagaagccaggctctgccgctgagaacatctgtgtgctggtgagagggagagactgggcggtggataacgggctgcagcttcctcctccgccacctcggaacgcccccggggaggcacgggacagagcccaagcctgagtgaagctccctggctgggggaacaccctgccccaggctggccaccttgactccttgctctgcaggctgcccccggcacctcgtctgcctcccgtcggcagccagtgagaggagcgtggggcctgagagcattgcctgcctgctggccggccgcccccacagtgcagagctggagcggtcttcagaggctcccggtctccctctgcagat

SEQ ID NO: 99488 - DNA, 1568 bp, Homo sapiens
cccattggtatactgtacagggtagtggtagaatcacagctcactacagcctccacctcgtgggctcaagcagttctcctgcctcagcctcccaagtagctgggactacaggcccgtgctaccatgcctaggtaatttttttatctttaatttttttgtagagatggggtcttgctgtgttgctcaggctggtctcaaactcctgggctcaagtgatcttcccaccttggccccccagagtgctgggatttacaggtgagagtcaccgggcctgccatctgagttttatcttcagagttggtttatggagtgatttctatcaaaagataagtagattatatcattttattagatttttctcaagatttcctataggaaacttatatcagtttgcatttccgccagtagtgtctgagcgagcctattcccacggggctttggagtggagtgtattacttacttgctgatttggtagatgaaggatatttcagtttgtaagggccgtttttctgtctttgcttttggcttttctgttaggcttttggtctctgttcacacagtttgtaagagttctactgatggaagagattttggcctttgtctttcatgtgtattgcaagtaactgctcacagtttgtccactgtattttgacattctttctcatgctgctttcaccctgtaaaaggtttttcctccatgtatcaaacttactgttttttttaaattgcatctggattttcagtcctggttagaaagccttccttgacttccagaagatgttttctttgagtgcttgtacggtttcgttttttacatttgcatccccaattcgtttggagtttacccttgtgtatggtgttaggtttggatttaatgttatcttttcccagacagcaacccaattgtctccagtactgtttattaaaacatccctgtttgtcccagtggttgagatgggcacctttatcctgccctggagttccgtctgtacttctgtttctggactttctcactgtcacctggtctgccgggttgatggtgtctgtcgtgctctctgaagcgtaggggctttgaggcgtgttttagcatgtggttgggcatgctgggtttcattttgaatgtttctctagcgctcgtgcatcggcattgcccgttgctctcccatcatctctcttctttctttctgggattctgattacaggtgtgtaaaccaaaagtatctgagacaggtctcactcaatttaaaaagtttgtttagccaagcttaaggacgtgcctgtgacacagcctcaagaggtgctgacaacatgtgcccaaggtggtcggggaacagcttggtttcatacatttttagggagacatgaggcgtctgtcagtatgtggaagatgaacattggtccagtccagaaacgcgggacaactcgaagtgtgaggctttcagattataggtagattttaaaatgttctgattggcagttggttgaaagagttattatcaacacaaaggaatgtctggattatgataagggtttgtggagaccaaggatttaccatgccgacgaagcct

SEQ ID NO: 99489 - DNA, 1050 bp, Homo sapiens
ctactccccgagcactgacccacaagtctcagcatcattgatggttctttgtcggagtctgttgttgtcgtggtggtggctactggtcatctagtgtcaccgttcttgctacattcaggacgggaagccctcattaacctcaggaggttcttggaaactgacttttaagtgaaatggtcatctagtgtcaccgttcttgctacattcaggacgggaagccctcattaacctcaggaggttcttggaaactgacttttaagtgaaataatacagaataaaaccaaggttatttttctcaccagtgcaccagtgttatagtcaaacgactggcattgcttgaggaccctctgtcgttggcttaaagttgcggtttccaagaacctgtggacaacgtgaaatgtggactcctgtagttaactttctcctgtaaagagctttcctttcctccttatttatgtgtttccttattgtttacttatattagtttgaactcatagattcctaatttattaactgggttataaccttttattatcaatatctattctgctgcccaaattgttccagtttggccaatgagagccccttcatgctggcgtttctggcaggtccctcccgttttgggacccttctttactctcttggatacacaaaatgtcctaatctcgcctgtacttaccctgtcctggcctggaatcagctttttctcaaggcggcctggttcctttctcggggaatgctatttagaaaccagctctcggccgccagagctgtgaatagatgtgtgtagatcggcccctgcacccacacacgccggccccacccacacacatggcagttcacttccagcccagcctcacaaaggccaccggctggccttctcctttcacatttgttactccctctgctgacaaggagacgtggagctctcagaatccatcatgtacttacttatttgttcagtctcaatcccagaatactcagagattattaacctatgcctctgtgaaaaagaaacccccaactagagtccagcagtcgctgaaggcg

SEQ ID NO: 99490 - DNA, 1792 bp, Homo sapiens
ctgggattacaggtgatttatcactttctcagcccgcttagtcattctgtttttatcccctccacacgcatttattttaaattttaattataaatctctaattaaagaattaaacaattcatagacattatctgcatcatttaaagcaatacaatagcagtgaccgtgtgctctgtgagacagagaccactacaaggacatttacatgtttgcttttcattctgctgtttccaaaaaaaagttttatcatacatgcacatgttcctaaacaatatgattttagttttatgtttttgaacttcatgtaaatagaattatactatacgttttctatttcgtgggttctttttcaggcaggactgtttttgagaaccaggtttctgcctgtagctgtcggtgactggtgttcattagtgtcttgcattcaattttgtgaattttcacaactttgattcatgttcagatgtggctgctctcaaacatgatgttgtggacattcttttgtgtgttttctgacacacgcaaacttgggtctttgccaggttcctgcctgggaatgggagtgccgggtcacgggtaagctacttttaactctgcgtgacctccagcacggccacaccgtcttagacctagtgccagtgtcttcaggctgaccagggcgccttgctcggtcccgggaggtggccctcgcctggcctgtgcctgaccgccagcctgctgtggctgtcagtgtcttctgacatgggtcacccatttttatgtttgttgttggtttcgttttcttaatcatttgcagaattgaaatatctgggtgtgtgtggcttccttccagcagctaacgggaggctgcggccgtgtgctgccttcattgtcacagcttcctatggccactgctccttaaagtttcctatatgtggatattacttgcttgctgtttcttgttgaatatcagatattctggttttttgctcttacttttcttctggaagtaatatcctttggaagtaatatcctttagaaattcctgcagaagttccgttttttgttcgtctgagagttgcctccttttccttcattgttgaatgatccctcacagaagacagtgctggggaggcagctgctcttccccagggctctgaggatgtgattggttcactcagttccactggggctgttccgttccttggcaggaatccgttgtgtctctctaggtgttttgtagtcttagtgttctacatttttgtaagcgttttcacttacccctgttgatatttttttggacttcctgaatctgaagattagtgtcttccaataataatggggaattttattccttaacttttttctttttaacttttaattttgctgtaatttcaaacttacagaaaatcagcaaaaaatagtccaaagaattactgtttattgatatgcatcctttttttttttttcagaatcgtttgaaagttagtgttagatgtgatgccttcccccaactaataatccaggccatgttgcctcagataagcgtggtcactcttcaactacggtcagtgagtagagttggaaaataacagcgagcaggcattgttctctcatctgtaggccttgtttatgtttcgctgatagtctagtgatgtctcgttatcaacagcagatgacaggccctgcagggccttcaattctcacgtcctccccagtcccctttgctccgggacagtctcctcgtcatttttatgtttcgtgacattcacattttggaagcgtaggggcagctattttgtaaaatgttttt

SEQ ID NO: 99491 - DNA, 1012 bp, Homo sapiens
ccacacaccccgcagcagcgctgggtttgtctcagtcactgcagttctttctgggcttcccgagaaggaagggccacaagagtctgtccaggtgctggggcagacattggtgacgtcgcttatcgaagccaggagtggggccccgggtgtggggccgagtgacagacccaggctacccacacccgggcaggatgaagagtctcaagagtgctttccttaggctggttcccgtccacacaccagcactcagccagtcaagacacctcttgtgagcatctgctacatgccaggctgctgtaagcactggggtctactggtgaaccacacaggaaaagcccccacccattgccacacccagtgccagtgggaaagtcaaacagtagatgggtaaataaacaactacataatggtaaatatggctggcagtgatggagtctgccctgcacaggcactttgctaagtgttttctacatatttacagctgtgatccccacaacagcctacggatgggtcctactaaccttacatcatctgtattttacagatgagaaaacagaggcattgagaaaggaagtcactggcccaaggggctgtgccaagcaactgactcttaaccagtgagcttgcgctctgaagtgtaaggctttactcccctaaacttgtcattgcaaggcagtagaataggatctggagacagggggccttcacttcagcatccgattggttgcaggctgagctttcacttcagcccctgattggttgcaggccaagtcttcattcgcatagggtgtaacttcactttggcctctgattggtcatgagccaagtcttcatttacatagggtgtaaccagtaggaaacctctaaagggtacttaacccccagaagattttgcaagtgggagtcttgagcagcttgctctggagcttgctcctgctctgtggagtgtacttccgcttaaacaaatctgtgctttcgttgcttcattctttcattgctttgtttgtgtgtt

SEQ ID NO: 99492 - DNA, 4520 bp, Homo sapiens
gaagaaatggcagccaccccaggcccctggatggtgtgtatgcggggagagcatgggaaggaagactgtccagagactgtccaggggcctctgctggatgttagcttgcagggagcagtgtgggccaggaaccaggcagggcttggccatgcccatgaatttggccagggtgtctctaggcttgctctgggtttccgagggcctgcagggcacaggcacgctttggggaggctgtcaggccctggttctgagtcccatcctgtgagccaggcagtctctctgggaaagccctgtaggcagaagggcagtcccgggccaagtctgggctggctggctgggggctagcgtctgatttcaagattgcagtttcgacttgttttctgcctatgcacataaactgtggtatgaaccaaatttaagggagtttcatgaatgaaaaaaagtccaggctgtctacgataattaactttgtgtgtaaaattgagaaaagacttccgtattgtagctgaggggcagaacagctgagtttcactcgctggacacctgggctctgcagagcaggttctgagggcaggggacctgggccccagtttctgagctgcatgggggtgcctcccaacccctggggaaggggaggaacgttcatcgggccccggcttgccttattcatgccattggctcagccgagccctgggccaccccgtgggaaaggcacaccctccctcccaggtgggtacggctaggctcccagggcaaagccaggtgccccaggaaacccagctgccagcagagccaggcgaggctgccgccttctgaccccaggctcttgtggcttccttggggctctgcttctcagattctgaaacatttgttcagcgaaggcagttggtgaatcatcctagtcagggtttttttccagaaacaggtgcaccgccagtgagtgatgtggtctcgttcagactgtgcctctcatgcctgcactcatggcctgggaaggtcgtacccctgggcctgttgtgcacttctctttagcagtatgacaggggtgacctctgtgtgcttgggggtggcatgtgaactgccccacaggctcccatcagcattcagagaggcctcaggtgcggtggatgtgggggtctcggaccagagaagcagccagctgctggctcgctgggatgcccatggccccagaagtatctagcaaatcatagagagtttaaaacatactgccatctgttgttttcttccaactccttgctttgccatttattctgtcttgaagattatttcatatcagttaataaagcaatccctgattcttttaataaataacatatttctttttaattcttgaaataacacttgggtgttgtttctgtctaccaacatgtatattaatttctttgttcatcatgcttttttattgtggtaaaatatacataacataaatttataattctaagcattttgaagcgcacagttcagtggcagtaaatattttcccattgttgggcaaccatcaccaccatccattcccagaacgttttcatcttcccgaacagaaactccatacctagtaaacaatcctgtttccctccctctggctgcggcacccaccattcaccattctgctttctcagcgaatctgactcctctagggcccttctgtgaatggacttgtatttgtccttttgtgcgtggcttctttcacttggcataatgtgtcagggttcactcgtattgtggcatggtcagaatttggttcctaaaacttttaaggatgagcagtccattgtgtgcatacatcacatcttatttattccatctcttggtggacctttgggccgtcttaactttttggccattgtgactaatgctgctgtgaacatatgtgtacacacgtctctgagtccctgctttcacatcttttgggtatataccttggagcagaattgttgaatcctatgataattttgtgcttaatttattattatttttttttcatcccactctgttgcccagcctggagtacagtggtacaatctcggcttcctgcagcctctgtcccccggggttcaagtgactctcgtgcttcagcctcccgagtagctgggactacagacacccgccaccacgcccggttaatttttgtatttttagtagagatggggttttgccatgttgaccaggctggtctcgaactcctgaccacaggtgatccacccgtctcggcctcccaaagtgctgggattacaggcgtgagccaccacgcccagccctgtgtttaagtttttagaaaccaccaaagtgttttccacaacactgcaccattttatgttcctgcccaccacgtatgagggttccaatttcttcacatccgcaccaatattttttattttccaattttgaaataatagtcatcctagtgagtgtgaatggtatcttattgtggttgtgatttgtatttgcctaataattagtgatgttgaacatcttttcatgtacctattggccgttggcatattttctttggataaatgtctcttcacgtcttttgcccatatttgaattgggttgtttgtttttttgttgttgtgttgtaggggtacttcatatgttatagatatataatctgcaaatatctccttctattctgtaggttgtcatttcactctctggatggtgtcctgtggtgcacagaagtttttcattttgatgaagtgcagttaatctgttttttgttgcttggcctttgatgtcatatctaagaagccactgccaaatccaaggtcatgaagactaaccccctgtgttttcttctatgagttttatggttttagttcttatatttagatcattggtgtattctgccttaagttttgcatatggtatgaggtaggggttcaacttcattcctttgcctgtggcaatttgatggtccagcaccatttgttgaagaggatgttgcttgcctttagctgctgtaagagagcatgtgtcttagaggaaagatcttgctcatttctgaagttgtgctttggaagtgtctgagctgcagttgttcttccttcccaggtcggtgtagactctgctcttcctaagccagggcgctgcagccatattcagtctcttgttctttggctcccgtccctgtcgctgcgtccctacagcagcacctcgcccacgcccccttctgttatggcctctccaagggatggcgagtttaacaacaactgaccagggtttccacaggagacagagaacaggctttctgcagcgtgggttcccagttgtgctgtgagctgtggtgcctcgtgagtggggctcttccgaccatcctgtcaccacttgcgtcagagtcctgcgtgctatctgcctgggggtcctgagtgtgctggctgctgcactgaagcgggtgggctgctgagcaggaagccacagcatgccacgcaggcactttggctttgcttggcccctggagagcaaacacataatggcaataggctttacagggagtaggatttatttactttatctgaaggagtttaaaaattgctattgttctcttggcttttaattttcactctcaccagcctttctgttcaggatactgtgcggtgaggacctctttctccatgttaagttcgcactggtgagttgtggcaggattggttttcttgtaggatggctcagggctgtgtttctttcagctaattgtggctacatttttgcctttgcgtgtccaatttgggtttcaaattcaggattgtccaagtactctatgtttgaaaatattttccagagaccccagatttcttatttatgtgcgttagttactttttaattttttcagctgccttctagtttcacaccttcaattgtgctaatccttcgcattttaaaagttacaccagcctttgtcagtgtttcatcagtgcataccgtagcgcatgtggtcccgttcagatgcactttctgtggcctggattctaggggaagcaatagaggatatatttcattctgaaatttgcactgtttcttttttaagttaaatatttcaacagcaatggatgttcttgtctttttttagaaaaaataaaaatgaatgtttttgtggcgcttctgcctgcttgagtggcagcgttttttccctgtgcaggcccccaggtgtgtgtgattggctgccccggggccccgtgacaggggatgctttttgagctctcaccggcatcttcctccttaaatccagattgggcggagacatgaattcagcattacctctcccatgtccacacgtgaagaagcactttccaggcgcacacacctaagtcgttggccgcgggttcttggagggcgtggcctgagctcccagacgcctcctctctcacctagcactgcacagtgccttccacacacaggctctccgaggatctgccccatttattgctttgattttgttggatgaaagcagtttattaaataaatgggaaaatactccccttccccagtttcaaaagtta

SEQ ID NO: 99493 - DNA, 1054 bp, Homo sapiens
gggctagcccaggatcggctggtggggaggtagctgcactgggggggatgtggggggttggcattgcaggaccttccatgccgcctgcctccatctggggccaggagttggccctgggctctgcctgtgggtcctgggtgtgctgctgctgcctggtggcctgggcctggaggaaggagctcagcttacactcccagcctttcaggcaggttcgcagcagccaagtggtttcttaaaaagaattcctcctcccttgattaatttctggcatgctgcttcggggagctcttgcgtcagtaaatcgtcataaacccccagttgtctggatcagacataaacaccaagcccagctccaccgctcctgactcttggccagggctggcctgccctctgagctccgggctgggctgctggagataaagagggccagcgggcgcccgagaggtcaggcgtatggctgcacccgacaaagtccttttctcagaggtgccgagcctggcagttcggatgtgtgctgtgctcgctgggggaggatgccgggcacagatgtgatttatttcctgaaatgtttggtgtttctttttcctcccccaccagctccccactctcatggataggatgttttcctcgttgggagtatttgcctccttccagtgggcattctgtaggggttaagaaagatccctgtgtgtgaggcttgcacagtgttacattcaggtctgggaaactcaggggctggacagcaagtacctcactgtccagatctcaaggacagaatgccttacagaatgcttcctgttgctcacagcaaacctcatcttaaggccttttcagcagcgtttgagatcgtcaggaggtcccggactacattcatcctgcccttgtttttgtagaacatttttcatctggggtacccgtgaagaggccagaagcctgggagctgggttccccacagtcctgggttaccggggagcacacttgggccagcgccagggctcctccagggtggctagaagaaagaacttgggcctccagtcatttcagggctgattca

SEQ ID NO: 99494 - DNA, 2135 bp, Homo sapiens
catcattatagataaaatttgctataagttctgtgtagtccatgagatgaatgcagtttacttttgttcttagtttgctgagtttttctgataagcagctgttaaaatattagatggagtcatgtgaaattgcagatatttgatctttttccatctacaaaaaatggtattttcatttggttcaacttaatgtattagactttttctgcatctgttaatagtcttatgctttttttctttattttattgtgttgaattttctgattgacttgaatgttaagtcaaccttacacttctgtaataattattataatgtgttattctttttatatactgttgaatttacattgcttatagtcagtttaatttttatcatctaaagatatgagattgacgtgttattttttcttgaaatgctttgtcacattttaatattaaagttatactaatctcttaaaatatgaagttgctttcttcttctattcctaggattgccaaaatttttctgtagagagtcagtaaagacttcatgctttgtggaccacatatggtctctattgcacgtttttttcccttttttcttttctttcttcttttttttaccaaccacttaatgtaaaatcccatcttatttttcaggttatataaaatcaagccacagattgtacttggcccatgggccatagtttgctgacacctgtttgattttcttgaagagtttatgtaggaaagatgctatttctttcttaagttgggatggatttgcttatgaacttatcttggagttttctttgtgggaagatttgtaaattacaccctcaactgatataggactgtttagatttttaagattttcttgtgtcagtttttgtgtgtttagtttttcttggaattttttacattccatctgcatcttcaaatgtattgaaataaagttgtttaaataccttctcattatctttgtaatgactgtaggatttgtagtgtcatccccttttaaattcctgatattgtttgttctctcatttttccttcattggactttgctaggagcttatttattatattaatattttttaagaactgtgtttggttttcttgattttttaaaattgaatttaaaaaaataaatttctgttcttattgctattatttttgtttttgggatttaatttgctggggttgttgtttttactgattaaggtaaatatttagatcactgatttttttttttcagactttcttctgtaatccacgtgcttaaaactataaatttccacctatgtatggctttcgctagattatgtgagctttttaatgtcattttaattataatttggtttagaatattatctagtttctttttttgacttgtgttaattagaaatatatttctaaatttcagtgctttatgaatttgctagtattttgctttcattttgttattgatttctagtttaatttcactgtggtcactcattttatgtaatttcagtttttagaaattctttgaattttgctttattgattatatggtcagttttgtcaacattttatgtatacttgaagagaagaagtcagccgtggagatttgccagttctacatgtccatttaatcaaattaatcattgtgctcagatctcctgttatctttactattttattgtctgcttttctgtcagatagtgggaatggaatattaaaatccccctgatgtaactgtggattggcattgtttctctttttagctctgtcaggtttagcctttgtttattttgaagctattttaagcctaggcagatttagaattttatgcataaaattattccataaaattggaataactgcctttttgttactgtgaaatgtccacctttccctcttgtatcccttcttacgctcaagctgcggattctgtgaggactggtcaggtccgtgttgccctcactcctggcacggggctctcctcacccccacgctcagtctggcgttcgtttcccagggtccgagccgtccggtgctgctccgctcctcagcctctggaggacacgcgggccgagtgtgccctctttccacctcccttctctcccaggcctgggctcctcgtgcatcgccgtgttttagattgcatcctg

SEQ ID NO: 99495 - DNA, 1083 bp, Homo sapiens
tgtgtgccaaacagttcttcaaattgattgtaccaatttacactctgacctatagaatgttgctctgtccttgccaatacatggtactgtaattctttttcattttaactattgtagtttcatttgtatttcccagattactaaaaatgttgaataccttttcatacgtttattgaccaactagatgtcatctttggtggagaagtttctattcatttaagaaattggtttgtctttatttttcttactgagttgtaggagctatttctgtacactggctatgaatgagctttttgttgtttgttgctattttctatgtgtgtgctgcgttttccctttcttaatggtgttttttttttttttttttttttgctgaacagatgctcttaattttaatagtccaatttaatagttttatctatgcctatttgaagatattctatattatttttgataaacttcattgttctatcactcatttagatctgtgatccactgggaatttttttttttttatgtgtgaggtagggattgagagttacttttccgtttggaaattcagttggcctaacagtatttatttaaaagagtcatcctttcttctctgctatccaatgcaactttgtcataagtgaaataaattatataaatggatctgtttttgcactttattctagttcattggtctgtttgcatatctgtgtaccagtgcaacactgtcttaactaatagatttgcagttaaccatagtatctaataatgtaggtcttccaactttttaaaacttttcaaagcttgttttggttctttttagccctttgcatttccatatggattttttttttttttttttttgagatggagtcttgctctgtcttccaggctggagtgcagtggcacgatcttggctcactgcaagctccgcctcccaggttcacgccattctcctgccttagcctccccagcagctgggactacaggtgcacgccaccatgcccagctaatttttttgtattttttagtagaggggggtgtttcaccgtgttagccaggatggtcttgatctcctgaccttgtgatcca

SEQ ID NO: 99496 - DNA, 1620 bp, Homo sapiens
agtgtacaaaaacaagccagcatttcttgttctcttgctatttgtaattgtcccgagcctggactgggtccagtccgctcatttattctgccagggcccagtctgcagatctcagccgaagccggttgtcctgcctggctcgctctgttcctggaaagctttgtcacgcacagccaggggccactttgggtgcatcctgtctcccccgtcgccgtatgtttgggagcagaagttggctctggtcagatatgtggatgttaatttatcctcattcttggaagcaagttgggagctcagaggaaaggaagagccacaaaatgtcaaacccagcagcggccatctgactcggttgctcatcgctataatatgtgattaagatggaagtgtttgatttcctcgcttgccggatttaggcctcattttgcttactcccgtgagtcctgatttcttcctgttagagagaggaagtttgcagcgataaccgacttgcagtggggttttctgtgaatggagcttgtattggtgcgatgtgtggcgtgggagtccccaccggttagtggcttatgcagggtgtgagtttctctcaaagtggacgttttctgccttcccggagccaaaacgtttatttcgccggtgagtacagctgagtctcacgtgcatctgacagcagtgtctccgagccttgccatttcctccactccctcccttggagccgtttgtgtgacaacctgctgttcagtaaaaccagtttagtggagtgggtgtgtgttaattctagtccatgtgtttaaaaatcaattcatatgatgagaatggcactttcccccgtggtcttcctctcagtaacccatagccccagtccaaccatgggaaaaacatcagacaaattccagtagacacccttcctacagtctactcttgccaggcccactcgatatgccaaggtcatcagaaacaagcatcctttgagaaactgtcaccaccaggagggatctcaggacatgcgacacctaagtgtgatgtggaattcctggatgggatcctggatggatcttggaatacagtaaaagacattagtgggaaacttcaggaaatcctaaactctagaattttagttaatgacagtaatgtcagtattggttcccaattgtgactaacataccgtagtaaggtaggatgctaataatcgcggggaatgtgcaggtggtattggtagggtatatggcagctctctctactgtctactcaagttttaataaaatatgtcaagaattttgagttcacaaaatgaagtacatttatagatactctcttttgcttaatgtttgttcatgaatggctgtatactgtagttactttagcacctagcttttacagtttttcctttggggactcttttttttatggttgtgcatggatgtggtagagtaacttaacaagtcattgttggtggacagggagtttgttttcagcctttccattgttgttattataaacatgtagccttgaagaccgccaatgtctaagtgaactttttaactgaagtatcacaggcatccaggaaagtgcaagaatcatgactgcttagcttgatgaactctcccaaaaggaagatgcctg

SEQ ID NO: 99497 - DNA, 1460 bp, Homo sapiens
cagatcagagcatttaggcttcacctggggaatggacaggggcaggagctgggagatcactgcccaggggtggctctgtgtccggggtgacctggactgggcccattgcctcctggggctgaggttgcttcctttcatcgggccctgtttctttagaaagatactgggctttgacttttgccttctgtcggcacctggccctgcagctgatggaaactggcagagcaaaggacttcactgggacagtgagcagtggggcagccctgtgtttacaggcaaccccagaccctcttatgacagaaggggagggcagggcagccggccttcacctggataggaacagcaggtggctgatgtatctgagttggtatattcattcagagacattggttaaaattacttgtcaatataacatctttaccattgttttcttcaaagccagattctgtattttctgattttatgtaaactaaatacatagttttcttaaatacagatgacctctgccttcacagtttctttggatacctttcaagtcagtttaacacacatgctctccggaaacaaaactcagccactggggaaccgaacctacgcttttggtagaatctcagccttggggggagcctggaggccctgagccctggatgacacctgctctggaatcctccaccagtggcttttgaaatgtggttggtggctgaatctcacttctgccttggatgcttatggaatcttctggatggactgagctcagaatctcattgaatactgtggtcctctcagtctgaactttgtacctaaaaatccacgggaatctcatagcagctgctgaggatttggagaactcccttagaaaaataaaaggaatttattttttcctattttatgtagtggctatttaaattttgaacatcaaatggtagttttggattttaaaagctcagtgtgaataaactttgagctcagatgcagccgttcttttagtgtgtcaattttaataggtgtcatttgatgtttgcactagggggttggacgaaggtcggtgtgagaatctcagggataactgggctgctgcaggggtcagacaaggcctcctgtaatagggattttggggcactgatggaatgaagggaagcgggaggagagggtaacgagtagaggctgccgctgccccagttgtattagagggtggtgagggacgtggtggataggaagctgcatgggcctccaggaactcactgcactggctttgagtcgcgagagaggtgccacgggaggtctagaaaccgtgcattttgggactgagataaaacacgtccagctggtggcacagaccaagccagctgggagcggagttgtctctctgtgcttgtctggagtacctgcctgtgctctctgagcagcctctgcacctggctggtgggcggggctgagcctcaccttcaaggctgcagatt

SEQ ID NO: 99498 - DNA, 1055 bp, Homo sapiens
gcacggggagccctgtggctttgaagcagatgcttcattcaaggcaggtggttcttttctgaacacaaacatacacgtgagcatccccaaaggctgtttttgagagatggtgtgtgtctccatgtccaggctgttgtaacagaatgataaggtgcagaggccatctgacagctggaagggtacagaggcatctctaagcagcagcaccgatggagtacccagcctggaagtgctgacaccccaccatggtcctcctctgtcccatgcagcccagcctttaggagatgcaccaacaggcatttgggtggcagactggagctcagtggggctgcccccactggggcccctctgtagcttctgagaacagttgaattgtctatctgccttcacatctatctgtgatttggttcccttttgttcttcgccagtcctcagtaggatttggtaagacgtaatttctcgatggttcaggaagacgggtggggctgtgtccatgcttgcacagcctactgtgaacagctgagctcactgccctgtgactggcttggtgtagctgaggctcagggaagagctggggtgtcctggggtgagggagcagcagcaccagcaggaccccatgccccaactgctgcagggaccatcctggcctgaatgtgttagaaactaggagggtatctggggtggggacacatcccactcttcttgctttgtgttcaggcccccagcctctttctgtcatgatgtcttgatgtctccctactcagctgctagcacttctgctgagggaagcagtcacaaaggccggtggccctggcctgagcatggatgtggctttcttggttcttggctgcggtttccttgaactctctgtggtctgcaggacctgatgcatgagaatcacatgtggggagggtgtttcttgtgtttatcagtgtttccatttctttggaagttacctggatgctgttatgagtggatttggtggactgatttgcatgggtgtggcctcaaggactgcattttctaaggagatggtgtttttaatgccttagcca

SEQ ID NO: 99499 - DNA, 1102 bp, Homo sapiens
tacattctcaaaggttcaaattagctctttgagtttgtattcacttgagatgtcagaatttgttattatgaagccactgtcttcagagcctttccctaaaagaagttttgtgattggagccagttttttttttttaattttaaattttaaaatgcttagaccattttcttagaagattgcttccataatgtggttgtttaggtgatgcctttgttcgttcagcctgctatcataaaataccttagggtggatgatatgtaaataatagaaatttcttgctcacagttctgggggctgggaagtccaagatcaaggtgccagcggacttggtgtctggtgagggctgctctctgcttcacagatggtgccttcttgctgtgtcctcacctgttggaaggggtgaggggtctcacttgaacctctataataagggcactaatcctgttcctgagagtccataacttaatcactctccagaggccccacttcttaatactgtcacattgggtattagattttaacacgtgaattttgggggggacgccaacattcagaccacagcagctgctaaagccaagagaatacctttcattataagagctaatggttttctttcaattagtttgcattcatagccaaaggtattcctttttaaatacctatgagttttcctaggaaatatgtagaaattggatgcttattaacactgtgtttctcagtgacttgttgattcagtagggtttgtgaaatgctgttggagtttcaggcaaggatgtggagtctgttctgagcacactcagggtttccatgtgttgtcctgaaagcctttctcacctcttcacatctagggtaaggccgtattgaggggaagttcctccctccctgttaggtagtgtgatgcagaattcttgacactctttgttttcacatggactgaatccaaatcaggtggggctgattcttccagccctgtctcctcatcccggtctgacactgcacaacacaaaccttcctgctgcaggctcaccgaggtgctgcctggccctgtctttgcctgaacacctgcagtctcaatgtggctgtgcgggagcaaaggcggcct

SEQ ID NO: 99500 - DNA, 1002 bp, Homo sapiens
agattgaaccccgagaacgtgggagagtagaccagccctacatcaactggaggttttagagaaggacaacagaaatgcctggatagttccggctgatgttggggtgggagatgcttttgatccccatgtactgcttgcttccgctttctaaaggcaaggtttcaaaaatacttgtgtacgttttctgacgcacagcaccgcctgtctgaatgtgcatcctcccagccacccggcacggggcgtctgcagctctcagattgtcactagcctggattctccatgccatcattatctgggatcttaatcagtcaaggtttgttctggaaatcatgtagacataaggacttatttttcaacctacttttttttttgatcctcaaattgtgttttgtcttttaaaaatcacgagtactcagtcattatgaagagctcagaaaattcgctgtcaatggagcattgatggtttgttttggcaattctctgaaaattcttacacagtttgtggaacatttgcatttgtgtccctttttcaaagccactattgtagaaatgcaaatttctgagttctgagatgctgaatgttggatgattaatgatattgaaatttaagaatgaactcccggtatgtatttgacatagaaaacgcggtgtgagaatcattagaaaccattgagcacagcttggcggggaacagaaaggctgtgattgaggcacccggcagtgggggcaggtcgcacgtggacaggtgtgcaggtgcgtggctgcctccgggtgccaggctgtgtgaggcgggagctactgccatcaaaggtctggctctacttgaccataggtgttcaaaactcatcataataatacatcagccttgatgacttgcttgctcagtcaaccccactgcgcgtttaagagaacgaaatgaacagcaggtttgttctgagttttgcttgctgctactccatttgtgcttgcatatagcctgtgacgtgagctggacacgttatt

SEQ ID NO: 99501 - DNA, 1665 bp, Homo sapiens
ccttccgcccggaggtcccttgggaggcaggaccccttgtgcccaacacgtgcataccaccacctgcacacactggctggtggcccagcggcctctgcccacgtctcaggcgggggatggggcttgcccagaaccgtgccctccctcctgggcgaggcccactcgcttgtgtgccttcccaagcagctccatccccagagatctctagtttcgggaagttcctctgtgtttcttgtcagctgatgcacctgtccgtccgctcccaggcattgctggaagtgctttccaatcctgcttttcatcattttagtgggttttgggaggaagagaaatcattaatactaaaggattcagtttgctctcttgagcgggaaatttctaggtgtgtcagagcacagccacggaaccgctgtcccttttccttgagccgaggagccgagtcctggcaacgtggtgttcggggcctacctggctgcacctcccctccctccgtgtgtctctcgtgccgtcctctgctagctggccctgtccttcgccctgcccacccggctcactcttgcctgcctggctcacccttgcctgcccatctggcatgggggccctgctcctgtgtggcctggtgtgggtgcccgtgccgccctcactccctgggcaggccgggctgggggagtccagccgcccatgggccccctctcacatttgtcatgtgacttggctttgccctgctgatgaagtgcccttctagtgcagtgtgtgtggctttcctctcctgtgttctgtgaaagtcctctgctgctgggtgagttttgtgttacggttttattgctgttcccgctgaactttgccagagccaggccctggttctctgacgtcaaagctgcttaactgttgggattttattgctctaaagaacgatttctaatgatgtgagcggcctgagggaagaacctggattgacttagcctggaagggctctcctttgaaaggaggccctggagccttacgccccttgcccggccagccctccacaccctccctgaggggatgcgctgtggcagggcaggatgcgtttgtcaggacacagagcctctgccttgaagccagagtccctggcatgaaaccgggagtgtggacggaaagcccacgggggcctgctggcaggacaagctacgcctccttttttttctcccattcccttgttttcctccaaggacagttctccaagtaactgtccttgtctttccttgtggttaagggcttaggatactggtgacttgactggccagcaggaaaggcagacgttgttacttggccacccacttaacactaccccgtccctccagtgtcatttactttcccttccggaatgttcgtgcctagagaaagtcttgcccagaaaagttctcagtgtcaaggagccccgcagtggatttgctgggacgtggatttgctgggacgtgtctgtggtcagcgggatggtgctctcgataggaagcagtgcatttgctgggacgtggatttgctgggacgtgtctgtggtcagcgggatggtgctctcgataggaagcagtgcatttgctgggacgtggatttgctgggacgtgtctgtggtcaccgggatgatgctctcgataggaagcagtggatttgctgggacgtgtctgt

SEQ ID NO: 99502 - DNA, 1366 bp, Homo sapiens
tcccagcactttgggaggctgaggtgggtggatcacttgaggtcaggagtttgagaccagcctgggccaacatggcaaaaccccgtttctactaaaaatacaaaaattagctgtgcctggtggcatgcacctgtgttcccagctactcgggaggctgaggcaggagaattgctcgaacccagggttgcaggggtggtggaggttgcagtgagcccagatcgtgccaccacactccagcctgggcgatagagcaagattctgtctccaaaaaaaaagaggaagtcatcatttccctagttggatgttgttttccagatcggaacttccatgttgtaactccagtctcttttctccttctgaccttgcaggttcatctgcagaagccagcggacgcctctgttcaacttgtgggttacctggctcatgagaccttgccggcgaggctcggcgcttgaacgtctgtgacccagccctcaccgtcccggtacttgtatgtgttggtgggagtttggagctcgttggagctatcgtttccgtggaaattttgagccatttcgaatcacttaaaggagtggacattgctagcaatgagctcccaaagccatccaggtaaggccgggtcatttcttctctgggcacacagcggggctttctttgcccaaagtagaagttcttgtgactgcagcttgctttctggatttgagacttttgtttttcttgatagtggtcactgttggtttttgacagcacaaagtgcaaaatggatggtttattcttcctcttggtgaaagaagaatgataaaacctgggaggatgtggagtcaagtctgcgaccccggtttgcaggctgacttgagaggcacacaggtttcctcgatgctttttgacaagggtgatgttgaaaggtcaggttgtgatgtggagagctggtttcttgcccagtgtctttgttgtttcatgaggggttgtgtgaggggtgggagtgctcctccaactgggcgtctgggctgtctgggaagaagctcatgttcccactgaggtcgtggccacagttgctcctggtgtttgagggcctctgtgaggggctgcactaagcattttacaagcatttagtacagccccagatcatctcaggcctggagggaagaagtaatttgcctgaggtcacagagctggtaggtgggggacccacatgattgggaagcaagcttgtcctgctctgagcttcagaagcatgtcatgggcccatccatttacgacttcacactttctgtccttggaaagtcaccgagagcgtgcaccataatgaaacctcgaggcctgccgccgacctgcctgagtgtggggctcctgcagagccagtcct

SEQ ID NO: 99503 - DNA, 1046 bp, Homo sapiens
gaagccataaggaataaaatggatattgtggaaaatagcagcagtgaagtgaagaacatacttgagaggctgcctgggaatgcagaataaacaacagatgtgtcaccggtgaaagaggccagatctgatggggagacttcagccaaatagcataggaactctgaagaagccagaacaagtttaacaaaaataataatcagtgacataattgaagaacattttcctgagcagaaagaagacctatatttgttgaaagagtcatgttttgaacaaaataaaagactcttacttatgtatcttctgacaacgtttttgaattttaagattcaagaaaaaaatgccagtagattccaggcagaagaaaatggtaacaaccacaacatcaagactcggcccccaaagttttacctggaaagaagctgtaattgagctggacttaaacttccctacaatgttgaggggggaatgacatccaaaaattttgaggggggcatatttgtgatctaagatttttatacccagctgagatgtgtttttttgtgtgaaggatactgtcatctgagatttgtgagggtttgaaaaatatgccatctacattcccttcaagaaaatgtctctttctgaccaagagatgaataaacattctgaccctgaagacaaataagtcattgtcattcctaaggagataaccagatacagaacaacagtcatgaagatattaatcagagttgtagatacaatgaacataaagttggaaagcatctagatagccagccttgggggcgggggtgattctttacatgatgaactggttagagttctttggttataagcaattggcaaaaaaaaaaaaaaaaaaaaaaaaaaaatttctagactaattaaatcaagaaaaggaattggtcacacttttaaagaaagatgaacacagaagcctctgaaagcacttgagctgggatcagccagggactctcagtggtaggagtgctgagacttgtctcttttgggttcatctagtgactgatctattgaagaggcaggccttg

SEQ ID NO: 99504 - DNA, 1014 bp, Homo sapiens
ttgtaaaatcagaaagtaagcaaatgctcaaaaacaaacaaacaaaagactggattggaggcttgccagaaaaacctaggagctggtttgcaggagctcccgacggccggcgctttagcaccaacaccaatggtggcagtatgggactaataacacagcggataacgtaactatctgtgagtccacacgaacggaagcagattactgagtcactgggaagatggagcagtgaaagctcatccttgccttggaattctaagtaataagtgcagcaaaaaggaggtgatttggatgtcaccactaggcaaacatcatgacagtgagtgtcacagcccggctgctctgatggattcaggcccacgaagacgtgtgttgatatgtgtctctctccagtgagcttcggtagcttgggcttttcaaggcacttgtttatttcatctaagttgtcaaatttattggcataaagtttttcataatattccccattgtccttttaatatttgtgcaatctgtagttaattcccactctctttttttttttttttttttttttttttttggaacagaggcttgctctgtcacccaggctggggtacagtggcgtgattttggctcactgcagccttgacctcccgggttcaagtgatcctcccacctcagcctcccgagtagctgggactacaggcatgcaccaccatgcccagcttatttttttttattattttttgtcgagacagggtttcacaatgttgcccaggctgctctcgaactcctgagctcaagcaatccccccacctcggcctcccaaagtgctacaattacaggtgtgagccaccacacctggccccctctctcattctcgatattgttaatctttgtcttttctctttatcagctctgctagaagtttatcaattttatagtctcaaagaatcagcttttagtttcattgatttttctctgttctgttgtcttctgttactgttttttttttcttattttgagtttaatttg

SEQ ID NO: 99505 - DNA, 1006 bp, Homo sapiens
gaggacacaagattctgagaagccctcttgttcatgacacagccggattctggccacatcatgtgaaacatgtttcccattagcttggctgtgcgtgtaaaagtgaggaggaactcacatggtaatagagttacatgggtatatgcattttcaaaatagtgccgttaactttcggacgtttcagtgtaggtggaaggaggtaccgacgcagcgtgaatgccagggtgttggctggcgttgaagctagatgccgtgggctgtcacacagttctctttactctgtatatgtttgaagttttcataatataaaagctttgtttttaaagagaaattcatgttaaaacctgtgaaatcttaaattgcaaatatcaatatgaaaacactttttttttacttaaaatatttgtactttttacatatccaaaaaataaacaaatgactaaaaccaaccagtatgtggggaactcaacatgaaatacatatgctaaccaaggaatttaactctcttacaaatgcactcacctgataactttggaaaccagtgtcttacctggatacggtaaggctgagaacaaggagaatcgtgtataaatggtggtcttgtgaatgtgtttctcatgtgtagaggttagcgattctgaaatgactttgtgtgtgtaccggaattaaacaaatgagaaaagatactgtagataataggaaccaggtttcccactgttagaaagatatttaataaaaacaaggaaagaggaagactaaaatacaccttgtgatgttgggatctgaggtctcagtatagactcatgattattcaagtgtaaactcatacagagatactgaggtgtgagtgagtccctacgcgcgctgcctgctgagagggccctgcgtgctctgtcgcccagcagcagttagcacacctagcactagattgggtccgaacacagttctcccaaacatggatccagggttccctggagaagccattgattccgggactgtgacaggg

SEQ ID NO: 99506 - DNA, 1059 bp, Homo sapiens
ttttactgctgtatggtgttctgtggtatgatgacatcacaaggtatttattcgtgcagcttttggcacgtttgggaggtttctggtttttgactgttacagataatgctgccgtgtcttcgtagatgtctttctgttgggtagatgcctcgggctggcattgctggggcatggcacttgtgtggctgtagtacctgccaccgaggggtttcccacagggtgtgtgccgttgactgttttgtaacctcgtgtgtgagtgccggccaaccacatccttaccaacacatggtatcctttcgtttatagattttagccattttggtgggtatggagtgttccgttgtggctttatcgcgtttccctgcagtcacacatgcgcaggaccttgtgtgtgttgattgaccacttggaatcctgtcttgtaaagtacctgttgatgtgttttgcttatttttcattcaggttgtctgcctttttcttagtgatttgtaagaattatttatacattttgaatatccgtcccttgctgggtgtatgtgtggcagggtctcttctattttgtggcttgccttttccctcttctgcatcttttgataaatgagtgttcttaattgagtgcagcacaatttatcattttctttccttcatggtcagtacctttttaacatctgtctatctttgcccacctgaagatattttttgttgttgtcttttagaccaggcctcattgcttacctttaacatttaggtctgtgatccagctcatactaatttccatcatggcgggctgtatgggctgtggttcatttagcatcaaagagcagctgacgcaagcactgcatattgaaaagaccctgttttccctatggatttggggtggaatcctcacaataatcagatgactctgtgttggtctcattctagcatattctccttggtttactttaattacacaagtttagaagaagtcttgatatttggtagtgtgagtcccccaagcttgtttctcttccagattgctatttcaggttctttgtgcttccatttaaaatgtaaaat

SEQ ID NO: 99507 - DNA, 1096 bp, Homo sapiens
ccggctggatggcaggctggccacactccaccacgggccagatggagcctgcagtctgcatccgcttccccccgagtcaccccgcagccaggtccggagcattccactgtctccctatcccactgtcagtgtctgcgtgcaggtgctgagcctggcttggtgttcttctgtcctttgtttcctgtgaccctgtggtgagtgtgaccccgtggtggggcaggggctgctctctggccttcccagtggagaggatgagcaaggggccccggcagccgatggggggcttggagaaagggcgcttaccccaccctggggctccttggggctgccaggggaatggtgcccaggctggctctgaagatagggtaagatgactgggccaccaaggtgggggctgtggggagcgctagggaggccctgccaggagccggtgccctgagagcagggcgggcactgggccagctcaggccgaggggacctgccagacccctcctgggagcttggacctccttgggtaagaaggagcagaccttgatggggctgggctggggctgtgcttgagggactggagggtgacaggcagaagagggcagtggctccacaacgggtagacggggtgagtcttggtgtctgtcagtgactgccagcatgcccagcatcatcacacgctctgctttctcctggcaccggcctggtgcgtctccccggggctcgcccacctgcgcgggagccagcacttgcagggacccaccttcctgggttggtcacctggcttccttcctctccacccccagcgcccactccccctggctggactctccctctgtcctccgaggaacagcttttcttggcggcctccacccccagctcctgccttcctggagtgacttgcccctgggctccctgtcacttctgaattacttagcctgaggagcgtttcttccctttgtgtctccttccctagggcacttcctctttaccttcccgtcccacccctgcggctgacactgaagattctgctgtgtgccagtgagtgagcgggcccagcatgggacacttttccttggaaatgaggggaaagagggctgcttcctgg

SEQ ID NO: 99508 - DNA, 2774 bp, Homo sapiens
ctcctctggcgtgattcctggtgaacccagaacagccactcacctctgatcgctgccacctaatgaggaagggtggagtttctctaaaatgggtacatctgatggtggtgagggtggcgaaatcctctctcatgcacagttctcacccagcttctcttctctccagggagaccactgtgttttcactgttagaactgggctgtctctggacaagggccagccttgttacgagcagaagttctcggtactgtgtctgggatgtggctcttgctcctctaggtcgtgactacgttgtttatgaaagtcaagctcttacacctaaagccggtgctcatgggatttccttacagtgcattacattgttaaatttcaggcccagacgtggtctggcggcttgtctggaacacacagtggtgctccaagcatgcctctgcatggacgccttacccaccaacatccgtgggctccagaggcctcgcaccctcccctggccggccaccccgggatgcccccaggacctgcaccctcagctgacgctcctcttgggaaggtggttttgaacctctgtcatgtggttcctcccgtggttgggacacactcatctgcctctggtgtgacccatctctctttggtctttcctcgtccctccagtgccacccattttcgtacagaaactgaggatgcctctaattccgtttgagcatttgagtctcagtgtctgtgaccttgactccccctgtgcggccgccccagccccagcagcacagtcaggactgggacctgacagtggctctgaacctccgagacacaggccccagcctctcttccctgtgctccgactctcagccttccttctctgccctggtcctggcatcctgtggctcatcattgtctagagtaaaacgcaggcccctctgccttgcctgccgggtcttccagggtttggcccagcctccccgacccagattccttctccctcatccttgggtctggccacattgtttagcccttgtttagggcacacctgagctttcctgtccctgggcctctgtttaccttgcctccggggcttgtttggggctcccagagcagagctgtaggagactgtcttggaccgctttccggggcccagtggcctctttttgattctgtaccggcaggaagggtcatcacagcctccgtggcttcctcggcactcaccgtggcttgcctggcctcctgtcccctttgtgagttgtagtgagtaatggacgaggctgcagtcaggctccctgtgtcctgttgtatcacatggtccttctggggctcctggggtggcgtctgtagaatcagggacaggcgtgtgcgtgttccttatcacaggccggctttgcccactggtaggctgtgctgtgcacgtgaagctgcaagggctcctggcacaggcaggcagggggcttgaggctgagacttcagagggaacaggggcccctgtggccactcatttccatgctctagctctgccttcccgctctggccaccaacagggagccgggtggaggcagagcttccccgctgctgagctgggcagagtcgtgggccaggagcctccttttcttcagtcctcggaggtgacccggaggcccccggaacctcctgacactgccagccagtgcttcctcctgctgagagcagccagcccgctgtgtgcccccatgtactgagctccaagagtgtcgcctctggctaagggaagctgagggcaaggcttcttcctgaggcttggaggagacctttcagctgaggtgctggggatgctggggagagggcctccacgcaaagcagtcaggggctatgggcctccgattgtgccagtcctgtggaggcggccgggaagcaaggtgcccttctcaggagagagagccaagatggaagggaagggatgggaagggctcttccatggaagccttgtccctgtccctgtgcacaaaatgtccgcagttctgttctcctgtatcctggctcgctggagcccttgggtgtgcacctccccatcagtttctgggcccggtggggtgcagagaggagccctgagcccctcctcaggtcctgcctgtgtctcatcttcctggtgcttggtccgagggctgatgtatttggaagttttatttaagctgttgtattgttaaagtgtcatctttgtatgtgtttgaatacaaatcggcattttagggatcagaagcaggggacagagccgtggggtatatggtgctggggccatgtccactgaaacaaagcagactcattgttgccgcctaggacccattccttcggatgcagggcagttttcccttctctttcttttcttccgtttcctttgcctttttctgagatagagccttgatctgttgtgcaggccggagtgcagtgggacaatcatggctcactgccgccttgacctcttgggctctctccatctgcctgcctcagcctcctgagtagctgggactacaggcgtgcaccaccacatctggctttttttttttttttttttgtagagacaggggtctcactatgttgtccaggctggtcttgagctcctggtctcaagggatcctcccacctaggccacctaaagttctgggattacaggtgtaagccaccatgcctagcctcagttttctttttcattaaacatttccatatgatagagagaggtactaaaatatgtcatttcgaatgtggctttagggagatcatggatcttttcagcccacgcaggtatcccagattac

SEQ ID NO: 99509 - DNA, 1028 bp, Homo sapiens
tcacttcttatttagcgtcataattttaatatgatacattaatatgtttgtgtacataaacattttggagtctgctctgtttaaaaatgtgagtgttgggctttgtgagtttactgttgtttatgaagtactccgtctgtgtgagtcaagtgcttttgctggattgatgtttaagcttgaaacaataaatcagttcttaggacctgaaagtctgaaccagcattccaagtgggagtattgttcaagcggtgatggaattgcattttcccttgggaatggcccatcatctggtttatgtgttgctatttgctggagcggttcttttttaaactgaggaagagaagtttctgtggtatctccactggcctccctggtggtggggttgggggtggagggggggtggtccttgggggccatgttccctgaatatttctaattgattagttattattttgcaaatactcattttacaccccagcccaagtactaggttttacatgagatgagactcagttgaacacattctctgtgccagacgcagtggccagccccatgaccccaggcttgatcaggaaaactggcctctgcccacaagaggctttggtgttggtagggacagaggagaaaaaggagctaaacaggcaggtgcacacgggtcaccatcctgagaaccagggctgtggctggagggcttgcttggtagggagagccgtggtgcaggagccaggcccagatgaggaggaggaaggggaggctgggtgggtgggaatggggtgtggtcctttttagccagagccagagtttcggggctgcattgtgaaaagggcattgtggccagatggtggcctggtgactgaggtctctgaggccagagtgcgtgagccagtgatgagccgggccaactggcaggctgcctgggtggggtggaggtgtggtctgcacaaaggacttccttgcgttttcatgtatgtgtagtcttcttgcatttaatggagagtttgcttctgttctttctattttgtgcactg

SEQ ID NO: 99510 - DNA, 1774 bp, Homo sapiens
tgctgtgttgactgttcttggcgctgttacaggcgcgtttcataggtctgggcagtacttctggctttctcatgctgtcttatgtcacgtgtgggactgcagaactagaagacatcatgttcttctcctgcaaagtccccaggacgcctggaggcaggtgggggtgacggaagggagctaatgctccaagtccacttcagccggagcagcttttagtgtttgttgttcggtctgttgattaccttggaagattttattggaagaaagcatttgaggaccaagttaatctactctttcaataccaacccagaaaccttaaagaaaatcttgacagatttaataggataagagttttttaaaaaatctctttggcaaaagactccgtcagccgggctaagagacgagagagaaaatacataccacattatgcctgtgtaagcttaacagtcaatatataaagagcttttacagaccaataaggagagcatgagatcaccattgcaagatgagcagaacgtatgaacattgaatcattgtgccagtgatgaaaggttagcattactaatcaattcagtgtgaaggagattccctttatgcctatcatattggcgagtttgatgatacctgttgctggtcataataataatttctattttgtaaggtttttgcaaagtttaagttaatgtatggaaatttccttgaatagggcctggcatgtagtaagcatgatataaatgttggctgttatttattatcatttgctctctggagagacccatatgtattattatataaaatataatagggctgggcgaggtaccttatgcctgtaatcccagaactttgggaggccaaggtgagaggatcacttgagcccaggagttcaagaccagcctgggcaacatagtgagaccctcatctctacaaaaaaaaaaaaaaaatcaggcatgacgtcgtgtgcctgtagtccccattacttgggaggctgtggcaggagaatcacgtgagcctggaaagtcaaggttgcagtgaggtgtgattttgccactgcacttcagcctgagtgacacagcgagaccctgggctgtcccccccaaaaaagtttatatatgtaatgtataaacataaaatagtgattaccgaattgctctctagaaaagtcttaagtgtcaaaatcttaaatgccattctccttgtccccacagttctacattttgaaatctattctaaggaaagaagataagtgtgtagatatccagacgtgtgtggaggtcggggctgcattatttataaaaggagtacttgttaaacctgctggcatttctgcactgtggcatcctccatgtgtagacaggcagaagtgtgcagtgtaagagggaaaggcggggtctggagcagtccccgggccactcctggttttaagtacatgggtctctaaggtaaccatcagaggtgaggagacggggtacacttttcttttatacatggtggtattgtagagattcttttggtaagcgtgtattacttttttacagtagtaatttgaaaacatttagatatcttcattggaaagaaaagtactctttaagtccttggcaagttgataaatatgctttgcaatagaagaatttaggggcatttgtttttctaactcacatgtaagctcttcaaggtggggactgaccctcggggtctgagcgggctctgctacagcccatcctacaaacagtctcccaggtttccaccagaagcaggtttgtacctctcattccct

SEQ ID NO: 99511 - DNA, 1042 bp, Homo sapiens
aatgttctgtgttcagcagcttcctagccatgcaaaataaaaatccccaaatgccatattctcggaggccttgggggctgttgctgtagcaagatggacaggacaacctggcacgctggccacgtgcggctcaggcagcccatctggactctgtggccagagacctcgttgagaagaatgccctatggatgtttaccaggaggactctagtgctggaagtttccacacattgtggggttgctgcagtttaattttgttataactctttccttttaactactgcatatttatgcccagtaatcgacttccattctccagcttcattgtgaggtttcaatgcagcatgaatggctttgaattccaatcctttaatgttgggggtggcaccaaaggaaaggcgactttatgctgtcttaattgccggagcagaagaaacatttcatcactcctgtagaattcatccataccattctctattgaaaacggctgggctttcatagctcagaagctgccatgagtaatatattaatacctgatgtagggcgcgaaggagccgcagaggccgagagaactgccgttgctgagaggcagcggggcgacaggctgtggccgggctttcctccgaggctcagaattgatgactagctggggatgggggaactgaagggcgaaggggcccagtctccacctaagcttggggctgtggaaccgagactgagcccctgccctgttgttggcagcccccagtctgtcctggggtaaggagtcggaaaggatggatttggagggagtgtttgttttgatttcaggtggtcagcatatgccctgccgtgtggtgggctctgggtttttggccttgacgttagaggcgggtactgcaccttctggttcaggtcagatgaggggtgccatgtcaaaagtgatgctacctttgaacagaccttaactcattcataagcgtttctgtgggaacaagtgtcactaaggtcagtaagttctcttcatacggtcagttttcttctcttgggcttctgtgcgtggg

SEQ ID NO: 99512 - DNA, 1019 bp, Homo sapiens
gcggggggctgcccgggacccgctcggctcagcccgcagggcgccagcaggccgagacggggcccggtcccgctcgggggtgggatccgcgtttgccggcgttgcgaaaacacaccacggaatcataagcaaattatctcgtatttacattgagcgttgaattatttgacactgttataggaggagaccgtgcgtatcagttggaaaggccgggggtggaacccagtgtactcatttaatgcacatcaaaaatttgtaataacttgaggcagctgatatgagtgttttctttattgcatgttgtaaattgacctgctgtgacacagttttcaaataaagcgttgcagaaattaaacttaagttattttaaaactaatgactttcttcactaaatcctaattgcatgactgtagagacctacctaattgcttgctgagagcagttctgcttgctctccgtgagggaggaaagggcctgtgcagtcactttgccgccccgtttttctctgttcaggcttttctgtttattcccacaaatcaccgaagcagttaaggcctgggagtaagcctgtaaacagtcctggcccagcgccagcccagcaggactggggggatactggcaggtttgcaccttgacctggtttcactttttcttttgtaatatgatcgtggttgcctggagttttaattgcttctgataattctgtgcattattttcgggactgtccaaagaaggctggtgtggtggtttcaggacctagccaggaaaggtggtggtggtggctggggagagggagggtggaagggagggagatcgaattaagaaaactcagctgcttgtacacaaatatacactacagcagttacaaagcaacaaaagttattgcagaattttgcagtaactatggcaacacaattactctattataattggaaatgcaaaatgccaccgagttagaagtttcatcagaatggagttttggatatcaaaaatatgtgaaatttaattttttttcaggt

SEQ ID NO: 99513 - DNA, 1013 bp, Homo sapiens
ctcacttcagtccatctccaacaccgcctccctcacggagtccccccaacaaccaccaggacccaccacggattcctgctgtactggctaaaggcacaggcccctcactctctgctcctggacctctcccacatcactgttgctccttgctgaccaccggctgtgtcccagctgacctcgcgctgtcccccagctgaccctggaccatctccctgctgaccttgggctgtccgccagctgaccttggaccatctccctgctgaccttgggctgtcccccagctgaccttggaccatctccctgctgaccttgggctgtccgccagctgaccttggaccatctccctgctgaccttgggctgtcccccagctgaccatggaccatctccctgctgaccttgggctgttccccagctgaccttggaccatctccctgctgaccttgggctgtccgccagctgaccttgggccgtctccctgctgaccttgggctgttccccagctgaccttggaccatctccctgctgaccttgggctgtccgccagctgaccttgggccgtctccctgctgaccttggaccatctccctgctgaccttgggctatcccccagctgacccagggctgtctccctgctgaccttgggccatgtccctgctaacgttgggctgtcaaccttgtcctcttcacctcagccctccagggtccttgaagcccgcagctggatccctccttccagctcctctgatgctgggaatctcagtgggaacagtctgtgtggggagcactgcagtttaccctactccagcccagtgagaggggcgcatggtgttttgtgtgaattgcttccccccgccaagtccattgctagggccacacagacacatggacggcgccctcgagtctccgtgccatgtccagggaggtctacactctgatgtggttcgaaggccaggcgaggctcttggcctgcagcatccctcagcacacctgcccctgcctgtctcaagctctc

SEQ ID NO: 99514 - DNA, 1436 bp, Homo sapiens
gggatggccacccaactggacagtcacctggatggacggacacctggatagacggtcaccccgccagacagtcacctagatggtcacctcgctagacaatcacctggctgggtggacacctggatggatggtcagccagctagacagtcacctggatggtcacccatctagacagtcacctggatggatggtcacctagatggatggtcacctggatggacagtcacccggctggatggccacctggatggacggtcacctggacggatggtcacctggatagatggtcacctggctagacagtcacctggatggatgttcacctggatagatggtcacctggatggatggtcacctggatagatggtcacccggctagatagtcacctggatggatggtcacctggatggatggtcacctggatagatggtcacccagctagatagtcacctggatggatggtcacctggatggacagtcacctggacggatggtcacctggatagatggtcacccagctagacagtcgcctggatggatgtttacctggatagatggtcacccagctagatagtcacctggatggatggtcacctggacggatggtcacctggatggacagtcacctggacggatggtcacctggatagatggtagcctggctagacagtcacctggatggatggtcacctgacagacagtcacctggatggatggtcatctggatggatggtcacctggatggatggtcacctggatggatggtcacatggatagatggtcacccggctatacagtcacctggatggatgttcacctggatagatggtcacccggctagatagtcacctggatggatggccacctggatggacagtcacctggacggatggtcacctggatagatagtcacccggctagacagtcacctggatgtatgttcacctggatagatggtcacccggctagatagtcacctggatggatggtcacctggatagatggtcacccggctagacagtcacctggatatatgttcacctggatagatggtcacctggctagatagtcacctggatggacagtcacctggacagatggtcgcctggctagacagtcacctggatggatgttcacctggatagatggtcacccagctagatagtcacctggatggatggtcacctggatggatggtcacctggatggacagtcacctggacggatggtcacctggattgatggtcacatgactagacagtcacctggatggatggtcacctggatagatggtcgcctggctagacagtcacctggatggatggttatctggatagatggtcacccggctatacagtcacctggatggatggtcacctggatagatggtcacccggctagacagtcacctgaatggattgtcaaccagctagac

SEQ ID NO: 99515 - DNA, 1009 bp, Homo sapiens
gctcagggcctcccctaagtgccacccattgctctctgtccccctcctgtggctcttgtcaccctcctgacattaatgagaacactcagtagttcgtttccatttgtggctcccagccctaggacagaagcttctggcaggcagggctgggttgtggtttgtgtacctgtggcatccttgcactcacaggagacacctgccacagatcatgtgctcaccagcattgctgaaggaactcatgaagtacaggcatctgccgggtagacattgaactatgagctggggaaacattcattcacgttaaacagaatgcaccaatgcctttttcccccacagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaatttccccatcgtacgtctatgtgcgtgcgggcacgtcgaaactgcacacgtgcacacacgctgctctgggccctgtttggtgtggtgtggtttaattgaggcttacattatgctgaagagtttttctaaaggcctactgtatttattttagtaatgtgctacattagagtagaaaaaataagaacgtgaagaagaaatagcaaaaggagaaaattaccacagatt

SEQ ID NO: 99516 - DNA, 1069 bp, Homo sapiens
tcagcatacagaacagagcagtaagacgctggctgcaaccccagagggactgaagctactcaccgttcctgccccaagatccactcatctggaaaattgttaatgggggcatgctttgtgtgtagcactgtcatgtaaccatttgcttctagctttttgttcctgctattcctgtgtttaaagcacactttgcctcctttttctatgtctccaaaacagcatccattcccagaaggtcgtcctatgtaggtactgaggcttttaaaagatgctacctcaggttctgagagtaatattaaaaagcagctccagatcgaccatgtggtctttgggaggaaggctttgctgctgggatgattgcttggcaacgaatagcatttattgggatatatagattttttatatggatgtttaaaaaaaatcggacttacacttcttttattgtatttattttgatggtttggtgtgatccacatgtgtcttattttttagggttcaggataagtttgaggtgctgaattacacaagcattcctatctttctcccggaagtcaccattggagctcatcagactgaccgtgtcttacatcagttcagagaggtaagactgtggaaatggagaaagctggccagtggatgagtctgcagcacctggggacaatgcagtcacttctccagaaaggagtttttgttgttgctgtgttttgtttgttttagtgaaggagcctctttttcattgaaataattctcccttttccccgtatttctgtgtggaaagctgatgaagtcctcagatgacagccccagagcagagatgttcttctggaaggttcttcatcaggcatattatcttgataggagaacactctgttcatcagctgttatgtcagtttctttactgtcagatgttacttctggtattttcttactctttgtctgtaaataatgagggttccatttctgcagaaggcccttaggccatatgggaggacatagggagggcaggcagagcttgggacagacagcgagggtggaagttggtaggggcaactgtgtcattgatcttctt

SEQ ID NO: 99517 - DNA, 1005 bp, Homo sapiens
tactcagagttggggtcatcggtctccttacggattttctctctgctggatctgtcggttactgagagttgggtttaaatttccaacagcgctggatttgtctatttctcccttgggttctattagtttttgcatcatatattttgaggtactgttgttaggtacatagtttattatcttaggttattatcttcttgaagaattggccgctttatcgttatgtaatgcccctctttttcgctgatgtttgtccttgtttgaagtcagctctatctgaatttaatatagccactgcagctttcaattagtgtgggcatggtgtgtcttttttcctcttctatctcgagtctttagttttcttgtagatagtaagtagtaattgggtcttgtgttttaatctactctgacagtctctgtcttttaattgctgtatttggaccattcatgttagaagtgagcgtgaagataatcaagttccattttaccatgcttttccctgttttctgtttgctgcatttgttgtttctccctgcctctttttctgccttctctggatttcattgagcattttataagattctcttttatcttttcccttaacatcttgattgtactttaaaaaaatgtttgtagtggttgctgtggagtttccagtatacatttacaacccatctaggtctacttcgtgatggtgctgctgctccatggggctgcaggtaccgacggcacagtcttcttggctcctcctgctgtcactgtgacatggctgccattccttccacttttttttttctttgagacagggtcttgctctgttgcccatcgcccaggctgcagtggcatgatcttggctcactgcagcctccccttcctgggttccagcagttcttatgtatcagcctcccaagtagctgatactacaggcgtgcaccaccacacctggctaatttttgtatttttagtaggaatggggttttgccatgttgcccacctagtcacaaactc

SEQ ID NO: 99518 - DNA, 1046 bp, Homo sapiens
accatttcattaaaggtcagccagcttcacttccattctgactgttacggtgtgattcttcctgccaaatattcatagcttataatgtattaaaatgttacctcttggccagccatggtggctcacgtctataatcccagcactttgggaggctgaggcaggaggatcgcttgagcccaggagtttgagaccagcctgggcaacgtggtgagaccccatctctactaaaaatacaaacatcagccaggtgtggtggcatatgcctgtagtcccagcaactcgggaggctgaggtgctgaggtgggaggattgcttgagcccagcaggccaaggctgcagtgtgctgtgattgtgccactactttccagcctggatgatagagccggaccctgtctcaaaaaaaagttatttcatttaaatttctaaaatggggttctctgtttaaattggaatttttcctgtcttaggtggtagaggacattgaatacctgaagttcgataaagggccgtggctcaagcaggacaatcgcactttataccacctgcgattactgtaagtgcatctgtgtgggggctgctgcatgtctggggtctacttgcatgatggggaaacttagggaagtttgaaataattatgtttcaagttaggtgttagcagcaccaacccaatacttagaggtattttttcttccaaacagctcctgaatcccctggtctgatacttaatttattgagtgccattattaatttaacaggcattttgcttccactatgtgcaacaccgttccagatttaagagatatagtgtcagataaaattcttgatgtctttgaaaatgtgttttagtaggtgagacagagtaaacaaatagataaaactgcgtcaggtcacaaaggccagggagagaagtaaccctgagtaacagggtggtgagtagctaggggtgacaaagggcctctctcgggatgaggcctaagtgaggccaggattgggtcctgtgggccgtggggtgagcagagggcaggggcttggcaggtgcagaggct

SEQ ID NO: 99519 - DNA, 2015 bp, Homo sapiens
aattgggcctaaggtgggtatttcacatttttgtttattgaaaaagctgttttataaaacgaaacaagaaaaagctgtttttaatcttttatgtttggaaaatttgtgaaaatccatgctggttgtcaatttgaattggaattttatgtgggcagtgtaagcagggcacttccacataaactgtcgtgtttgaactttgtgacagcctctgaaatagagccgaggatggtactcactcacagatgggtgtactcctgagtgagcagatgccacatagctgggtcccaaagccaaggttagagccccttcctgactcctggtgcagctgagtgtccattgtacctttctgtagcacctgcatgacagcagctgcccgctagagggggctcctgtggttacagggagcagtcctttcaggaggaacctggataagggcactgtgcaagctctttcgctcacatgcttgcttgtatatgttgtgtgttcccttcatacgtgatgaaacccaggcatgtaggtgactttctctaggtcattggctccatccctggcggtgagattcgggcgggctgtgtgttttggctagtccccactgctccctgcggggagtgagtgatgtgcatcagactgcatccgactgtttctcttttcaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggtgcagtatttctgggcagttagatctgttctgtacttgaacactattctagaattcaaccacgttaaattgccactgagtcgagctttcctttaagggtgtttgatgaggtgagttctgtctttccaacaagatcatgaatttcttgagattgtgttatttttgcttcagaattaatttaatgctgtttcactatggatactggagtgagatttatggattgtatagaattctcaaggcactactttaagcttctatacttacatattcatttatatatgaaatgtgtcaaaacaaaggggtaaagagagcacagaagtgtccaggaggaaacgggatcacacttatgaagactgtgcatgtgccatgcagacagagatgtggatgccaacaacatagggttgtcccggagggcccagagataggccggaatcaccataaagccacgaggcagacgtgaatcttgataagatgacggggggaggcagaacacacagggtcccataggccagtgcagtaggggaggatgcttcccttgaaggtatccaaagcagaaaggaagagctgtgtactggggagcctgggagacggaaacagggatcagaaagtatagttaggagaggaagggaaggtggatgaaagggcatgaacatggactacttgtgtgcagaatgaggttagggtccagcgacgggttactgtaatcattctgggaaacagcagtgcatgctagacatcctgagagttggaccgcagatgcactgccaatttttggtcaaagctaccatgccacggcggtcctcagttcacaggtagcagcaaatggcacatctgtgtgcggagagagggagatgggtggactcttagggccttcgtgtctgttttatattgcagtgcttgctgctttcgttgattggcagtgcccctgatgagcttctcacgcacaagctcagccgccactagggttggcttcatggggtctgagccgtgagaacaagaatgtggttttcactgggagtggccggctcacaggcttcttctcagagctgagctaggagccgctgcctatgctccttcaggtctccacggatgcagtgtgtgtccatgacacgtatctacacagttgtacggtggtggagttattgt

SEQ ID NO: 99520 - DNA, 1035 bp, Homo sapiens
tgcccgtgcactcgtgggtgcagacacggcactggcgtgtcctgagtgctgagttgtggctgtgcggtggtgtccgtgggactcagaacagccctgcatgcattttcttaggattgtcttttaaatgaaagctagaaagcactctagccaacactctccccttggactacatgtacgagccctggttggctgaaactgaaagtctgttacgggaaaagtcttttatttcattggatcattgacgattatctctgtattttggactactatataattcattctgaagtgatttcttcagcccttacccttgtaggtgtaactacgtggttttgcttatttccctagattttgaagatctttttgatgatgatgacatccagtgagatgccctctggctgcaggcggggccaagcccttggtacagagccgcagtgtgagcctgcgcaggacagtttcaggtggttttaaagaacacgtggaaatcccttgaatttaggacctggttaaccagaaagataagactgttcttaacgacctagatgattctgttcatctctgaacgggatcaggttttgtcctcactccaattaaaagaaagcaatgtcacatgtggagtgatctctttcttgcacttatgagtgaatgttgcagtccctaaacgtctctgtgtgtttgtgtgtgcatgcatgtgcgtgcatctgtcagcacgctgagagaaccacatttgtctggtagcagataccttgtgttaaggtgctgtatgtgctggagcaggaggcagcgcggcccgtgcacagctgggcctgctgacagcacttggaggaccttgccacggggccgcccctctgctgtgtgggcaggttcccactgtgtgtgtctgtcagcacagtcgtccttatgctgtcctctggcctccacgtcagggcagctgcccctaggcttaagaactaggacgacaggatgcgactgcaggagacgccttctacgtggaaatgcacattggtccatttcaaaggagagtgtaacgcccatgtg

SEQ ID NO: 99521 - DNA, 1082 bp, Homo sapiens
aaaacatgggtaaaccaaatgaacagtgaaaagcaaattttctgtaacatcttcagacctgctagagggaatatttctcattctcttctgatttcttcaggccttattcctatagatgatattaacctttactaagggttcaaataataagtaaataagataggtttcttactccagagagtgaggtggcatttttcatcctggtttaatccatggtgcttttctctacagaaagctcttgttactagttaacagctaggacctgagcttgccacatcggtttctaatttaccagagaccccctgccatcctgagtccctgctgcttcatcaggcttactgtcaggcagccattgcctgaggggagcagccaagctgctgagttggggtgcaggctttcccagggtgcctggccatgcccctgaggcagcattcttactgctaccaactggagtcagaactgaggcagatgacatttgagatgagcctggagaactgaatagcatttatttcaattctttatgccagagcgaggtgggagaagggtgttgccttcagagggaacaaattgtacaaagctgcagagcgctctccaaagctgctttgcaaaaacaccagctcaccagggcgactttgaagcttttcacgtgggcaggattgggcagttgctaatgctggcaccacacgcttgcattttgatgatctccttcaaagtcccatttatcctctgccagcccattggttagaggcgattgctgtgttctagtgtttgagttcacatgacttccagagtcagcccttgaatcctgacgggaaagcatctctgagagggacccaggtcctacccgtcaggtgagcgcccagcaacctgagcattgtgggcgcgtgtctgcctttgagccacggccggtcagggaggggacgcaggagagctctgtgtcccctgcctgcccacccactaagttcacaaagcactcactgtcccatcaggttgtgacaaccccatgtgttcaagaagccatttactttgagagacctctgtgggctgtggatgaggcttttgctaagtcctttttactcgtc

SEQ ID NO: 99522 - DNA, 1088 bp, Homo sapiens
aacctctctccctgcaccccctatggctgcagaagtggggagtaaccttcgggacccagggtacagaagacagtgtgggagccacgtgggctgagggaaacagggtgactccctcgggtcgcagcagtcctggggcagccaagcccagtgtcccctcctgctttgtcggctgggcctgggctccgtggaacgggcgccctctggtggcccctgggcggcagatcctcccaggagccctggaccctctgtggcctagtaggcaccattctcagtcccctctctcctgcatccagacttctccagggggacctcctcagagggaatgcgaaccccctggggttgggcacctcgctggcccggagcaggtggggtagagatctgatacttcctcgtgggaaggagagcagttggccctgggtgtgtggcgggccttcccagcctctgccccagggaccagaaaaggcagtgggtgacaggagacttagctcatgaaagagggcagtgtcgggacatattgggctcccttttgagacttcctttgtcctctggacagccaggccaggctgcagtgacagcagtggtcatcccattttatgggcaaggaagcaggcctgggtgccaccagctggacggtggcactgcagcagggcacccggccaccctccctttatgccagggcacggcacagaaggcaagggcggagccgagtggcaccccgggtgcccctgcgctgccaggagccctcatgctgaatcactgcccgcgtgccagcaggcctcctgcttttgcttgcaaggttgtgtctgggcataggtgttcccagagcacctgtctggcctcctgatgtctgatgtgatgtgatgtgtgtctgtttgctcctttgctggggtctcagcgccccaccttggcacctgagctccctggtcgctgggaccacctctaactgtttccctgttgtagccacagaacccggctggctcccggcccaggatagcttctcggaggacacccccaggccttcctggctttatacctggctgtgctgggtggggagcgggacatggagggtagaggagggtctccttgga

SEQ ID NO: 99523 - DNA, 1077 bp, Homo sapiens
ggtctagttttgggggcagaagtcagagtggggcatgggactgtcggtggcacagaaactgcccagccgctcctgtgcccagagtggcagcccgcctaccagctggagcgggcaccagcgtgccctggagcctgtaccaagcacccactcgttgggcccctccgaaggaatcttttcttctctgtgccacttttgaccgcctgggtggttggcacacagactctggggaaccatcctcagagggcctggacctctccttcccacatccctgaaagggtgtttccggctgggcccgggagagcccaccagcatctgcttctcagtcctgctcagcgggcctctcggaggctgcctggcacacagcccctcaccagaccagacagttccctgtgccctgtcctgtccaggtggctcagcgtggttcccaggtggtcctcagcctttgctgtgtcgctgctcttccctccatgagaggagctcatcatccccagcgtgaggaccgagcggagcccaggggagccctgatccgacagggccacctgcgtgatgcaatggcctgggtccctgctggaccgccaagcctcccatgccaggcaggccacagcactcctcaggcacagatgcccccacccccatcccatccccggtgtccccgggccttttcacaggagagaaagggaataatcgtgacctcctgtgaaggtggccaggagggagaaggtgctggggctgtgcacctcgtgggcagcctcgggctgtgtcccccctctccccggacaccctctgcaaaggcccacacacacccctctcagttaatggcatccggtaccctaagagcactcatgaacccgggtgctcttagaacacggggaaacccggcttgtggagcgtttcccatgactgtctggttaacacatcagacggaaggggtctttgtagacctgttttacaaatgagtaaaccgaagcctggtgaagcgctcctcttagggccagatctggctacagcattgaccactgcccagtaaagccaggccaggctgcttgtcccaggctctgcacttcttggaaggctcgt

SEQ ID NO: 99524 - DNA, 1102 bp, Homo sapiens
agtaccagggtaccagggccggcctgggtgccaggtagggaggcaggagcaagaaagtggaggctcccctggcagaggttccctctggaaggagcatggcttgttgggactggaggccagaggctggggaggcttcctgagggaggtgaggggaaagcatgtgagatggagggaagtggcaggtcacagctgggtggggtgactgggtggagtgactgggtggtgggggtgggcgcagggagagccaggcctgggaccaccatgaccacagagatggcttctcgggaagtggttgggtcggaggtgagcggccgagttcctttgctccctccccttctgttccttccccagtgtttatgagccatccctcttggcgggctccctccagaggcacccaagggtttgctctgggatccggcccagcctcagctgtatgtgtgtctctgcctggttggcattcacggggcagatggacgggcctgcgcggcgtctttgtggactggaatgtggctgctgcgtccccttctgcgtttctagcgtgccccctgtgggtgtagcagacagggagggccagtccatcttccaggcctccttgggtgcctgtggcccctgcagtgggtgtacgggaagctagatgggagagctgggcagagccccaggaggacaaccccaccctcccacagcctgcctgaatttccaccctgctggcagggttgggcatagagatgtgagtgccctcttcagctccaccaagccaaggaggagaaaggctgagccaggcctgggggcacggcctctggggagcacctcatcctgggttcgaagagtgggctctgccttacagccaagacaccgggtcctgggtgtggcaggaggttcgtgacacaaattctgaatcccctttcatccccagtctgaggccacagcatgagcctcagacagtggagcaggctggcatggggggaggcctgcacagggcacgcggcttcttggcccgagctgtgactaggctcccatctgatggacccctgccgtcgtgccatgccagggccggcaccgcccagacctggcgtctgccggcaggatggcctgctcaggggtt

SEQ ID NO: 99525 - DNA, 1088 bp, Homo sapiens
gcccggcgcccctcgcccgcggcccggcgcggccgccgcccatggatttcacctagtgccggcggccatggccgcgcagtgctgctgccgccaggcgcccggcgccgaggccgcgcccgtccgcccgccgcccgagccgccgcccgccctggacgtggcctcggcctccagcgcgcagctcttccgcctccgccacctgcagctgggcctggagctgcggcccgaggcgcgcgagttggccggctgcctggtgctcgagctgtgcgcgctgcggcccgcgccccgcgcgctcgtgctcgacgcgcacccggctctgcgcctgcactcagccgccttccgtcgcgcccccgccgccgccgccgagacgccctgcgccttcgccttctccgcccccgggccggggcccgcgccgccgcccccgctgcccgccttccccgaggcgcccggctccgagcccgcctgctgtccgctggccttcagggtggacccgttcaccgactacggctcctcgctcaccgtcacgctgccgcccgagctgcaggcgcaccagcccttccaggtcatcctgcggtacacctcgaccgacgcccccgccgtgagtccggggcgggcgccggggctgcgggccggtccgcagggcgctgctagcggcctctcgccgcacggccaggctgagggacgcgaatctgcgccctacaggtgcccccctccccccaccccggtgattcccagctgttgcctgtgagcccttaggaccctcggatagaagccggagtcctgcggggacacgggacagcatgtcactccgggaagcctcccgttcaggtgtctggtccctgcctggggacatgagcagcttctgtcacccaccgaggtgtacatctgcaggatcctggcaccaagggttgggctggagtgtcagctgcggaagggcctccatgtgaccagtgcgtgcagatgagtccaagccagaggcagaggaaagggccatggagattgtgatgctcggtttggggcttccttggccagcactggtggagtgttgagaccagtgggccccgcgaccccaacatagacacacataggct

SEQ ID NO: 99526 - DNA, 1054 bp, Homo sapiens
catcaggaggctctggcttcccaggttccacatcccagcctccttttcctgaccatgaccaaatcaactgctgggaatttggactgagtgtgtccctactgtgcctcagtttccctatggaagctaagataatgcaatgatgggctattcccttttttcgccttggcgttagctgggagatgcccctatcggctacctgacacagggcctcctgcctgggttggggtctggccctgatgacacagtgcaggccacaccctgggtcacctgccctggatgtctccctgcccaggcaggcaagtgaaggctaaggggtggctattggccctcgaacccagcaagataatctggccattgtcccctcccagagcctcctgccttctctcaggctgctgcccagtggctagggcccagcaccctagctgggtggccgtctgctgatgggccatcctgcccacagatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggtcaggggccgccagctgccgtcaccttgctcccaggacagcccagtggcctggccacgccgcctcccccttgctcctacctgcctgggctgtggccccagctgccagcaggccacagtgctagcaggagcccaccctccctactctatgggaggagccgctttgcagggaacgggggaagccgggctgcctccaacgggcctgaggggtcggggtcctggacccggggtgagtccccagtggcactgcagggtccccagacaaggggtctcccgacagagctgctgatccccagtggggtctgtgggtcaccgggcccgaacttggcagcaccctctgtgctgggacgaggtttgcaggctgggagctaggggttccgaatggagggtggcagttcttcggagagaagttctctgacagaaacgttccctgatggggatgtagggtttcctg

SEQ ID NO: 99527 - DNA, 1035 bp, Homo sapiens
agtggcagtgctggctggagctgactccgccttcctgaacagcccacgtccctggaacaggccacctgcctggaacacactcagggtctggggtctcctgggcagattgctcaggcagccccttcctagcctgggcagggaccccagggtcacttctcccctctagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcagggtgagtccctgcagctgatgggggcggcccaggggctggggtgcaacagcggcccagccctgacctgccccctgcgctgcagaggtggtgatgagcctgtccaagtgctactcctccctgctggactcgatgaacgctgagatccgcatccgctggctgcagattgtggtccgcaacgactactatcctgacctccacagggtgcggcgcttcctggagagccaggtgcggtcacctgcccagggggccagcctggaacggcctagccgtgcggactgggagtcccacccgactccctagtctgagcccttggggcaggccaggcacattctggagaatggggcggggaagacgtaggggtctgttgggagtgggggcatgcaccgggtgcaggtaccagagggcagcctggactccaccagttcttggagaaactgtggaagggaccagctgggagcaggagtttagggtccaggccaccacagcctgctgggccctgggccttcagcgtcctggtctgggcagaggggacgtcccagctcctcagagggaggccagagccctcaggcccgtgggccctggctgccctgctccctgtatgtgctccctccagcccaggttccctggagatggggcct

SEQ ID NO: 99528 - DNA, 1920 bp, Homo sapiens
ggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacaggtagtgccccgaggggctgtgctgggcacgtgctctgcctgccgaagtgaggaggctgggcaggtgcctgggttccccctgcccaggcccagtttggttctcttcagcgtggagagatgattctgtcccaggagccgggaggagggtgatgattctgtcccaggagctgggaggagggtgggcttgtgggaggggctggctctgtctgtggccgtagctgctgcttagaccctgccagggttcatgaggccaccatggcgggaggccagcgaggagccgtgtcccacagctgatgcctggtgttttctcactagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtaactcagccccgtctggctcacgctcggttcagcaggtggtgtggaggcccatggaggtctgggttctaggactggctctgccgggacacatgtgactctgccacgggccccaccagtctcccccctccttgggctgttgcacggggttgacgtctgctggtgctcccagacccggctctgacctgagactgcaggtctttctgccttgccgtgtgcctcattggccaaaggaaagcaacagagtctgcagccagggcaggacccgcaggaggggcctggacccggggggctcctggcagcgccgtgcctttctgaggcaaggaggtagagccagcggctgaggacctgtcagggccagtcccagctctgcagcttgctgtgtgacctggcacacatcctctccctgcctccctcagtctcttcccctgcaagacggggtcctgacacggatctcatgggattgctctgaggcccaggcagtcccaggctcaaccactggttcacaaagtgtgttgtttccaggaagaacagatgggggcgcctgagggcaaagggcctgagtgtgggtcgaggatatgccggctgctcgctcaggggctgggttttcatcttgtgtgtcttgacagggtgtgacacttggcaccacactgttccctgtcccttcatggatgtggcccacatgatgttcctttcctcttgcaaaagaagttgctggaaggcccactgtccagcagcccccaggttgcctgggccacggtgcctttgtgggcccagctacaaggaggacttgcaggctcgtgtctgggacagatactggcgccagggccaagtgaagcccgggattggtgggcatctctagctggtccctgagagagggtggagggtgctgacaggccttggcgctttcatctgtcaactccagaggcccttgtgcttgcagcagggaggtcaaggccagggcgtctgaccccggccgctcctccacactgagcctcctgcacgtgctcacaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgc

SEQ ID NO: 99529 - DNA, 1023 bp, Homo sapiens
ccattcacagccaggagatgctgggccagttcctccaagaggtgtgtatgcagccccgccagcccggctcacctgcctggggctgcctggtggcctagggtctacctgcaacctcaggcaggtggtttctgcctgggacgtgaggtgcccttgactcttcctgtgagagccccgggcggtgccttgaagggcagggggagctgaggctgcgtcccattccctggctgcactcggggtggggtgtgagaaggggcgagtgccaccgctgcccgggccccccatctgtctttgcaggtctccatcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggaggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatcagtcttgctccaggtagttccaggctgtgcctgctcttgccaagcaggctgtggggagggctgggtgcctgccgagatggtgaggatgaggatggcctctggaggggctgggggcctgggaggtgggcagagccaacccaggcagggcaggtttcagggggagatggtgagtggggaggaggggagaagtttggaggggcgggcccagggcatgccccaggccagggggctgaggttgaggctggccggggcaggtcaagccctggtcttg

SEQ ID NO: 99530 - DNA, 1054 bp, Homo sapiens
accagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacagtcccatgggctctgctgtggctttatttgcgtgttacgtgtgttgcagggccccggaaaatggctgtaggtgcatgcatccagcgtggtccagagacagtacccctctcccagtgatgaggcagggaggggctggctctcgaggtgggcatggggaggtggtggggaaggtgtcgaagactgagtgtacacagggtgctggtcttggaggatcaacctccacctgcctcccgtgaccggttgcacccctgtgaaccagccccaggcacctccccagggacacagcacctaccaccctcataccaggccactgcacccatcccaggcagcctcaggcctggacccttcagagtctctagtccatggggtctgcgcctgggcccagat

SEQ ID NO: 99531 - DNA, 2287 bp, Homo sapiens
ggtgggttcctggcctgctcaacctctgcccacttggggtgaccacagcgaagctgccatttgcagggggatccctcacagaacccaagcactcaccttgtggcttctggagttgttctgagatgggaggagagcgagggaggagagtcaggcctgctggcttccttgggttcccagggcacagccgagatggccatgggacgccgggctggataacttcctatggaagaggcctacatggctctttgggccccagggtggaccaaggaccaggggaagcccatctccactccagaggggagacagcttcacagatgggcggacctctaggatgggtgggaggagcagccacccatcaggtaggggtggaatgtccacgtgccccatgcagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtgaggcagcctcagaggatgaggcccgcacggtggtgtccatgtggctttgtgtgcagagcaaaagctggagagggcccagggcctggtgcctactggggggcagcacagctgcttgggagtcacagccacctgcaggaggagcatgtgatgctccagtgtgcactgcggggctgcgtggtgtatgacagaaacatggccagtgtagcacagaggcatgctctggaattagccgaggaagactatcgggcatatagacagaggccagaaagggacccggaaggagagtcgcggggctgggctgccctctgcggctttgatcagggaaaccaacatgcagcatctaggcactgcctcgggccgagtgtgtgtgtgacacgtgacgcgtgacgtgtgagatgcgtgaggccagggctctgcccacccctcggccctctcctgaggcctccagcactgcaaggcagcacagccctgccccagaacctggcgcgtgagatggatgtgtctgagaggagcagcttgcttgctgcccatgaaggtggcagggctggggtgggggctgagggctgtcagccccggggcgccagggtctgttccctcatttcacagctgagggctgtcagtcttcagtcttagcccaggggagggtgggctctccggggtctgcccagagggtcatgctgctgctgaggctgagcacaactccggaggtcacccctgaggtgcagcaggtaaggccttgtgtcctgtctgaaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaaggtgggtccagctggtgggcagtacagccgtagccccaggccctcaagggccctgagtcatttctgggcaactccagcaacccggccttgcccatggctgctctggttagcaccaccaggagctaggagcttgaggggtccctagggtccccttgcccactgactgcaccccacctgcactgaaagttgggtgccttttgcagcctcccttcccaagcgatgaatcactctcttgaatacctgtgctgatggggagctcaccacttccacccacaagtggctcttttggcggctgaacgggcctctgggaaggcttcctgcgcctcctgcactggaggcagcacagcctctggccctcacaccaggccctcagccggtgcctgaccctgggagacttcctgggctcacccgatgacctgggcggggtggaggtgctgcccaccttgacccactgtgctctggcgtcggaacccacctgtgtctggggaggggtgggtagaagagcctgcaaggctgtctgagcagggtcccgggaggcctggcccctgaccacgcgtgtgctctgtccacagtgcttgcgcctgctcacgcacacattcaacagagagtacacacacagccacgtctgcgtcagtgccagcgagagcaaggtgggtgcagaggggctgcaccaggctgccccgcagggctcgggctcccataggcagtggtccctgaggaaaactcccattccaagtgggaaaaggcagttaagagtttcctaggaacacgtctcagtgcagagggacacctca

SEQ ID NO: 99532 - DNA, 2776 bp, Homo sapiens
gctcttctttccctccctcccttcctccctccctccctccctccctttccttgttattatcatgactttttggtgtaagaagaagcaggaacattcctcctctgtgtcttgcttagccttccttttccagcagtcaggaaggccggtggtttccaggctaagcacctgcatttgtcagtgtgtgtatacgggggtgttcactgtggccgagagacagacaagaaagaccgtggagcagcaactacacatggcacctgggttgctgaggaccctgtagggcctccctgttccccctggcaccgcctttgacagacgctctagtgaccatgtggggagctggcttgctgacaggacccccacctgaggcagccccccagggtcccacctgccccctgggaagtgacctgtggcccgttgccttttctgcaggccgcatccgaaacactccagagaccgacgagtccctgatcgaccccaacatcttgtctctcaacatcctctcttccggatacatccacccagcccaagatgaccggtgagtcggagactccctggagacagggcccagggcatgttcccagcctgccaggccctcagccaacccggcacagggttcagccacacaaggtgacccgctcaacgctctcccggccctccctcctggcacctgcaggagctgtgcggtgaggggctggtggcctctgcacccccggctcctcgtttgtgcacctcgttgctggttcaggcatccccatgcccatttgtttatcaccaagcagaggggccagcgcaggggttggaagatgagctgagttctgtcctcgggagttttgtggttgcgtggtgtggggacaagtggctgtatgtccaaggaccatgctgctgtggatgagtcagtggcctctggcaggcatcctggggctagaggtggagcagctggggtgggcgcccataggcactgcttggcacaggcccctcatcaccaggctgctccttcctacactccttgcacggccaagaccccacagtctgggcggtcccagcccgaccgcatttaggctggggttttggcgctctgggatgtctgtggcagccctatcggggtctgctggggttaggggatgggagagggaggcagcccctgcggttggcctgggcaggtggctcagcactgccaggggcagccctggtgggtggggacgtcccgcgggctccactgcgtcccagacgctgccttccaggggcttggggaaagtgaggcgggggctccagtgtccagtcctggctgctccctgggggctcgacctggctcatgatgcacaagcccagagtggaccctcagagctgaagccgcaggtgtctccatggctgtgtttgtaggaaaacgtctttgagggcctccctgcaaggagggtcagggtcataaggaaggagggtcctggcgggcgtcgtctcctattcttctgacttgggtccacacaaagctttggtttcatcagcaacacccagaaagtgggctatcggggcttagcactgcagtaaggagggcactgcaggggcagccagggcagggggcagctggatagtcagggtgggcacagcgctgaacagtggggggtgggggttgggcacagacctgggcagggtggatgcagctctggtcccagccctgcctgtggccttccagagggaacttgccctgcactcatgtccataggagggtggagaatccggggggtgttctatgtggaggtggtgccatgaggggggagcacgtctgggagagggagaggtgaggcagaccaggtgggacgggccggggcttggggcttccccgtgccttgcttctcctgccgccatgagaatgctccctggtgaggtgtggagaaggcctggagcccccagcacgggcgctgcctgcagagtgtgggctgctgtgcctgggccatgggggaccaggaattggagtagggggtggggcccggaagggcgggtctgccatgtgagatgtgctttggagcctgggagatgacctcattaccttattttcctgacctctgacccccctcagcccaggcagctcctggggtggggtgggcaggggctccagccccccaaccccacctgctatctctctgcacagagggctgagtttctgaggtcttcctcagaagaccagctgccatgggtgacgtaggagggagcggctcatggctggacctcaggccaccctgttcctggatgcctgagaacctgtcactgaaggggctttggccccacaccctgagggctgagacatgaggccggtcccagggtgcctctggggttgaggcagccctgttctggggtcaaggccctgggtctgagaaaggaggaaggcgcgttgcgtgggcgcggcctccccgaagcggctttggccctcgcttggctcctgcccgtgctggcagctcccacccctagccctgccctggagcagtcttggggactgtcctctgctggcacccccaggcaggcaccgtcctgtggcttggctgaccaggccagtgggccttcctgtgccatggacggtgctggcgtcctcagccccatgatgggccgggctgctccaaggccgctctccctgacgtgcggaggctcaggatccccggcttctggctccagcctggggccttggccttccatgcgcttttccatggccttgcctcctgcccgctcccaggccccacgctttgcagcctccctggctcagagtgggcctgtggccacaggccgcttc

SEQ ID NO: 99533 - DNA, 1036 bp, Homo sapiens
gccggtcctaggaaagggggatcttggtgctctgggtctctgacagggcaggctgggccgcaccgtggccctgggggtgtcctcagggctccattcagcacctccctgggccctgggctgggggtgcctcatcttggccaactcacctcggagctcccacctgccgagtttctgtctggggaaggggttctgcggggtccgtgagcatcagggacccctgggaagtgggcaggaggcagagcgatgctggccatcagtgccagtgtgaaaaggggggcagtgcagtgtggtctgggtcctggtctggcccccgtcctccttgaagcaggctgaaacctccctcctcggctgctcccttctcaggcagccaggtccgggcccagctggactgtgcctctgctctccgcagctcattcctcgtcctcctctctgtccctccacctcctgtctcctgtgagtgcctgccctgcctgtccccgcccgctcttgctgtcctggccttggctgtcctgtccggcggcttccctctgctttgcagctccatgttgtgtcgtgagccaggccatgctgccaccgctgccgttcagaacatgcgtggaggggtggcccatgaccgccgcctctgcttctccccagggccttcgtgtacctgagcaacctgctgtaccccgttcccctggtacaccgtgtggcaatcgtcagcgagaagggcgaggtgaagggcttcctccgcgtggccgtccaggccatctcaggtgcgtgtgggccaaaggccgtgtgtggcattggagcccctggggctggctctgacctttgcaggcagaggcgtgggcccaagaagggccttctggcatcatgtagtggttagtgggaagctggcctcagctggccctccactctccctggggtcaacctgaagctgtttttccacgctgtcctgggctggcgccccgggctgctgccccgcagtgggccctggaggggaagcccctgctgcccagctcttggctctggactccccagggtcagctggagg

SEQ ID NO: 99534 - DNA, 1045 bp, Homo sapiens
gcccccgggccctgcatccttgcagtggggctgctcacccatcctggagacggtcgctttgggccggcagggaagagtctgggttccaggtacagaagaggtagtgcaccccggagcttgcagctgtggccccaggcaggtgggactatttctgcagagaggccgtaggaaccccggagtggctcaggcacccaatggccgagttcctccctgaaagtcccagtgcagggcccaaggggcatttgataggtgagggccagccgcccccaagcaggatgcccgtcctgtcattctcctgggaatcaacactgtcctagcggaggcagcctcaccccagctcagctgtcatccagaagagacagaggctcccggctgctctcagtgctctccactctctttggggaaaggagctgaactcagaggcagccatcctgaggccacttttaggagtgggaggcagctgctaaccctcccatctccctctgaaatgatggggcctgggcaaaacatgcctgtctaaaggtgaggactactccatccctcctgacctcctcggttgtcatggccagagatggcggcatgtggcccaatgccctcatggaatgtgccctttgcagagagaagctggttatcacgttgcccaaatggatgagaagccacggttgggagacagaatggaggctggggaagcccagacccagggagcagacgtcccaccctgctggcagatttggcaaatccagctgcctttctgttatcatggaagggaagtcaggtgaaggaaagatctagaaacctggctgtagtagtcagaaggtcagctcacgaaacagctgaatttatatattttacatatatgaatgtcataagataattcttaatagcaacctttttttggcgattaagattgcttccctgggctaggccagtggaagttttcaaaagtctggagcttggagcagcagtgctgacagctgaaggctaagggtggccccagatcgcagggtttacacgggctttactctgtccttgggtggagatggtg

SEQ ID NO: 99535 - DNA, 1050 bp, Homo sapiens
ggtgggctgcccactggctgtaccgtttcctgttggagagagtgtgtcacctcactcatgacggggacagctacttgggactcagcacttggctctctgccggccccgggggtggcatagcagccctgcctgacctggccccccagaagggtgggcagtgagggagcccagacctggccaggtgggacttggctgctcacgggagacggcggccgggtgggcaggcaggaagtaggtggtcccccctggcggctgtctgaaaggttccagtgaaccattgtggggcaggcagctgaaatctccagaaggtgggaaggaagcctttttggggacctggcaccctgtcccccaaggagctgacgagtggtcatcttcccctgtcacaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggtggggctggagggccgctgggtggatggtgggagggtcctcctgggcagggctgaagccacaggagcggtggtaggcacaggcttcacagcgagtacctgcagacaccgctgttcctcctgttccaattattttaaaatcagaagaaaaatgtgaatagagtccagccttgtagaatcctcattctctttctaccaatgcagcaatcatacataaaaatagatttggacattttctttcggaggaaaggacagatgaggggaatgctccctaggcccacaggggtcaggacggtgcagtggaggggagggcaggctgtggcaccgacagaacaggctggcggagcgccaagagcgggtacagcagggcctgaagggtggctccccagagggactgggagaggtggtgggggatggaaggaatgcccccttgctcctccattcaggaagctgccgggaggtggatcccttagctgagcccagtgg

SEQ ID NO: 99536 - DNA, 1066 bp, Homo sapiens
ttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggtgaggcggaggccacccccaactgcctgctgcccctcctgccctcccgtgctcaccccaatgcccccttgcaggctccaggaactggaggaccagtaccgccgcgagcgggaggaggccacctacctgctggagcagcagcggctggtgagtgacgtggccccgccctccctgcccagcccccacccacaccaggggacccctgtcctcccacgcccccactcctccctgcttgcctggccccatctcttgcatctaaacagtgggatgtggtgaggcccactgtctaggcgcagtgtgagaggcccaggcaggtagggccgtagtggagtcacaggccttgctttctgcaggactatgagagcaagctggaggctctgcagaagcagatggactccaggtactacccggaggtgaacgaggaggaggaggagcccgaggatgaaggtgaggggtcactgggccagcacctgctgcgtcaggagggtctcagcatggaggtgggcagccctgggcctctccctggaggtcactggtcagcacttttgccctggggtctggacctgtctctttagggaaagacctccttgccctgggaagcaccgtggaagcagcattgggggaggggggatactgtgccacagctggcaagcagctctgcacactcacgcactggcgtgtgtacacacatgcacacattcacgtgcacacatgtacacacgtgcacacacatgctgcctctaacaggagtggctggatgatgatggggaatggggctggtaggggctcaccatgctcatgcgtccactcttcccatcctgctgaccacaaggctcatggggcccccgaggaagagtccactgtgcacatcacctcaggattccctcagtgagcatgtgctccgggggccaacccagctgacc

SEQ ID NO: 99537 - DNA, 1063 bp, Homo sapiens
gaccatggtgcagaggggccagtcccatcagcagatgccctaacccagtgaccagatgggacacgcatgggcaccacccaggccacggtggccacaggcccgctgcccccattggtcagccagggctgaggccagtgctggaagccttgtggagcttgtgctgacctcagctctgttcccccagggaagccctgctggccgagatgggtgtggccatgagggaggatggcggcaccttgggcgtattctctcccaaaaaggtaggagctatctcagttctgtggtactgccctcatctgaacaggaccaggtgaggtgctgtctcaggtagagccagagggggctcctggaagtaggggagcacggtggggctctggcccaggcactggggctgtgaagctcacccatagtcacactttgctttttgtggagaattctgtccccacattctcatggtggggcatgctggtggctttgggacatcagatgggtctcttagtggcctggagtgtggactgggctctccaaggtcagagcaaggctgaggagccaacacccaggctggagactgagacacgaggggcctggacctgccctggagcctgggctgctcacagagctgggtgccagctgccttcttggaactcagctagagtcaggtctgactgttccagtggggacccctcttttcccaccaggccaggcctaaggggtctttcagctggaggccctcacatggcacagaacccctgggcagctgcttcagagtgtatatgactcctgtgcccccatccagcagcccaggtggggcatggcacagcagcccaggtggggcatgacacacacacttgggaaaaagtctttcttgtggttctagtccccaacccccacacacccaccccaaagatggccaggacatggggacagacacctgtgtgtccatagcttgggaggggctgggcagggctgtgctccaggccgccggcccagcacgcgctgaggtccggagacaggaagggcctgagaagagctgtagggagattccagtcccaggcagggccgg

SEQ ID NO: 99538 - DNA, 1949 bp, Homo sapiens
cgcccagggtcttggcgacatcactgacagtgagtgcctgctccagcctgtcctggacagggttgtggggcctcaggctcaggggcctcgcaggtcatcacatcctctctcctggggccaccactttgctggctgcaccctgggctgtggcagctccacaccgctcccagagcccctctgggccaaatccctgtccctgctccacgttcctgggcagaaatgcctctgggtgggaggccgggcgggggccctggacaagggcaagtttcctggccttggcctggatggtaccacatggtttgggttcaatgctgatgcaagtgggccagagacggctcccctggaagccccataggcaggctgtgggtgctggggtcaccgaggtcccccgcgttctggagctgaagaccttcaccaccctgcttgtggccacacacccactgctggccaccctggcctgtgaaaggcgtgcctgaccctctggagacaaacctgttcttctgtttctctgtctctccccctcccccacgcttccctcccccatagccaacactgtgcctggaggacccaaatgtgtgtattccctttgctgctctctgcatctctgcttccagccccagccagcatgagggcctagggtggcatggtcagggaggggtgaaccccagggtacctgctctgctttcttctcctttttggggggcagaaagcactgctctccctcagccacagggccctgctcgtagatgtgggattctgtctgcctctgagcccacactcctggctccttcccacccatatggtctacatgagaaaccaaagcaacgggggagtcagggtgtcgctgaggccttctcaggctaaacatggccgagatcaggtcctctgaccccctgtgcacccaaaggcctgcgaaggtcaggatatcagcaccaaagggccaggagggctggagggactgtcctgtccccagctcttggctcaggcctccatctgcaatgccatttctccagctgacctgaccccccacgcccaggccctcaactctggaaatgccagaagctcagctttcacagcggatactgccaaatcccacccaacctttgtgcctcctggcctcgggtctggctccatggggctcagtgcctccccgagcttggctgcagggcgccctccacttcccccacaccccgtgtggtcccgtgcttgctgctgctctgctgtgtgttcgcttccgctaggagacccctggcaccacccacttcagagatgtcacagccccacctcccgggccttagggatgcatgaggcctaggctggtgggtgagctcctcgtggtggaggggaagggcctccctcatgagggtcccatgttcacctcctccaggatggtctctgggccaatttccatgtcagtgggctgaaggttagcacagcctggccccacagctcgggggtgtgtggtgtcccaggctgacggtggatgtgaggggtgggaggacaagcgtgggggtctgcacggggcgctgctgggtgaccacgccaagccagtggacagggtgggaagatgcagggaggactggctcccagccctcaggtgtgggggctgtagggtggcctggcagtggggcctggagtgcagctgtgggaaagcaagaagcctggcgcagggggtgcaggggagctccagagtgcctaggtctgtgccatgctgctgctggggagggcaggcctggggggcaggcgggcaagtgcgcgccactgctggccccgtcccatcgtaggcaaggggtggcaggaaggccttgcatgcgcttgtcctgggcctggcagggctgctgtgcctcgttgatggtttctgtttcttgccttctctgggccccatctcttactttttcccatcttcatcttttttctctccctccctctgtctgtctgcccgccctacc

SEQ ID NO: 99539 - DNA, 1025 bp, Homo sapiens
ctcaagagaaagaacacagtctgttcctcatgccacgcattacctgatgctttgatcctactaacctgggccaggaatctgatgttaaatactgaggaatatatttcaaatgaaaatgatagaagtgcttgaaaaaaatattgaacataaatggtatttattttggagtaaatactttaaaaccctccacaactttcctctctgctttggggaaaggaaggcctgatggttgtaaaatggccccaaatgtgagaaaaacacaagtaaaagagaaataatagcggtgcctggttcagagatgaaggagcagccaaggaaggccaggtccttgctgttgtctgtgttcatggggtgggggtgggggggggggtaagcctgtgactcagtttacctctctgggcctcagcctccccatctgtaaatgtggggggaaggggggagcagacatagccctggggcctagatccccctctgggcacaacctggtcttcttcccacaggcggtaactcaaggacagctatggtggcagccttgagtcctgcagacatcaactacgatgagacccttagcacgctgaggtgagttctccagggagacaagctctgcttcccgctccctggtcttgggggatggatcctctcgtgcttgaattaggaagcaccagtgaccaggggcgactctttgtgaggggtataccctggactctgtgaggctggaagagactgttctgaggctcctgggcctgcataggccctgttctattccctccatggagcctttgggggtgtgctttggggctgcaggcagcccagggccccgtggcaccagactgggagagctgtgcctgctgggcgaagcagtttacactcacctgccggccggggtaaccactggggatttttagatagcagaggggacataggtgtgtcttatgggcagggtgggcacctggggtggggagcctgggcccctagccatgctagaggctgctcggttgtttgggtcagtggtctctcccttcttt

SEQ ID NO: 99540 - DNA, 1120 bp, Homo sapiens
ggcagggaggtaagcgtggcagaggccataggggcctggagggccacatttagctgtggggccttttcccttgggtcaggagtcgctgatggtgttcgaggaggggccatggactcagatgagtccttcagacagagtggagggaggacacacttgctggtgacatcagcactcctggccggtgtccagctgggtggcccaggggcagcagggatggaagagggaggaacctgaaggacatgctagcaagtccctgactgtggcctagaggaggcctctggggtggcggcctggggtctgggcagggagaggcctgggcagcctgagaatgtgtccagcagagcgggccccgccccttgcccagcctccagctttgaggacccacttggcagggcctgcgctggcccctccctttcgcttcctctgcagtgggctcgggcttgaccttgaatgttcctcccccacagaacaagaaaaagaagaagacagatttcattccgtaccgagattccgtgttgacctggctcctccgggaaaacctgggtgagaacttgtgggtttgcctgtccccagggctctgatcccaccctgggctgtgcccttcttccccactgagggggtgcccagtcgccagcaggcctctcaccctttctgggctgaggctgggaggtgaacctggagggtccagtcagttcgtggcccttctggaggacctggggcaacggccagcagtgggttaacgaagcgagtgtgggaaccaggacagcccagggggtggcacagcacacacctgcctgtgtcagtggtcctgggtcaggtgggctgtgacacccaggccaagtactcatccttctctgggccttggtttccccatcagtcacggggacctgggacgcgatctgggagctctgcttgctggattttgaggggctgccataaacctcctcttctccgtctgagttctgagcagtgagacttagacggggaggtgggaattgaaatgcacccgacgctgatcccgtccatcccggaataacctcagagtcctccccaactgcatttacagctggagaggctgatgcccagggaggtaaactgagtcttgggctgacctggtgaa

SEQ ID NO: 99541 - DNA, 1117 bp, Homo sapiens
tgagttctgttcggatggtgccaatgtgagtgtcccatacctcaagtggacaggcctcctccagctcgggccaacgctgagcaccattctgtcctacccacttcgtacttccaggagtcagtcccgttcctctgtccaagtcccggtccagagggactttcagggggtagcaccgacagcatggctgcccctcccaccagtcaggtcacccagtgctgccaccgaggtggggaggccttcctgagcaggtgtggaaaacgcagtgggcgctgtggatggtgttggcagttgtggggtgggaggcgcactagagggcatgtggtggaggaggccctgtggatggaggtggggagggatgatgacaaccatgcagaggatgtggatggtgacgacgggaagctggggaccatggggaaggtggtggtggaggcagtgctgctggtggtggggttgaaggaggtggtgttgacggaggagttggcagtacaggtggtgttactccgggcagcacagatggcagaggcgatgtggctggcagtgggttgaggctggaggtgggcgagggtatgagagggctgatggtggaggtggccgtggtgacggagctggaggggactctacttgaggctggcccagcagttttctagatatgatctggggtgtttcagggaaccaccaggtaccagtgcaccgtggcctactcagggcgagtgctccatgcagttaccaggtgcatttcattccctgggctgccataagggcttggcctggggtcacactctgggagccatggagacagaaccggcactcgggcctgttccttcagctgagctgagcctgctgtcatgagtccctggccccaggagtcccactgggagtcctgtttggagagtctgagcctgagcggccagcccccagactgcggagaggacggcagggaggggcaagcctgttgctagcccgcctaggagggtcagcgaagaagcaggccctgccctgagcgcctgggcaaggggtccagcctcctggctctgggccgcactggcgtccacggggggcggggctgaaatggcccaaggaggggctgcaaccttcgcaggcccggcgccccacttgg

SEQ ID NO: 99542 - DNA, 1060 bp, Homo sapiens
agcctgaaagggtgggcaggggtcacacaaggtgggcttcggggaggggtgcccccactagagcggagggggatggccaggggccagcatggccggggaggctgcaggggccaagtaggggagcctgtgctcggcctccaggcagcggggagccccataacgtttctgagcagcacctctgcagtgagatacacatgcttccatcctggccccacactccatgccactggctgcgcatccatcagtgacacagttcagctgccgacctctctgtgctctggttttcttacttataacagggggctatggttggaatgtttgtgtccccccaaattcctatgttgagatccgaactcccacagagatagtgttagcaggtggggcctttggaaggtgattaggcaataaaggtagagccctggtgaatgggattagtgccctaagaaaagaagccccagagagctgccttctgccatgggaggatacacaagaagatgccatctatggcccaggaagtgggccctcaccagtcactgaggctgactgacagtgccttgatcttggacttcccagcctcaagagctatacaaaatatatttctgttgcttatgagccactcaatctaaggcattttactgcagcagctcgagctgaccagggcactggctctgacctgacagggtgctgggcccaggtgaatgagttgctggtcacagtggtcagctctgcgctgtcattatttgctactgggaagaatgtgaccagaaccatgcttttagaaaagaccctctggacttcccctttgggtgaagcctggaacgggcactaagggggtcccagactggcagcacccctgccttctacacagaggcaaaggaaaaccctctctggaggaagatggcatcatcttaggcctcaagttattcctgcaaataattttacaaatacgcagtccaggacacagccaaaaataatcgggcacccaaggaagcatgataccaccaagaggaatagacagaaatgagagaaacagcagatactggaattatcagactcagaa

SEQ ID NO: 99543 - DNA, 1052 bp, Homo sapiens
tttcattcttgtttcgctgtatgtaatgtggctttttcctctggctgtttttgaggttttttatcattagttttcagcaatttgattatggtatggctttgcatggttttcttcatgcttttcttggaaatgtgggttttagttttcatcaaatgtggaaaatgtttgggtattatttcttcacatactttttctataacactcctttccacacccatctccatcctccttcgcagactccaaatacgtggatcccaggctgcttaatattgttctccatcctcctttgcagactgcacatacatggatcccaggctgcttgatactgttcttcatcctccttcacagactccaaatacgtggatcccaggctgcttgatactgttctccatcctccttcgcagactccagatacgtggatcctattaccctaatatcgttctgcaggttgctgaagatctcttctttttcttttagtcttattctctctgtgatgcatattgaattgtttctgtttcactcttcaggttcattgatctttccttctgcaatatctaacctgctgtaaatactattcagtgtattttaaaaactcagatatatttttcatttctacaagtttttaaaaataccttctacttctcattaggtttttttcccctcaacaatcttgattataggagcatattcataatagataattaaacatttgtatctgctaattctgtcatttctggtgcctgtttctattgatctatttttctcctgactgtgagttatatgttacttctttgtagacctgataatttttgactgggtattttggagttctggattctgttgtattattgatatactcctgttgaggagtataggattttattctggcacatggctcaatgacttaggatcagtttgatccttttaagctttctttaagatctgttagggcaggtcgacattagtctttagttcagcactactaaagtgacaccccactgaggactctatgcaatagactcccagccctgtttgagctccaggaagtgttt

SEQ ID NO: 99544 - DNA, 1052 bp, Homo sapiens
cttctgactctcgggagagctggcacctggggaagcctctctcaatagccttcctgtaatatggggctagacatctcctcttccccagtggagtaagctcacagggggaaaagcacttctgcaagtatacaaacaccatgtggtatcttacctaagccccaacacaagctattaaaatatttaatgcatacataattaggcatgtgtaatgaaatgtatcactactatacgtttgttagtgtatagatgagatggttaatcacttgcatcacgtatagttatatagaataatgatgtgatgctggcagtgatgacaggaaggcgtttctgtatcacagctcagtcctgcctcgtagaagacggaagggtgaattctgctaaaatcgagaaaaagagaaattccagggaggggccctagagcccactctgaggaatcaagatgcccacagagtgtattttcagtggccttggttccagacaggatgtcagggtaaccctggcaggcaaggtgcccgccagcctcttgccgcccgcacagatgcggcgtaagctccaggaccaccctctgtcccccgcccccagccctgccatcaccctgcgactcggacccctgcttcaacggaggctcctgcgatgcccatgacgactcctacacctgcgagtgcccgcgcgggttccacggcaagcactgcgagaaaggtatggcgggcaggggcgtccgggccggcgtcagcaccctggagagcgcccgcggtccgccgtcctgcttctctgctgtctctctccttgtttcgcgaattgctgacctcgtctagagccttgcctgatgtgctgctctgttctgtgtatttagaggtgagcacctcactgtttggatggttctgatctgcaccagtgccaggcctgctggtcattaccttgctcttctgaaaataggcttcattgcctgctcagcatttttccaaatagattttagaatcattatatcaaattttatttttaaaatttccataggattttgctcaatctaattcagcatggaaaatgtcgaa

SEQ ID NO: 99545 - DNA, 1577 bp, Homo sapiens
ccctccaggtggacttggaatctaatccttgtgagactatgaaatctatctctgctttacagaccagtccctggcttctcatgcatttgtaatgatcctgtgggtgagacctggtaggtgctgagaacttactctctgcatctgtggcttctcttgatttcaatccattgtgcttgcccctgcagcatgacaaatttggctggaggatgaaagcagccaacagcctcaacttctctgcctcctcaactctttaataggtgaaaagataggatttcataggcttcatgatgttcctttaacattacagtgacagtggtggtattctgtgactgtctacaccctaaccaaatggatctcttcagtatttaaaaaaattcactgtcttatatctgatattgctgttgagaagtttgatgtcaagctgattcttgttcctttgtacatgacctgattttccctctggaagttaaaactttttctgtttgtctaggatattctcgtattttactataatgtgtctggtgtttgtttcccctttgctcctgtctgacgttctgtgggcccttttaatctgctgttcatctggaactctgggaatttaactccctagccacttatcctttacattttcattttctcttcttcttgggctccgattatctcagctttagcacaccttctaccctctacagcacaaatattttttcttttttttttttgagacagagtcttactctatcacccaagtaggagttcagtggcacgatctcacctcactgcaacctccgcctcccaggctcaagcgattctcctgcctcagcctcctgagtagctgggattacaggcatgtgccaccacacccggctagtttttgtattttaagtagggacggagtttcactatgttggccaggctggtctcgaactcctgacctcaggtgatccacctgcctcggcctcccaaagtgctgggattacaggcgtgagccacagcacctggccccaacattttcttttttatttatttatctttccctgcttctttctggaagagttcttcaagctgatctttcaactcactaacttactcttcatctgcatccatttataaattatgtctgttatttcaactattatagtttttaatctgcttattcccactgtttttaaaataatttatcgatcctgttttggatggccaatgccatgtttactttgtaaatttgtcacggttattttataccgttaatccattttctttttttgtatgaggtggggtcttgctctgctacccaggctggagtacagtggcaggctcatggctcactgcagccttgacctcccaggttcaagtgatctcctgcctcagtctcccaagtagctgggactacaggcatgtgccaccacgccgggctagtttttaaatttttttgtagagatgaggtctccctatgttgcccttgctggtcttgaactcctgtgttagtctgtcttctacacttctgcttccgatcatacatattttctggacttttattattgttttctgaggcaatcgtacttttcaggtgtctcgat

SEQ ID NO: 99546 - DNA, 1051 bp, Homo sapiens
tgttcatcatttctttttaaattctttttgtggcttaaggagtctttcactaccccaaagtcaaaaatatatttacctatattttccacacaaaattatatagttttttttggttgtttttttttgagacagggtctcaccctgtcccccaagctggaatgcagcggtgcaatcacagttcactgcagctttgaactccggtttcaagtgatcttcccaccctagcctcctgagtagctgggactacaggtgcatgccactacgcctggttaattttagtttatttttgtagagttgggggtctctctatgctgcacaggctgggctcaaacaaaactcctgtcttggcctcccaaagtgctgggattataggcatgagccatgtgcccggccctgtatagtttttttttaaagaaacatttaggtctttaatccacctggatttaattccagtgtatgaaaaatagagaaccaatataatatttttccaagtacaaaaccattgtattccagctctcatgaatattttctcatatgcttttgtatttctttcttttagaagtttatagttagggacgggcatggtggctcgcgcctgtaatccagcactttgggagcccaaggcgggtggatcaccagaggtcaggagttcaagaccagcctggccaacatggtgaaaccccgtctctattaggaatacaaaaattagctgggtatggtggtgagtgcctgtaatcccagctacttgggagactgaggcaggagaatcgcttgaaccagggaggcggaggttgcagtgagccgagattgtgccactgcactccagcctgggcaagagtgagattctgtctcaaaaaaaaaaaaaaagtttatagttttagcttttacatttatgtttatagttccttttacgcatttaaaaatttatcatgtttttgatgctattaatgtaacactttcatttcaaagtgttcactgctacaacaggttctatatactgaccctgtatcctgggatctagttgaattcacttgttagttctatagcttct

SEQ ID NO: 99547 - DNA, 1143 bp, Homo sapiens
gtgagcaggggagagagcccccagcaaggtgtctgaggagagggcaggcagctgcccgggatgcccagtggtgggcaggtgagatctggagtacagaggggggcccgttgtacttgcagctatggaagcggatatgaagtgcccgagggtgcggttgagatccctgcataagaagtgatgcagttgggggcgagggcatgaggaaggtcagtacagactgagggcagctcagaaagagcagggggtgccacagcctccaagaagcaggggtggaaggagaggaatgcagaatttgaccctaagaagaaagcaaccgcatcagccgtgaggatggggcctctcagcatgatcagtggtggctgtccctgaagcagctctgagggggccctgcaaggggaaggccgagcccctccagagggtcagcaggagggtgaggccagcccttcaggggaggcagctctggggccgacaggtgctggggccacgcagggagcctggtccccaccagggacatccgtgctccctgagatatagaagcactcaaaagggtggccccaggaccatcccgggtgcaaagcagctgcgccgtgtggtcaccgcctggcttctcctagaacccacagcctcggcgcagctcgagaacatggaggaagcccccaagcgggtcagcctggccctccagctccctgaacacggcagcaaggacatcggaagtgagtcagcagcgctggtggggactttgggactgactgactgctctcaggggccttagaggctgcaggcaggagggaccacccacggtgaggaatcaggaggcacagagcctacctgaggggaggctgagcaccaggcaccccggtgtgggaagatggggtgaagctacaccacccaagcagtgggaccccacagacgggaacaggccagggggcaggacccacccaaaccacccagagtctgagctagagagactggctttgatgctgcctcccctcccctctcctccttcgcctccacatgcagcagagcccaccccagcccctgcctctgggcccctcacccctcacttctccaaagaggagcaggcggagtcaggatgggagaagcagagggagcagccactgggcgagccccagcttgaggact

SEQ ID NO: 99548 - DNA, 1055 bp, Homo sapiens
tgacccttgatagagaaaggctgccagtcgcgccgttgtctaaaaaagtctgaactccaccttagtgttaactagtccataggatggctcgtcgacctgcacgagcgtcataaacacgctggaggaccagagcaggggcggctgtgtctgcaacccggctttccttctgacatcacctggtctctgcccttcagcccctgcccccgtctctgttttggaagtggtccatcacagttccttctcaatttgttgggcctcgaagggagaattctttctctggctttggagtctaagaacaggtttctgcatactgcagaagcgtggctgactgacagcctcactgattccggggaatggcgagctgtcatctcatccgcagagacacagactacaccttcaggaactgcagcttgggtgagggcacaggctgcttaaacgcatcgcaggactcacaggtggttggtcccagaggggtctctcagggtgggctggtgtgtgcacaggcctggccatctgtcctctagaggcctgaggagagaggtcacagaggggactgactccagctaggaccttttctcagggtgtcctttttcatccagtttttagacctcatcttcctgggtgttagaaactcgtgaggttggtggagtgtaacaagaacgtcttaaatcctttgaagaaaaaacaaagtgaagcatgaggagaatgacaggcattcccactcctctttaaatgggctgcttcctgcttctcttagtggccctcagggcctctgtcacccagaggaccccacgttcttagagcaccaggattctaccatatggcagtgcacacggggaggaccccgcgttcttagagcaccaggattctaccatatggcagtgcacacggggaggggcagcctccaccgactacatccccatctttaggaacatgtgggctcagcattgcaacttttaaatgtgaaatcacagcctgttcctcttccctgccctcctccttccggtaacgactctgggtcttttctccaagggcacagctgtgtcaggttgctc

SEQ ID NO: 99549 - DNA, 1008 bp, Homo sapiens
ttgctgtgtggctgaggggcttgaggtcctagtagggagtagaaagtttcctagtaggattcacctacttttccagtgatatcactcgatcttagcatctgctagtaatgctgtagcttacatggacaaacagtgacaggtcccagggcggcaggaagtccgcagtacgcgtttgtgaacgtggtttctctcagttcacccagtgacccttcgctgagctcgagacccttcattgagctccaccttctgctctcaagtgggtctggagcctggggaacagctcgggagtacaggtgaaacttcgcgaattgcctgttccttctttctgaaaatgacaaattgcagaatacacagacacatgcacatgaaattttaataaagataaaaagcctaaaatatactctaactcttcaaaaaacatttttatgaaagaggaaaggaaggaggccctctttgtggctggaatgctggctctgagcagagtcagggtgacgcggcagggcgctggctttccagctgggtcagcggtcgtgaggctcaacacgagaggaggtggggtggctgctttggttgtaacattagcagggggaagacagctgcttagaagcatggtgggaagcagatgtggtgaagtgccgtactgttctgcttacaaagatggggatgtctaagatcgtgtttactacctgatagcctaaaacagtatcacttgagtcatggactaaaaggaaccttaaacattgtccagcccagcccaggtgtccatctctgttgcactgagacttgtaaggcgtccttgctgcttcgtggcagtgtgccttagctttccaagcaggggtctgaatagctttttccatgaaaattcaggggtctttctttgatacccttgtgacttgtcattcaggggatggcttccactgtttaaggctgaagcctaggtgatctcatagaacagggttcaccaaataaggcccatgggccaatttggccaccacctgttattgtaaa

SEQ ID NO: 99550 - DNA, 1714 bp, Homo sapiens
tatatcaacaattggttttatttttttctcttttgaatatgttggtgataattccgtgacagttggaagatggggttcattcttccggttcaggaatcactatgtatttccttcttgtgataaaaataaaattacgagaaggcaatgtgaggttttagtacatcatagcactttattttatgaaaacatgtagcagattttccacaaaaatgcttatttttaatccaaaagtatattgcttcataatggtattcagtgcacagcagagtaaaagaagttaattcatgatgtactggttaattttgcatggcttcttaaggccagcaaaatgctggcagttttctttatctttgtgaagaacaggcccttcctgtttggggaagttggcttttatgtcagctcttggccagtggtcacttccaagcctggtgtctccggccctgtagtctgtagtgccagactgtgctggcctggagagtgctggggcaggtggaggccagggaatggtcccatacagttatctcccctgccctggttacagacagcttcgagaaccagaggagaagagcatagggtcatggagcaggtgggctgaagccagggccacagggagcaatccgtgaccccccaaggtgggtgtgggggggggggggggcgtgtcaccttagggaactcaatgagtccgaagaacaatttgaaatgttgggaaaagagaagaggaatttgatgtcagccggggtgatccctgagatagaggcctgtctctgatggcatgagctctaagagggtcctggaggattggtacatcctagaacattccagttagccctcttttaggggaaactggcataggattgatgcagaaggcatttttgatgatgggaccaaaattcaagtctccttggtagcattctaggatcaactagatcctaggatctggtagattgtaggattctagtgggtagaggccaggggtgctgtgaaacatcctgcagtgcacaggatggtcccacaagagaggatgatccggcccagaatgtcagtgctgagcctgagaaactcatctaaggcctggtccacaacagtaatgtgactgttcactcgtgacaacttcagatggtaaatggacttaggatcgtattattttatttaaaagaaaaataaggagctggtttttcagccgggttcctttcccctatgcactggaatacccctggtaggtgtgagctgcatgcaattgtggggattcagcactgaaatctaggtgcttttgttttctccagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggtgagctgatacctgagtggggcccttgcctgttgggttctctactggaggacagtgggcacagcaaagattcccttacttgtacctggcagcccacacgcaatggggaaaagggagagtttgtctttattgccttgcttggccataggcaaaactgtttggaaatgagacatttcactgtgccagtgttttcattttctcttccattgtggcatcccggtcactgccaccctccctagaacctaggctgttgttgtacccagtcggaggactaa

SEQ ID NO: 99551 - DNA, 1026 bp, Homo sapiens
cttgggcttggagaaggtacaagaagttgcagattttggctgggtgcggtggctcatgcctgtaatcccagatctttgggaggccgaggcaggcagatcacttgaggtcaggggttcaagatcagcctggccaacatggtgaaaccctgactcaactaaaaatagaaaaattagctgggcttggtggcacgcacctgtaattccagctacttgggaggctgaggcatgaaaatcgcttgaacccaggaggcggaggttgcagtgagctgagatggcgccactgcactccagcctgggtgacagcaaggctgtctcaaaaaaaaaaaaaaagattttatatagtgtgacaggagccagaggtggggaaagagcagcctaaggtgagatggattaggggaggtttctgagtatgtcagtgttcctggagaggactgtataatttggcttggaggtgaggaataggagtggctttctgtgcagaatacattttgagagggaaggaggaggagttaagactagaagaaaaaattgagtgccagggcagagactcttgtctgccttgttcaccgtgggatcttcagcacctagtgcagtggtgggcatatggtatgtgttcagtgggttgatgctgataatgtgatgttgataaatatgtgtacatatagcatttgatgtttaaatcaacatgaaatggtcttagtgctctgtctctgtgatgtgatgtcaaaccaacatctcttgtaaagacttagattctagtcgagtgtttagatttactctggaacatgagagatctggccaggttcctgggatactcgtggagtggccttcccttctatttatcccccactcctgcccccaacaatattcacatctcaaggatgctcaaagttccttgaatctctttaagggccttctggaggagttgggggtctccaaggacccttacccactttgaccagaggagttccactattatttctttgcattattgactcttcctggtaagatgttttttgaggcagt

SEQ ID NO: 99552 - DNA, 1031 bp, Homo sapiens
attctcatcttccactggctgagagtaaaaagaaagaaaagcggtaaagacttctttttgtgcgtaggtggccccggtgttcacgctgaatacagatttttacacaataaaatcttaaatatctctacatggaacggaatccatttttcctgcctcgggaaggatttctgcgctctcgggtgaagttcccgaagcaaggaaccagttcccctctacctgtactcttgagaggaattctcaggtcatctgaaacacaagtatgggccaggacgacccattcgttcacgcggcccagagctctgcgaaacgggacacggcagtgcaacgggaacaaccggacaccgaggcccccgaaggctgaggccgcggcagaggcggcggcacggtgacgggcgcgactccggccttccggctttctaaggggcggccccgggacacctgagccccgcggggccgtgaacgctcagcacagctccgggccggaatcacgatccaccacaccgcgctggcgctgggaacggcgtcggtgacggaccgggggccggaagtgaaggacgggggaggaccgctgcttccggcgccgtaactgctgccatcttctccgcgctatggctgcgttcggccgtcaggtaagctcgagctgggcgcgcgggcttctccgggtcgcaggcgggcgggcagcgacgcagaggaaccgcggccgccgagtgtttcacggccaggtcgtggagccctcccggaggtccgtgcacgctgacctggttttggcatcctggacccgtggctctgctcaattattgtgggatatagagttgacattttttttttttgagacaaagtctcgctctgtctccaggctggagtgcaatggcgcgatctcggctcactgcaacctccgcctcccgggttcaagcaattctactgcttcagcctcccaagtagctgggattacaggcgcccgccaccatgcctggctaatttttgtatttttagtagagacggggtttcaccgtgttggccagtctggtctg

SEQ ID NO: 99553 - DNA, 1101 bp, Homo sapiens
ttttaggatgagcttgtcagttttgcaaaaaagccagctgagattctcataggaatcacattgaatctgtagctcactttggagagtattgtcatcttaacaatatttagtctcctgatctgtgaacgtggaaagttttctattcatttagatctttaatttctttcggtagtgttttgtaatttcagtgtacaagtcttgttgttcttttgttaagtctccattatttttatgtccagtttcttcttttttccaggtttatttttcatttgctagaatatattcgttgccagtttttccaggaaggattcatgggtactatacattcagtccttgtatgtattaaagtgtgtttatttttctctcatattttagtgatgatatgcctttctcctctcagaactttttagacctgtatctgttgtaatctagcattattttgaagtgaattttgctgacagcaaaacgtgatttatttttctttctagatgtaaaatctttgtctttcaaagttttcaccaggatgtctttaggggtttatgtttgtgtgtgttttctttattcttgcttgatacttggtaagactttgatctgaatatttaaagcttccgttctttggttccgttaattctttccttctccctcctcctgacactcattttaggtgtgcatgggcccccctggaggagcctgccctcttgtctccttggccctgcagctggacaggccgcaggcctcttcacctagagtgtcagggctcccgccctcccggaggcttctggagctctgccacatctcagcaggcccttcttttgctcctcaggaccacagcctgcttcccctcgtcttcttgctttccctcagtctcacttctggccttttgggccatagtgaccctcccgtcaaagggtcttcagaatttgtctcctttcacctctcacaggctggcacccaagttgcccccttctctcctgatgacggtgagaggcctggatgttgcccaggctccgatgattcttcctgctcccgccctggccccgatgccctcccgatgcccacttacgttgcctgcccagccccccgcctccctcacacctcctc

SEQ ID NO: 99554 - DNA, 1108 bp, Homo sapiens
caggtgacatggagcccaggaagtggccagagctcgggaggaaggcaaagaggggaagagggcatgcagtcttaggcttggggtcccaggaggcctagggaagccttgtagatacccaggtacagcatttctgggatcaggagccatgatcccaaggcctctaatacttcagatatggcagggaggccaggtggagagacctggaggagtgaggccacagagttggggggccatggccgagacttcggcttctatccagagtcagatgggagctgttggagggttgtcagcaggtgagtgccgtgctctgacttgggtgttaataggatcatggtagctggctgcaggtgtcctgggccaaggagcagggagacaggaggcagagaagagggcgctgggttggacctgggacgcctggggtggtgagaggtggtcgatgctggtcatgctgtgaagcagtctcagtgagttccaggcgaatgagcagattcgttttagggagtgcctgtgaagagcaaacgctcttttttggtgttgctgccagatccaaggattaatgtcgtgcttgctggtggccacgttgtgccccgagatgagatccggaagctgatggaaagccaagacatcttcaccgggactcagactgagctgattgctggaggccagctcctttcctgcctctcacctcagcctgctccagggtaagtcccttggtgggaggttgcaggtttactaaaagtccagacagatggtaggtgaatgaggaacaagtcagagagaaatgttcagcctattattcatagtaacattgaaaactcacatgtgttgagcacctgctctcttccacacacactgactgctgggttttctgtgctgcctggctgagtccttatcagcctgtatgggagggcaccatggtgttactgtctcactgtagggataaggaaacaggctgtggagagttccagaatgttgaggtagatttcagagaactgatggaatcataattttatcattttctttttttttttttttttttttttttttagacagagtctcgctgtgtcacccaggctggagtgcagtggtgcgatctcagctcattgct

SEQ ID NO: 99555 - DNA, 1060 bp, Homo sapiens
gaggggtgggaggtaacatccacagctgcgcagctggtgtagtgctgcctgtggggccagtatcctggtgccagatcaaggatggcacagttgccagtggcgtggctgagccccgagcctgagccccacagtcctccctccctccctccctgctggtgcccggcccctcactggggtgtctcacttgccctggggttgctgtgcctggggcggctctggacactgagtcctccccacccacagaagggctctttcctgggccagctgggcctgggaggagagggaaggcagagcagtgtgggtgtgagatgtcctggggaccttccccgatgacgtggggtagaagtcgggtcggacgcagcacagactcagtgctctgtccacgtgaaacacggcttaagccaaacgacaagcctttctttcagaatctcaagattcagaggtctgttggaagagccagggacggtaccaccttccctctgagcttaaagctgaaatcccaacccagcagcgaggaggcgaccaccggtgaggcggcccctgtgagcggctaccgggcatctgtctgggtgttctgcaccatcagtggcctcatcaccctcctgccggatgggaccatccacggcatcaaccacagcttcgcgctgacactgtttggttacggaaagacggagctcctgggcaaggtggggctgccctgggcgcctggctcccgttccctgggaggaagctgctgtgctctgcagtgcgggcttgcgtgtggcacaggcctcgcacccggcaagctctccagctcgctcctttacccaggaaggaccttgggtccagggagggaggtccctgctcatggctgccaagctccttcctctccacccttccccagcaaccaccgtcggagggagaggagcactgtgcttcgaagccctgagagatctggtctgactgatggaccagggtttacgacacaactgcgggggttcatttctcaccctagtagaaatactaaaaagtagctaagctgaattgtagttacgttaaatttaagttagttaaaaagcag

SEQ ID NO: 99556 - DNA, 1025 bp, Homo sapiens
cttttttaagaaagtaaggttttacaacatttacaatgtattctgaagctataattaagtgtcctgagctttgtctataggttggttctaaaagtagaaaaaactgcctcacactataatcatgtcattgttatttattatggcaataattagtgcatttggatgcttagagaaggagatgtaaacctgtaactaaaggtcccattcattgttgctgcttgtaggaaagctgcacactcgaaccccaaaccctatatgtaatagcttcctacacatctgcaggtttgcagagcctttgccttccagggtcctaggctgggtttgtgtgtgaatgtctctgaattttttggccgtatcagtttattcatacaaaagaataaaggcagtgttagtcatgaattgtaccagcagagtggatgcatttgaacccatcaccctaggaaatcaggggacctgtgcccttgtgcctcttccccactcttgcacctgcctgacccagagggaaccacctgcctgaaatttaggtttaccagtctcttatttaagaagtagtttaattacataggtgtgtttccctgaactacttatttagattatttcatgacaaaggaatcctcctgctgattgtcttccgtaacttgattttttccactcgtatatggctaagattcacccttgtgtgtagtttatttgttttcactgctgtaattagtggtatgaatataccagaatttaaaatctatcttcttgttaaagagtgtttgggtttcatttccttttttcctccctctctcccgcactccctccctttcttccctcccttttttctgcctgtctctttgccattgagaaccatattgtcccgaacattctggtgtcttcttatctgtttgcaaaaatttctctgaaatataaatctaagtgaaaagtgctgtatccatatagacaaatgtttcacttgaattgttttctaaagagattatattaatgtattaagagttcctgttgatccaaatcctttttga

SEQ ID NO: 99557 - DNA, 1032 bp, Homo sapiens
gctgggatctaccagagtctgctccttggttcacgtggtgagggtggagaagggtcttctcttgaaatcgaatggactgttgggaaggggtaacaaggaaccggaagattgagttacacaaggtgatacctgttttcaaagctgtcatagttccaaaaagtctgaattcaactttcttcctcctcattcactttgttggaaaaaaaaaccacatgcatatatgtatatgttatacgtacacatgtgtttataattttctgcatatctgtaggtacagtcatatacgtgcacgtacagtatgtgtgtaaaaatgcgtgcacacacccacttagcaactggggaatcagttgtgtcatcagcttaagtacttttgggtcccatggtttggtgaggggtacagacctcccagaagagcagtcactgccttatgtgaaaggggtagggaagaggaatgtggagctggggaaggagggcgggtgcagcaggaaggcctgacatgttagggagtggtgacagctgcagaagcagggcgagctctgagctggagcctgaagaataactcgaaggcaacgaggttggggatagggtgagggaaaagagcaagaatcactcaagacggagaaaactgctgtcaaaaggtgtggaggagagtttgaccaaatcgtatgtggtggggatgggggcggtagtgttaagggtcttggacttcataccctttgagtctttttaagaagcgcctcttcatatcctcccactccctcttcagctgtttccatgtcttggtaaatgacagatataaaagcccggcttttctcactgtcccactcccacccatgtcctgttagtcaaggagctctgacttttacttttgaaagtatctccaaatctccgatacgtcctccattcccattgccagtaccttaactcagaccttcatcatctctaggctagattgattgtccctgttcaccagcccatcatccccagtacaccaaagtcattttcttacatgcagagccactgtcccatgtt

SEQ ID NO: 99558 - DNA, 1050 bp, Homo sapiens
aagttcctcatccctaaatgaagagaggaactttgttttgaagattacttggtcgtacatttcctcgtgatgagcactaagtaaatgtttctacaattgtcagcctttcttcagagcgtcagggggttactcggttcttcctgggaccatcagtctcactaggtctgtctcaatggacagggatctgggaggactgggcttggagtctgacacagtctcaaattccagcgatcaggagagctcagggagatagctgggcaggctctgatggaaacactgtcccagggagggctgcaggaagcaagcaggtctcgtcaccctccatagcatgcccttaccctgtgagggcagagagggcagtgcacctgcagccctaaggtcagcacttgacactgcctgcgtggtcatgcaaatcactgttgatcagaggtaatccaggaaacattttatttccttcttttagaacaaactcacgatgttggacattgcatcaaatagaatcaaaaagattgaaaatatcagccatctaacagagctgcaagagttctgggtaagtttaatacacgctggggttgatgacactttgactaaactggtctcactgattaaaatgtcttatgaatgaatacaagaatctcctgtaagccttcatgctgagtgactccgcacatcatgagatttggggtgggcgctcttgtagacttgtattgggtgttgtctgtgctcctcagcgtgagccacagatcagcagcattgacatagcttgttagaaatgcaaaatcttgggccccaccatagcccagatgaaaactgagtcaaaatctttgctttacaagactccgggtgattgcagtacacacaaaggttggagaagccctgatctaggtatgggtagaacctacaattgtcatttgaccaaatggtttgcaaacctcagcagagaggcagacgcattccctacagatatattccagcacaacagaaggaaatgttggatgggtttctgcagttagtcatcttggaatttgccttgtatttgtcttgtcacag

SEQ ID NO: 99559 - DNA, 1153 bp, Homo sapiens
ctgtctcaaaaaaaaaaaaaatgcaagagaactcttcctgccaaaggcaggtccctccaactgggcatggcagggccaagatggtaaaatgtagcctgcaactcagacctctgaatcccacctgctcacgatttgtgtccctgcacttggtattgggtgaaagcagcagctgggacttccttgtggagagagccatagaggtaatttacagaagagttgagagttttaagtagagcggcctctgtctgctgtgtcacagtgatggcgcagagtgcagccttgggaatgatggctgagaactggtttgtagaaagtgcagcccaccctgctttgacacttgcctatggacaagtgtagcaggcaggtggccagaactgctttgtccttcctctgctgacctgaatgtggacttggccccgtcatagtgactggcccagggttggctatggacaggtaacttgtacttgggatgcagctgaaggtggccaggatgcaccaagaggccatggaaggtcccatgaggtgccagggaagacccacacctgctcgccatcttctgagtgggaaggaggagggtggctagtggaccccaccagagtcgagggctgggctgtttggttctaaaggcttttctgctgtgtgtgtccccagatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgtcacacaccattttcagatgccgttgcaattaaatcttgccacactgtcctcctgggtgattgttgacagttattgtagccacagagagaacataagacacgttgcgttcattcgctagaaatccctgtttccttctctcagaaggcagtcacagtccctacctgagtcgtgt

SEQ ID NO: 99560 - DNA, 1112 bp, Homo sapiens
ataaacgtccttgactttataaaagccaaacgtttgccctcttcctttcccacctccctcctgccagtttcccttggtccagacagtcctgtttgtggagtgcaatcagcctcctccagctgccagagcgcctcagcacaggtgtcagggtgcaaggaagacctggcaatggacagcaggaggcaggttcctggagctggggggtgacctgagaggcagagggtgacgggttctcaggcagtcctgattttacctgccgtggggtctgaaagcaccaagggtccctgcccctacctccactgccagaccctcagcctgaggtctggtgagtggagcctggaggcaaggtggtaggcaccatctgggtcccctgtggccgtcacagtgtctgctgtgattgagatgcgcacaggttgggggaggtagggccttacgcttgtcctcagtgggggcagtttgccttagatgacagctgggctcttcttcacaccacctgcagcccctccctgcccctgccctagctgctgtgtgttcagttgccttctttctacctcagccggcgtggagtggtctctgtgcagttagtgccaccccacacacccgtctcttgattgagatgtttctggtggttatgggtttcccgtggagctgggggtgggcgccgtgtacctaagctggaggctggcgctctccctcagcacaggtgggtcagtggccagcaggcccatctggagtgggagtgggcacttccaccccgcccacaggccatccggctgtgcaggccagcccctaggagcaggtcccgggtgactggcagttttcacggtctagggccgagacgatggcatggggcctagagcatgaggtagagcagaatgcagaccacgccgctggatgccgagagaccctgctctccgagggaggcatctgtgtcatgctgtgagggctgaggacggggccctagtctctggttttctggtcttaacatccttatctgtgtccgccacggaggtgactgagctgctagcgagttgtcctgtcccaggtacttgagttttggaaaagctgactcacgcccatccatctcacagcccttccctggggacagtcgc

SEQ ID NO: 99561 - DNA, 1068 bp, Homo sapiens
ggctgtttgccttgtgtttcgtggagccccattgctgagcttacaacgtcactctgctctcagctcccacggcctaaccatgaccatcctccctgcaggcattggttcctgtcaccattgaagtagaggtgccctttgaccttcaccgttacgttattgggcagaaaggaagtgggatccgcaagatgatggatgagtttgaggtagacccctttcccgggaggccatgtcacaggagtggcctgtcgcatcctctcccgagtgccagtgtcctttctcaacttcctgttgactctgcctcctcctgctcggactgggcactgacttcccttcacggcgggtggccttccctctcaccacttctgggtcccagggccaatggactctttcctgttctctggggtcctgaacgtcaagtcagccccctcttcacgtaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggtgagcaggaggtggccggggcactgcccagagccatggtgctcagctttgggcacatgtcagaatctagggaagttcttcaggatcccagcatcccagcgacatctggctggaggtgagatgcaggcagtgccaggacgcagtcagcatccaggggtcttgctgtggaactagccaagagcatggcacctttctctttttcataaaaaagtgacaaagttggacttccgtgtaaatttgcagtttctctcaaaaccaaatcagagtggtacctcagacctacaagaaaggtcaaggttgcgagaggcccccaagcatgtgctatgcagtgaggacgagcatcggggacccccactaacctctagcacagggtggtcaaagggcgaatgacttcctggtaagcagggatgaaacccccccaacctctggcaaggctgacgtttgaaggattgtatgagcggagcgctgcagacgcccagcctctggcagggctgac

SEQ ID NO: 99562 - DNA, 1032 bp, Homo sapiens
tgtctcccctagacctctcaccccccttcccactgcctctcctgggtggggctgcgtgctggccgccttccctgatgagccctgcctcacagtcaagcctcacttgtgcagtgggtctgccctgtgttcctcccatgaactaactcatctgatctcactgaagcctctgctgtagttagttgctgttagcttcatcttcaaggtgaagaagggagacacagagctcacggcctcccggcaaagccttcattgccgcccccccccccccccccaaggtctgggagccctctttgaggctgctgtggggacgtcctatctgctctccctgaccagaccaagacctcctgaaggacaggagtggttttccctcccttttaccacccagcacccagcaggtgcctcacagacatatgcattctgaacaaggtgtggggtctcttccagcagctgtcagctgtcccttttcccctttctctctagttcacagtacagagccagttgtccaggagaatggggacgaagctggggaggggagagaggctaaagattgtgaccccggctctccaaggaggtgtgacatcatcatcatctctggccggaaagaaaagtgtgaggctgccaaggaagctctggaggtatgtgtccatgtgcccccctccaccccccgccaaggcccagtcagcaggcacctggggagacgcgtggcctggatgggatggacggttgcccaagcggcagtggcagtggaggtagccctcttgctcctaccgtgtgcgcacgggctgtgcttctcggctggacacagagtttggggaggccacttcccttcaccaaggctcggggttctatagcccctttctgggacagctgcatgggatccggcctctcaggcccacggtgggtgcgggggctgtggaagggtctcagctgcagggggatgaatgtgacctccagttgcaacgtctccccccgcgtgagtggggttatcaggcctagctcaccttgtgtgcagtcagtgtcgagtgccacctg

SEQ ID NO: 99563 - DNA, 1204 bp, Homo sapiens
cttgagcctggggagtggctggttttgtggaggctgatctgtagcactcgtgggaagaaagggagcctggcccagatttgtgtgtgcttggtctggaagcaggtagaagagtgggagcatggtgcacacctcttgggcagcttgcttcctgctctgctgggcacaccccacgctccccaggacgtgcactccgccaacatatcgtccggcgcgttgctcccacctccccctgtgcagatcaaaaatggcttggagaagtttggtcagtgcttgtaagtggcaggaccagggttctaagcctgtgtgttcatcccaccagcatctggttgttgtggaagagaagtaggtgtgcagtctgggtattcatctgtttattcagtgaggtgtgctagccccattttgggggtattggtgcaacatcaggacactggtgacaatgtaaggggagcccgagcttgctgtcctacagaccctcttgtcttcctcactgtggtccaggcacgtggtgtcaggctaacacagtgggattggtttctgcagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggtagggagcgggcctcggcggccgactctgctggggccgtgatggggtggcttatcttccatctcttcttaacactgcaggataatgtggtggaagactccatgctggtggaccccaagcaccaccgccacttcgtcatccgcagaggccaggtcttgcgggagattgctgaagagtatggcggggtgatggtcagcttcccacgctctggcacacagagcgacaaagtcaccctcaagggcgccaaggactgtgtggaggcagccaagaaacgcattcaggagatcattgaggacctggtaggcacttgggtgctcggggaggggttctcaccccccagtggccactcaccgaagccgtgtatgagtgttcgctccaccctgtagggaggtgactccctcatacagccctggaaggcttcagaaggggctttctggtgctc

SEQ ID NO: 99564 - DNA, 1294 bp, Homo sapiens
aacaggtttagaaagtgtagtgagtagtggatgagaaggccacaggcagccatgtatttccgtgggcttcaccttagctgatggctgccctgggagaggcgatggtgaaggactccagcactgtgagctgctgtcacatcactgccgtgagtgcagaattgcccagagcgtaggggtccgtgctgtctccatgtgtgttctgagccccttccttaaccagctctgatcctggcatgggacatgaactctctcttagccaaaaagtagacttgcatcgattgactgtaatttgcaacgtaagttagttgttggacaaatgatctatctcacttaccctcatgacaaacctctgaaggtttgtttgcaaataccagtgctctgtcgtgttcatgctacccttaggggtagaagggatactgtattttactctctagcacaggtggtgaatcgggctgtgttttttgtctttaaggtggaaaatagctattcaatttctgttccgatcttcaaacagtttcacaagaatatcattgggaaaggaggcgcaaacattaaaaaggtgataacttgtccgctgcatcttgcttcttcttgccttgtcctctgtagccctgcaccattttggttttagactaggagggactcttccttacttctagccctgtgctcaactgtgtctcaactctgggagagctctagtcagcttctcatggtgatctctctccctgtagattcgtgaagaaagcaacaccaaaatcgaccttccagcagagaatagcaattcagagaccattatcatcacaggcaagcgagccaactgcgaagctgcccggagcaggattctgtctattcagaaagacctggtaatgggagatgttttctaatggagatcctccagtaaaatctctaacagcctctaagattgagcctggggttgagtcacgcagggtcattgggccagcgcaggctgatgtggaagattgcacctttcaatccaggctactgatgagttggtcagcagttttctgcctttgtctctcacgatacttacttacctggaccctgcagcagtaacatttgacgtgggcacttgtcttattagacattttcttcttgttacctgaaaatcttatctgaaggtatttacggtattttctttcctttaaaaaaaattgacatgcagtaaattgtacatatttacagtgtacaatgtaatagttttgacgtgtgtatacatccatggaatcattcccaccatcaccccaaaaatgtcccatgccattttgtattacag

SEQ ID NO: 99565 - DNA, 1059 bp, Homo sapiens
ttggcagctgtgctgtggcctgtgcaatggtgagctctctggtgtcagtcttatgttttgtgggcattttacgtgacagcgacgagagtctgtaggcacaaagtgacctttttgcgcactacttgaaccacacatacaccataaacttgcttttacggttttgttttggttttggttaactgtagcgtttgtttaggcctgacacggtggctcttgcctgtaatcccagcattttgggagaccaaggcaggaggatcacttgagcccaggagttcgagatgagcctgggcaacatagtgagacccctgtctctacaaaaaagaaaaatttagccaggcctgtggtccccgctgctctggaggctgaggcaggaatatcacttgagcccaggaagtcaaggctgcagtgagctgtgattgtatcgtgccactgcattttagcctgggtgacagagcaagaccctgtctcaaaacacatatatatggaagtacagtagtgtaaatctaacattaatttctggtttctgcccccgagaaattgcagaatgtagcttagtcagtcatgtctgttctgttttcttctcatgcagttcctaactcttgtcttctttcgtaatctaaaaaaacctgctgcccagctcccatgtcctctgcttctcttgtcttgtgttgcttcacctggcacagctgcatgtccatgttcccccctcagtgcatcgcctcgttgctgcctctgcgtgtgcatgtgtttgggatggacgcacaaaaagccctcctcgtggtccttccagcaagctgggcttccctttactgcacagtgggcaagattcctgccttgtttcctgatgatacggcttctccagagtttggggggcctggaactcttaacttgggggtactgggttctatccagagaggttgacagcaggagggtttgcaacagcacttgtcttgcagacacagtgaagtgctcagtgtgaatctgagccaacagtagatggggtctctgggcagcagcatgggccccacaaggctcttaggcgtcagtgagtgcttttgt

SEQ ID NO: 99566 - DNA, 1407 bp, Homo sapiens
ttgtctatgtcaagcaagttactttaccaccttggtacagctatacgagttttaaaattccatccgtgctctgtctcattctttatgcaactcaagaggaccaggccttgtaaaagttcagatggtggaggagcatgtcgcatgtcgcatgctttatgttagtggcttctgtggggcaaacggtgtccttagtgagaggcaggattattcggccacagtatttagtttcctgactatggctccctaaccctccctttcaactttgtttgatggctgtggatatgtccctccctccctcacatctatgtgaagcagtttgggatcagaagccgctccgaagagagctcccactgggagctcaggggctgcagctgtgccattctgttttagctatctctttggttttggtgtggtaggttcacatcgagttcacagagggcgaagacaagatcaccctggagggccctacagaggatgtcaatgtggcccaggaacagatagaaggcatggtcaaagatttggtaaggtaccccttggaatgttgtgtgtgctggtgacaagggaggctctgagttgggcatgggcggtcatctctcgatgacatcccacatgtccgggcacagacacccagggcatcctagctgggtgagtaataggttctgaaacaaccagaagctggtcgaagtcctggaataatcgtgggtggaggaaacttcatcttgaagaaggcatctttcaggggagatgcaggggcagtctccaacaattcctgacagctgagtggtcagaaaaggcaaccgtggagactgctgggttttggttcagctcattggccaagtaaccaggcgcatccatggacctctgtgctcctcctgcagattaaccggatggactatgtggagatcaacatcgaccacaagttccacaggcacctcattgggaagagcggtgccaacagtgagtgaggctgtctgttgcggtggggccagtgtgccctgagacccttgtggggggtgtcagctgtgagaactgtgacgtccgtgcagacagtccaggcccattgctgcctgtaatgggagttacagactttacatcctcctgcctgctggaagaggccacttttccttttccctttggtgcagtggttggattagagctgcttggccagtgggtgaattgtcacttttggaaatccatctaagccctccccaaataacccacagaggccatgttgaaggcatgcccaagggcagcattctctatatttccgtcagacctgctaggttagccaatcagtgttggtagtactcatgccttctgaacgtggaaactgctgatctggaactcactgaagagtaaaaacattctagatttgtgcccaagtaaaacaacatggggagggatact

SEQ ID NO: 99567 - DNA, 2490 bp, Homo sapiens
caaagatggtgtttctgccagaatgtcttggaaaaatatgctccttcagaacctacaaatattcttgttttcttttattctcttcttgctataggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggtgaggcctgtgtgagtgcctcgtgcccctgcctacctgcttgtgcagacctcactccctcatgggttgccgtgtccagtgtggacttcaaggcataatgtggtgggggtggagggcttgactccaactctaaaaagccctgtctgtccccagtttgttttcaaaggcctgttctcatcagatcatcccttcctttccaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaaggtacacgatttagaggaggcaaatccccatgggcaggaatagaaatgaggatttgggtctggagattcagttaaggcctggttctgccccttatctttttgtccttgatgaagatgcttattgtctctacacttgagtgacccgggtgagatcggtgcccgcccccccttgctgttgagcatctgcctggcagttgtccttgccgtcctgggcctctgactgtgctgacaggctgccagctgggctgccccgggtcagatgcacatcccggacttgttcacgtcttagattaagctgttagctcagcttagtgaactttgaggtctgaaacgtgttccttaattgagggaaaggattgggtgttttgcagtgttcaaggacgaagttatcagccggcgggtgactagactgaggggaaaaatccagtccttgaacagtgaagtttctggggattggctagtcctgatcacttgttgttcacttcttgggatcagcatctatagtctgggccgctttggcttgctttctgcagcagtggccatgcccacctgcccgcttcccacacctttccctttgactgccccttatggtgctcttatttagaaaaagaagactacaaccattgcagtggaagtgaagaaatcccaacacaagtatgtcattgggcccaagggcaattcattgcaggagatccttgagagaactggagtttccgttgagatcccaccctcagacagcatctctgagactgtaatacttcgaggcgaacctgaaaagttaggtcaggcgttgactgaagtctatgccaaggtaactgcctccgagcatgaagtgtgtctcctttgagtggagtccgcggggccttcatggatgagctctcgatttgtaaatcctggggcctggacacagtgcaggtgcccaggtttggggagagcgtgcctctgagccccaggtgagcagcctggctttcactgtgacacgaccttgagctctgcaaacccatggctgttctcccattttcttaggccaatagcttcaccgtctcctctgtcgccgccccttcctggcttcaccgtttcatcattggcaagaaagggcagaacctggccaaaatcactcagcagatgccaaaggtaaggacacgtttttcacctgttgtattgaatttgtcttgttttctgtctttctgtttctgatattgctttgttgacctttgtactgtggatgcccttgaaaactggtgtatttttctgaattaactggcctgtttgacatggtcaacttccgtgttagcttaaagaacagcagaataaatgtctgtagatgtctgtaccatccttctggcctttaaccagagaggattgtatgttcttaggtttcataagtatcttaagaaacatgtcatttagtaattatggtgaaataacttcatgatactttggcgggccgggtgcggtggctcatgaggtcaggagatcgagaccatcctggctaacatggtgaaaccccgactctactaaaaatacaaaaaattagccgggcttggtggcgggcacctgtggtcccagctgcttgggaggctgaggcaggagaatggcgtgaacccgggaggtggagcttgcagtgagccgagatggcaccactgcattccagccttggcgacagagcgagactctgtctcaaaaaaaaaaaaaaaatactttgaagagcagaacttgtatacaaattgtattaagtgtgaatttaaagcgttctcagtttaccaaaggagat

SEQ ID NO: 99568 - DNA, 1032 bp, Homo sapiens
catgagccaccgcgcccggccagttttttaaatttttaaaaattaattgctgttctttcttaacctatccttccaagcgtagaatctgatggaagagtttctgaatgtgcaagattgagaatgctttgagtagctaaagggagaaggccttcaatttaaatcatcccccaccccagagatgtttctgtcgaccacttctctcatgtccaccctgtatgctagcactcagtaggacaggcacgtggtcgttttgcaggcagtgtttgtcagatgaatgggtcctgttttctgttctctattcattatcctgctttctcgaagaggttaaccagtttcctggttttctttggcttcagtagcccttctctctgctacctgaatttgagatgttagtgagtttcaaaacttttatataaattcatatcatctggtcatggtggaaaattactatctcgctgccagtgtcttccctgaattttaggctcataaacagttgcatcccaatccttccattttcacctgtctgctatcttgttaatggttttgttaaatgtaccactgtctacttggtgactgtggtctcacaccagggtagttgatccctcttgcttccaccttgtccctcctcagttcttctccataaagcaacgggagggaccctgcaccatcaagcagaatgcctcctgctgaaaagcctgtgttgacttttactacagggtgggatgggtgatcctcttcactgtccccctctggtgtgtgcaccaggctccgcccccatccacctcctccgctttcctgcctgtacacccttagttccctcacctcttaacatggatagctgcctcgtgcttcaggacggtgtttcctggccgtccccagggtccacctcccactttctctcaaactctcttgcccctgttgatttcatcacagcacttgctagctgcctcattcatttgtgcagctgatgtggttctctccttaggatgtcagcctcttgaccttggccctttctccttgtctttcggctgc

SEQ ID NO: 99569 - DNA, 1100 bp, Homo sapiens
agtcttggctcactgcaacctctgcctcccgggttcaagcgattgttctgcctcagcctcccgagtagctgggattacaggcatgcaccacccacacctggctaatttgtattattagtagagacagggtttctccatgttggtcaggctggtctcgaactcccgacctcaggtgatctgcctgcctcggcctcccaaagtgctgggattacaggtgtgagccaccacgcccggcctccacggcaatcatttttaaccttgtatgttacagtggaaaatcagagtttgcttcaaaggcaattctcacaggtggtgctgggtaggaccattgttttgcaaatgcaggggtctgctctgtgcctggcattgccatagttgtgatttttttaagtgtgttattagactctagaggacttaaaaattgacgtagcaaggcttgctttcaagggactcaccccgttaggggagtggggctcacaatgtctgagctgatgtttaccaaggaggccatgtggatgggggtaggttcgctgtcagagactgggagtctctggcctcctctagctctcacactcagggtgctgggcctggtgacctcctggggccttttcctatcactatgaattagaagagaggggtggggggagttgtccttggagcatttgatggttcttgtttgtctgtttttaagcactaaaacccttaaaagtgtttttcatgtaatgctaaaagtagtgcttccttttaatctgtgttggctggtccagttgccactctaaattcagaagaggagagcgaccctccaacctacaaggatgccttccctccacttcctgagaaagctgcttgcctggaaagtgcccaggaaccctctggagcctgggggaacaagatccgacccatcaaggcttctgtcatcactcaggtagaaacaccattctttcttttaaaaattttatcatgtaacatgtctatgtaaatttttaaattttttttcttttttttttttttgagacagagtcccgctctgtcgcccaggctggagtgcagtggtgcgatctcggctcactgcacgctccgcctcccgggttcacgccatt

SEQ ID NO: 99570 - DNA, 1034 bp, Homo sapiens
atagacggagaattcttgaagacggtagctcttggtcaccataagcgctgcagagaccccgaggtccacattctgttgtaggtcagagcccagcacaacaacccttcttctggttcagccgcccagcggttatgtggggtacgggaaagatgatccagccatgcaggagagcaccagtggttctgtgaggattttacttcaaaatagttaagtttagaagtttggcacttaaaagatcactccctcaggtccctggaatagttgtcctctgcaagttggagctggttcatgttttgttttaatatgttttgtttcaagctaacgttttttttttcttccaagaaacttgcctgagtattggtgttagtaaccaaagcataaatatcttgaccttttctgattttgaggtaaaaagatctgagttgtaaaatgtagataagtaacttttctctggtttcctctctctcctctcccacttcccatcccataccagcaaaagctggcaggctgacagaggcggcctcaggacggaccttctggctactgaccgttttgctggtaagtttgaccctgtctgaagacttcctgtccctgggctgtgtgtggacctgggggcgcagggatgcgtattttcttagtcctgtgtgtaccttctttctttatatcacaccttcaagtttctcgtggttcgtcagagatgtctccatagcttcacctcccagcaggaaccatctatagacgtgtgtcccttagatgtgtcatctggcttccgtctgtttttaatcttttatttcttaaatgtgaattatgtttattcagtattatctgaattggggtcttgcttctctttaggattgcaggccttaacttttcttcaacttggggagaggtcttaattatgttataaaaattatgcaaaattcactccttattacttggccttgttgtgcgagtaattgatgcgtaattgtgtaaagaaaatgggttcttcctcactgtagtagtttggagctcacctggaactggggagaggg

SEQ ID NO: 99571 - DNA, 1050 bp, Homo sapiens
gcatagtggcgcacacctgtagtccagctacttgggaggctgaggtgggagaatcgcttgaacctgggaggcagaggttgcagtgagctgcgattgtgctgctgcactccagcctgggcaacagagtaagaccctgtctcagaaaaaaaaaaaaaaaagaaagaaagaaataggccgggcgcggtggcttatgcctgtaattccagcactttgggagacaggcgggtggatcacggtgtcagaagtttgagaccagcctggccaacaatgtgaaaccctgtgtctactaagaatacaaaaatcagccaggtgtggtggcgcacgcctgtagtcccagctactcgggaggctgaggcaagagaatcgcttgaacccaggaggcggaggtttcggtgagccaagatcacgccactgcactccagcctgggcagtagagtgagactctgtctcaaaacaacaacaacaaactgcctcttcttgttcactgacactgggtgtatggttaaagcccccttaactgacctgttttgaggcacagaggtttatttaatcaccagtcatttgatacagggtgaagacctatttgaaatgggactggctggattctacatgttttctttttttttttttttggaaacagggtcttgctgtgttgtccaggctggagtgcagtggtgccatcatggctcactgctcaacccctggggctcaggtgatcctcccacctcagcttccacactgagtaactggcactacaggtgcatactaccatgcctggctaatttttatttttatttttattttttattttttggtagagacagggtttcaccattgtaaacccaggaaatctgacaagtctcagttaatttagaaagcttactttgccaagggtgaggacgcgcacccgtgacccagcctcaggaggtcctgatgacgtgtgcccaaggtgggcagagcacagtctggctttatacattgtagggagacatgagacatcagtcagcatatacaggacgaacattggttcggtctggagaggcaggatgg

SEQ ID NO: 99572 - DNA, 1889 bp, Homo sapiens
tccgcctcttgggttcaagcatttctcctgcctcagcctcccgagtagctgggattacaggcatgtgccgccacgcccggctaattttgtatttttagtagagacggggttcctccatgttggtcaggctggtctcgaactcccgacctcaggtaatccacccaccttggcctttcaaggtgctgggattacaggcgtaaaccactgtacccggcctcttctgatgtttatggttctaaaacagagctgttactcttgttctgctcagatgagcttgatttccatccctgtcccctgtcccttctttccttaccccaacattttcttcttgtttctttctgaaaatataaacagacatacacatttctatttctgactctttcttacagaaaggtagcataccctgcacctgctggcctccgttgctcttttcattaactgtgtaccccgaagactatgcatagtagtgtatggaggctttccttctaccttttatgctatgtgttgcttcactgcatggacacaaagtggtttcttcagcccatctgcatattgaagttgtgttactttccagattttttttttttagctttttatgtctcgctatctctgctgttgcccttctgaagtccattcatcccacacgtgcagtagctggagtttcctttttatctaatacttgagtttcccactgccatactcaccccacgttgatgcctaatgtcttcttgaggtttcctttagagggcactccttacctttggtgccagccattctgctattctgatcctacttcccctcattactgatcttccttctctgccatcctgaccccttcctgtccttggatgcctttggagttgcagagaagctgtctttatcttcctggtgtgatacttgttttctaatagtaggaaatagtgttttcttgttctgcccagttttctctctttatagatgagacatctaagttcctgctccctggatgtatgtcagtttttctcttacatggtaatgttctgatctgagtccggtatctccattgtctaactttgcatagaggaacatacctgtgctttggtggggacgttgtgcttgtattcgtgcagtttaatgttgaattagctctttgtggagacagttatataagtaagcgtttctagggagtctttatatccaaaagtgaggcttaatctctgaagagtagactgataggaagagagtacctggagagatgatgcagtcccaccttctcatgagacaaaggaggaagcaggccaagtgaagagggtgatgtgccaagcagtgtcagcagcagatcgcacattggagtgccacatgctctccacccttgagaggagaaaacctgaagacttgggttttcctgatgtgtgttttcttgtttgtagaaaagtattgtttctatttggataggactgagcccaagattaatctttcagattcttaagtattttccacccatggcgttagctagctttgtatccataacagagttctttataaacatgagctaagctaattctagctcatagaactttcctatgtaaattgtaggaaggaaaaaatcatcaagtgtaaattgttgccctgggtcaaacttcaaattattttgtttcttgtagtttaatgagatttatagtgaggagatggaagggatttttaaattgcaggactaaaggggaatggcccttcctacagccattctgttcccatccccttcccaggaacaccattacagttggggtgggggcctgcgtgggcttcaagccctggtgaggagtatgtgtgtgtgcaggagctgccatgaaacacctttcagcggctcagggtggcagactagtgttaccatggcagttagagacatcagt

SEQ ID NO: 99573 - DNA, 1040 bp, Homo sapiens
gtttcttttccttttttaaaccttgttgggaaaacttcaaaatataccacaaaataaaagagaatagaagagaatcatatgcctgtcacccagctttcacagttgtcagcattttactatagccctgcccactcccaatattttatatttttcatttgagtattttaaagcaaatctcagacttttagtcacctctaaatactttagcatgtattttttaggaaacggctttaaaaaacataaccacaataccttcatcatagctaacaccaccaaccacgctcattaatattatctaatatttattctgtgtttggttttctccagatgtcataaaaagcctttttacactttgtttgcttgaattgaaatccaaagaaggtctccacattgcatttggtttaagcctcttagctctttgaaaatctatagcttgcagcttcttttcccttttttagtttttgtttttaatgccatttatttatgaaggcaatagggttgtttgtgctgtggaacgtcccaggtttgggatttggttgactgtgttgtggcactatctaatgtgtttttctaatcctcatacttcctgtagctaggtcaggatgcttaattggtttcaggctgtttgttgttgggggggtggggggcagtggtttcaaggatattccacagactgtgctctgtgttgcacgttgagcagccaggttacatgatgtcgggtgcggtgtcagtaggttgaattatagagttctttatcaaccagttctctactgggtttaacggccatttgcttgttgcttgtacccgttatttagttggtgtattactttcctattgctgctgtaccaaattacaacactgtggctgaaatcagtctcactggtctagagtctgggtatctgggtgccatcaggcagctctggagagtatctgcttcctggccttttccagctcgtggcagccattttttggctatggccccttcctccatcattagagcacatgatctaaaggacacttgtgattgtggttacgtccca

SEQ ID NO: 99574 - DNA, 1056 bp, Homo sapiens
aattttctagcctggttttatgtttaggtgaatttttaggagaatccttgttagagttaaaaaaatatcctactgggatgttgtgttactttcccagggctgccgtaacaaattaccacacatttggtggcttacaacaggaatgtattctctcgcagttttggagactggaaatctgaaatctggcagggccacactccctctgggggataggagagagattgttctttgcttcttcgtcttccagctcctgccccacagtccttggcttgcagctgcatggttcccacccctgcctccctcttcacgtggctttctcgtctgtcacgggtggcatttagaacccacccagataatccaggatcatctcctcatcttagtatctttcacttaatgtcatctgaaaagaccccttttccaagaaaagtaaaacaaatttcagggattgggattccctatctttgggtggccatttttcagcctatcacagatgttatttggagtgtgattgggggtgtagatgaacttggaatagaacagacatcttttgtgatgaatctcctggctaagtcttggcatcatctccatgattcaggcttctcgtgtatatgtgtgtgtgtaaaatttttgttttgccaacttgccaagcttgccttcactgttactagagcttcattataatagagaggttttctaaacaggtcatctgcagacagtggtatttgtctccttgcttcattctgtctctttagatggcctattggacagtctttgacaatagtaacatcttggtcattctgttgcttattttaatactatactattagctttttagtaaatatgttactttggggaaatattgttcatatagccatttgctgatgttaaactccatagaaagtaaataatacatgctgaatttcatcagttttttgggcatttttgaaatggtcgtcggtcagccacgtatatgtttatttgtcctttttttctttgagacagagttttgctctgtcgcccaggctggagtgcagtggtgcaatctcggctcactgc

SEQ ID NO: 99575 - DNA, 1025 bp, Homo sapiens
gtgcctggctaatttttattttttttgtcaaaatggaggtttgctatgttgcccaggctggtcttgtactcctggactcaagtccttctgcttcagcctcccaaagtgcaaagtgctgggattacaggtgtgaaccacctaacctggcctctagtttgtttgtttgacacagggtcttgctcagtcactagttggagtacagtgacactatcatagctcactgcagtctcgaactcctgggctcaaatgatccttttgcctccgcctcctgagtagctgggaagcatactacaggcactgtacctggctaattaaattttttttttttttttgtagagatgggagttgtggggggtctcactctgttttgctatattgcccaagctgatcttgaacttccgacctcaagcagtcctcccacctcggcctcccaaagtgttgggattacaggtgtgagccactgtgcctggccctcggcctcttttaccatttttgaaattgaggttttgaaacaagtgacttgctcagaaacagttttaccccttagggcttccttttcaatattataagatgtatggtttctgatttatttattagaataggaaactttttgccttaaatctttttcttgaaaaattaaaaaaaaaaacaaaacgaaaggaaaggatggccctttgggatcttttctgcctgtctgctgtaaccattcgacagttgagaaccatgttgcttggtgtcttgtagcttgtaaatagaagactgaagtgtgtgtgagtagaaccttaaaattcacttttcctttgctttgtcttctttatgttggagtttgcttactcctgagtgtatattattagatgattacaggtgtgtagtattcaccccagtatttgctggctagtgtgaacaaaatgaaatacactgcatcatccgaatgtgttttattttgtagcaatgtgtatattactcttaattttcactcttcttacgtgatatgctttctaattttattaatacctagctcattt

SEQ ID NO: 99576 - DNA, 1143 bp, Homo sapiens
ccagctactcaggagactgaggtgggaggcacgtttgagcccaggaggtcgaggctgcagtgagctgtagtcacaccactgcactccattctgggtcacagagtgagactccgtctccaaaaaaagaagtaatattctgaacttgtcctttcttgactttttggtgaattataacgggctgccagaatctagatcagctttttaggctctgagagatatgcttcatgtagaaataatccagtctgaaggccaggtctcaaggtgtcacttttgtattcttggatgactgttgaatgtgtggtctcgacgaatggctttgtggagcagctttctccagagacttgcatgtgcttggattaacaaacttgcgatccagggatgctaagcaggtgccttctgtgaccaagctcagtattgagggcgctgctgtccttgaggcagccaagtgttcttgtatacagctgtgttgtgtagcaggttaagtgctgcctctctcctgttgcttgttttctgtaatatgtcacctttcttggcatgattcctttgtccagtcttccagcgtcctgttgtatggtgtgggtgggctggggactgcataaatgagttggagcagtgatgttcttggccttgctctgtcctgtgagagaggaccctgcaccatctggggctcctggagtggcaccctgcaccagcaggacgcagctcttcctggcccttctgtcggcctctaaacacagtgcaggctgactttcttatcacagctcgtttggctggctggaccaaatgctgcttgtttctttctggagtggggaaataacttcaaccaggtgcagtcagtgtgtattcttatctcagctgcaaaagctgttctaaatgcccttctagggaacttttgcggtgtgaatttagtggttgtgctgcgtgttagtcctgcccaacactaggcccaggcagctagagttaagtcgttgggcattggtagggcactgtgagcaaagactctcttacctcgggccaggcagagaaggacacagtggctgagctcacctgctccttggtcatccttcaaacctctgagtgtgtgtggttccttggggagagaaagcagttttctcgtgggtgccaagacagcagctacctgca

SEQ ID NO: 99577 - DNA, 1096 bp, Homo sapiens
tgctgattgagcgacagttgattcaaacttgagatgagcaaacaagccatgggcagcgatctggggaagagcgttataagaggaatggacaggaggtgaaaagcacgggggcaggactgtgttgtgcacgttagaggaatgtggaacaccagttattagaccagtgtggagcaggaccagagggtgtaggagacgggcaggtcagggaagaagccggggctcctagcagtcggatcttgatgcctttggagagctggagcagagtgacccagtactggtggtggatcgtggtgaagtgaccatgggccacaccattcacgacatttcttacttttcctgtcacctgtaggaggcaagtattgttgttatcacaggtcgaggtagaccctgaggcaaaggctagagttagtggtttggctccagtttgtgccttcagctacttcactgcttccctaacctggccttgtcagtcagcctcagtctaccatctacccaggtctgcataccccgcaaaacagtatacactttgacgcttttctgcaagcacaattaccttttgggggagcccttctcttaaagcagagtaggttaatgtttgtgaatgaaacggaactttggcaggctgaggtgtctcaggtcatcagcttacgttgtctactgtgtgactaattgaggcaaaagatgtcctttttaatagtattttctcatcacttttgcctgggtgccctttaggaatgttatttttggcatacaacttgagtttcacttaaatttataattctttctgttcattcctactgctctgttgcccagatgtggattttgctttgtctcacaagcgttgctgaaacactggtagaaaggtggacgacggattggttgtgattagtttgatcttcacagtacagaaattcaaaaggtcaataagctcaacaagattgctgtctcactgatgatcagagttgccattaaaatcgtatttcccgcacatcaggctggaaaaaagaataaacatgatcattttagttgtcctcaaaggagaagaggacaggtattctgtaatcaggtgttgtgagtgtaactagttaaactcttt

SEQ ID NO: 99578 - DNA, 1540 bp, Homo sapiens
aaatatttgctggaaattgctgtgtagggttaagggttctgcagatacaaaggttgagaggatatagtcttttcgaccaggtgcagtggctcacgcttgtaatcccagcactttgggaggtcgaggcgggtggacacttgaggtcaggagttcgagaccagcctgaccaacatggtgaaaccctgtctctactaaaaatacaaaaattagcctggcatggtggcgcgcgcctgtaatcccagctgctcaagaggctgaggcatgagaatcgcttgaacccaggaggcggaggttgcagtgagccgagattgtagcactgcactctagcctgggcgacagagtgagactgtgtctcaaaaagccaacaaaaaaagaggatatagacttttcttttcctcaggcagcttgtggtctagtgtgagagacttatttgtagaagagtaattacattatggtgtgataagtgcaatgatagaaatatgtgtaaggtgtggacataggaaataggcagtggttacctgttggaaagtcttcctacagaatgtggtccttgaactgcggtttaaaagacgagtaagagtttttccaggtggtgctgagtggacaggaagactaggaaagaggaggctgacatttatagttggtggcatacgtgagcaacaggtttagaatttggtatactcttgccatggcaaatggtagagggcttggctcagactgtgtactgaaggacttgatgcccttcagtgagttttatctaagatactctgacctgaacagaatttgagatgattgtgccgggtccactgggatatcttacgatccttcgtgggtcatatggattctccattagtgcgtcccagctgaaacttacagaaagggcttaagcagagaacatgctttttggagtacaaagtgatatttttatttggtatggcccgttcattgtgcatccatcccataggcaaatggtgatacgaaagcttttccctcttttggtaagaagtaaccaagttctgaaagaagcatatcatgcggctttcccaattgccaagttatgatgacacaaagtccaaaatgcgtgtaaaggtttttgaccaagtagaaaagcagagaaccccaaccagtataatgtgtcagaatgctttttctcttcaattgtaaaagcaccacaacgttcaacatctggaaaccaagaaaataatgaaaagaaccttttttcatgtgtataatattttaaaacttggttacatgttattttttggtatttctaaagtcagagacattttagaagtgaaatccctagtaggctattgttttaccaagcacactgaagttcctcgaataccgttgaagatgagctagacatttgttctgagacgtgtctggacatcatgtggttgtgttagtcatcttgttgatacttgttgttaatttggtaagaatacattgactacatactctcccttactactttttattagcattcatattaatcttatttcaaatcaaggttacagcttcatgtcatttgtagagt

SEQ ID NO: 99579 - DNA, 2076 bp, Homo sapiens
aggcccgacaaacacttagagcttgtgtggccatcttgtctttctaacggtgccatttcctccctgaggcgtggaggactggccagcccccaaacctccaagcccatcggctggatgccgtggataagcgaggggagagcgactaggccctgtctgcgggtaccttcggcgaggagaggcgacgaaggtctgcaccagcgaggcacggacaggcagcagggggtagggtatagggttggaggccgccgagttggcccggggatgaggagcaaacctgtggcttccgtggtctcagtggagtcccaactgtgacctggcctactggcccagacaaacctggcttgcttttttaccttttcggtctaattcttgtcagtgccaccagaccttgtcctctctccacggaaacacacgaaccaactacactgaacttcttgtagttcaaacttctgcacctttggccattgcccaaactcttaaatctggctacttcccaccttaactgccttctccttacctagtctgtgcttgtgggattccgcccaaattagatttcctccagacaggcttaggtgtttacctgatgttccagatggtatttgtccagtggactattggtgctgtgagggcagggcacatgttgtcacccatactcattgcctcggttggtgtctagcacctagtaggttctcaaatactttttgaatcacagtgcctgccgatatatttaatgtttcaaaatagttctgccgtcataaagaaaaacatcatggtgtaggggtcatgaaagctgattcttgatacttctgatttgagcctcattgttttcagtgatttttgatagctcccattaatgggttctttgcaccacccagcatcctaactcatgatgtgtactgttatgtataatcttggcattgatctcattagctataaaggttgtcctgattttttttcctcaacttccaccttgatttctctcaccagtgccacagccaggaataaagaacaagagcgttttaattagatcagatttacattctgactggctcttaaactagcaaggtgacctagggaaaggggccagggtttccctctatcattcataaatgtaattcagggcccctttttatccccaataccagcatacagaaactgctgtaaaagaagaagttgtgggtatttttttttttttttttgtctggaggaatggggacaccaaaactcatttggcagcagaggtgaggtaaggccatttgtattgtctgttctgttagtagtcatacatgccacttatccctgccccagtccctgttaggagtgttatgtgggtatactgaacgtggaccttccccgaatccaaagaatccagatgctttgaataagatcatggaccttccgggttctacatcgccagatgttgttcatcttctatcttttgttttgcgaaaattggttttttatgtgtattggggttattctgtggaagaaataagctgtgggtcaagattaaagaactttaaacaacttctggcatgtggaataaacacgatctgaaggaacaaaattttcatttgactacatttttggtccaatttgcacccagtgtttaagttaatcacagtgcttggcagtttgtgttgctggatcaaggctttctcactgaaaaccatgtgcttcagaggttcataattcctctttcaccttccatttcacattagttaataaattatgagagaaaacattgtggatccaagttatgtttcagaaaaaaaaaaacaggaaaaaaaaaagatggcaggagaaacttggtaaagtcaaagcaaagttgaaatgtcagtttaagacaaatagtttctccattttcccatatgtgtgcacagggttcagtgaggctgaggggttctgtggaggtgcgggagaggtgctctatggtatttctatgttgcactgtgtgggtttgaaatcagatacatgtaataggtgataaggtaagtgcctgctcttttctatcctcagcattggcatttaatctttccatgtgaacttaaagctcattttatccaatcctttaag

SEQ ID NO: 99580 - DNA, 1083 bp, Homo sapiens
gcattgcacctaatacctgggagaagctattctttagccaagtttgttgaatgaaaccattcattcaaagtactgtcagctgtagcagtactttgtaagcttgactgattttcctggaactccatagtctctcaagtcgaaatttgaaattgcattaagatgtattaagcatgtatcttctatgtattgttaaattcctaaacagaatactgattaacaaaatgttaattttcagtcgcatacaactaaggagttatactagataagtttttctttttttaatgctcctagttgaatactactggttttctgatagaagtatgaccttctggaagtgtttatactttttaaaaaatttgtgaaaactgataacctatgtttgtttcatgtctaactgattatatcttaaaagcaactactaaggtgtttattagtttgtttgttttttaatcttatttagcaacagccaactcagtttataaatccagaaacacctggctatgttggatttgcaaacctccccaatcaagttcaccgaaaatcagtgaaaaaaggttttgagttcacactgatggtggtcggtaagaaattaatctatagtctccaacttactaaataaatatctcccctttccaatctctggagtatgataacgtgacctataaagaaagaggaaaatttggcagagtcaaataacttgagaatttgaacaaatatatgtgtattcattagaaaatttttctcaggagcaaaattatttttctgtcactttcttatttatatgtagtgaaagtttactcattgtgtcagctaggctccaaaatggcccccagtgattcttatctcctggtattcacaactttcttgtcccttcctgcattgaatagggttttacctgtgtagccagtaggacattgtggagatgaaagtgttgtcattttctaagactaggtcataaaaggcattatggccccccaccttgcctcttctcaaattactcactctggaggaagccagcccttcctgcattgaatagggttttacctgtgtagccagtaggacattgtggagatgaaagtgttg

SEQ ID NO: 99581 - DNA, 1867 bp, Homo sapiens
gtcctgctcacacgtttctgcagctcgggaagcacaagggttgttgacactatgggatagatatgttcagttttctgaaaatgtggtgagtttagtgactagcagaactgataattgaaaacctgctttgcattctatttgtcaaaaataaaaaccaacctctaaagtacattcctcacatttgtgaacagttatgtttctaattatatgatgttcaagttctgtagtctcatagacctggattcaaatcttggccctgctctggatagtactctgaccttgggcaaattagagtttctttgagtaccctcaaagatcatactgcaaacatagtagtactgtaggtactaaacacagaatgatgtttgtgaggtacttagcccagtaccaggccttatgtaaacacttaaccgattgaatggtgtcatatgaataaggtcatgacaaggtttttctttttatttaaaggtgaatcaggtctaggaaaatcgactctcataaacagcctattcctaactgatctgtacccagaaagagtcatacctggagcagcaggtaaaaacattcttatgttactgtaagtgtaattctacatgaaagatgctgaagactgcctaattaatattttatgtcttagctgtgtgttttgtttgttcttgttcagctttgaacacaaggaaaacacttttatggggtaggtgtgctgcaccgaggtccttggatttgggttgtagactttctttgacacgtatccatggatccatcctctcttgagtttgtctgtaaaatgtaataagtagtttctgcctatattaaatatttgatggaaggattaagtgagaatgttttacatcaaaaatgctgtgtaactagaagattactaggatagatgttcgaattcatctactgtcagaaagttccagcacaggacaccagcatccacaaatgactgttgaatgaaataggcacacatagtgagagcctaagacttgggctgctgcaagaatatgtagccctttcagaatatttttgaattcagtttttaaatgaattcgtaaattgctttctttttcccaggaacagaaattataatttttaacatttgtgtttttaaccttccccagtagcacaataatcttagctttaaccttcccctttctgacttctctgggatctttttttcttaatccccatggtatctttggagaacctacctctgtagagaggcagtagactctgaagtcacctgtcgtaagaacgtgagctttcctcttcacatgctgcttatattccctattaagtttgtttcttttctagaaaaaattgaaagaactgtccagattgaggcttcaactgttgaaattgaagagcgaggggtcaagctacgcctgacagtggtagatacccctggctatggtgacgctatcaactgcagagattggtatgctcccccatgcccagggatctgcatttgtttacttaatatacttcataaatttatagatagtgttaatgagtgattattaagtttgggattgctgtatataataaaacacctagacaatttaaagcgtgttaaatgttgactttttaaataaggaattttatagagagtaatttttttctggtactctactgtaatttgagatcgcaaagccagtcatccatagactgctagtataaatgaaacacctggatttgagccgtggttggtgaccgagatactgtagtacatcctttctatgtggaaggaagtgaaacctgttagagagtgggttgagtcgtagtgtctgtaaatgactgctcattggcatcattttcacaaataaggaaatgaagaagtagaagatagagcagtctgtcacct

SEQ ID NO: 99582 - DNA, 1057 bp, Homo sapiens
tgtttctgtttctctcagttttaagacaattatctcctatattgatgagcaatttgagaggtacctgcatgacgagagcggcttgaacaggcggcacatcattgataatagggtgcattgttgcttttactttatttcaccttttggacatgggtaagtaattgtttatcgtggagaaatgctttactacatgggtttgtaagttttacccaaactgtgtattttaatataagaattaagataatttgagagagaagagttttgtatgtattttttttaaataagtgacaattctaaaattaattttagacttaagcccttagatgtggcgtttatgaaggcaatacacaacaaggtgaatattgtgcctgtcattgcaaaagctgacactctcaccctgaaggaacgggagcggctgaagaaaagggtgagtgaggctggcgtcctgccctccctctgggtgcgactcgggggcatggggatgaagaaaggagtgtgttcccacgctcagtctgctcaggtgtcgggaggcagggcgggagaatttttcctgcattttagtggtggttttcaaggagaacctgatggttacaaattttaatttttgccttcatgaaggtatcaaatttctattctttaaattctccttatatttaaaatgccctcgatgagtagcagttggttacacacaagtaccttccatgggagttaaatgactcaaatatagaaatgtgatctctccatgaagtttgttattttacctaaattctttactgcaaatgacccatacaaggatgtatctaagtagactggttctctgttctgtttggaaacatagcagttgtcagccagcgaagcgcctctcacccgccagcagctcctgtggtgtcccagttttagtgcctcttccgtgtatgtctgtaaagcctctttattgattctctgctatatatttttaaattgcttactttgttctgattatatgctccttaagaaagtccaaatagtttatatatgctaaactctaaaaatacaaatccctaactgaacataccgg

SEQ ID NO: 99583 - DNA, 1032 bp, Homo sapiens
cagctcactgcaagctccgcctcccgggttcacgccattctcctgcctcagcctccccagcagctgggactacaggcgtccactgccacgcttagctaatttttttgtatttttagtagagacagggtttcaccatgttagccaggatggtctccatctcctgaccttgtgatccacctgcctcggcgtcccaaagtgctgggattacagacgtgagccaccacacccggccgcagttttataaatttatttgacagtaactttcgtcatcagtttgattattgacatttgtatgatttccaatatatttcttacaagatgagctagaattggctacaataacatacgcagtttgctaaaattgatcctggttttgtcattctctcagattctggatgaaattgaagaacataacatcaaaatctatcacttacctgatgcagaatcagatgaagatgaagattttaaagagcagactagacttctcaaggtaagaactggcttcagatccacaacataaataactcctgtttactgttgtccatgttgaggtgagagagattgcctgggtatgttcagttacgagagtatttttgctttcaatatattttaagacctcatgcagtggctcatgcctataatcccagcactttgagaggccaaggcagatggatcagttgaggccaggagttccagaccatcctggccaacatggtgaaatctcatctccatcaaaaatacaaaaattaggtggatgtggtggtgcacacctgtagtcccagccactcgggaggctaaggcaggagaatcacttgaacccaggaggcagaggttgcagtgagccgagatcgcgcctctgcactctagcctggcgacagagcaagactctgtctcaaaaaaaaaaaaaatttgatacagctatcacctaaagcttagaaattttattgtaggtttaatttgttttcgtacaatttgtcccatgtagaaagtatctgacacttttcaagaaaatgttacatacccccagctttc

SEQ ID NO: 99584 - DNA, 2953 bp, Homo sapiens
aagctaaccaactcttttttctcatatgagagtaatatataaattttgagttataggaggcatgaatattttcattacattttccgtaagtccttttagaagagtgtcttctatttcagacattgttgacctgaaaatctcttaaaatctgtctgccatcctgtggtagtgatggcctcacacaggggtggcagtgcctctagcagaaatccccctgagagactcagtcgagacctgtgtttgtatatcatttattggggaagaaagggagagctacacctcactagacatttccacggccatactcattatcctgaaatcccagcagctttatgtacaatttaccaagtaattttaattactgctatttcttctatgtacttgatgggtggttttttttctcatgagaatgtcatgtgcatgatgccaccttggtgcattcctcttctctttcagcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaaaaaaaaaaaaattaatttagccgggcatggtggcacacacctataatcccagctactcgggaggctgagttgggaggagcagttgagcctgggaggtgcagtgagccataattgcaccactgcactttatcctgggcaataaaacaagaccctgtctcaaaaaacaaacaaaaactttagatggaaaggccagaggcttgtgtcgagttctccttcaaaagcatcactctgtacgtgaggacaaacttgttgccattaggaaactgcagcacctgagttaagggtgaggccaggatgagtggcatccaagcagccagtggccgttgaagcagcagcttcgatcctcgcaaagtcctgcagccatcctcactcaccttttctttttaaccattctaatatgtttttatataagttttctgggaggccaaggcaagtggatcacttgaacccagtagtttgagaccggccctggcaacatagggagacctcgcctctataaaaattttttttaaattagccagatgtggtggtgcatgcctgtggtcccagctactagggggaggattccttgagcccagtaggtccaggctgcagtgagctatggtcgcaccaccacgctccagactgggcaacagagtgagaccctgtctcaacaacaaaagtttcctgtgttgtaattcattaaaattctcacattctaataatttgatggatttctagatacatatgttgtacacattgaagtctaattatgagtttggaaatgagacattaagaaagattttagaggcagcaagaaaattccaccctctggaagctgagtaggcgctggccctgagatggagattagtgtgctttgcagagcacagttctcaggtgtgcttggggagcttaccctttgcccctcgttcactcacgcagatcctgctccttaaatgtggtgactacattcgcattaataaagaataacatctcaaagcaaattcttcagataatacctatttttgagtgggtaacagcaagtgttgtcgctcaagcttagagtaagaaaagtctcttgaatgttccatttcatgttgttcgaactttttaaaatcattctgttccctttttattcattatatctttaattagaaaaatgataggctgggcgtggtggctcatgcctgtattcccagcactttgggaggccaaggtgggcggatcacttgaggttcaacaccagcctggccaacgtggcaaaaccccatctctactaaacacaaaaaaaattagctgggcgtggtagcacgtgcctgtaatgccagttacccaggaggctaaggtgggagaattgcttgaacctaggaggtggaggttgcagtgagccaagatcatgccactacactccagcccgtgcgacagagtgagacaccatctcaatataaaaagagaaatgataaatacatgtcattttaaattttaaagtagaattttttgggggggtagcaaataactatttgttgcagtgttatgattctgatttctttcgattcttaggaaagtggagaatgaggacatgaataaagaccagatcttgctggaaaaagaagctgaggtaagtaggaaagtactattggttggttggttggttggttgttttgtttgttttgagacagagttttgcaccattgcccaggctggagtgcagtggcgtgatctcggctcactgcaacctctgcctcccgggttcaagtgattctcctgcctcagcctcccgagtagctgggactacaggtgcccgccaccatgcctggctagttgtttttgtatttttagtagagacggggtttcatcatgttggccaggctggtctcgaactcctaacctcaggtgatctgcccaccttggcctcccaaagtgctgggattacaggtgtgagccaccgtgcccagccaaaaagtactattcttgtgactgaaggtgttttgtttacatccgtagatatcattggtaattaacttaaagtttatagttttttttttaatttgttgaggaggatacatataactactttattactatatat

SEQ ID NO: 99585 - DNA, 2235 bp, Homo sapiens
cctcagcgatgcagctcatttgaagcaggaagcagtgacaggtgtttgcttattttctctgagcttcattttcaacctttatggaatgaaaattttacttttagatcgataaaattttatttctgtatactttctagttttgcagcatttccagtttccaggagcctcatgaatggctttttggtttagttaactttgtggtcatgtaagccctgccttttgctcagtttatgacctttgttaaggagaaaagtagaactgttaataattaacgcagcagacattgcctcactcccacttaagtgtgttttgttttcttttttctagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatcta

SEQ ID NO: 99586 - DNA, 1051 bp, Homo sapiens
tacagagtagttttgtagttgggccccaagacagaaagtgggagaaagccattatttttttccctcttgcttcctctcctccactcagccctgcagtggcaggagtgtgtgaacacctaaaactcttagggaatggggaaaaccccagttgcctttttattctcttccctcctgcagctcagtcccaggcaagatgcaggcacaagaatagcatggctaaacggagtaattaaagccgtaggtttctggttggagtctgaaaaggggagcccaggtcactggaagggatactagggagattccagagagggaattgctcaggaaagtgaccccatgaagttgttagttaacttataggctcaacactgagctatgcacgcgtgatgtgagccagaacaggttgccaaagacggaactcggctatgggatagaccatcgcctggaaggcaggctggccaccaagcaagtagggaccgcaggacattgctgaggagcactgcaaaggctttgaaagtgaaagtgacactgataccatgttctacagaaggctggtcaggacctggggactgaatccagccaggccagtgcctgctcaacaaaataccagcattccccataggatttaaacaagatcaagagtctctaagagtgtgatgttaaaaatgtccaggatacaatgcaaaatttactcagcatgtgaagaaccaggaaaataactcgtgaaaaaagacacaggctaaagctgaggtggtgcctatgttggaattatctgatagactgtggtctgcagatttgtggcctccatgagcttgacctcctagtgtttatcctgggagtatgtgactgatttggcaaaagcacattgcagatgtaatgaagggtacgaatcaactagcctggattcgttgtctagattatccaggtgggccttaggtaattatatgagcctttaaaagcagggatcttcctccagctggtagcagatggggaaggcagagagactggaagtataagaagttttcaacgtaacatttctggcatggaagatgga

SEQ ID NO: 99587 - DNA, 1375 bp, Homo sapiens
gaaaacctcatatccaaactgagccattgccacatttccagaaaaaaacaaataatacaacctaaagaagttgtaaaagcaagggattagaaacttcagtttgaagatagcagactgaatatatgtatttatttttattccctcaaaaccctgaacacaatgacagttgaaggaattttttaaacatttaaatccgtaagaacaaagaatgggaaaacagcccacgaaagatgaggatagcagcaatgtttggaagctgggaaatgaaacagggagtgggacctgactttgcagagtagggaaggctggaatctcacagccttcagcggcaaagtcacagtgcaagccaacatgttcccaggagccccagaaagggctcacagttcatgcttatgagaaataggaatacttctttatcagaaatgtaaaattttatcttgtaatttttttatttttatcagccttgtttgtgatagtaaaattctgggaattaaccgttagaaagccagttaaatagcctggcacagtggttcacacctgtaatctcagcactttgggaggctaaggtgggcagattgcttgagtccaggagtttgagaccagctggagcaacatggagaaacctcatctctactaaaaataccaaaaattcattgggtgtagtggcatgtacctgtagtcccagctactcaggaggctgaggtgggagaatcacctgagcccaggaggtcgaggctacagtgagccgagatcgtgccactgcactgcagcctgggcaccttgagtgagaccctgtctctaaataagtacataaataaaagccagctaaataaatggtggtgcatccatgtgaacagaatattgggcaactgtacaaacaaggaagcagctctttatgtcccaataatgagacatccttcaagatgcatcattacatggagaaaagattgaaaactctgtatagtagctactgcttgtggggaaaagagagaaaattatatgtgcactatattccacactattaaatgaactggtgacattaatggccccagggaagagtggccaagctggcaggctttggaacagtgctgagagggagacttgcactgtggactcatttttgaaccttcagaatttgagccttgtgaatgtatcactgtattacattttcacaaaaccttcacaggaataaaacactgcatctctgaaatgagcaggataccatgatagaaacaaatggagaacataaaaacatttgcaaattaaaatacaggctgccccagtccatccccaccccatgtctcctacctggtctgcacgccaggcaggggtcatcagcctctttgtcctgcagagttgtgctggcacatgctct

SEQ ID NO: 99588 - DNA, 1174 bp, Homo sapiens
tggaggccccgacacaccatcggcccagcccctcgggccccccgcactccagcctggtccaggtgtcgggttttgtcatgtcgtgagcagctgtggttctgtctgtgctggggggcagagtttcagtgccttagacctagacacagggagggccggtagggagctcagcgctgcttgtaaaaatgacaatggtggggatgactttaccacaggctcatttccttccggtggggagcaccggtgtgaccggcagtgtcgtgggggggcccctgctttcacattgacaaatgcccagctgcaggtatctgaggagttcatagacgatgacccagcagacatctccttctttgctggaggctctgaggcgttttcttttccttatggctctgtagtcccacaggaatctcaggcctctgcccagcctctggtggcccctcctttgtgtgagcttccagggtctgctcggtccagcccagacaggtactccatggaggcagtagatatgaacacagaagacggttttgcatttgaggaggaaagtgacttcaatgggaacgcacacccctcagacacctcggagctatttgaggtgaaggcgcaggccagccggatgcagcgcctgctgggtccttctgagaccagctcactgagaaacagccagtctgaaaacagctccctcaataacatgccactacgtggtgggctgtctgtgcacacatgcagctcagccagtcaatctgaggccagctccatggtcaacttcccagcctactcagtccgctctgagtccagctcggccttccagttctctgacatcatcgaccagttagagcagctcagctacccacccacgacggccgaggactccagcagcacagagtcagactcatgggactctgaaaccgaggcccccctagacataagccttttcttcagcaacccttttgcacacacaagtggagaaagagtcccttttgatttacagaacaatttaaagaatttgactccaggagagcaaatagataaaaacccatcttgaccactctgggttcctttacaaggcaacccactcacccacgctgtgtggtttagagctcagaattgtttggtttaaacacagaaagtgactttcatttcatggatagatattcaatttttttttaatttcctgatt

SEQ ID NO: 99589 - DNA, 1044 bp, Homo sapiens
aacccttttgcacagacaagtggagaaagagtcccactgggactctggggggacagtcatccattgcactggggttgggggtgaggggatgcctggaactgtcccagtgccaaaggcaccatgtcatttttttttttaaaggtgtcaaagggccactgcctcattattgacttgagacccagaaatagtgctgtgtgtagatagtggtcttggagaggcgttggtttaaaatgcacttatgtaagtttgagctgttttcttttcttcagcttaattgggaactagaagatacgtggttgcaaaaaaagcagaaccagacacaccatgggcatcattctgtcccaggacaatgggaagggtcccaggggcaggtgtgccaaggtggccctgcccacccatccagcgtacccgtaaacacataccaggtgccatgggccctgctgggtaccacatggagagcttctcagtctaaaccaccataaaagtcaaggctgatgtttgtggcacagagtgggtaggtccatccagggacgtcatggggaaaccactgccatgcagctcagcacccacaagtgccggtctcaggccagccctagatgacactgttcaatttgtcaagtccacagatagggttggggtttttgttgtttttcttttctgatcttacctagtagtgcaataccacatttaaagtttaattctcttcccagaatgtcttgtggaaactttacatttcattcctgttcacattgtaagatctctgatgttttgcctggatggatttactgtgattgcacagggaccacgtggctcaggtgtctgagccattgagggcatcttgcaagggctggttttccttttctcatcagtgttggctggatgccagcaggggttttgtggctaaccacatcaggcagtttcccatttttgtagctttgttatacctaaaccgcagtctcatcattttgcttatgcagctagaagtttcagtctgtatagttgttattcattctgtccctggtaatttagacctgccttcttgat

SEQ ID NO: 99590 - DNA, 1044 bp, Homo sapiens
aatacctgtgaaaatgttaacagacagaagcgcagcagtgaacctgaggtcaggacaggactgtttgggaggttcttcttttcttactgtcactccaaaaataaaccttggatttgtgtgctggggagaaatgagtatagataacatttaaaacgttttcctaaaccttagtattcatatggtagctgatggttcctctccccttcattactgttgcctgacgacggtccttgctgatgctgtgaactaacaaagttgtctttttgtttttaagggaacccaccctggcgtctggacagcaggttaggtttgggtggttttgagctagcactgctgtggggcaggggtggccgctccctggtgaagctaatgctgtggaagctggaatgttccttcctaaggagtgggatcatgcccctaccccagcagaggtatctcatcactcgctcatgtgcgagattctaaataaattttgttcttgggcatcttctactaggcctcctataaaatagatcttgctgtttttggtttgtgttaatggaacctcactttctagagataattctttagttttttatttaggaagttttcaaaatatacaaagcaggaatgtaaggaacccgcatcacctcaaattcagtgttacccacacttgaccatgcttgccccagctgtgccttttttctttccttgggtattttgttgctaaagtattttattattactgttttagagacagggcctcactcctgtcacccaggctggagtatggtggcacagtcacatctcactgcagcctcaacctcctgggctcaagccatccccccaccccagcctcctgagtagctgggactacaggcacacatcactgcgcccagctaatttttaaaaaatttttgtggagacaggttctcttcatgttgcccaggatggtcttgaattcctgggctccagcagtcctcctgtctcagcctcccaaagtgccagaattgcaggcatgagcctgggtgctagagcgaggccctgtctcaaaaaaaaaaaaaa

SEQ ID NO: 99591 - DNA, 1077 bp, Homo sapiens
gactctacaagaggccaaggaggacactggtatccctgcgccatggcagctgcaccccagggggtgagccatgggccagagggcacccaaatactcaccggggggtccagcactattagctgaaaatcaagcaaaggaaaaaatgttgagcattttgattatccaaaagggagttggacaattcatttatgaaccaaagaccaaaacctaacagagctagattcaaagaaaacccactgtggattaattttaattttaagtagttagatgaaataattgcaaaataaaatattaccaaatctaatctaaaagcatgtaacaaggaattgtcccacgatcaagtaaggttgtttggggaatgcaaggatcgttcggcattagaaagctgattgataacattcatcctatcagaagtcaaagagaaaaagggaaatccattctctacatgctgaaaatgcctttgccaaaatccaaggtgttatttctgataatacctcttagaaacagaaggaaactgtgttaacatgataaagatgatcttttcaagccaagagccatcatccttcccttaacagtcaggaacgagggccagttctctgtccccaggaccagccagttaccaacaactccacagaatggacagcttccctgtgcagagcctgatacaccaaccaagcctctcactggacatcaaaaatctgaatcaacataagcaagggcaggcaaaacattgtccagatgttagtcttcccgtaagttaacacaaaaatttaatgcaatttcaactgaaatctccatggtgtttttgtaaggaatttgtccaatgacttagaagattacttggaagaattaaatgcttgagaatagcaaagaatcttttttaaaaggaggcagaataagggatggaatgtgttcaccaaacagtgactatctcatatgacaccactaatgagagagagtggactgatgctggacagacaggaatggagcagaatgcccagaaagaactcgagtgcaaagacacaggcttccatttgataaagtctgagatcagtgagaaaatgaaggattcaacaa

SEQ ID NO: 99592 - DNA, 1865 bp, Homo sapiens
ggagtggagccgttgggctcctgctggcagtgcccctgtggccctaggtggccctgggtttgagagtggcaaggagggctgaggtcctgaggacagccctgctgtgccctaggaggccaggtggatggtaccctggcccttctcagggggcccggggtggagccacgtggagcctgggatgacgcctgcctgtcctgtgtcaagcagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggtgggtgcagcgggcgggcaggtgcgggcaccatgcctggctcgggtgctcagggcagcaacagtccttgtgttctgtccaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattcgtaaggcccgcctctggcccggtcccttctagacaggacgtggagggagggcgttcgcttggggtgggcggcacagcccggaggcccaggcccaccagccttgtagctgtgagggcccgccccggtccaggctgcctcacgtttgcttcccttaggcagagcttggctgggcccagtgactagtgttcccctgaccccctgcagcggcccacggccaaggagctcctgaagcacaagttcatcacacgctacaccaagaagacctccttcctcacggagctcatcgaccgctataagcgctggaagtcagaggggcatggcgaggagtccagctctgaggactctgacatgtagggacctggtttatcctcatggtgaccctaggtgctgtgacgtgggtggtccccactccagaagcaggggcgtgggccctgggggtgagggtgaccagatatagtgttgggcagggaccccctcaaggctgcaggacagggcctgctgaggcatcagctggaccccgtggcctggcagagccccgtctggtacctcgggtttcccttggccgtgaggtgtgccctgaggccctcatgcctcctggccctctccccactggccctggcaactcctcatcctcttcagtgatggcgaggcggaggacggggagcagggccccatctggacgttcccccctaccatccggccgagtccacacagcaagcttcacaaggggacggccctgcacagttcacagaaggtctgttcctggcctggcctttgccctctgtgcacccctggggccgtgggatgggctggatgcgggacccagctttgtccacccagtgtctggagcttggacaaggagcttgggaaaggcaggggtggtctgaagcccactgtggcactaggcctggtgtggagaccccgagccccagcatgtgccgggaagatgagggcctgtttggagccaaatttgtgaggagagggtgggagtcacaggccctcagagtcaggagagggtgggagtcacaagccctcagagtcaggagagggtgggagtcacaggccctcagagtcaggagagggtgggagtcacaggccctcagagtcaggagagggtgggagtcgccctcagagtcaggccatccgggtggcttgatggttttggggccggccctggacatgtgccccgacaggctgctcccagcctctgtctcttcaaggctagagcctgg

SEQ ID NO: 99593 - DNA, 1026 bp, Homo sapiens
aagtagcttggattacaggcatgcgccaccatgcccagctaattttgtatttttagtagagacggagtttcaccatgttggtcaggctggtctcaaactcctgacctcaggtgatctgcttgccctggcctcccaacgtgctgggattacaggcatgagccaccgcgctcggccaccagtttatttttaagaactgcagaaataactcctttgggtcacaggatgagaaattggagctccgaggtgccctgtaactgtgtgctattggttcttggtgcgatcgcacacagggaagggagtgcgggcacattggagaagggattccaaaggtaggaagctccttttgtccttttagggatccctttgtcccagcctggatgatgagagacttgacttcatatagtggcagaaaacctgaggggctgtggttttctcctgagatggttgccatggtgtcctgtggacctgtggggcagcccctttgtgggagagtggggcgcgttccccccatagcctgtgctcctgccttagacttctcccctctacctggccagttcctgcctggccctggagggcccgaatggctgtggggtgccagagcactgtatcaccactcagctatgtgtgctgggtcattccccttgttttgtggggcaacactgacagcagacacattggcaagtggaggccccagacctggcagccccagggctaatgtggagaacaggtgtccaccgctcgagtcagctgagtggcccgagtgatcatccaggccacagctgctgctacatccaaaagaggattcgcagcctccaggccaggggcccacttaccctttcttctccaggtgggggtggggatggcttgccttggcttggcctgcgatgtcattgtagggccaggatcacagccaagagggttcctgtcacacagtttctgcttgggctgatgagccctggctctggcttaggggtccgctgtgctcccctgctgtgaagcagtagaggtctgagtgcccacccaggg

SEQ ID NO: 99594 - DNA, 1041 bp, Homo sapiens
tgtgtctctctgtgtgtgtgcttgtgtatctgtgtctttctgtgtgatgcatgtgtctgtgtgttcatctgtgtgtacgtgtggtgtgtatgtggggggggttgtgtggtatgtatgtgtgtatatgggtggtgtgtgagtatgcatctgtgtggtgtgtgcatctgtgtgtgtggtatgtgtgtgtgtgcatctgtgggtctgtgggggtgtgtgtctggtgtgtgtgtgtgtatgggtggtgtgtgagtaggcatctgtgcgcatctgtgtgtgtggtatgtgtgtgtgatgtgtgtatctgtggtgtgtgtgtgcatctgtgggtctgtggtatgtggggagggtgtctgtggtatgtgtgtatgtgtagggtgtgagtgtgcatctgtgtgcatctgtatgtgtgtggtatgtatgtgtctgtgcgattgtctgtggtgtgtgtgtgcatctgtgtgtctgcggtgtgtatgtgtgtggtgtgtgtgtggtgtgtgagtgtgcatctgtgtgcgcctgtgtgtccgtgtgtgggtggtgcctcctctctgccctcctccctctctgtcctccttctggaaagcctgctggatggctacgacgacgacttgtggatctcacctccgtgtttctcagcttttccttgacaatttatttctaggtccacaatctgcggagtcgccttcctgggctcagtcttcatcctgtcaatgttttcatcttcatccattttgctactcagtcccttcacggtggcgttttatttgaattcatgtttgtactgttccttttctttctccagctgatccctctctgcacacacagcattctcctggctctcgccgagatgtctacacacattccggagtctcctaattgctttctcagttatgtttcccaggggcgggagtggggtgactccttccctcggttgcgctgccgtttcctttctgtcttggctgtcttccatgcttggtgtggtagctgaataacggcccccaaagatgtcctggtcctgatccctggcacctgtgaata

SEQ ID NO: 99595 - DNA, 1034 bp, Homo sapiens
tgaaccccttgacttccgggcagcaaaagcatcggggccagttgctccaaattgggtctcacctccacacttccttctctttggggtgctggtcctcgctgacttggtggttctctgacacctttaaagaaacttcttaaaacctgggttgttatctgcaggagggttggtcagttacagagtagtcagccatggccataagcagaactccgtttcatccacttctggtgccccccaccccacatgaccccccacacatctggggcactagagagatagtgcccatcagagaattgtcttttgacagtggtcactctcacaatttgccggcaaacattctgggcatatagggctgactcattcgggacttagctgccataggcttggattcttgttggaaacagctgctataatttattctgatgaattactgttccaaagatggtatttctgagctttccaagaacacactggacatcagttctagttacagtgaaagtgggaggcagtggagaagggaagcactggaagctcagcgcttgtctgatcaggtatatgatttgtagagaccaaaaaaaggtgacttctcccatccaagtactaaccaggcccgaccctccttagcttccgaggtcagacgagatcaggtgcgttcagggtggtatggccgtcgacaaaaaaggtgacttctaaataaacaatccctgtgttcccctggtggtcttctggaggcagctgaagggcacctggattgtgacatgcccaggggccctgggctgtgtgtctaccctcctctggcagggccactgcctggctcacagcccgtgatgagtgtgtggcatgcagtgggcgcacaggcattgattgaatcttttgaagataaaactaagctatctttgttccattctcctgctcagatcacccggaagttcaggctgaattctgaaggcaaacttgagcagacggtctccatggcaaccacgacacagccaatgactcagcatcttcacgtcacctacaagaaggtgaccccg

SEQ ID NO: 99596 - DNA, 1050 bp, Homo sapiens
tagacatcattgtccattttggtattggagttattcacaggctagctgggagcttcttagcttttgcaaatgttctctggcaaagggtggccccgtgggagttggtcggcctctctgggaaggtatctggtaaccagacctaagctgtgcttttactttgttccgtgactgcttgtctctccacgttcttacttggctccatctgcaaattcatgttctcctgcaaaagtgtccgtttcatgagattttcagaatttttggaagaagtaatagatactgttttctcttgatgtgctgttctatgtcacttctcttttactgatgttttgtgtgtgttttctctttttcttgatcatacttgtcagaggttatctattttatcagggttttttgtttttttttttttgtttgcatgtttatttttgctaaataactagatttgggttttattaatttaacaaaaagtggctctttttctgcaaatagagggaggagacagagacgatggagttgcgaagcctgggcatggcgcttaggggaaggctctgtgccatgcagcccctgcaccctgggggctttggggacctctaccgagcgacttaatggacagaagctggaagcacaacctgaggggctgggcctccccattgggttgacatcagcaggactgaggaagccaggaagcacacacagaaggcagggaccttgaggctagaaggagagcaggaggcaagaagagctgggtcttggagggccagtcctactaggcttgtgcgggggtgaaaggagctgtccctgttattacagtgttgggggaatttcctgggactttgtttgtagccaaatacaaagtcagtgtttatcatctttccaatatgtattgggggaaatgtgtcttccttgttaggttcagagttctgtagctttatgtgctgcataaagaagttttccagctgggcgcagtggctcacacctctaatcccagcactttgggaggctgaggcaggtggattacctgaggtcaggagttcgagatcagtctggccaaca

SEQ ID NO: 99597 - DNA, 1029 bp, Homo sapiens
ccgtgaggtagtgcgtgtcttgccactgtgtctcacaggcctgtcttcactgtctccttcttttcccttctcggaccatccagggtggatgttccctaaattcattgccccctcctcggctggtcagtggtgtggtttttttgaggtttgttgtttgtcacaaacatccttttgcatttgggttgtccacgtttacagatatatccatatctattgataaatttttcccagttaaattgctggatcaaaggacaggtacattttaaatttgatacacactgttagattgtatttcttcatgattatcctcccactatctcttgcatgagggcagctggttccctactccttaacaacatggtgtattttcagaatttcggtcctttcaaatctgagaaataaaagatgaaatctcactcatgttttgaatctaacttagaagcaggagggctcattccccatgctcactggctgtttacgcttcttattctgtgcacttgatatttaaagtctttgcctgtttttctgtggattgttcttttttgaggcggagtttcgctctgttgcccaggctggaatgcaaaggtgggatctcggctcatcgcaaccaccgcctctcaggttcaagcgattctcctgcctcggcctcctgggtagctgggattacaggcatgcgccaccacgcctggctaattttgtattattagtagagacagggtttctccatgttggtcaggctggtcttgaattcctgacttcaggtgatccacccgcctcagcctcccaaagtgctgggattacaggtatgaacaaccgtgcccggccagattgtccttttttttttttaaagatttgtaggagctttctgtatgccatgggttaatctgttgtctgctttatttgtgacacatacttccctagtctgtggcctggtccatgatgggctgtgccccacaggtgctcagctttcctgttgttgcctctgggctgtttcctttacaatgtctggatttgggttcttgctaagga

SEQ ID NO: 99598 - DNA, 1055 bp, Homo sapiens
tcttggcttttcgtggggagaacctgatggggttcctggaggtgaaacctatgaaaatgtaggaccccaggagattctcacacctgccatgttcagcctccagcattttgtccaaatcaagttcccaccagttccttcccctgtagactgtagattctgctccacgtgagctgatctcactgctattctctgtggcaggagagacatctgtgacctcacttccttatggatccaagaaaagttgttgattttcacttctttcagtgttttttgctgttgttttaaggctgtggtatatgactcctaagctctttacatgtgagagtggaaaccggaagcttactccccacccattatttttcggttattgctagcgtgtgggaaagctacccattttagtaattggccatcttatcaaattcacttgtagattctaatagttcttcaattgagactcagattaacgaggaaatcaaacataacatttgcaaattatttgtatccactttatggcctttttatattttatagaaatacttgctgtattttctctccatcatgatttctgtttttcccctgggcatgcaactccttccgtttcatggttgataagttgagggccttgatgtcactttaaaacaacagttccctgctggtatgccttgtcagtggacccaaacatatcacggtgttcctggacagctcctccccaccttgggacagctggtgcgggccgcgcaccctcagcttccatgcaccctgttgtactaagcagtaagtgtccctttctgtgtgtgccttggcaggaaacaacgtgtcactaacacaaagagatgtgagggtgggagctccaggaaggagccgtccccaggtcccagtgggtgcatttgctcacttcctgtcctgggttcccgggccgcttgccaggagacaggacagtctctggagcctccatgtccaggtgaagatgagtctccagccaccctctaggagacagaaaaggacatgccaggggtggccagagggactgctctggagagagaaagcatttagga

SEQ ID NO: 99599 - DNA, 1059 bp, Homo sapiens
gccgtgaactgctccaaccggcagggaaagggcgagaagcgcgccgtctccttccacaggtacgcgggccccgggccgccacgcccccgccccgacccggccctgcggggaaactgaggccccgcggccggcccgaacgcggggggcgggggcgccgggcctcggcggccggggcgcgggggagcgggcgtgggcgctgtgtgaccttggcccggccgccgtctctgggccgggcgcctcgggcagcgcagccgcccccaccccggccgcctgggtccgccctgcgcgcgatcgatccggccggcgcctaggcttcagaagccgcacgctctggaagcgcaggtcctgggccgattgtcctgctcggccgcgactgctgactctccggaccgcgcgggccgtcggcctggatgtctgcgagcaggagcgaccgggcagacgcgacctgcgcctccgtagctgacagcccccgagagggctttccgggactgggcccccgagcccaggacgcgggtacgcgcggagagtctacgggacggccggctggggacggcatcctcctgcgctcccttagagcctggcccggggctctcggccgcttcccacgtgggcccccgcggcagggcccaaacccctctaaggccttgtgagttcagcctatttcagtgagatttctgcggattacacgcgggaggcaccagaaccgcgaacagactttaaaaaccactttggagatgtttctgttttatgttgcatggtgttatttaagttttaaagacgggaatggcacgtgttatttatagggttattgaaagttcacagtagtttgctgtaagtcttaaatcattacaatgtattataagaattagtaacattagattatttcacaagtcagccagcgcactttcttgacaatttccttcagagcttgtgtcctagaagttttgttattgttttttgaaaacgaggcaacgtgttgcaacggtctaacatggtatgggaggaaaggacatcggaattgggggtgggggggtacctttgcagttggcctcacagtgt

SEQ ID NO: 99600 - DNA, 1049 bp, Homo sapiens
cgggtcgggctgccgcgactcgcctcggggcacgccggtgcgggccaggctgggccggggcggcgggcgctgcgggagcgcggggcggtgttggtgggtggtgggcggtgggagcgggagggggacggcggcgcactgcgccgcggaacccgccgtcggttgcgctggagcttctgcttttccggtcccgtccggagcgctccggaggttgtggctgcacaggcccttgcgccaggtcggccgtggagggcggcggagcctgccgggcggggagaggcgcggcggcgaacggggcggccgcggtccgggccggggacgcgagcggcgggcgaaagcgtagcctttccgcagctgagcgtgaagggatggaagctctttaacttttatgaagttattggtaggttggaggagagaaacgtgacgtgttcatcacagtatacgtatcttttttgtttttgtcttcaatttagtaaccagtagattctccaagctgcttttccgtgacgagaaagagaaacagtgaatttgtatcatcgggtcttagtttcttggggtcctaagagagagagaaagagaaggagtgtgtgtgtgtgtgtatagggagtgttggtttttttcctatcctttcatgcttccgctccatttttgctagcaagattattttaagtcagcgccaaacccatcgctagcccagtagccctagaaatatttttacacagaagttttagctcattcattctttgtgggaactgatttgccttttaccaagtatcccccatctgtaaagaaagattttcatctggtttaattctgtcattctgaatgggattgtttttactttttatttttctggtagctacaacataaatttattaagatctgagttggaaaactgtaatgtgtattgccaatatctattaaaatgatttgtagcagctcaccacttaaatgtggtaggtggctggaggaaacaggagccctgactccctaaggagcatgttgaccaggtgtatatcttgtgaagtttgtcttttagaataaccgtcatt

SEQ ID NO: 99601 - DNA, 2097 bp, Homo sapiens
tttcgataccttgaggctggagtatcatatgagagacttggctaaggtcaaaaacacggttcagtgtcgatcatatgacctaaaatgtgaaaatcatcatgttcaagttgggagaacagttatgttgttacatggcgatactttattttatcttttattttcccttgacaactgtgttgacatggtgatactttaataggacactggatgttgctgcatgtgggatcagagtagaaaaggtgtttgcatttaaaggtctctgtttatgctgataaaaacgtatatgatgtttgtaggatatcatggggaattttccttctgacttgatgctgtatttcctttcagagatgattaatgatctgccctcctttgatctctagagttcttgaagattctgccttccttgaccatgtgtaatacagtttctgttctgatagtcattaattcaatacactgtttgttactgactgtcagatatgtgttaggcattgttctagacactaggactagagaagtaacaacatagatgaaaaccattgccctggggtagctaacgttctagacatgagaccagcattagcagcgaagtgcgtggctcctgggggatggtgatttgggccaaggatgaggaggattggaattgtagccaggatggccaggaagggtctcactctgaaggtttaagttttgacgaagacttaaagcagtgtaggaggaagggcaggtagcaagagcctggtgtggctcaggtgcagcgggtggcggtgggagaagcaggagctgaggatagaaaggtgacttaggctcagtgtagtggggccttgccagctcatagtgaggactcggtgtttattctgaacaggatggcagctcatagtgaggactcagtgtttattctgaacaggatggcagccgtttggaaggtttcattctagaggaggagtcacatgatagactgtgttcaacaggcttgctctggcatctcttttgagaatgtactgcagaggggcaagggcagaggcagcgagaccagctaagagactgttgaacaagccagcaaggagatgccagtggattagctcagggtgggtaagaggttgacttctgcatgtgttttggaggttgagacaatagaatttgtttgtagattggaagttgggagagggatgggtagagagggaggagttaaagatggccccatagtgtatggcctgagctaagcaactcagatggaggggggcgggcgtggtggctcacgcctgtaatcccagcactttgagaggccgaggtgggcggatcacaaggtcaggagatcgagaccatcctggctaacacggtgaaaccccgtcgctactaaaaatacaaaaaattagccgggcatagtggcgggcgcctgtgatcccagctacgcaggaggctgaggcaggagaatggcgtgaacccgggaggcggagcttgcagtgagccaagactgcgccactgcactccagcctgggcgacagagcgagactctgtctcaaaaaaaaaaaaaaaaagaaactcagatggggaagacttggggaggtcctgtctggtgggaagctttctgttgcgagtttggatttatgtgtgttgaatgtgaggtggatgttagacatccttgtagagcagtgtccagtgggcttttgggtctacaggtttggagctaaaagaataagcctgggctggagatagactggaggtcacatcagatgaggtcacccagggtgtgaatgtgggtgggaaagaaaagaggccaaaggcctctgcgggtgtggagaggtccaggaggtggcaggcagaccacagtgtggctgtgttctccaccagtccctagcactgtccctaaaagcatgctccccattcagacgactggcaggtgccagcacttaaatagccacactgcccattccttgaggacagagctggtgtcttgtgcttgcatttctagtgcatcacttgtgtctggcatgtggttggtaataaaaaaaaaacagaacttgaattaataataacctacacattcccctactatcaaagctttcagtttgtagagtttaacataaatccagtatgtta

SEQ ID NO: 99602 - DNA, 1053 bp, Homo sapiens
tgaaatgggacggtctctgagctgtggcgcagccccagagtgcacaccacgctccatgcacctcctgggcagggtggcagtagtggggaacatgggctggagctctgtggctcacactttttgtttgtttgtttgtttttgagacggagtctcactctgtcgcccaggctggagtgcagtggcacgatctcggctcactgcaagctccgcctcccaggttcacgccattctcctgcctcagcctctggattagctgggactacaggcacccgccaccacgcctggctaattttctgtatttttaatagagacgggttttcactgtgttagccaggatggtcttgatctcctgacctcatgatccacccacctcggcctcccaaagtgctgggattacaggcgtgagccactgcgcgcagcctggcgcacacttcttaccagaacctagtcacgaattcctcgtcgaactagaattaggtatgtttgttactgtaaacgcagcttggtggcttacagtgattggcactctaacagtcaggtcaggctagagagccagccaccgcagacagaggagtggacgcgtgaacgttgagttgagaccaaaggggccacctggtgggataactgtcctcacccgtgaggaggaggaatgtcccctgtccccgggggagagtgctcctacaccagcgccgaggcggcagaatggtgtcttcaggggaagagagtgcccagtttgagcttctccccccatttcgtttctttttgtgttaacatctgcgcatctggcagcgttgagaattcctagtgactgtcattacaggcggcagctttaaggatgtgattgccggtgacccttggccggtcccctgtctcctggctcctcagcaggaggctccctgtgtcacggtgtccttgggcagttctcggtggcctttgccgccaagcttccagggagctgctgggcgaaggctgagacccagcggccctgcctcacagtcacagagagaagagctccccacttggccctaactcataacctgccccaatcccgga

SEQ ID NO: 99603 - DNA, 1051 bp, Homo sapiens
tcagacacagacatgaatttctgggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtgggcggcctgggcagaagggcggctggctgtcctggagctgctgctggagcctgccctcagagtgtccctttccagtgctgtggcattctgtggcagcttccccaggtgtggtgacggggggggggcggggcctccacctgtgacagccaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccagagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgt

SEQ ID NO: 99604 - DNA, 1122 bp, Homo sapiens
tagaatttgctggcactggccgggcgcgatggctcatgcctataatcccagcactttgggaggccgaggtgggcagatcacctgaggtcaggagttggagaccagcctgaccaacgtggagaaaccccatctctacaaaaaaaattagccaggcatgatggcacgtgcctgtaatcccagctactcgggaggctgaggcaggagaatcacttgaacccaagaagcggaggttgcagtgagctgagatcgtgccattgcactccagcctgggttggcacccagagcaagattctgtctcaaaaaaaaaagaatttgctggcaccgagaacccctgaacgactactcccggggctccacatctgggaggaccagacggaaacggcagcagctttgctgacacaactgtgccagccaccacggtgtcatcctgagccacttctccacgcttcctagtgtgcaattctgggattctcaccttccagttcaaagtcgtgtctttcatgagctggtggaaacaccggagcgcccgctcctggaaagccccgttctcatagcgctcatggccaaacgctccccgcttggcagcatccgccagctgtaactggaggaacaggaccaggtcgggtttgggaaggcccacgtctggctgtttacaccaatctagggaaaaattctgccaagaaagaacccaacagttaaagcttagtgtagtctaggtttttgtttcgaaagtcgtaaaaacaggaaaaaatgaggggacatttggtgaggtaccaagatgtgagactgtttatattgtggctcgtttaatttttagaacctcaaacgtgtcggtttctccagtgtcacctttgtttttcctttgtaaacagacaagtggacagaaaagtaggtagatagaacggctgccagtccccgccacccacagcccaggccccatggaggccctcccagcacagctacaggcctgctggccaggagcaaacagtctatgtacagaacccctggagacccccggcctagaacgcctgcagcacagagcagctgggtccggacacaggcacgaggtccttggcagtgtcttttctgccacacacacgccagggtctcctctcccgtgga

SEQ ID NO: 99605 - DNA, 1030 bp, Homo sapiens
gtgtggcagaaaagacactgccaaggacctcgtgcctgtgtccggacccagctgctctgtgctgcaggcgttctaggccgggggtctccaggggttctgtacatagactgtttgctcctggccagcaggcctgtagctgtgctgggagggcctccatggggcctgggctgtgggtggcggggactggcagccgttctatctacctacttttctgtccacttgtctgtttacaaaggaaaaacaaaggtgacactggagaaaccgacacgtttgaggttctaaaaattaaacgagccacaatataaacagtctcacatcttggtacctcaccaaatgtcccctcattttttcctgtttttacgactttcgaaacaaaaacctagactacactaagctttaactgttgggttctttcttggcagaatttttccctagattggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaaggtgagaatcccagaattgcacactaggaagcgtggagaagtggctcaggatgacaccgtggtggctggcacagttgtgtcagcaaagctgctgccgtttccgtctggtcctcccagatgtggagccccgggagtagtcgttcaggggttctcggtgccagcaaattcttttttttttgagacagaatcttgctctgggtgccaacccaggctggagtgcaatggcacgatctcagctcactgcaacctccgcttcttgggttcaagtgattctcctgcctcagcctcccgagtagctgggattacaggcacgtgccatcatgcctggctaattttttttgtagagatggggtttctccacgttggtcaggctggtctccaactcctgacctcaggtgatctgcccacctc

SEQ ID NO: 99606 - DNA, 1105 bp, Homo sapiens
tttgcaccattgcatccctctgctgctttgtcagaggccagttgactccttatgtgggtgcccctgtgatttgaaggccccagtgagactggctgagtcgaatgaatcggacttttctttctctgtcttgagcagtgcttctcactagtgtcaggccccgtgtctttgtacatctgtgatcttggcagctgtagggatgatggtggacttgtggtatttggctgagaacatccttgcagtccaggctaggggtcatgagcatggatgagtcacctgctggctgtgcccacgcttcccccgccaccatcctctgctctcttctttgcctgtgctttcttcttcctcgacagggtagagctggcctctctgaccaagacagctgacagtgcatctcctttcccctgccgtgtttctggaacattgaactttaccagttgtgtttgttactatttagtaaggttatcttctccatgttgggttttgctggaggtgtgggtatggcatcttctagagaagatccagacctttttggattaaaagtaaggttacaaatcactgtgctgtacttgttgtcatatgagatttctgagttgtattgttgggataattttctttttctttttttgagatggagtctcgctgtgtcacccaggctggaatgcagtggtgtgatctcggctcactgcaacctccacctcctgggttcaagcaattctcctgcctcagcctcccgagtagctgggattacaggtgcctgccaccatgtccagctaatattttgtattagtagagacagggtttcaccatgttagccaggatggtctcgatctcctgaccttgtgatccgcccgcctcagcctcccaaagcgctgggattataggggtgagccactgcgcacagcctgttgggataatttaagcttgacagttcaaggcctatgaaacaggaccagggctcaggagcatcctctttttcaggccgttaattaaggaaaagttgagccagggcgtgaccctcgtcgtggacagatacgcattttctggtgtggccttcaccggtgccaaggaggtgagtgccacttggcctcctgtcaggcgagcacag

SEQ ID NO: 99607 - DNA, 1649 bp, Homo sapiens
gactacaggcgtgagccaccgcgcctgccctaatttttgtatttattttagagatgggattttaccatgttggtcaggctggttttgaactcctgacctcaggtgatcagactgcctcgacctcccaaagtgctgggattacaggtgtgagccgctgcacctggcctccaggtagccatattttaaagtagggttcagcgtcagatatcccaggccttgttcactgcatttcacaactctgcttctcattattgcccacactcatgtcttttccctaaatgggatttattccattgcaatgtcaaaatatgcagaaaaagcacaagacccttgcatggactttgaaatagtgggccttgttttagcagaggtttgttcattggagactcaattaaagggcaagaaggtgtttcctggtggatacttttgtacattcgtgattctgaggtgttttggttttactttaaaataagactttgggtatccttttgtaggtggataaacacattcgaaggcttgatgcagacctggcgcgctttgaagcagatctgaaggacaagatggagggcagtgattttgaaagctccggagggcgagggttaaaaagcaagtctgttaattttttttctttattttattactgttaactatggagttttgaagagttttgtcacggtaaatcattaaagtatgatcactagggtaagtatcatatttgggtaaaccttgtcttgcaggctgggtgtggtggcttacgcctgtaaccccagcactttgggaggctgaggcaggaggatcacttgaggctaggagtttgagaccaacctgggcaacatagcgagacctcatctcaacaaaaaatttaaaaattagccaggtgtggtggtgcacacctgtggtcccagctactcgggaggctgaggtgggtggattgcttgagcccgggaggtcaaggctgcggtgagctatgattgctccgctgcactccagccagcctgggagacagagcgagacccctttttaaaaacaaaacacaaaacttgccttgctttagagaattctataaaaataatttgcatcttgattatttttcagaaggccggggtcagaaagaaaaaagagggtcccggggccgaggcaggaggacatcagaggaagacacaccaaagaaaaagaagcacaaaggagggtaagaggctttcccctctttttcccaaaagaacgaatacccatagcctgtatcccggatgtaggaacactgatggaagctgacccgagtgaagtgcaccccgtgtgccgggtggtattctgattcttacgctgcgcgcctgtcgtcagcctgtcctcaccgcagcctttgagggggtgccgttgtcaggggcattttcagtgtcgcagggacctgcccaggctttagggctgctgtggtgcggctgggctgcacctggagtctgactccagtgcctgtcctcttagccacagtgtgtgctgccccactagggacaggaggatggtgagcaacgtgttgttgacagaggccaatgtagaccactctttaagtagctagatttctgtatatctgtcagttattttatgtgtcaacatatagtgtgcatatattcattgttaattatgtggccacatttatt

SEQ ID NO: 99608 - DNA, 1731 bp, Homo sapiens
gtggaacacctgccaggctgctgtgtagaaacccacgtgggagctgatggggatgaaggagtgacaaggatggtgtgtggtcggaaggggccctgtgccaggtggacagctgggtgggtggtgggcggtccagggagtgtgtggggagctgctggttgagtcagtattggggcagaggtgcctgagtaggtgcgtggagggcccgggcgcaggacgcatggctgttctcttgggaggaggtcacagttacgggagagctgttgactgtgcgggctgctctgacacctgtcagtctggagtgggaggctggcaggcttctctcaggtgtcagccgtctgctggcagaggtgacgtgtgcttgtttccaaaggggccggggtctttggagggatggcccagaagtgggttgagtccagaggtccccgggggagtcctgtctgggaggagggaccgagatgagagtggactcgtccccagagtgggaccagaaccccggtgctgtgggtgagtgctgcgcttcacggcctcctgggggccctctgtgcccccatgcccctgcctgggcccgaaggtgggcgcgaggtctccacccctctgctgccagctgctgctgttcctggatttttgtgggtaactgttctttctagcatcagctgacaatctgttcgtatacttaatgattttcttgctgcgccttcttagaacattgcgtgttcagaggggttattgaggttttgaaaatgtgtgctccaggaagaaaacgtccacaaggtgtgtattcagttagtgcatgactgcagtggctggccctggagtcgcattcatttctaaaggacaatgggaaaaatggaagcaagcttattcattatgtgtcgctcagagcacggtaccaatttcccccttggaatgattgtcttcacagttttggggtgagggggccttaagtcagagacagaagggcccgtggtgtccgtgccgcctcacttcccaccatggccttcagtggtgcctgtgccctgtcccctgcaggtctgagttcactgacaccatcctgtccgtgcacccctctgatgtgctggacatgcccgtggacccaaacgaacccacgtactgcctgtgccaccaggtctcctatggggagatgattggctgtgacaatccagacgtgagtgtcgcctgcaggattcgcgccatggggcggggtcttgtgtggggcagggctggcggatgttggcatttcttgtgttttgcatacagaacatgaggcgtgttgactgcggtttctccctttactttgcagtgtccaattgagtggtttcactttgcctgcgtggaccttaccacgaaacccaaaggaaaatggtgagtgtggggacgctcgctctgttttctcccagtctgctgggtgttgcgctgctggcctccccaggagaaggtgctccatggcagaatcttgccgggcttagcgggacacggtagccacgtaggcatgccccactgtggcctcaaggagtgtggctggctggtggctgctctgggtgtggctttatcccccctttgctgctgtgcctgtccgagctggcagagggatgccgtcacccaggaatggtggttaccaggttacgtgatattcacgttaatggcccctcctgaaggacaaccttccggactctgggaggtagggatcgtcttaaatcagaaatgagaggttcttgtcccctagggaaattt

SEQ ID NO: 99609 - DNA, 1046 bp, Homo sapiens
cgtgcaccttctcctgatctgatgctggtggtgacactaggtgtgcacctacccctcctgatctgatgctggtggtaacaccaggcgtgcacctgccaggcaaaccctgggctgtttgttgcagtgccagtcctcgtgctcctcgtggctgcccagctcacccacccacatgagtcgggctgatgttgctgctttgaagggggacttgggtgggctgggtttagctccgtgtggtgcttgacatgctgtgacccgtttcaggctgcccaggctttgctgaggttctgcagaccttcagcacctgcaaggggatgctgggtgagatcctgtctgcattcgagttcatggatgctgtgtgcatgcagctggtcgggcgccatctccacctggccagcccggtgcaaggtactgaccccccacacagggggcagctggtcctgcagctccttctgcacgtctggacacatgggacggctcagagaccccgggtgggcggggggtgcccgggcgggcgggtggggggtccctgggcggagcatggagtggccgttgggctcatgtgtaagaaagctgctcttaacatatttaggacaaagaacaggctgccctggtcctgtgtaaggtttgtagttacacagatttcctgatcttctgcaggaaggacgggaaggaactaagtggctatttttggtgagctgggagactttctttccatttcttcttttctttgttttcccatgttgctttctgtaagcacgtttttcttttatgctgggaaaaaagccaataattttttgttgttgggggatggagtttcgcactgtggcccaggctggagtgcaatgtcacgatcttggctcactgcagcctccacctcccggattcaaaccattctcctgcctcagcagcctccacctcccgggttcaaacgattcttctgcctcagcagcttccacctcccgggttcaaacaattctcctgcctcagcctcctgagtagctgggattacgggcacctgccaccacactcagctaatttttgtattt

SEQ ID NO: 99610 - DNA, 1218 bp, Homo sapiens
ttcctacgcgtctacgaggagaagcgggagcaggaggactgctgggagaactttgtggtgctggggcggagcaagtccagcttgaagacgctcttcatcctcttccggaacgagacggtggacgtggaggacattgtgacttggctcaagcgccactgcgacgtgctggccgtgccggtgaaagtgaccgacaggtttgggatctggaccggggagtacaaatgcgagatcgagctgcgccagggggagggcggggtcaggcacttgccaggggccttcttcctgggggccgagaggggctacagctggtacaaggggcagcccaagacatgctttaaatgtggttcccggacccacatgagcggcagctgcacgcaggacaggtgcttcaggtgcggggaggaggggcacctgagcccttactgccggaagggcatcgtgtgcaacctctgtggcaagcgaggacacgcctttgcccagtgtcccaaagcagtgcacaattccgtggcagctcagctaaccggcgtggccgggcactaaacacccgcctgcctgccagggtgaacacacagccagcttatccctcttaagtgccaaaacttttttttaaaccattttttatcgtttttgaaggagatctttttaaaacctacaagagacatctctctatgccttcttaaaccgagtttactccatttcagcctgttctgaattggtgactctgtcaccaataacgactgcggagaactgtagcgtgcagatgtgttgcccctcccttttaaaattttattttcgtttttctattgggtatttgttttgtttcttgtactttttctctctctccttgcccccctcccgccctccccgccccataccttttcttcccctggattttcaccctttgggctgccttgctcatctttatgccccagcactaggtacggggcccaacacgtggtaggcactccatcagtgtttgctgaattgaaaacattgttgactgtggcttctatcagagtgtctaccttttgcagctcttcccctccctcatttaatttgctgcttttaatctacgtggtctgagaatttgtgaaaccagtgttgttagaagtgtatataatctgaatcaataagctctgaatggtggccaagggcctctcttatggcacaaagatgcatggacttcatgacagctcttttggtggctcagaagccatt

SEQ ID NO: 99611 - DNA, 1005 bp, Homo sapiens
cagaggaatgctgagaaatcacctggaggagggagcagaaagagaaggtttttaaggaggggcttctgaatacttgggagatacggaacggaccaaggaccacactccagggtgcattcgttgctccctggggcaccacttctggattacagtgtgccaggtcctttggaggccctaccccttccccattcattgccaccagtgagaaatgggggtgcccctgtgtaaagaaacctaccaaaggtttacatttgcaccttagcctcaatagctacgaaccctagagaagcagctagctggagctcatgtgcaactcctgattctcaggagaaagatggattttaacccaaaattatgagtgagctgttaactctaaaatgtacttgggagataggccaagcgagaggtcatgggccaactaagtgttatccagtagaaaagacagtacactgcttttcttttagtgtttgcttttcctttgctatatgttttgctatttccttgtggcttagaatgtaaaattgattgttaaaagttttgttctgaataaatatttatcttttgtattgctaaaactggtgcactatttcctttcaaagtgttagatgcacagttacccagctccagaccgtatttcaatcccacttcccctacactccatttgtttaccttgctaaatacatttcccacccctgcaggcaacacttagcacctactacgttgtgccggtccctttgcatcacaatcagcacactgttaaaacgggttttaagtcctaacacagttccaataaatcagaatcactgttagaggaagtgaaacattttagttaatcatcctcaagcaattctgatgggcagccaggtttgagaccagagtataagatgtgtgagctgaaccctgccctcagggagattacagacctgtgggaaagagaggtggtttgccagcttcctcgtctttctgttactgtaagcgcgcgctgtggatgggatgcaaaatatt

SEQ ID NO: 99612 - DNA, 1670 bp, Homo sapiens
cgcaaaacaatgtgtgttgtgagccaggacgcaacttgccggaggcggcgggggcgcgccgagcccgcctgagaccgcgctgaccttctccccccgccgtccgttgggcccgagcgcccagctcctcgctccccagttcgcgggggccgggccgagccgcggggcggggccgcccctccgtcgccgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagcgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccggactactgcacccccgaggttaccgagatgatcgcgggggactggcgcccgtctagcatcgcagacctggttttcacctactgagcccaccgtcagcggggcgcgcacgcccccaaaccagctgtttacatacaggaatcaggtattggggcccctcggaggccgaggctggcaccccatctcccgcgcagcctgccccctcctggacgtgcccatcccccctcagatccagacatgcccctcccccgcagacacaccccaaggcagcccaacccccaccccttccccgacacccaagcccctccccacgtcgccccctcctgcacagccaccagcagccagccccctccgatacacctcccgtcctctcctacagacctgcacccctccccccttttgcacacgcccctcctcgtggccggaggacccgccccctcctttgctccggaatctctcctccctcgcccggcccgccttctctgggttaggggggcgatgcggccgggtggcaacgcacgcgcctcctgcgcccctcccttccc

SEQ ID NO: 99613 - DNA, 1722 bp, Homo sapiens
gcgatcctgggaaatcctttgatccgggagccctaggtttcctctccagccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaacatctggtttgggagagaccatcgacttggccagtgagactgagaatggattccgagtagtgatgggccgtttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacaccccccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctattttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgccccgaccttgccctgtggttctgcatgtctgtgctcttcctcaaccctccctaaacagtttgccagattcaagtccgtgtgatttgggcccgagctgggtgtcccagggcaagccaccttgcctgtctaggcctctatgtcaggactccctggccttcatgaagaatagcaaactcatccctgtagggaccaggcaggtaacatagacgagtgactctgggtggacagtggtgtcatgacccacttcaaggggcctacctcctgccagttgtgaccctgtgggaatgcagtccacagtggccaggtggccagatttttcaagaaaagctggatggatgtttctgagtcatcttaatttcaaaatgagactcatattttaaaatttctgtgggccaaatgaaacaagtatgcaggcaggtctggtccgagggggctggcttggccatgcctttctgtgcctttaatgaggactaagaagcaagattgggccacac

SEQ ID NO: 99614 - DNA, 1044 bp, Homo sapiens
attggtagaatctgtgtggtcatttctgcatccggggcattctggacctggattacttgggttcaaatttcagctccactagctatgccatctcggacaggacgcttaaacactccatactgtttgcttttctgtgaattggagataatggtaaccaccttatggtggtatgaggactgcaagacctaatgtatgtgatggactgagtacagagcctggcatggacaagcgcttgtctctcactgcccccgtgactgccccgtgataggatattactttgttattctattacagtacttacccaggtatattgccatttgctgtccacaggactgtcctttccactagactgtgagtccctataggacaggaccctgtctgagccatccatcattatagattatgtgttgcctgctagttctgaacctcagacttctctctttcataataacagctggcatttagggagcatgtctacgtgccaggtgctgtgttaagtgcattaagcttcatacaatctcaagggattggtatccttgttgctcctattttggagatgaaaaaaactcctgacactcagaacggttaagaaactcaggttcacacagtggcttgaacactggcagacagattcactctcagcctgcactagatataagttgtgggaggagattgtgggggcaggaatgttgctgaacagaaggaatgcctgcctttcggactgctccagcaggctctctctcactccacccccattaatccctcccccatctatatgaatatcactgtttttggccgggtgcggtggcacatgcctgtaatcccagcactttgggaggccaaggtgggaggatcacctgaggtcaggagtttgagactagcctgaccaacatggagaagccctgtgtctactaaaagtacaaaattagccggggggcgtggtgacacatgcctgtaatcccagctactcgggaggctgaggcaggagaatcgctcgaacctgggaggcggagattgcggtgagccaagatcgcgcattgcact

SEQ ID NO: 99615 - DNA, 1048 bp, Homo sapiens
gtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaaggtgggcacaggctggaggtggctggggaacttccggtgggaagtgggccccgcaggacctggccttgcccctggccagaagggccttggagagggggctttagcctgccctccctctaccctcctccccatcagtttcctcctttggtacctgctggcttccagagccatcttggggccctgagaactccttgggctggctctgtgctgagatggggctaggggactcgcagaggacacagggcattgaacttggagacctcctgggctggtgggagacagacgtcagttgacctgagaagcaggggtacttgcctcttctcttgtcccctgcacctagggttgtagaacggaagtcagtcactgccttgctggaaaccctcccatgcccctctgtgttctccaaacaaaacccagaggccctgggtggcccacaggatatctgtcctcagtcaccccgccatgctcactctactggagccccactggcttccttc

SEQ ID NO: 99616 - DNA, 1938 bp, Homo sapiens
caactcaggaaactaacgctgatacagtactggtatccagtctacagatcttactcagattttaccagttgtcccactattgtcatttatagcaaaagacttggcattctgctgtcatgtctcagtccctttcaaagagtccaggccagtttcttttttttggcgggggttgggggctgatgtttcctccggagtggatcaagtcactgttttggcaggaccgcctcagcggtgctcttgggtccctcttggtgcatccttcaggaggcacggaagggctggtgttgtgctgggttttgaagctcaaaggacatagaagcatttatcggtggaatagggaccctgaccctgggggagccaggatgcccacttggccagatggaagctggaggtacccccagggaggagggagaggatagggggagggtctgcctggctggctcagggagacccacccccatgggtgtggaccaagtgggccgcgtggaaccaccaccctttaaccctcctccacagatctgggcttcaaggacctcacgctgcagccgcggggccctctggagccaggccccccaaagcccggggtcccccaggaacccggacgggggcagccagatgcagtgcctgagcccccaccggtaagctgtccttggcctcagtatcctcttctgtgcccctcccttgcctcaccctgcccagtcgggctcacagcaccctctgctcccaggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcaggtgggcgggaaagtccctggacagacacctgcagaccgcacgggggaggtgtaggccaggaagggagacacctgcgcactgccgcgcctctccgttactgccttgcccctcccaaccatgctgctggcagtgaccctgcacctggctgtgaccctgcacctggctgtgacctgccctctctcaaaggtcaccctgtggctgagacccgctccctggctgtggcgcacatccaggttcacatgccccactcccacgtgggctgtggctccatccccagctttgacacaccacacgagtatggctggccatgaccccagcaccctagccatgaccccagcaccctagccatgaccacacctcagctcggacctcacccccacccgtctgtgacctaagcctgctccacctcgccgtgacctcaccctggactctcctactcctgacctcttccctctcgggctgggcccacccctgacttcctgagagcctggcctggaccctcgctgcgccctagggggatgacccccgaccccggtcctacgccttagccctaccccgcccccatcgtgacacacgcactaatgacacagacattgatccccgagtgctccccattctgatctcacccctggccccacctgcattccccttggacccggtgctgcccctggccaccccactcctgttcccgtctcagctcctcggcttcgtcacttccccacccctgacgttgagtggctccaccagccctggcccgggccctgccctgctacctgactcaccactcagaccccggcccccttccttaccttgctgccattgctgtctcacctggcgccttccgtggctacctggccggcctcccctcccttggcttccccacctccacctggcctcactcccagccccgcccctcccaacctgcctgctcctgcccatcccccaccccccaccccccatcccccagccccacccccatcccccacccccgtcccccatcccccatccctactggctcccagctttgcctgtggctg

SEQ ID NO: 99617 - DNA, 1002 bp, Homo sapiens
atgggagtcactggggagacatggctgctgttctgagatagactctaggggccagatggatgcagggagcccagcgaggaggctcctggagtcacccaggtgggggatgtggggcctggaccagagaatcagagcggcagtatggaggcagggtggaggccttggtgatgggttggtgagagggatgggaaggaaggagatattgaggagaagtccacctggggtgactgagtgaggcccctggggtcaggccttgccatgtgagggatggagtccccagtgaagggggttcctatgatcctaactcttttcccctcccctcccctagggagtgcctgcagggcaccatccgcaacagccaggaggcggaggtctcctgccccttcattgacaacacctactcgtgctcgggcaagctgctggagagggagatcaaggcggtaaggcctcagggtgggagacataccccaagtcccaactcctaaggaactgggccctgagcaggcagcagacatctttcttttctttcttttttttttttggagatggggtctcactatgttgtccaagctggtctcaaactcctgggcttaagcgatcattcatcctcagccccccagacatttttcaagagctttgtccatgtggggtgttgagaccccaagcagaaaaagaattgaggggagtagctagtcaagaaaccacatctatgaaggaaggacagcagagttgttaagaatcagggactcggctgggcgtggcagctcacacctgtaatcccagcactttgggaggatgaagtgggcagattgcttgaacccatgagttccagaccaacctgggcaacatggcaaaaaatattcaaaaaatagccaggcgcgggggcatgcgcctgtagtcctagctacttgggtggggtctgggatgagtgggctgaggtgggaggattgcttgagcctaggaagtaaggttgcagtgagctgtgattgtgccactgcactc

SEQ ID NO: 99618 - DNA, 1049 bp, Homo sapiens
gccaagtaatgtagtggaggttgtttttacaaaaacagaaaaatatgcctcaccacatagaaccagagcagaaatcagagagaaaatcacccacaaacccaggaaatcctccaattgcattttatcttatttccttcagtatctctgggcaaattttttttttttttcctttttgagatgaagtctcactctgtcatccaggctggagtgcaatggcgcgatctcagcccactgcaagctccgcctcccgggttcacgccattctcctgcctcagcctcccaagtagctgggactagaggcgcacaccgccatgcccagctaatttttgtattttcagtacagacgagttttcaccatgttggccaggctggtcttgaactcctgacctcaggtgatccacccacctcggcctcccaaagtgctaggattacaggcgtgagccaccgtgcccagccagatatgattttttaagtcaactttacttaagtatactttgcacacaataaaatgtactcattgtaagtatgcagtcaggtaaattttaacaaatgtaactctcgtaaccaccaaccactgttacatataacataggcatgatttctgcctcattgtaaccagcatggatacaatcgctttagcttttgttattttgctatagaatttttctaaagattattacaaatctcaatagcacatatactgtttatacctcttagttctagtttctcagtttgtaatactccttcaaggaatgttttgcatggtgtattcttttttttttttttttttgagacgaagtctcactctgttgcctaagctggagtacattggtgtgatcttggctcactgcaacctccacctcccgggttcaaacgattctcctgcctcagcctcccgagtagctgggactacaggcagatgccaccacacccagctaatttttgtatttttagtagagatggggtttcactatgttggccaagctagtcttaaactcctgacctcgtgatgcgcccgcctcggcctcccagagtgttcagattacagg

SEQ ID NO: 99619 - DNA, 1061 bp, Homo sapiens
gcccctcttactagcagctccatcagctgatcagaaatcagagacagaagggaactaggttactcgttaaatcctacctattttcagcctagaaatcacatgggcgtttccagtcaagtgggaaggaagctcatttttagggcctagacctagactagttttgcctgcctttttttcctccctgctttcttctacaagccacacaacattgcttataaaaggtacttttattactatttttagaatatatacaccccatatgtaaattaccctcacttttaaagtaataatagttccttcacggaaaaaaaaatagttctcatcagaaggatgagcttctaagatcctgaattttactttctacttgattaacattttcgctttagccagagttgctatttgcaaacagctttccacttccaaagtgccactttctgaccggtttttcttcctgttttcctcaaatcatcctactcccaaataggcacccactcactaccttggcgtcgttttttgggtctgacttgactcgtcaactgctggtctctcccacctggttggaaatgtcgttggaaacttgcaaagactctccagaccttagggaacaagaggcatcactcagtccttctgggacagcttccctgtaagcaaagccaggtttgttttagattcactctggcctgaaaaaaaaagtgccttttgctgctttaaagaattggggtatatggtatgaagcagccatgtacttgtattttcctggtctttcctgggcactcttctctcttggcagatgttttcttaaagtgaacacaccagaagcactctaccccaccatatccagtcctctttgcatgcctgttgtgtgcagggtggagggtgtcccacgtgccagagcagctgggagccctgtccgctgagttacactaagcactttatttttatttattttattattattttcttttttctgagatggagtctcactctgttgcccaggctggagtgcagtggtgcagtctcagctcactgcaacctccgcctcccaagttcaggcaattctc

SEQ ID NO: 99620 - DNA, 1069 bp, Homo sapiens
ctgcaccactgcactccagcctgggcaacagagtgagactccatctcagaaaaaagaaaataataataaaataaataaaaataaagtgcttagtgtaactcagcggacagggctcccagctgctctggcacgtgggacaccctccaccctgcacacaacaggcatgcaaagaggactggatatggtggggtagagtgcttctggtgtgttcactttaagaaaacatctgccaagagagaagagtgcccaggaaagaccaggaaaatacaagtacatggctgcttcataccatataccccaattctttaaagcagcaaaaggcactttttttttcaggccagagtgaatctaaaacaaacctggctttgcttacagggaagctgtcccagaaggactgagtgatgcctcttgttccctaaggtctggagagtctttgcaagtttccaacgacatttccaaccaggtgggagagaccagcagttgacgagtcaagtcagacccaaaaaacgacgccaaggtagtgagtgggtgcctatttgggagtaggatgatttgaggaaaacaggaagaaaaaccggtcagaaagtggcactttggaagtggaaagctgtttgcaaatagcaactctggctaaagcgaaaatgttaatcaagtagaaagtaaaattcaggatcttagaagctcatccttctgatgagaactatttttttttccgtgaaggaactattattactttaaaagtgagggtaatttacatatggggtgtatatattctaaaaatagtaataaaagtaccttttataagcaatgttgtgtggcttgtagaagaaagcagggaggaaaaaaaggcaggcaaaactagtctaggtctaggccctaaaaatgagcttccttcccacttgactggaaacgcccatgtgatttctaggctgaaaataggtaggatttaacgagtaacctagttcccttctgtctctgatttctgatcagctgatggagctgctagtaagaggggccgatcatgctcccagacgagtcctttggcctcttgctctccatcccaagcctg

SEQ ID NO: 99621 - DNA, 1694 bp, Homo sapiens
acaaaatcagattttttttgctgcatgacacttctgaacctttaaaatgctaatctgcattgtgaattgtcagggttcctgttgacattgtctggaatatatgttcagctgatgaacacaattagggaaatagtagcgtaagctgtcaactccagatttaagaaaagaagagatctggtgtcatgacagacaagggaggcggcttgcggtggagggtaggggcttcagttagtagaagggtcttgagggatggggtggagatgggaattcagggaagtccttcaatgaccactggtcccttgagcatctgtggatttgtggaccaacagtcagaaggaagatgcttaaagggagcaagactgttctttctactgttttgaaccatttcttctatgctggagctccaggaatctcccaataattctcctactttctcctaaaagaatctccttcatttctttcaagacttaaagggacacctgagcagcccagcatgcccgaaggacttagattgtaactggtcagcctttcatgtcatgtggtggaagtttgcaggaagggccagagagtaggagtagcactgagcgtatatatgttattacttccttgatggatacaagagtttgctcaacatttgggctgagtcctgtctgttaccagtttaaattcatctgcaaggataatggagtgcaggtggcccaggccctgtgtgtctggcctctgactgcaaggctttactacctccccacagattgtgttgtatcgcgagcaggaagtcctggactgtgactgtgacatggcctcggtccaccacctgttgtcccagatccctcaggacttgccctatgagacactgatcagcagagcaggagacctttttgttcagtttcccccatccgaacttgctcgggaggccgctgcccaacagcaagctgagaggtgagcaaggctgggacactggttgaatgggggtggctgtaaatgagcagaagcgagggaaggtttgtgtctggtgggatagggttggggcatgtttccagagatctgagcttaggccagtggaatccccactgtagacatatgggtctttatcataaagagctttcccagcaatgaaaggctctgcccgcagcctatgtggtgtagttttgctttcctcctcctctttcataccacttccttccttccgtctctttcccctgcaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggtctcacccttccatggaaggattgggaggggtggaatttcctttattaaaagggtttctgtccagagttttttattcctgccaccctgccctgcccgtttgtgtttgcctttacttcagaggccagtagcagagcctacctgacacagaggggacctgggggcctggcacagaatcttatgcctctcccagtgggc

SEQ ID NO: 99622 - DNA, 1020 bp, Homo sapiens
gggacagcgggatatccaccatgctgctgtgagactcgggcagttgtgactggtttagaagtggatacacagggagaggtcttctggaaaaggtcttctggagagctgagatcagaagacaatcaactggcttcaaatctaaggagagacaggcacaaaatggaagagatgacatgggcactggttacctggtaaacacaagtggacactggtgagggactgggtcatggagactgcagtagtctttacccttttcagcgtttttcaccatgaaccccactgggagcacacagaagattggagaaagttttaataaaatgtctcaagatctggaagaagacaatggcagctactgtgaaaggatcacagtgctccacccagacccttccctgtatcccctaccggacaaaagccttagtctgtggagggaaggacaccaaatcctgtcacccccttggatgaagctcccttgcatctgggggaatgaaacaggaacaaaacaaaactttccctgggcaggggcaggaatacacactgggcccagaactgggggaggaacaggagcactaaggaggacataaccccaaaatcagagacacaaagggcctgacagagactgagacttgatcagaacagagaattccctcctcccccacctgccaatggtaagctgacaagccttgagttagaagtaaaaatgttacaggagagagacaagagtatgggaagaagaccctttctgagggtcacaaagggaggacctaaagctgagcagggagcacacatggaaggagaaaatccctctggcaggccagcctgcaccctcagtccaaggtgtcattggaggaactggaagctgctgcattgggggtaaccatagcaacaataaacctcaaacctagcccaactcttttttttatttactttttagagacaaggtcttgctctgttgcccaggctgaagtgcagtggtgtgatcgcagctcactgcagcctcaaactcctgggctcaagcaatcc

SEQ ID NO: 99623 - DNA, 1939 bp, Homo sapiens
caccacaagccaaagcgtctctggggattaaggatcctttgccataaaactcattttgtgtctcagcagtgcagggattggggatggaaaaagtcgccagtttttgtgtgtttgtgtgtgtgtgtaaagtggactttccactgtaatccaaccacctaagtttatcaggtgcttcactgaggaagcctagttttttaagcacaatagcaaaaccatcagctctgtattttctcctgttatttcattacagtagctgcttgtgggaactaggaaaaattcttccaacatattttaaggcctaaaatcttagttccccattctcctaccttatagattcacaggcctttctcgcctaggcatcatagataaacgtaattgtttggggagttgaatttaatgaacttatctaactttgtaacccatcttggctttagtaactttatcaaggtggtggctttagtgaatataatggtaaactttagaggacgctaaagcctccttttatagcgcttctcaacggtagggagagctgaagggaaaacattctgactgtgtggcagggtgattttcttccttatgaccacttacagtggatatttattgtacttgacccttttatgccctagaatgctgtgagggttaccatgttgaatttgtgcagaagctaaaagcaccagatgtgccagagatgcaatttgtgattatgtttgcactggattgtgatttgaacaggacacttataactaatgagttctttcttttgaggtggggagagggttgtaaatcaagacttcataccctatccttgtagctcggaaattgaggtgtagcttaggctgatgcggagagctgcagacagctggacctccttacacccatcagaccttggaataaaccgaaggtgaatgcagaggactctgaggtgccacccaagagccttttaaaataaatagaagtttttaaaaatgctacttaagagtcactgcagaagcatggagagagagaaaaaaaaaaaagacccaattgggtggggggtgggggggaggcaagggtttacagagtaacaacttacgtgttgttgtaaattacctcatctgtataccttgtattgggacactatttctcagcactacctgtgtctgcattgcttagatggcaggaaatggaatggccaacatgaaaggttatgttggcaattactctgaaagattttttaaagtatttttaaactttgtttgaagtggtccctcccctcttcctctgcttttttttaagtttgaagccagaaggccctccccaccttgctttattggttgtaattgtattgtaattggtatgactaaaccataactgtgctgggaagaagttgtgccatgaaggtctttaattttttttaataaaaacatttaaataaatgaaatgtccctgcagcctgagcaatatgcttctccaaccgacaccgtgtgtgatagatggctccgttttcacgttttgaattctgtttcttgtacttgaaatgcctgtccagcttacataagatagattaaattgttagagtgggactgtcagaggaatatatcttgtaaagtagatcctcagggtatggctaattactatagtcctaaagtagcagagaaaattagagattggttgacagatttgggaattttaatttcttcttagtttttaactttcatctttgcttcaccttttgacaagtatggttataattagaattgaccatttaagcatctcttgaaaaacctgattttgtcccaccagcaaattctctcccaagactggaattgggtttgcatagtagagagcctgtcttcccagggccttttcctagttaaagaaacacttaactaaaaaggctgtgtggtaaggtcatgctcagttccttcctcaaaaaatgagtctaaaattggtttatcct

SEQ ID NO: 99624 - DNA, 2024 bp, Homo sapiens
tttttttttttttttttttttttttttggagacaaggtcttgctctgtggccaaggctggagtgcagtggcacaatctcagctgctgcagcctccgcctcccgggttcaagcgattctcccacctcaacctcccaggtagctgggactacaggcgcccgccatgacgcccagctaatttttgtatttttagtagagatggggtttcaccatgttggccaggctggtcttgaactcctgacctcaggtgatccgcccaacttggcctcccaaagtgctggcattacaggcgtgagacactgcacctggcctttgtatacttttttgaaccttttgtattttgaaccatgtgaatgtattacctgtgtgtacacacacacacacacacacacacacacacaaaaacatgattagagaggtggaagaaatcaaatggaaataaattccaaaacacaattttatcttagaaaatgctctttccccattcaaattgactttcagtaattttgaaagctgccagctatcaagacagcatggtgtaagagcacatgagctttgactgcagtcatgtgctgttcagtatggtagtgactagccacgtgaggctatttaattacaattgaataaaatttaaaatgtagttcctcagttgcactagccatatttcaagtgctcagcagccacatgtggttggctactggtcaccagggtggacatctctgccctagacaggcctgggttagaatccaaccatggttgccacttgcttaatcgtgtactttggacaaactccttaaattgtccaagcctagatttctttacctgtctcttaaattgattaggacttgccactttaacttgaatttgtgagggtcagacttgaagtatatgtaaaaatccagctaagaggaagtcttcagtaaagaattattgtgttccttttgcagtgagtgctatgagaaactggtaagattgccatggttggtgtctttggctcactgacagctcttttctttcagggatttcttcagtgccaaccccttcaccccttggacctctggcaggctcaccagtgattgctgctgccaacccccttgggatgcctgttccagctgccgctggcgctcagcagtaacggccctatctgtctcctgatgcctgagcagaggtgggggagtccaccctctccttgatgcagcttgcgcctggcggggaggggtgaaacacttcagaagcaccgtgtctgaaccgttgcttgtggatttatagtagttcagtcataaaaaaaaaattataataggctgattttcttttttctttttttttttaactcgaacttttcataactcaggggattccctgaaaaattacctgcaggtggaatatttcatggacaaatttttttttctcccctcccaaatttagttcctcatcacaaaagaacaaagataaaccagcctcaatcccggctgctgcatttaggtggagacttcttcccattcccaccattgttcctccaccgtcccacactttagggggttggtatctcgtgctcttctccagagattacaaaaatgtagcttctcaggggaggcaggaagaaaggaaggaaggaaagaaggaagggaggacccaatctataggagcagtggactgcttgctggtcgcttacatcactttactccataagcgcttcagtggggttatcctagtggctcttgtggaagtgtgtcttagttacatcaagatgttgaaaatctacccaaaatgcagacagatactaaaaacttctgttcagtaagaatcatgtcttactgatctaaccctaaatccaactcatttatacttttatttttagttcagtttaaaatgttgataccttccctcccaggctccttaccttggtcttttccctgttcatctcccaacatgctgtgctccatagctggtaggagagggaaggcaaaatctttcttagttttctttgtcttggccattttgaattcatttagttactgggcataac

SEQ ID NO: 99625 - DNA, 1050 bp, Homo sapiens
ctgcaacatgacatttttccttcggtgtgatggttttgtactgaatcatttatacttttgcccaatacctgaagcagatagataggctgattgggatagagaatgtggtcatagccctaagctacatggacctatagctttggcctacttggtactgggctgtggacacactggtaatatattaccgtctttgccgagttacagtgtcttgtctccattaaacctcaacaggaccagggcttcattaaattcgctctgctataaataattacctcatctttctaccatttgattgaaaggttagcttttaccacagtttgataggaaagctatttctgctttttaccacttgtctaattcatggtgaaggcaattgccaccttaagttctttggggaataatgtagagtatatataaattgcaaagaatgaagctggctgctttcaggcttccagaccattagtttaatctttcaagcaaaacagaacctagcctttttgtctcttttctagacactgttgtgaaggaccaggctcgaatgggttcatctagcatgccagggggcagtacgcccgtcagcagcgccaatatgatgtcaggtcagttcattggtaaattttctttaaaaaaatgtggaagtcaattactgttcttagctttgtggtctgatttcttgtataccttctcttctccgtactggtggccttgtgacttttttttaaccaggtttcagcatgcttgacatttggtatactttagtgatactgtcttgagtagggtatccccttctaggctagaatctcagcattcctggctgaaaatttttggcataggggcttgaaagtgccaagccatgaaaaggaaaaatacaccatttcatcttatagtttgaaatgacagtagttacatggcccttagaaacaatgttaagaaatggggtatagaggtggggtttatacataggtgtgtatgtgtacaaggacagttccgtgacatgtgccagagcaactatagagtgcctatcagttgtaaaaacataagtaaaatggt

SEQ ID NO: 99626 - DNA, 1076 bp, Homo sapiens
actccatgcatggtgatgtgtggcagtagtccagactactaggaagctgaggcaggagcttcccttgagcccaggagggaatgctacagagagcaatgaacatgtggctgcgctccagtctgggcaacagagtgagaccctgtctccaaaaaaaaaaaaaaaaaggctatatgcagacaaccgactcttaacagtagtgactagatatagtacttatacacttaaccactcaacaggaggagatggactttcctgatgcaaaggcttttgctggccaattggcagagatgccaggaatatgtgtggggatgggaaataggcctggtgagctcagccacctgaccctccttgctacacagaagcggtcacgtcctgtcaagtaacctgaattatgtttcttaaaattgagaggactcagatgtcttttttcactctagctatgttgtttccagtctccagttagctttgttgtcccactcagtggcagagcggtgcaagactaccctcttgagtttggatccctctttgcttttgtctgggctgttagccactaagaaaaatgtaggaatgaaatgttgggcttctgtgcccacgtggcccatttctcatgccctcttttggtcctgcagacactctcgaaagcgatgggaacgctttgtccacagtgaaaatcagcaccttgtcagccctgaggccttggatttcctggacaaactgctgcgatatgaccaccagtcacggcttactgcaagagaggcaatggagcacccctatttctgtgagtccagatatctagcccacagagtttgtgcaggcgcagagtcctatagaacagagtcgtaatcccagctcctgtcagcttgctgcaaagttaattcacccacactgagcctcagattcttccagtggggatagtgatggcaactacattgcagaattactggaagaattcttctgtaacagaatacatgacacaagagcattcctaaataaactcttttcatactgtgaggatgacacttctcagtgcctcagtctggaatggttgaattagaatacacagccctgtatctttc

SEQ ID NO: 99627 - DNA, 1201 bp, Homo sapiens
tagattgatgtttcgggagctaccagcttagccttttgaaatcagacattcccccctagtctttgtcatttgcattgcttattttattgtgaagaatacatataaattgtcatccagatttttaaaataggacattaccttagaattctcctaataaacccttatctccaatatggtgttttctccaatatgtgagcccatatgtggtatttctgtgatccttttggctctttatatgggttgagttacagatgtttcttaaactaactccacttcccccttgaagatcaaagggctctttcattcacaagaacctggaatgattctaggaccttgtggaaggtaccattgtcttgttccctttgagcaccatgtccaattttaatgagtcaaagaatacaacctgaattccattaaagtcaataactctgtatcaagtgcatgcagtactgaggaatacagaaaaaagaaagaatagttttcttcccctcagatagttcatagctgatcttgtaagggagtcaaacatacaacaaaataggttacagtcataacttcagagtagaaatgtggacaaggcacaaaaggcagtagtggtgagtagtttgagtgtgcaatgggagcttcccaaaagaagtgacatcttcaattgggttttgaggggagaaaaataagggttcaccagggtgacatttcaagaggaagaaaccagtttataaagtagtttgctttttctaacactatcacattgagttgaagtctaaactgttaggaggtagcattcatacctgtagacatgatgacccgtttatgtaaattcaatcattgttaattgttgatttgttaatataatatgcttgtgatatgggtttttgtctttctttaatactagttggtgaggatagccaaggttctggggacagaagatttatatgactatattgacaaatacaacattgaattagatccacgtttcaatgatatcttgggcaggtaagtcatgaaacaaaatatgtgcatctgtggcttaagcactttgagagtgaactggcacttaggatcttcaaaatagttatgttttctttgccagcactgtcaggatgtcagtggtccagtgccacaggatgctgcattgagcaggcctctgataaaggcattggattgaatggccctttattcaaattaacttacaggagtctga

SEQ ID NO: 99628 - DNA, 1724 bp, Homo sapiens
caggagatcaagaccagcctgagcaacatagtgagaccctgtctctacaaaaaatttaaaaattagctgggtatggtggcttatgcttgtaattccagctacttgggaggctgtgacaggaggatctcaggaatttgaggcagcagtgagctatgattgttgcacaggctggagtgcagtagcacagagtaagaccctgtctctaaatacataaataaataaaaattaataataatagtatcagaacccttgtgctaagggttatggaatggggtctagtgggagtataatttagaacaatttgaaaaagggtatttgtaagatagctgggactgaccccttaacaaatatttgtaatttctgtggcccctatgtaagttaatattaaattttcaaaactcgtgaaaacacctgacgtgctagcttctggtatactttatctcacttaagagtcagcaaataaaacagtaaactttaactcagttctcaaagggtaattgtcctaaggattgtgtaaatttctgcttatagatgctaattgaaaatttacttacatttctaaagtggggtcaccaaatatcttgttcccagtagccacaagatcagcttcctagaagagagaattgctaaaagttggctaagctttcttactaaacaagagttgacataaagcctgctgttggagccttagaaatcccctgaggagattgtgccagcagagatacttgatctttccattggctcatgcagtttgtggcaagcaaggctttagaaagttacagatatgattgcccagccctgggaactgtaggaacccaagttgcccttcaggaaggacaagaatttggccaacaacgtcggctgactgaaaggctgggattaacaaaccccaaagattatactactcagttccctttagtttgaggttggaaacatttcagattggatttgatgacctaaatcaggcattggcaaacttctttaaagggccaaatagtaaatattttaggctttgtgggccatgtagtgtttgtcacactattcaagtctgctgttgttgcacaagagcaaccataaacaatatgcaaacaaataggcatggctatgttgcaataaaacattatttacaaaagcagacatcaggccaaatttggcctgtggtctgccaacctctgttacagactcttaatggctaaagaattactgttcttagaataagaggtttgtagtaaagatctgttttctttctttgaggggtctgtggaaataatctaggatctggacaagacagaaaaatttgaagtggtgcaatttgggtatactttgggtcttttaggacagaaaacatgttgaaacaactgtgtcagaaaaagatctctaagctcagagagctgagtttgcttgactgtgagatcatgaacaagtctctgaagcattgctgtggaagtgactgtgtcctcagcttgaatcccaggggtattgtgaggctaaaaggaaaatttacatggagggaaaagtaaaggactcttacgtattattcaggctaactcctttctgacccgttcatcccacaggccctggattattgtcacagcatgggaattatgcacagagatgtcaagccccataatgtcatgattgatcatgagcacagaaaggtaaagtgataggctgacaagtgttatttatctacatgatgtagctaattgcccatcttcaacact

SEQ ID NO: 99629 - DNA, 4599 bp, Homo sapiens
tgtatctatcctcaatgccatttttctcttccaggctgtcttacaaaaatcattcaaattttgcctgcagaggtaacaggatatttggcaaaatatgattaaagcaaatatcagtttactgtatttcttgggatttttcttctcatgttataggaagcactggttaacacagttgagctatatttattggctgtaggtaggagagccagaggtatatttcaggccattattatttgtaagattatttccttcccatataccttctgtaaatgattccttggactttgtgcattttgtttctgcagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatgggggtaattgtttttgttgacttcattatactcactcaaagggctgaatcttgtggatctgttgagtagtttttgtcagaaaacctccgtgactctgtatgtgtatacctcaggatcaaagcccaatttgtgttttcttttgagctgaaaatttggttttgcagtgaggaagcagagttgctttggcaagtgaacaattttaatgggcttaccatttaaaaatcattttagtttcttatccttttctatgatgtatatgcagtcgtgcaccacataacaaagtttgaattaatgacagaccacatgtaggacagtggttccataagattataagagagctgaaaaatgtctgtggcctagtgatgtcatcgtaacatcaacagtgcattcattaccttttctacgtttagatacacaaataccattgtgttacaattgcctaaagtatttattacggtacacatttgtatcctaggagccgtaggccataccctaggtatgtaatatgccataccatgtaggtttgtgtaaacactctgatgtttaacacatttctcagaatgtcattaaataacgcatgacggtattctgtatgggcacctggcaacaaaaagttacctatcagcttgcttatcaagccaagggcattgcagatcagtgagaagtgatacttgagagactttgaaaacaccaaagtcttatataaagtatttttgaggtagagaatgttgtttcgtgttaatacaggaggacgaaacagttctccaaagaggtaacttctttctgatgagaaacaattaaattcttaaacatttgcccttatcctgagactaggcatgtcttagcatggaattcagcccaaattctatcttgaacagttgtagtctgcctgaacagctgtgtttgccctcctaattctctgtgcagactcatttggatgtttgcatttcctgtcccaatgtggtagacatttaattgttcagatcatacttttgtgataaaagcattttgacattcaagtgcaaaagaaagcaatttgaaaactaaagctacagctcctgtatgctgtattttatatctgactgcatgtgatttctgtaacctgtaagtggttagtggatggcttccctaaattgtcatagggcgtatttttaatcttgagtatgccatgaatttgtgtatgtgtgtgtgtggaaatgagtcttgctctgttgccctggctgcagtgcagtggtgtgatctcggctcactgcagcctccgcctcctgggttcacgtgattctcccacctcagcctctcgagtagctgggattacaggcaccttccaccctacccagctaatttgagtatgccatgattcttaacagtaaatacattgcctctgaatacagaggcactgtatgctgtaaagacaccattaaatgccagtgtggtttagtaccaataaatgttgttattactgataatctaacaattctcctcttatgtcacaggctttggactctaggtgacactgtgtttactataggaatttcagccgctatcttcaaattgagtgctttgcacttggttctgcttaaatggcactaaagagcccttttgggcttttggcatggttctgtttgcttgctggcatttgttttgtatgccctcccataggaagagaactcaaccagaagtaggagcattcttcccctacacctgccatgattattatgttgtccattgtttttagtaccttttgtcttttcattcactttctttttagctacttgaggaaaatgaatggttgaggtggttgatttggttcatattggatacttagtaggtccagaggattctatccagtaggatagaatttaggccttattggaactgtgtttgtcattcttcagagcaaagcgctctacattggaagcaggcaggggcaggaggaaaatgttggcatttcccttattctacctctgtttattacctctgatgttgcttattggtcacagaatatgggtatatgtagaggaggggatcgctgattatagtttacaatctataatgtgcttcgtactacgcatggactatccccagagcttgccctggagggcaaatagattaagcctatacatttgaaagccatttaccttcaaagaggcctgttaaaaatcagctgctgccaaagtgtggctagattgaaacagtcttgcaaaatgtttttagttcctgctaagtgccaacactggaccaagcactaagggacaagaatatataaaaattattctccggccgggtgcggtggctcacgcctgtaatcccagcactttgggaggccaaggcgggcggatcacaaggtcaggagatcgagaccatcctggctaacacggtgaaaccccgtctttactaaaaatacaaaaaaattagccgggcgtggtggtgggcgcctgtagtcccagctactaggggaggctgaggcaggagaatggcgtgaacctgggaggcggggcttgcagcgagccgagatcacgccactgcactccagcctgggcgacagagcaagactccgtctcaaaaaaaaaaaaaaaaaaaaaaattattctcttggggaaagctgtctcttgttggagacaaacgtatttagaacaaaccttaatacaagccagctccatgtcatgtgccaataaagatgtaaacagtttgggattagaaagaataattgaaaggtataagtttttctaattctaggatttgaaacacacgtattttaattggcctaatttaaaaaaaaaaaaaatacaatgggccaggcgcggtggctcacgcctgtaatcccagcactttgggaggccgaggcggacgaatcacgaggtcaggagatcgagaccatcctggttaacacggtgaggacccgccgtctctactaaaaattcaaaaaattagccgggcatggtggcaggcgcctgtggtcccagctgctcgggaggctgaggcaggagaatggtgtgaacccgggaggtggagctggcagtcagcagagatcgcgccactgcactctagcctgggcgacagagtgagactccatctccaaaaaaaaaaaaaaaaaaaaaaaaacctatttgggaattgtttgaaatacttcttatttctattacagctgctggtaatagattcctgtaatttgaattgatgctgataatttgaccgtttataagtcattttgtttgtgtccacagaaatcaagatgactaccagctggttcgaaaattaggccgaggtaaatacagtgaagtatttgaagccatcaacatcacaaataatgaaaaagttgttgttaaaattctcaaggtgagtacaagagataatttcagaggtatttggaatatagatttttaaaagtagttttgaagacttttttaaaacagcatttaaaaggtttttggtgccaaagcaaataaataaaattttattgtatcctatgaactcaatagaacaagttctgcttatttgacagatcgggaaactgaagcaagagaagtgatttgagttgactcatatagctaggttgtggcagagtaagggagcaaaggtacagtctcttctctcccagttattgcctaatacttatttcctttacttttcattatataatgaggcttttgttttcaataaataaatcattgcctctactttgtaaagatgaggagtcacaggactcgagggggacagacagatgatattagtgcagctagtcgggtgtaattgcccttgcttaggtgatgtgagtggtagggactgaaacaaactgggaaacacatgcctcttcaaaaggagttagctgcttctcagctgaagctgatgattgccctgcagtaatgcaagtccattgttgcttgatactctgttttgcaaataaaagccagaaatttatatttgtatatgaattttcctgacttttaagtgttggctcaagattttaaaaaaacaatgcacaggccagatttggcctctgggagaccaatatacaacttttaatttagttataactatgctgtgcactgtcatatattgggaacttagcatatagttccttaccaca

SEQ ID NO: 99630 - DNA, 1060 bp, Homo sapiens
ctccacctcctgcagtatgggatacagtctagagtattgcatttatgcaatgtctctttagcctccatttgtcttttatgctgtggacatgttttagaagtatagtaccccttccccctttttaaatagacacttcctctttttctgaatgtttcctggtaattgaattgaagttatggctgggtgcggtggctcacatctgtgatctcagcactttgggaggctgaggtgggaggattgcttgagcctgggagttcaagaccagcctgggcaacatggtgaaacaccgtctctactgaaaatacagaaaattagctgagggtggtggtgcgtgcctgtagtctcagctacctgggaggctgaggtgaaagaatcaccggagtccaggaagttgaggcttcagtgagccatgatcacaccactgcattccagtctgggcagtggaataagaccctgtcttaaaacacatacacacatacaaattgaagttatgctgtctcagccaggagacttgcatacgtgttatatccttctcacgttatcacaatctggagactcaatacaatttcatctaaatgcataatgaggggaatcagcacatgctgtaggagatagggaagacatcattggaaaggaacctgatttgatagcatatttctaacatcttacttattttcccccggtgtcaaattttgcattagctcagctaatctgtattactgttttataccagtttttaagctcctgtattaaatataaagagaatattactgatttctgtttttaaatttaatgaaaccaagtgtgtctttcaaatggtgatcaaggttctactgattattaccttaaggttcccccaaaagatttggattggtataagatgacatggagctttgatgtatgagaacaagcctttattctcttcctggtttcatcaaatatgagtcagaatggcaagttgtactcttagctttgccgccattctagaaccttttagcacccctacttaagttacagaaagctgctgaaaagaaagtatttttcttgccaataccttttg

SEQ ID NO: 99631 - DNA, 1022 bp, Homo sapiens
tttttttccttttaagatggagactaataaacattagggttaaaaagaactaattatattacagttcaaaaattgacttaaagttctagaatgatcttttccatttctgatactaggaaattcatcaataaaaatacattagcagaaatgactaagcaaacttgtttgtatagttttctggtattggactgttactaagcctctagttttctttttagttgccaaattgaaaaataacaactgaacataagagattagaaggagggactagctaagggcaagaggagtttttattgaaattaattctgctgtattcagtgtatatcagtaaacttatgattttggcaatggacaatttttccttatggtttaatggcattttctttttatttacttatactttattaaagaataggtcatgcagacccatgcagttggcttcgatgtgatcttacttcagtcgggaaaaattcattgacatgatacttttttcgtagctgattaattggcttctgttaggctaaacgttgagcatacaagacctagccatgtcttcaaagtcattctgacggtgttaaggtagatgtagtggtctgaaatggttagccactaaagttacacctccttttatgcaattacatgagaacagtaagcactaagtaagacaatttaaaatggaacttaataagaaaggcagtgcattttgttagattgccttaagatatactagtattatgaacagtggagaggagaattgatcttccaaatatctaggactcaggcactttttccatcttccaaataagctgctataaaaattggtaaaatcaagtttcttcagtattctcttaatttgaattatcgaggggaaaaagacaaatcctagttgtagtcctgtgatttaatagaagctgtagtattgggaaagagagagagggaagggaacaattactcaagaacctttgacttggttttccagttctcctagttgcgtaccagatgacctgaagtatttaggaaca

SEQ ID NO: 99632 - DNA, 1019 bp, Homo sapiens
ttaggtgtttggggtagaactattaatccaaatcaaactgcttggattttcttctaatacctcccttcattgggagacctcacactgttgctatgtcatttatgtcacattgacactcagatcccttttctgggttgaaggtggagaaatgtaattcacacaaaaggcccaaatgctaatgttttctgttttactgtacttcctggtttgttttatggaagtaatacttccgtgtattggtttaatttttttgtatgtatgtatgtatttattttgagacagcgtctcgctctgtcacccaggctggagtgcagtgacatgatctcggctcattgcaacctctgcctcctgggttcaagtgatgcttctgcctcagcctcccaagtagctgggactacaggtgtgtgccaccacacctggcctatgtgcattgtttttaaaaacaaacatgttgtatgttttgtatgtaggaataaaagcagaaggcccctaggggcatgttaggatttataatctcctaaagttaaatattctgcaagtttacacaagcagtaacttcatgaattactaagtattactgagagtatttatgttccaaattcgaagccttaatcaaaccagaaaaaaacatattctgttgggtttgaacaggtagttttcttattcattgtatacttagaaccttgggacttaaaggtcagagagtcaagggaactgccaaggagttagttgctagatatttttttgtttttttgagctgtatatatttccccacttgaaaaaacaaaaacactactacttatatggcattagtatgataggtgagagagaatgttgttggccatggttaccaccttaaattgacatgggaaaagagaatcaatatgaagtggaggaaaaaaaacaataacttcatttaatcatacatttttaccgttaacctgttttcttttggcttatccttctgagctagggtaaggaggcttgttttgtctttgttgtttttgtttttttgtgtc

SEQ ID NO: 99633 - DNA, 1105 bp, Homo sapiens
acagttttagggttaaataccaaggtacaagttagattaatgttttataattttttatgtgtgacatcttaaatgcccttatattggctgctcttttctttttatactttcttgtcttgtgggtttttctgacaggtttttattagctgaaacattttaatttgcttggaaaagtgaacatttgaaattttcctgaagttatgactaatgctttaatgggcatttctcagtttagctatctcatcaatgttctataaattttaagaaagctaccctgtttaaaatgaatgggtaaattattttccaaaaaatggtatcatgtcatatccagaaatacgagatggtcattttgggttattgaattcataaccactcagaagatgttgttcattcagcagatcctgagcgcctgccacgtttctggcaggcgttgtgctaaagatctccaaactgtcactgccctccaagctcaaaattgagtgacgttttctgataacaggcatatcataccacaacttagtagattttggaggtgttttcttataataactcctatttgctttgtatcttaggtgtagtttttgaaacagctgcagaaatgagaagggggtagaatagagaattaattgagattgcgggtagggaggggaaggcaataggttagtgggaaagaactcccactttgagtttggggaagtttacttaacctcttcaagtctgggagttcttgtctctacagttcggataacaactaccttgggcaacttactaacttttggtttcttcacctgtaacatgggaattagtagtacctacctcaggatttttgtgaggattaataactagagtactagctagtattatctcaggattattgaggattaaaggagaaaattgataaaatgtctggcatgtgggtgcccaacattagttctttcccttccctttcggagaaaagaatgtgtttattgccagtgctgtcattcttcattctttattttcattttctgctgccaagagttcttatttttttaatgagacttttgacctgtacttccttgtttctaatgtagcctgttgggtgggtgaggtatgaattgctgcc

SEQ ID NO: 99634 - DNA, 4267 bp, Homo sapiens
ctgcagcccatcggggaggcccaggggccacccctcagggcggagggcgaggtttgggggcagaggccgatgtgagggtgggaaccggctgccggagtccagcttattgcagaggagaggactgaactgggtggggactaggggacaacttggaggagggggtcgtcagagggggaagggaacttgaggggtggggccgcaggggggtgctgggggagggtgcggagggagtggtgcctgctgggtagtgtgcagtgaaccctcccgcgaaactgggcagctggagtaggggccttcttagggtccctctgggcggggctgagcttcccacctgcagagtgggtgcgaggtggagagaaccccaggcggggttgctggggcgaaagggggaagggaccaagacgtggggcagaacgtctggagttggagttaaggactagttaggagcctggatagaaaaagaggtatggagagaaagcttggctaagggtatacatatgttggtgaccttttgaaagagtaggacttttcaattttgtttttcgttgtgtgttttttgcagtgttggaacattgctagattaagcaggtgatgggtggagcttctgtagtttgttttggggaagcagagtcagggtcaggagaagttgcatcttggctattgctttgtgtggaggaaagagttttgaaaagaaggtggcaaattatttgggaagacttgattacttttcagctgtttaattctacgagaatgggacatggggagaggaaatgaaaactaagaagagaggccgggcgtgtggctcacgcctgtaatcccagcactctgggaggccgaggcgggtggatcacgaggtcaggagttcgagaccagcctgaccaacacggtgaaaccccgtctgtactaaaaatgcaaatatcagccgggcttggtggcgcgcgcctgtaatcccagctactcgggaggctaaggcaggagaatcgcttgaacctgggaggcggaggtggcagtgagctgagatccgccactgcactccagcctgggcgacagagcgagactccgcctcaaaaagaaaaaagaaaactaagaagggaagatttttccaagaattggagacttcattccatctgaggagtgcagtgtaggcccagtggttaaaaaccagactgcctaggttctcaaatatcagggccattgctacttagctgtgtgacctaaactctctaagcctcagttttcccgtctgtaaaagggggatgatggtattttctagcttgtgagtttacggagaagagtaaataagacaatttgtgtcaagtgcttactacagtgtctggcaggtagtaagtgtagtaagtagcttttacctgtcactgtaaagggactagctggtatatttggggctcttctgttctaagtaaaatttatagtcaagaatttgactgtagacagggctttagagtagtatctttgtagttgttgtagggttttgttgtaagtcatttggctttactggcttggtggacctggggctgaaagtccagtaccaatactagttctcctccgtggtattctcaaaagttcacctgcagtcttagcagggcatgtttttgtccttctgtgactttgaaatacttggctttggtttgctattgcgggagggtgtatgacttgaagaaagaatgcaagattggaaatttgcttagattgattaatcaactgattatacagttaggtccccgtgaggtgacttttctttaaaaataaaaaaaagcctagttatgtactcctttgtggaatacagagaagagaaatacacatttaaggaggagcatgggttagtttctaagtagttatgggtgaagtgccttgcaatttgaggatgaaacaggtggcaactccttttccatactgcgcgtccttttcctactcactcatccagagtgagtccttgtttttactattgtctctatctctgaacatacatctttgtgtcacataagtaaagacatatgtatgtatgtatatatactttacttcacataagtaaaatatatacatctttacttcacactctgttaaagaaagggatgattttctttaggaagtgagtttaaacccttccataggacttggatttgtagtaggcagaattacatctccctcttcccaaggtgccataccttgatccccagaatctgtagctatcctgtgttacatggcaaaaggaacttggcaggtgtaattaaggttaagaatcttaaaatagaaaaattatcctggattttctgggtgggccgaatctagtcacttaagtccttaaaagcagagaactttctccaactgggatcagagaaatgggcagaaaaggaaatcagagatttgaagcatgagaaggactccatttgcctttgctagagaggaccacatggaaagtttatcagaaggaatgtgggcagcctctagtggcaaagaccagtccctggctgacaaccagaaagaaatggggacctcagttgtgcaaccagaaggaacctgaatttggtcaacaacctgattgagcttggaagtgaatttcccagtttccaccaaggaatgcaaccttgagacaccttgatttttggcctcgtgagaccctaagcaaaagacctagctagccaagcccacccaacttctgacctacaataactgtgagataacaaatttgtgttatttttagctactacatttgtggtaatttgttatggcagcagtagaacactagtatagattttggtaccaggagtggggtactattacctaaaaatgaaagtggcagtagataaaggttagaattgttttgaggggcatgatagaaaaggcctggaacacaggaggatcgcttgagcccaggaagtcaaggctgcagtgagcggtaatggcaccactgcactccagcctgggtggcagagtgagaccctgtcaaaaaagaaaaggcctaggacatacttttagtagcaatatggatgttaatgactctgctagtgagggcccagacagaagtgaggtctttcttattggaaactggcagaaaggggatccttgttacatagtagcaactaagtttagcagaattgtatcctatggttatatggaaagccaaatttgcaagtgatgaacttgtatatttagctgagatttccaagcaaagtattaaatgtgcagcctggtttatttgtgaatgtgaactttaatggagtggacccatgtggaatacttccacagcccattaggttcttgagaattttatgccaacataaacagttctagtttggattgaaagagacagaaagtaatagggctgttggaccccccaaattctactgataggaagcaggctgataaaactactcacatgtgaatgtgttgcttttcataaaagaatcagggtgactcagacggagataggagagcccagaggggtggagctaaaagctggagaggatttttcccaggctttgaaatggaatggagattccctagattttgaaactgctttggaccggaggctctgttttcttttacattttgcccatttgaactggaatgtctaactgttattctctacatgtctcacagtggtatgttgggagtagagaacttgtttctttaggaattgtgccccaggaattggacttactgttttgtccccagaacctcatccacacctgaatagatgaatgagatttgggacttctgaaatgataagctttagatgggaaacctttgggaccttgggatgggatggatgtattttgcatttgagagagagatgaatccttggaaaccagaaggcagactgcggtaagcagaatggctcccctacgatttccatactataaaccctggaacatgaatatgttaagtagatttaattaaagttaaggatcttaggtagattatcttggattttctgggtgggtttattctactcacataagcacttaaaagcagagaactttttctggctggtgtcagagatgaggcagaaggggaagtcaaatttgaagcatgagaaggactcagcctgccgttactggaggggaccagattgaaagtgtgagacggggaatgcaggcagcctctagtaggaaaggccagtcccagctgacaaccagcaaggaagtgggaactcagtcctacagctgcaaggaactaaattcagccaatagcttgaatgaatgtggaagcaaattttccccagagtttccagcagggaacccaccca

SEQ ID NO: 99635 - DNA, 1055 bp, Homo sapiens
cggcctctgcccccaaacctcgccctccgccctgaggggtggcccctgggcctccccgatgggctgcaggggcctcgcttggtttatgtgtgaaggtgggggcaggggaaggcgacgggccgctcaggagtctgctggaagcgtgagggtcggccgcgctccgctgccctatcctgggcccaccccacccgccaacgacctcgcctggctgctccctaggtacctgtggtggaagcggcagcggcggcggccgctctcccctctgctcacacagacaatatggcggcgatggaggaggagacacacggctcggccgccagccgcagggaccagagcgaggctgcagccgctgctgccggaagcggaaaccccctcctaccaggaggcggggcgagacagcttccgactccgcccccagaggaatctctctgaatgcggccatgctgggatgtcctattgtaaccttagggattcagttctggcctagggtgcaaaatggaaggaatccccaacgcaaagcagaataaggagacttgcaatagttaagcgcattttatttcaatagtgttaacaagtgacaacagagagaacacgaacctcccattaggtgaacagttggtttgacccaagttaagatggcggtacccaggtttcccacacttcacccagctggcccccctttcttgaaaagaaccatgcgcgacctgcagagctgtagagccaagcattctgggagctgaagtctcttttgctctgacccctcgttttaaattagggtttcagcaacactttctattcaaacttggagttcggaagaagtgaatgaaagttggaccctaggaagggcatggcgcaggagtctgagaagtgaggatactagctctcaagagaccaaggcccaattccttcctcctacaggagtcctgccaagagctgtgcgtccaaaatacagtgtttttttttccttctatctgcctcccacccctgctctccttgcccgagctacctccccaaaacagccacaaagcactttctaccatgcagagctcatcatg

SEQ ID NO: 99636 - DNA, 1050 bp, Homo sapiens
atctttctgttctagctgctcttactagttagagactgagccagggaggcccagaggggtcaagcaacatctctggggtcacccagcaaatctggtggcggagtgggcctccagccagagcacccaagtgtctgctctgcccccactcccaggcttcctgccattgacaaggccacagtccttttcctgtggctttgccagaggctggctgtacctgggagggtaggcgcagggggagcaatgtgctttcctaatcagctcccaaagggggaagcacagccacgctgggacacaggataagcacgaccagtgttcctgaaacagcggggaagtgaggtagagggtgcttggaaagctctcctgggtgggggaccccggccccctggggccctccttcctctacttcttacaccaaaggaattaagcatggtaatttcatggcctgctccagcctagggactggcaattccacaactcccttgatctccctgggcctcggttttcatctgtgaggaagaccaggttggtcgggctcattcctgtggcatctggcacagtgcctgccacacagagggtattgacaatctgtttgtcaatttgcaaaatcggagccacaattcaggctcagatggtcaaacgcaggggagtggggtagaggcagaacagaggggatacgaacgtggactctggggccagagtgcagtcagtaaacatgaaatagatcacttgagctcaggagtttgagaccagcctgggcaacatagtgagaccctgtctctaaaaaaataaaaataaaagtgtttgttaaataaataaactgttgaaataggcatatgaatgtaccttgctgaggagagggtggctgcctggctgccctggcctttccctggctctcccaccctcgggcctctcgagcttctctgatcctgacctcacagggacacagccccagcccgagagccaagaactcctagctgcactgatcagctgacgcatcgctgtctctgctgggtctgcagtggggaagacaccagctctcacctcccaggg

SEQ ID NO: 99637 - DNA, 1171 bp, Homo sapiens
tttgtccctaaacattgtcatttggcagcagtctgtatcagtccagaaagggtttcttctgctttctgttgcagagaacttgatcgtgtggctgaactgtgatttattgatcaggatccctcttgagggatacagaggttagttccagtgttcacactggcctaatcgaacctctttatactctttctccccctctgcagggtggccgtcgtgacctggggggcagctgcttgaaggtgaggggggtggccccccttcgagggccacggagatgagcctggaccctggagaaggaggccaggagccagccactggctggacagggaagaagaccccaggagccaagcccaccccttctttgtgtagggaccgggggaccatggcctgttccgggacactctgggcagggccctcgggacatctccacccgatcctggagagctgtgaggatccattcagcctgcccagctctggctggtcagagacaaggcagaacttttggaaaaacaaagactgttggtgacagggtgtgtgtgtatctgtgcgtgagtgtgagtgtgtgtgagagagaattggtgagtttaaaataaaagctatttttaaataaaagacgtcgttctgagctgaggagagtcccgtggacatcggaggtcagaggtgggccctcccctggacctagagagaggcacagatgttctgggggctgccctgagccctggaagggtgggggtggggcgggggaaggcaggcagagccccctctccgggcgccataaccaaactttcctcagtctgctgtttatcagatgttcttaacaactgttaggtgtctgatatggttggtaaagaaatcttaattttacttatttttgaataaggcctgtgttcatttcattcacatggttcaaaactcagaaggtaccagagggtatgtgttgaaaagtctccgtgcccctgtcctccagccaccagctctcctctctgcaagcagcctagggcaccagtttcctgtgatgtcccattcactatgaatgatcaggcaaatacacaaatgacagcacatcgtacacacttttggctccttctttttttccttaatctagcttggtatcatcccaagtcagtacctaaagggtatttcatttcttcctgagctgcttattattccattt

SEQ ID NO: 99638 - DNA, 1492 bp, Homo sapiens
ctctgcatcttggcctgagaccaccctctgtctggctcatcagatatccagcctggttgctcaacacttggctgcctcagttgccctgaatcgtcggtcttcttagcctcaggcttgtgccctctccagggtccctgctgctcccagctgtgggcccctgtcagtgccccaggctgggctgagaagccaggagtgggcctttaaggcttcctgggatgggagggcctgaaggggctctcagggatactccctgactgcctttcacccattcattccagttagcaacccttagctacccaacagctgccttctgttggctctgagaaccccagagaagcaggttgtaggtccccacccttccaccagtcaggacctgacagtacagccccagggtcagggcagggagatgaagatgaggatgctgtggtctgatggtgggggaggggaagcacaaagggattctcagagcccagagaaagcctccaacccagggtgagtgctgacagggtttctgtgtctcatttctgaaggatgctttagaacaggggcaggccgatgaaggggtaggaaagggtgttctaggattggggcatacagcaagagctcaggcctagagaaggaagagggaagaggttaaaagtggcaggagtgcagagggggagcacaatggccaataacagcagtgacagcagccttcatgagcactgatctgtgctaagcgctctttatgatttatcattaaaatcctgcaacagccaggaatgaggcgctgtggttatccccacttgcttagaggtgctgccagtggcgcagagacacacagtcagtgatggaaccaggattcaaactcaggcctgcctggttgggacgtgggataggttacagagggaagtccctgtaactgtcatgtgtccacccccatagcaagcaggctgggggacttctctgcaggtctcaggcctgtcccacagctcacaggggcctcccctgggcctggccgcttccctgggatctgtctatgggaccaagaactcagccaaatttggctgtagaaaccatgctctcaaccccacggtctcctctgggaataggcgagaggggcaatcctggccagctatggccccttgaagactctgctggaagaaaactggctggcttggggagctcttgctcccttctgagctttgtgggccagaagagctttaagacccaagaccccgttcctttaccctgagccaccacctccctcccatcctggccagtctggagttggggttgccgtggaaacagtttcctgtagcatctttctgttgaaggaggggttaggtgtggccctctgtggtagaattagcacgtgggaggtggaaagggggttcttgtctctgccctgttttccctttgtcacctgggggtgaggattggacaggatcatcttgtaaggctctcccctgttggtatacccagagggtagctgggaccaggaggcactgtc

SEQ ID NO: 99639 - DNA, 1049 bp, Homo sapiens
aactgaggcccagagaggagaaagggatctgcccgcgtctcccaggtggtccaggctggagacaaaaagttcggatctgggcccaccccggccgaccctcccagacctccagcatctgccgggctagccagccgggaacgggggccttcggggtgggccgccggctcccgggccgctttcaacctgggggacggaggcggtgggagcgtcgccattggccagggcgcggcggacgcctccccattggccgggcggacgcctccccattggccgggcggagccctccgcccccggccggggcggccttgccattggcccctccctcgcctataaggcgggggccggcggggccgtgggagcgcgcgggagcgcacggcggggcgcggccgacgctgggacgcggcgcacggagggacgcggccggcgcccatggcgttcgcgctgctgcggcccgtcggcgcgcacgtgctgtacccggacgtgcggctgctgagcgaggacgaggagaaccgcagcgagagcgacgcgtcggaccagtcgttcggctgctgcgagggcccggaggcggcgcggcgcggcccgggccccgggggcgggcggcgggcgggcggcggcggcggcgcgggccccgtggtggtggtgcgacagcggcaggcggccaacgcgcgggagcgggaccgcactcagagcgtgaacacggccttcacggcgctgcgcacgctcatccccaccgagccggtggaccgcaagctgtccaagatcgagaccgtgcgcctggcgtccagctacatcgcgcacctggccaacgtgctgctgctgggcgactcggccgacgacgggcagccgtgcttccgtgccgcgggcagtgccaagggcgccgtccccgccgccgccgacggcggccgccagccgcgctccatctgcaccttctgcctcagcaaccagcgcaagggggtgagtgtgctgcgtccctcgctgcggccgccaggtcggggtaggcggggggcagcgcctctgcgggaaccggagaggtgcaggggtccccaacg

SEQ ID NO: 99640 - DNA, 1054 bp, Homo sapiens
ggcacactgcctcctgcaataaaactgggatcccattaccaagagagaaatgcagaattgtgtaccagttagcttttgctgtgtaacaaaccatccccaaacttggcagctagaaacaaaccctgtattttcccacaatcctatgggttggcaatttgggctgggctcaacagggcagttctgctgctcacacctgggatccctcatggagctaaggtcagctgttacctcagctgggcctggatggtctaggatagccttactcacttgcctggcaggtgacaggctgttggctggaattgcttggttctcctccatgtggcctctccagcaggctagctcaggcttattcacatgatggcttcaggattccaaagagagtgagagtagaagctgaaagacttcttgagttcttggcctggaactgggactaggacagtgtcacttctgctaagttcttttggtcagagcaaatcacaaggctttacccagattcaagggatgagaaacagactacatgtcttgatgaggggaaccacaaagagcttgtggccatttttcacctatcacaaataattttggatgggtatttatttggataaaggtatttccctcttccccctttctctctgtctcatggggcctcactctgccaagttggaaggcactaagacattgtcctggccctcagggtctaggggaagaggtgttggggcaggaagtgagtctctccatgggctggacccactgtagtaggagtgcctccttgtctgcactgctggtatggggttaggccaggtaggacattccagaggggcttctgaaaaccaagagtccctggggaaagggaacagagtaaggcaggccttgttctcactgccctctaagggaacttggtcactcggcacttttaagcctcagtttctccagttcaataataaggacaagagcttttcccatgcattctctttccccgggaaagttgactgaggtgaccagtaatagaattgaaaagggagagtgtcttcagtgcaatgtggcatcctggattggg

SEQ ID NO: 99641 - DNA, 1048 bp, Homo sapiens
gggaagcgccccttcctcatttgggagtggaggcttagggaatcgaggtgactggtaggcctcttcccaccatgtgtacctcagcaggggccttctctcaagggcccttgccctgatcatgggcacgtgaacccagaaaagccactggattctccttcgcccccgggcggccaactcatgggacccgtcggccccgcaggctcactcccagaaggcgctcctcgcacctagagagtattccgtgggttcccctgagccctgtgagagttctttgctccggcgctcgccccgcaagccccgtgactctgcacctcttccctcccggccccgcaggtggcctcgtgggtgcttttcagcggctgcctcagttacgtcaaggtgatgctgggcgtggtcctgcgcgacctcagccgcagcgccctcttgtggtgcggggcggcggtgcagctgggctcgctgctcggagcgctgctcatgttccctctggtcaacgtgctgcggctcttctcgtccgcggacttctgcaatctgcactgtccagcctaggcaggccgccgaccccgcccccatcgctcacggacggaactggggtccagagaggccaggtcacagagcaaggggcaggaacagagagacagagcctgagtaattgaatcatgaacgcaagtgcccactggggactgtggggaagatggcacctggaaatgcaaggtgcggctctatccccaactctgtgtcacactacctgtgacgaccagctcagatctcctttgctttgactctcaagagaggactgatttgcagcatctagctggaggcaggcccaagggtgttagaagggaaacagctgggacagccggctgtcccttcaggctgtgtgaccttgggaaagtcatttggcttctctgtgcctgtttcttcatgcatgcagtggggattccagtaagtaccaactacctcacaggcatggcacggaggcaaaaggaaaaagcagcccgcatcaagcaagccctcctgggccacctgctgatctgacagtccatcgtag

SEQ ID NO: 99642 - DNA, 1036 bp, Homo sapiens
ttgaacttttctttcatgaatcacggttaggaaaggcttctcttgttttctgctaataaaaagacagcttgggccaggcgtggtggctcacactgtaatcccagcactttgggaggccgaggcaggcggatcacctgaggccaggagttcgagaccagcctgaccaacgtggggaaaccctgtttccactaaaaatacaaaattagctggcatggtggcatgcacctgtaatcccagctatttgggaaactgaggcaggagaatcacttgagcccaggaggcagagggtcactgagccgagatcatcccattgcactccagcctggactaaaagagtgaaactatgtctcaaaggaaaaaaaaaaaagccagcttgttcacaggaaggggagtaataagagaaaactctgggccccaggtcccagcatcttgctaggtggtgaagctggaattactcacctggtgtccttctctgccagccccgctgcaggctgatctgagaaagcctctggcccagggcagataccgccatggccttcctgatgcacctgctggtctgcgtcttcggaatgggctcctgggtgaccatcaatgggctctgggtagagctgcccctgctggtgatggagctgcccgagggctggtacctgccctcctacctcacggtggtcatccagctggccaacatcgggcccctcctggtcaccctgctccatcacttccggcccagctgcctttccgaagtgcccatcatcttcaccctgctgggcgtgggaaccgtcacctgcatcatctttgccttcctctggaatatgacctcctgggtgctggacggccaccacagcatcgccttcttggtcctcaccttcttcctggccctggtggactgcacctcttcagtgaccttcctgccgttcatgagccggctgcccacctactacctcaccaccttctttgtgggtgaaggactcagcggcctcttgcccgccctggtggctcttgcccagggctccggtctcactacctgcgtcaatgt

SEQ ID NO: 99643 - DNA, 1048 bp, Homo sapiens
cccgcgtcgtacctgcgtgtcatttcacagatgaggactctgaggctcagagaggcaagtgtcccggcccggcgagctctggcggagaatccagttcaagtctttctgccccacctcgcagccccctagtctagtcacatctggacttgccttgagaggcccagacgggcaactggtagtcattttcccagcgttttatcggcagggacctgtagacccctggctggatcacatatccccgcgccccacactgtcctcgggataccccctttgggcgtctgtctttccttctccgcagtccggggttggactcggctcatttggcgcctttctgtctacggggacagaggaccactctttggggatcggacgggactgacatttctgggctggatgcaggggcagcagattctccagcccccagagccgctgctggcctcttgggaatcatccccagtttggggaagggaatagagccagtccctaaaccaaagccactagtcaccagagactttggaattgggagtggggccggaatccccccaggtggagcagctgacctaggccagaccctgctgtgtctcctggggacaccccctgccccctaggttgctattgtcagtctccttttgtaggtggggaaacggaggttctaagaagttaagccccttttcgaagtcacagtcagacaatgcagtggttagctcctagtccctctggcttcaatcttagaatccttgacacacagaatcatgcattttgagagtcttcaatctcttcataagggagttacatatcctctctcctctggagcctgcccctggctttgggggacaggatctccgaggactcagaaagaaaacaaggctttcttttattctttcaacaaatattatttattgacttcataagccctgctctggttcttgcatgttttggtttttttacttattagcaaatgtatcatcttctcccactgtgatgcaaggcaggggctgaggcaattgagccagtgcaaaatttagggatgcccaaaacctcagtaatc

SEQ ID NO: 99644 - DNA, 1116 bp, Homo sapiens
atgaagtgggcgtggttcccatttcctccagcgtagtctcagaagcgggaagccatgtgactgaggttacagccagggagggcagaggcccccggcactcacccctctggggtccaagccccgctggcatgtgttgtgtccctgggtaggtgtgtcactccctgtctgtgtctccagtgttcctgttggcaaatcaggggtgggacggaggtaaatggagaggccctgcccagtctgctgtaatccaggatctcggacttagtggggccaaagcttccaagttctcctgattagtgaggctgcaaaaaatgtttggcatgttattctctcaccgtttaaatgtgggcaagtaacaacttacatgtaaaattacccccatataccaagcatttaagttatttattatatcattgcttacaatagcaaataattggaaattatttgagaaatggctaaagaaactcaggcccaggtacgcaagggaatcctaggcagccctcaaaagatgtcctgcaaacacctgatgtggaatcacaagatacacaacacaggtcagtgaacaaaacaagttgtggcatgatacccacagtgtgctgctgcttgtggaagcaggaacacatgtccatgtactcttgtactggcacagaaccctggagaattatcctgggaaccctgcatgctggctgcccctggggaggggaacccgagggttgggctcaagggtgggaggcaagactcactactttgcacaccttttgaattttgaatcatgtgaatgtgttatctgtgcagaaaaaataaaaatacatttaaagtaaagtgaaagtagacaagaaacctgaaacagagacggacaagcaagcctgcaggcccagccagctaccgcccccgggcaacctcatgccacactgtgggctctgcccagcttggttttgtggctccaccctctacggtcatatttgggtttccacacacacagcacccaaaggaaatcccagctaacgcacatcaggttctgggctgggccacccgccaaggtggttggtgggcatgacaccgccccgggaatggcgtcgtccaaatgcctgagcaatgacacggcctcagatggaatga

SEQ ID NO: 99645 - DNA, 1056 bp, Homo sapiens
gatgtccaaaggccgtatcatcatgcgagaggcacgcagtgagtagctggggcccttgaagtagtgccagcggatgccgtccatcttgtacttgttgtcgggagcgtggtagtagacgccgttgaggtttgacaggccacaggcgtcaaaccaccaccctggtggaagagggaggacaggcgcttggtggaggtgggagcccagccagtggcaagagggcagcccctgtgtcccaaagagaacaaagactaatcggggctgttgcctcctctgggaagccagctggctggggatggggctgggtgggagtgggggtggggtggacaacagaccctctgctcagccggggcctctagagggcagcaaggggctctggccactcctcgagcccccttgctcctcccggccttctccctgagcccttggcgtccctgtcttcctccctcactgaacctgtctttccagctccccaacctcccctcatcgctctgctcactgctttctagtggtctctgtcactctctctgagtctctcactctccaggttcatctctttctctcttatggtctctgtgcgtgggtctgtctctgtgtgtcccattgtgttcatctttctctgatggtctttgtccctctctgcctttcgtgtctctggccctcccttcctctgggcccccatctttcacatgctgtgtttgtctcccggcctctccttgggctaagtctttctcccccatctccctctgtacttctctgccccagtatagctctccatctgctgctcaatgactctgacagccttggtgtctctctctttctccatctgtcctctgtgtctcagaaggtctctccccctgtctctgttcttcttactttgtctctgtctcccattcaccccacttcctgttctctgacctctgtgcctaccaaggaacactgcctgagccacagctggtgtggagctgcccctctgcctccctctggtctcctgatcctggttcggcttgcctggggttgggactgatagggtatagggtgcctcccccccggggccct

SEQ ID NO: 99646 - DNA, 1062 bp, Homo sapiens
tacaaatagactcctacagtatggaaccattggagttgcatatttttcactcatgatccatctgaagttcatctgtgtgtttgcacacatcaatggttctttcctttttattgctcaatggagtccactgcatggatggactgcagtttctccattcaccaattgatgtccattttatataaataatgcaggagagaagcaggcttgagcagatctcctcggccacggaggctgctcatccacggatctgcacctgttatttgtctgaatcaccccctctcccccagcccctgcctgtgaaaatttctttcttttccttcaagaccctttgcaaatgccctctccccagcaaggagcagggtgtgctgacccatgacccagatctgtaaagtggggctcagagaaacacagtagtctccaagggcccacaatgaaagtgtggcagagccagaactcaaacccagggccaaggggatggggcagtagaccagggaccaaaactcagtctctttgccagctggaagggtgacaaaaggtcaggcctttgtaccccatcataggcctgagaattcggcagcctgagagtgatggagaaggggcaggtctaatcctggagtcggtgcacggcatagagagaagtagatccaaaaaaacaagagaagtagatcccacgctgggtgagttcctccactgggatccattccctgcccttccagctggtgcctcagccatgggccagacctagctcccaccacccaggccaatattagtctccagagcccagcccagcctaactgagcccatctggcccagattatccatcccagggcctgtgctggtgggcgggtgtggcaaactgggtgatgggatccagctgtgggtaacctttgccctgcccagccacttgcaaccacaggacaagtgggggaccagtgaggtgcttggggagctccagtcacttgaggggaccctgagctgccctgaatcaccagctcagctctgcagccctcaggcaaggagtcttagagcctagcctgccagatggtgaccttgggcaagact

SEQ ID NO: 99647 - DNA, 1035 bp, Homo sapiens
ctaatcattggtcactgttgggaaatcgcatctctgatggcgatgtggccacgtacttggggcgctgaccacggccgcggtcctcactgggattgtacttccctaagtgtctgttggtatgttgggccaagcgcttccatcaagaaatttcttttctttctcctctatattacagttaggacactatactgataaaaaaaaattacctttgcaagtaggccacattctccatgaacttcattaagaatgataaagagggtattcccaaatccttcttattaaaaggggggtgttcagtttgagagggttgggaactcctggccagctcaattttcctaatgtatttgggactgaacccagcaaggaaggccctcctttgaaaggacaccagggaaggtgatgtgtactccacatgatagtatggctaatggtggcctttcaggcagtctcatagatactatttgtggggcagtgatctgagtccgccctgtccctgtgggcctttcccaccgcagcctcgtgtgcctgtcctggggctcacctcctgggcagggcctctggatgggacatttccttgactcagaaagcacctggcaggtggctgcctcctcatgcccagcccggccagcctctcgtacccggctctccaggccccaagccgagccgcaggtctttccattgtgtgtgcaggggctccagccgccccagggacccagttcacactcccctgtggggtgaaaggagagacagacagacagacagacagggtcagccggcagtgagggtccttcagatccaagggcagggtttgaggggttcagtcctctgaagactgaagacaccacttccacctgctaggagcagagttatttataagagcctggaatgagagcgaaacgaatgcatgcacagactaatatgggcctgaagccagagcggccgactgtctagctttaaaggaaaggcttcctggaggaggtgatgtatgagttaaagggagagaggggagctcgtcaggtgagaagaaggaagccc

SEQ ID NO: 99648 - DNA, 1022 bp, Homo sapiens
tgaaagcttcctgtctaggaaggacagggtaatcataagagatgtgtcatttggaatagcagtgccccaaccatcctcaggcccagagcagggtgcagcaatggatgtagcagacctgggctacccagacaggggccaggggccaggctgtgcactagcccagacagagaggaccagctggctggagataaagaatcaaaggtgcccatccagaggtctgagttctagctcctcccctcccatgactcactgtgtggcttctaacaagtgcctacccctctctcaactcaggacacttcctgtaaaatgctgttactacctcaggctacagataatagactctgcctaattgccttctcaaaagagggtgccggagtcttttacagtttccgtatcttgtaggtcatggtggtatttcattcttgttctcatcttcaatttgaaaattcttagggaagtagaacagctttgcgtatggttattgtcctatttgtctttcttttttaaattccttgtaatgtctttgcccattctccctccacacacttggatcattcccctttttcttattgatttataggagctcgttgtgtattaaggatattcttggcttactttgtgtgtaactggcttaatgatgatactgaagttgtaacagagggttacaaacatggcatgctttccatgcaccccccaccccccacccccaatgcacagtcgtatttttaaactccaatccttaataactttgggcagatctcaaagctttctggtaactttcagctattaaaaagcctagtccagtgctgaatttttaaaatacaggtctgatttgaagctctcctttcccatcactgcttccccatcactgcctgactcagcttctgactccactgatttgccctgtagggagatatgtcatgctgtctcattctcttctctcctccctctgggttgatttctcccctgtatgttggggagcagaagaaggaatggggatagagacagctgtcactaccctg

SEQ ID NO: 99649 - DNA, 1046 bp, Homo sapiens
tgcatgcacatatatgtggatgtatgtgagtgtgtgcatgcatgtgcacgtgtgtactactgtgtctactgataccattgtcaaaatagtgtggaggctgctggaccagctgagcccatcttctgtgctcagcccctttcagtcatggcctaatggaggccctcctgacagctgtaaggggcagattccaggaggatctttatattatagatgaggagactgaggcccagtgggtggtatagcaacagacaggggtgctgggatgtaagcccagagagtctgtctctggagctccaaacaattgccttagttcagatgcttgtttctaatcgccctgaatctgacagctacatcattccccaggtgtgtggattttagctcctggaaggtggaatgatgtgtcggggccctaaatctcctcctgcatcaaacacctctgctcggccagggcgtggcagacattgcacgctcctttcctttggtcctcaccccagtcctgcctggtggatatgcctctaccgccagcttacagaagagggaagttggttcagagaggggaactggcttatccaaagtaacgtcgcaaatacatgtgtgagctgggtcttcttaattccaaaacccacagcaaatcctgcctacggtagacttctgaaaacccatctaatgctgccattaaccaccttcttgtttgtgtagcactttatagtttgcagagcaattcagctttcattttctctctgaaattctggagaagggttctagaataatgaagtgataaggccaaaaaggccaagtgagacctttgagaccaatccttgtaaaattggagactcaagcagggaagtaccttactcaaggtcacccagctgtgagtagaagtgagggttcaggagactagcggtgaaggcaaaacttgaattggtagaggaaggcagcctgctccagagcctgataggttgagagcctctcagagcctcagtttccccccgcgtgacttggaaatgctcagtgtgctttgccttttttcccagggctgggacaaa

SEQ ID NO: 99650 - DNA, 1726 bp, Homo sapiens
gctcagcctcaggcctttgatttttcatcagaggaagttaaaccacgtgactgtgtacttaggctactttccaactgtggctttctgggactcttgatatttgatgtcagggtttacagggcagttgcagaccatgtttggcctgatatcgccagggtctgtcctctgtttactggggaacatcaattgcactgcagttagagatatcagtttcacctgacttcagggattttctgtaactctggaagccaaaggtgatggggtggtgagcagaccaaattgtttatattccaagagagaactctggtggattgaatgctgtacatggaggatataatataaatttaaaggcgtttgccagagcaaagatgaggatgtcatcaaattcctggcttccaaagtaaacaaatccacgacactaaacactaaacatattcgggaaatttacccagtttggggtgaggggatagtttctttttcgcagaagaatggtttgattagttttacttttgtttttcctcactctcatttctatgcttcaggcctatgaatttcattgtcatccagccaggttttaaaccatgacagttgcgacatcctgaattttatttgggatctctttccccagaggatttctgagcaccaggggtgacgaaacaggagaggccagcaattctcaatgtgtggtctccccttgtccttggtgtgtgaagttttgctttgctggacctttgtcttttccattttcttcatctccggtcccactccctcccgctgtattctcatgactacagatcttcccagtccacctgccccatggtgagcaatataaatatacatccatgaaaaaagattatagcatttttttgtgctttttaaaatttttacataagtggtactggagtgtaaacctcattttttggggaacttttctttaaatcatattttttcttttatatataatactatcattagatctggtttattccttctgactgctatatagtattccactataagcatattttgcattttatctccacttttgctaccttagccaaggctataatgaagatcctttgttatgtaccctgtgcacagggtttcttctgggagtagggattttggatcataggatattggctcatctaattgcactaaaaactgtcagattgctccccgaaggggctgtgcaagtttaaatgcccaccagcagggactggaggttcccattctccccacacctacacagacatctggcaaaaaatagaaaactgggtaataacagtccgaatcatgtaacttagtgtctcattatttcagttctgcttctctgattgctagtaaaattgaataactctttagacactattagccgctctttttcttgttcatatcttttgccactttttggagttcccaattgttattgttcattttccaggcattccctttatgtagaggttattaatttctttcctttgcagccatggcaaatgtctcttcctagcctgtggctccttattaatttagtagtgtctctgtagaacagaagctttcaattatgaacagtgtcaaaggcagcattttcttttatggatcttgtttaagaaatcttccccacctagaaatcactatattatttttcctgtagaaataatttgagaactatttctcaaactttagtatggaaagtcttaggatttttaaaaaagaaaagaggaag

SEQ ID NO: 99651 - DNA, 1057 bp, Homo sapiens
aactgcaagcagttgactcttcatctgcttcctgcaggacctacaagaacagtgaggagcttcggtctcgtattgtgtctggaatcatcacacctatccatgagcagtgggaaaaggctaatgtaagcagtccccaccgggagttcccccctgctaccgccagagaggtggacccactccggattcctccacaccacccacacaccagtcggcagcctccctggtgagtacagagtgcctagcgggaagcccatgcttctgtagagggattccagccagctatccccatcctgccacttgaccccatccctggcccgtatgtgttttcaacaaaatgatcagtgtcttggggtgcatggagttagaaagtggagacgtaagtggagcagtgagttcttgaactgctactagtcaccctaattacccaaaatcctaagcctgcctgatttctttctaggggccacacagagcccctgagtctgtccaaggatcagtgcctctggggcttatgtgcagtagtctaaggttgctgcccaggtaattcacagctaattcattccagagctttttgtctagacagggccctgggccagtctttctgagaaaatgtaaacatgtagaggtactagcccagaggagatgcagtcccagtgtcttgcccatttcatttcattgtagtcccccaatctcactatcaagttcagaagttttccaaaatagcatgggatgtgagtgagtcacattccaaggtttttgcagattaggatggcagcattaggactggagacttctgctcagagggaggagacaaggaccaggggaccctagtctctagctgagacagcacttctcagtttggagcccgtactgtgataccatactgttggtagggataagggacagagttcactgtgagggacatgaataagcacttaataaatgtagactaccattgttattttattctggtttgcaattatatgcctttagttagctaaaaatgggaaatcagtttaattattccaagtaatgattggcgtatctctttggcaaaatc

SEQ ID NO: 99652 - DNA, 1103 bp, Homo sapiens
cattttgcaaatctctttaatgtctggcttaatggaagacaactagattctcatttctgcttctgcattcagtctgtaggggatatgttgttttcattgaagcctttcacatatcagttgttggaaaaaaagaggactagtttaataaccttttcaaataattctagatattctttactgttaaaccaacttgacgagtagtagtttttgtaagggttagttgtaatgtggaatcaatccataccagtgaacttgttatatatctgttacatcaaaatctgctggtctatcatgccatttgaatggaccttttacccgtgtataatactattgtagaagatcgtgtattttggtcatttggaaaatactgattcactgagatatgcagatctgctcaaagttgacacatcttattatacaatatcattgctaatttttgcttgaaaacttgaattttctcattggcagtaaatagcattcattattttccttgaagtaatgggctcacatccttttcgagaaaatgtccgctatgtagccaagttgaataagcatggtttgtcattctttcaagtaaaaacaaaaaacaaaaaactgttttctttgaaaaaatgactgcttcagccagcagcttgaacaactgcacaagtacttttcatcatgacaacattgtgcctctgtgtgcagtagaagtgctttatgcaaggccaggtgtggtggcccacacctgtaatcccagcacttcaggagactgagacaagtgaattgcttgagcctagaagtttgagaccagcctgggcaacatggtgaaactctgtctctataaattagctggatgtggtggcgtgaccctggagtcccaactacttgagaggctgaggtgggaggattgcttgagcccaggaggtggaggttgtggtgagccatgatcacaccactgtactccagcctgggcaacatggtgaaactctgtctctataaattagctggatgtggtggtgtgaccctggagtcccaactacttgagaggctgaggtgggaggattgcttgagcccaggaggtggaggttgtggtgagccatgatcacactactgtactccag

SEQ ID NO: 99653 - DNA, 1055 bp, Homo sapiens
gcatctgaaccccaggactaatgcgtcactgcattaaccccaggacacatggaccaagtcactgcggccgtacttggccctgaatctgtcctggagggtgggtcaaaaggcaagggtggcaggtaggatggtaggcagtgaggggtggcaaggcctagctgactgaggacagacccagcaacaatgacaggaggtttgaacacctcacgagtggtagtgcccatgggaggtgcgaagtggaaggcccagcccttgcttggaggaacgtgaggctgatggtgcagtgcaatagaggtcactggatgcccatttgaacagctgcgttccagatgagccacctaaggtggatgttgtgagagtcacagtgggtttagagggacaaggtagtgagaggatgctgctgacgcattagtcctgggattcagctgcagtaaacagaaatttaccttttgtaaccaaaaaggtaatggtccagagagcagcaggatcacatcatcattgctacaatctggggattaggaactccagagccacacagcagctgcctatatctgcaccaaaaagtagatgtccttcacactgccatctggacaccactcagctagctcatccaagttcaaggctcaattgaatgcgtctggttgttggaacctacatggcctctcaaatggtactggcatggaatattggggagatgtctttattccctcttcccacctttcctggaaggtgcactgggacagaggtctagtgagccaatcttctgtgttgtctacgccatggaccatgatataaatgggtaccacagccttgcatgcctgagcctaaccatctcctgagatgcttgctctaagtacacattagtacatgctgggccccaatctagatctcaagggaacggccttcagatccatttttgacaagttccttttgtgagtcctatgatcatgcaagtttgagaactgagaagggaggggaagacctacctccttgttactcagaccaccagcaacagcagcatcacctgggaacctgttacacatgcagaatctcaa

SEQ ID NO: 99654 - DNA, 2563 bp, Homo sapiens
accacctgcacaacctccattccacagaggaagaaacaggctcaagaaacccatatgtgatggggagctcctaacaggcttccctgggccacaggaatgggctcgggctctctgctgggctctgtcacctggctccatgtgctgctcacctcggccttctgagtttagtaggatggcagctagtcttccctattgacaggtgaaaaagcaggtccacagctgttgagtgactttcccaaggccacacagaccacaaatcctggctccaagtccagggcgtttccagtaagcactgtccaaatcagtcatggaggtccctgagtgacaaaaatatgcaggaccccttctttccccctcccagttcccgcagctaggctgagtgttaagaggaaggtgccatacaggttcagcaccctggtcagcgcccagcctccctaaagccgctggaggaggcctttggagccagctcaggtcagtgtctgctgcttccttacccaggatggcccactcttggggacagacaggcatcctgagaggagggggcctggacctaggtgtcttgccacccaatacagagccctgccctctccctctccttcagaaggaagtatgggagcagttccatcctcaaggtttcttggttcccaggacagaaatttgagtgagaagcatgtgaagagagggatggcccaggggcccttggccatggtggccttggacaagtttggctttccccatctgtaaaatgtagataaggatggacccacctccccaagatcctgcctatctgtgagagtccatgactaagtgggccatgggctggactgagttcagtgctcccccaacctgccctcctcctctcccccacagagcttcccaatttacatgtaaaccttgggcatcaaagtgacagctgatagcccaggtttgcccacaaatgtgctctgactggcgtgcatgttattaaatttgataagatgcatgatggcagctattagagttttgactctgttctttaccagtagtgtgaccttcggcaagtcacttaacgtagctgtgccaaagcatcctcatatgtaaaatggaggtagtgataggacccctctgtaggattgttatgagctttaaatgatctagtccatgtaaagacatagatgagggcttggcacagagagaacactattgtttaaaaatagggtgacttaatgtgtgtaataagtaactggttcattgcagtgtacaaacatgaagtgttttctttttattcagctgacctctatcaactactcctttcgtatctcaatatcttgggcccagccaataagtaactgggcactttgattttcaaactcagtccagcccagcttaaactttccacctcccaaacttgcaagaggtggtctctggcttcttctgagctcttgctcctccagtgtggtgggtgagggggaggaagggagaaaagtaaagtctcttcactggccatgatgatgaggatggtgagaggagattttggtttttgtttatttgtttttttaagaaacagagtctctgttgcccaggctagagtacagtggcatggtcaaagctcactgcagcctcaaactcctggcctcaagtgatcctcaagatggagtcttgctatgttgcccagcctggtcttgaactcctggccttatgtgatccttccacctcaccctctggagtagctgagattacaggcacaagccactatgcccagctacaggtggtcttactctaatccatactaggtttttgggttgggtttggtttggtttggtttgatgctggggttttcagtagactacatgcataatttgggagtggtggtgagtgctttgtcctggaccctcagagaggagtggggatctctgtccaatctaagaggctaagaggctcacagcccatctctttgacatagtatgctggcctgcagtcacttgcgccacccacagctcagcctcctctcacctccctgcatcagtgcttggaaccccaggaacactggggtccttcccctacctacaagggctttgggacacttggaggggaggtaggactgtccctcctcctccctgatccccaataccaccatcccttcaagtcagcgtgggctgttcccacgaggggcttcccacttcaggaattttctggtcagaaatagacctcatctccatgttcacaaactcttctgagctccagaagataacatttcaagccctctcaagaatactctccttacatttttcatctgttcagtgctgtatctccaaaacctagcacagagtgctcaaatctttgttgaaagaatgaataaagggtgcttggatgggtaacactcaggtggtctgcaggccctgcagctcagccctgcagctgggaggcaggcatcggtccccttcttaagtgatttattaagtcctgggcagggggaagggtgtggaggtctggtcccagcaagtggcatctcattggacactcccttgtcctcaaccaccattttcaggcagcgggataatccctttcagcattcttttaccca

SEQ ID NO: 99655 - DNA, 1068 bp, Homo sapiens
atccaaatgagtctgccaccatcacagtaatccatatgacttggttgatatttttttaattatcattatggattgaaaagccttagcccatgatttgggatgtccaatcctatgtagtttacttagaacagctcatgccacgttctgtggctgtgcctacttggagcctgggagaaagcgacacaacagtggaagcctaggacttgtgaatcttttaccatcttggagctttgctctttccacaccataccccttcaataccacaacaaaaacctgggaagccaagctaaacaacccttgtcctttccagtcttcctctagctctctgctcttggtaaaacctaccagtaggagcagatatttgatctgtcatagaagctgtgatattacactccccagatgtttaactcactggactgaaggctcaagttacagctaatcagggcctctctacactacagaccccatgcccccccaccctcccacccccaaggaacaggatcctcggcccatgtggccaactgagatggagtaagtaggacctacattgggcaggggattcactaaaatggctcctgtagggtctctacaccagtggcttagaaggcatgtgctctcaaagccctctgggtccattcagactgaaggatgcctccccacagtcctcaaacacctgtatctccttgccccagggcctacttcctttccttaccaagagtttaaagaaagtctgcaggaacctagaaacatttcataagaaaaacacaaatggcaatgtggccagcgtgtccaggccacccaaatgtgcctgatttctcccccaaataaactgtggcttcactttactactatatgagggagactaaggttacaaattcagcataaatttttttttttcctgttatccaaataaggtcaggagcaagagacatactatggaggagaaggtgatcaaggcctgcatcatgcccacagaaatacaataaagccctcaccctttcctgtgtaaaagatccttcttgcccagagaactgggtaatattgtgcacttggctttgtaaaaatgtg

SEQ ID NO: 99656 - DNA, 1027 bp, Homo sapiens
taagaggaggtgtctgatgctagtccatattgacaagaaggtcagaaagattgaaaaacatgtcttcctgcactgaggctctttgagtttcattcattcattcattccattcatcctcacttcatttgctcatatttacacacacacacacacacaaacacacacacacacacacacacacagagaacgaaccacagtgcactggagaataaactccggcatgagaatgcagagaatcgtgtgtgtgtgcatgtatgtgtgcgtagacacaccggagcatgtgagccactctgcacctggtggtctctgtagcccatggcttgtgcgcctagggctctgagtgtatgtgccctcaggccatcagtgtatacaaggaatgatgcagttctgctgtggattaggaatgacacatgccaggcagggaagggggctgaggtgggacctgtcggggagaggctagatctgcctaagagccccgattgccaactccaggcgagtgttacaagggaacgggggcctaaggtggccagattctttcattttgcaggagaagccaggaatccaacatttaaaatgtaaaatctaaaatcttttgctttttatacatttgcaactaattcaccaaaaacaaatgaacaggccaggaacaaaacaaagcaaaacttctatcagccaaatatggtccccgggctgtaagtcagtatccttcagcgggaatgcacatgtgctgtctgtgtctgggtgggtttgtgttcaggttcttgggtggggtaactcctcttgcagcacagagagtgtccctcttctcgcctctccctcccggttcccctcctgtggttctagtccaggtccccacacttctgtttacataaaggcatttggctttgacctagtcatggctctccagtctgccccttcctcttggcccttttagccatgccatccccaacctgctggcttccttgctggacccccatcctccactttgccccctcccatctcatcagtcctcctttcttctgaagcc

SEQ ID NO: 99657 - DNA, 1023 bp, Homo sapiens
gtgtgtgtcagtgtgtgtgtccgtgtgtgtgcctgtgtgtctgtctgtgccgatgtgtctgtgtatgtatctgtgtgtgtgtgtgcctgtgtgtgtctgcgtgtgtgcctgtgtgtgtctgtgcctgtatgtctgtgtgtatctgtgtgtgtggcgtgtctgtgtgtctgtgtgtgtgtcagtgtctatgtatgtgtgtctgtgtatgtgtgcctgtgtgtgtgtgtctgtgtgtgtatctgtgtgtgtctctgtgtgtgcctatgtgtgtgtctgtttgtgtgtgtatctgtgtgtgtctctgtgtgtgcctatgtgtgtgtgtctgtgccggtgtgtctgtgtgtgtgtatctgtgtctctgtgtcagtgtctgtgtgtgtgtttgtgtgtcagtgtctgtgtgtgtgtatctgtgtatgtgtgtcagtgtctgtgtgtatgtgtgttgtttgtgttgtttgcctggcttcctaagacaactcctgtttgctatgctttctgttttctttcctccactctttcccatcctcctccttctagctttattgaaatatagttgatatacaagcttcacatatctaaagtacagtgtggtaaattctgacatatttctatactgatgaaaccatcaccacaattaggatagtgaacatctccatcgtccccaaaagtttcctcccccttcatcctcaggcaattactgatctgctttctgtcagtacagattacttcacattttctagtagtttatataaatggaataatataatatgcacatttttggtttggctttttcactcagcataattattttgagattgatgttgtgtataccaatagtttattccttttttttcttttttgttgagacagagtctcactctgtcacccaggctggagtgcagtggtgcgatcttggctcactgcaacctccgcctcccgggttcaagcaattctcctgcctcagcctcctgcgtagctgagattacaggcatgcgccaccatgcccagctaattttt

SEQ ID NO: 99658 - DNA, 1050 bp, Homo sapiens
tatttttttttttacaaagagctagtgactaaaaatgtacacgtgttaaattttatatcggggaaaatattcatgaaagcaaaatgaaaagaatgtaaaatagttacttcctctctaatcctcaatccttactagtttagctaaccttgggtcccccactcctaccaccccttgccaaggggtgactcctccgccccttgccaagcagagaggagacctgcgtgacttggcttgagttgacctaggggccatgacgtgagtacatagaagaaaaccacttctcattccacttctatcaccactttctctttgacagtttacgacttacaagtactttttcctcggtaaacaccatacagcttccatggaacttttaaaattgcctccagctcggctgcttcagcaaatgggcctcaccagggcctgccttttccaggctcataaagggacattgcccctccctagacctgccagtcactctcccctcaaggagcagagttggatggcaacaaggcctgagtctctagtcgcgagatacatgcccaggttttaagccaagatccaaggtttctgtttgagcaaaacaaccagcagccaggacactgagaatagagctggctgggccatagtctgttgtggaattggggcattctccttccccgtgaaagcctggccctccctcctccactggcacctgactgccctctgggtggaaattccttctcctttgccctggtagggcaccatgtcagtgccgccctgtgctgggagcagtgcacttccagcctgctgccaccccagagtactgcagtggacaggtccctgcccagagccggcaggtgttcacgtgtgtgctcccatgtgcccccggaggtgaaagtgtgaacatgtgcctgggctggtgccctagtatgtgtgagtacctgcgaggcacaagtgtgtctccatgtatgtgggcatgcaggtgtgaatggactgggaattgacatcccaggaagtgtgcgtgcatgtagtgctcacccacgtgtacgcagtgggggtgaggagtga

SEQ ID NO: 99659 - DNA, 1001 bp, Homo sapiens
tgacagaccaggcaggcaggcagtgagcgtgtgtgtgtctcctcggctcgcagggacacagagattgatgacctgaagacgcagctgtcacgcatgcaggaggactggattgaggaggagtgccaccgcgtggaggcccagctggccctgaaggaggcccgaaaggagatcaagcagctcaagcaggtcatcgacactgtcaagaacaacctgattgacaaggacaaggggctgcagaagtacttcgtggacatcaacatccagaacaagaagctggagacgctgctgcacagcatggaggtggcccagaatggcatggccaaggaggatggcactggggagtcagccggtgggtcccctgcccgctccctcacccgcagctccacctacaccaagctgagtgacccggctgtctgtggtgaccgccagccgggtgatccctccagcggctctgctgaggatggggcagacagtggctttgcagcagccgatgacacactgagccggacggacgcgctggaagccagcagcctgctgtcgtcgggggtggactgtggcaccgaggagacctcgctgcacagctccttcggcctgggcccccgcttccctgccagcaacacctatgagaagctgctgtgtggcatggaggctggtgtgcaggccagctgcatgcaggagcgtgccatccagacagacttcgtgcagtaccagcctgaccttgacaccatcctggagaaagtgacccaggcccaggtctgtgggacagaccctgagtcaggggacaggtgcccagagctggatgcccacccttcagggcccagagaccccaactcagcagtggtggtgacagtgggtgatgagctagaggccccagagcccatcacccgtggacccaccccacagcggcctggtgccaaccccaaccctggccagtcggtgagcgtggtgtgccccatggaagaggaggaggaggctgccgtggctgagaaggagcccaagag

SEQ ID NO: 99660 - DNA, 1042 bp, Homo sapiens
agtgtttggaccacctggcacgctttgcgtagagacttttaatttcttgttcttcccatgatctaagtggtgtctgcaggcccatctctttttatcaaacaagcaaatgtaagaggatgtaagaggaggaggatccttatggccctggaggcagcaggagccagagggtggatgggtacgcctagtacctcccacaggatggggaggcatttatgctttgaggccagaacccaaatgtgactgtgggcttggtgagtctctgggagcccttggaagggggaggagaatcgcattgatgaggccctgttacgcgtcaggctcacaccgctggccttcaagctgagggtgggaagaggcatgctcatttgaccaaggagatcctcaggtgggagacccatgttctcactcaagcaagaccttacctgggagtctgctgggaccctcatctgacaggctcggggtccgaggcagccctgccctgcagtcagccatcagtggtgtcctctagcagtggccatgctgatccctccacagaggggcctgtagagttgcccctggtccccaatccttagggtgatcgcttacttgcctcctccctaggacaaaaagatcatggagattctggccacggctgggaacgttgtcaccctgaccatcatccccagtgtgatctacgagcacatggtcaaaaagtaaggctgcacccctcctcacccctcctcacccctcctctgccatccccttcacctcccggcctcccaggtgcacctggctcagccacttccactttctcagtgctgacacagggcacaggctcagccagctctatcctcccttcccctccctccaaggtagcttgtggcttctggtgattcgaaagtcttagaactgggagtgaaggcccacatgggatgcactggctcggaagggggtggaggttgctggagggtggagagaaggagctgccaacctggtcactgttgttgctgtatccaggttgcctccagtcctgctccaccacaccatggaccactccatccca

SEQ ID NO: 99661 - DNA, 1095 bp, Homo sapiens
ccccctgccccctggtgtctgcagacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggtagggcgcgggggctgggtgggaagaggagctcgagctgcacgcgctctcccgccaggcctcagagctcagagggcccgtccacagtaaggaaggtgcagagcgggcctcctaaccccagcggccaggctcttgcccccagtccctcctccccgagacccgggcggggctggtgctgggttgcgcagggccctccactggcctctccgtgggcttccgtcgctcggaggagcctcccttccccacctgcccttcgctgcccagggcatctagcttccaggcgacggtgtagacagccgacgccagggaagcccatgcctttgtgaatggtacagtggagtgtttcggagtgcagccccaggccagggttgaaatcctgactcacctgcttcctaactatgaggcctagagtgtttcctccccggtaaatggggtaaccttggtgcctgccatgcagagctgtgtccctggcaccctgtaggttcctggagtatcaggaggaaaacaacaggttggaagagggatctgtgcctagggtgggccagggacactgactctggggccctgcctcccccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcgtggtggttcgggacaggtgagtagccaggcccgggcagcctctccgtctcaccccagccatgtccccaggacagctcactgtccctcctgccaggccgttccagcggactgtcaccatgcacaaggacagcatgggccacgtcggcttcgtgatcaagaaggggaagattgtctc

SEQ ID NO: 99662 - DNA, 1005 bp, Homo sapiens
accctgagtgtgtacagcgtcaatcctcatgggactgcccagcacacgagtccctcgtccctccccaggcacccagtgcgacaggcaccctcacccaaccaaacccaccaggatctaaactaaattcttcctccttttctgttcaaatttatataattatttttggaataagtagtacatttaaacttttcaaaatttaagacaccaaaaatgtgccataaaaaaaaaaatctccacctcagcacacagctccttaggtctgctcccaagagacaaccactctaaattcccattaaaataatcaaacttaattgcttcccccttacaaaagtcatgagcattcagagcaaaagctaacttaaaaaaaaaaaaaccaccttggaacacacaaaagtacaaactgaaaacctcaccctcaatgctgccattcagagatactcagcattttagcgtatgtcctcctagactgctttcaacgcacatccactttacaaaaaatgaaaacaaaatgcaagaagagattcacaatattgatttttcaacatctcactagaatctcagaaatgtttcctcataccttcttccttaagtgactttaatagctctgtgatcttccacagacaatgatttattcaagcagaccacagagatgggcatttgggatttctacattttccttactagaagcagcagtgatggatgggccctgtgactccactgtaacaaattcctagaagaaatgctgggtcacaggatatgaccactttttaatatcctggcctagacccctagatacctatcacaaaccgccctctagccaactgcctcgatcagcaggactaggtgtccaacccaaatttagagctatttaagaaaaggccaagaagtcttggttcataaccgtctgaacagcagctgtgagggccttaatcccacctccaaatccagactaaggccaaaggcctcctctgggctggcaacctgccttgtttacccagccacagc

SEQ ID NO: 99663 - DNA, 2008 bp, Homo sapiens
actttcctgatgcccaggtcaaaccctaaaccagttaatcataatcatgggagtggaacccaggcattaagagttttttaaagcccccaggtgatgcctatatgtagcacagtttgagacccaatgatagtggggaactgtattgtcagcagcatgggtggctagccctcctgctgtcctcagcaaggcaaacttaaccttagattaaacaaaacacacagatcaatttaaggagaaagtttgtttcacctgggacccagcccaagtctttctggctgtctccagctggaacagaagtggcttggtctcagactgctcagctgttggggaagggatttggcgtggcagatggcatcgtggctgtcgccactgcacacaaagaacactgagttgctggaaactcacagattttctgtccccaacagatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctcagctctgtgtcatggtggttattttcaggtgcctcccctgccatttggtgcagggggatggggttgggcagggtgaaggagggtggcagtggggatgcagtttcaagattgtgtcttggcagaagaatgcagcagtgaacatccttcctcactggctattaacgggttgggggtcagaggagggggaatgtggggtaggtttgcatcaaaggagctgcctgaaagggcaagctgggatagtcagggaacatcccctcccctgttaccaaatgtttattaaatatgtgttctgggtagagcactatgctcggggttcttgggttacagaaaagtgggagatacaacacatttttgagaagtgagtcacagtccacttggagatgtgctacaagcaactgcaagcaaattaatgagatacgaagagaagactctgattttaaattggtattcctcagtaacatttaatgtagaaagacagtcctgtggaga

SEQ ID NO: 99664 - DNA, 1108 bp, Homo sapiens
caggatgaaaaaaaaaaaaggccacaaagaaggcttcagaggtccctgctggcccagggacagatacctgtagtgtccagcattgcagtgaacatgatctactttcaaaggcagagggtttaaggggagggtgggtgggaatggtggaggcaaaggctctccccatccccacctcagttttaggtagggcttttaatttaacccaaagacatctctcaacttggagagtaattcagtcctcaacagcgcctcaaatctgctatggctttgcagcgcagcagcaagaatgtttaatatataatagataaaaatttcatccaaaaaattaaaataaaatattcttgcaaaccccccccccaacaccaattcctattctaatgttaacctaccacttgtgctgttaatacttgaccatgtacttaattggaaacctatatccaaaagactgaaactgaatcttcaccccaaaatgaaaacaaaataaaatgaataacttgaggtttatggcatatagtttaggtaaacacacatacgaggagaaaggggaagaggaaacagaggtgtcggaagcaaagctgagtgacagaacacattcagtcagggcagatgtctatacaaagtggagtggaacatcaggaaaagctccatatggattcatgtgcacatgtctggaggcaccagatccctccatggcagatctgttggggacagaaaatctgtgagtttccagcaactcagtgttctttgtgtgcagtggcgacagccacgatgccatctgccacgccaaatcccttccccaacagctgagcagtctgagaccaagccacttctgttccagctggagacagccagaaagacttgggctgggtcccaggtgaaacaaactttctccttaaattgatctgtgtgttttgtttaatctaaggttaagtttgccttgctgaggacagcaggagggctagccacccatgctgctgacaatacagttccccactatcattgggtctcaaactgtgctacatataggcatcacctgggggctttaaaaaactcttaatgcctgggttccactcccatgattatgattaactggtttagggtttgacct

SEQ ID NO: 99665 - DNA, 2115 bp, Homo sapiens
tcatagctcactgcaacctcaaacctctgggctcaagtgatctcccacttgatccactcaagtagctaggaccatgtctggctaaatttttttttttttttttttaattttttgcagaaacaggattggggacatgagtcttgctgtgttgcccaggctggttgcaaactcatgccagtctcaaactcctggcctcaagtgattctcctgccttggccttccaaagcactgggattacaggcatgagcctcctccgcagctggcctcattgtactttttgtcattaagaaactcacctgcgtgttgaaagtagaaatccttttccctctccaaactgtaaatggcaaggactttattttattttgaaggtttggggcttaggatattctggttttttgttatgtttgatttttggtttagtttagtcatttttttttttttaatcttaaaacttcccatattttgtccctgtaaaatgctgcctataggaaacactcctgcaaagattcatgagcaactataaactgcattgtgagtcatgagctttcactacaagtagtgaagccataagtctgtagaggtgccttcttcagtcctgttacccagtagaaggtatatggcactctgcccttccccaaagcagagtgccttggaagtgactccatttctattgggttattagtgaaatagtatcccagtggtccttgtgaatctccaggtcctggtcttgagtcttaaccaccgcttcagtggcttgagccaaccaccaggaacacagtctggggatactttgctgcccaggagctgctggccaggtctccctctgctgattccttgaaaagcaacaggaaagagcaggctgctgtggagtagacagacttgagactctctgcaccgtcttgttttgtaaacccttttgctccctttccaaggatttcagttcaggaggagacccaggcgaagatgacgtcaacagcctctgcatgcagtcagtcatagctttggcttctttcatggtcttgtgcttttaactggagcacattttcacatttttcttactgattagtaactaaaggtgcttaaagtaaagtttaccattctgggattacccctcatattcttgttaccatatagggaagaaggtctaaatatgaaggcctcatgcttgtccttctggttcttaaaaatcatgcaagtaaagcaaatccaagagtgctcttgagtaccagcaccatacgtgccaccaggacacagaacgcaggccaggtctgtgagcttgggctgcattcagtcaggagagccaagactaaatacttaaaataagaatatggagctattccaggcagtttgttaggcatgagttataggcttgtacggccaggaatgaaattggtcagttctgcaattagaaggcaatgcttgtgatgttttatgctgagtggcctttagagcttaaagactgtcagctgtcttgtctgcactgtaacctcagttgccttctctgagcagggcacgctttctttaggaaattatggcactaacttggcaggtggtttcactgttcaagggctccagctcctggcacaagtgatctccagagttaaaattggagcagctgctgagacttgacttgctgcctgctttacctgttccctccccaaagagaggaagcacttttcattcattgccagtgtgtatgtgggagctaaacatatatagcattttagtaaatgccactgcctactctttttcttttccttttttaaaaaagttactgaggcgtgattgaaatccaatatactgcacattttaaaaatgtacagcttcataaattttgatgtgtcattgtttccctttgaattcacccctccttaccctcctctaacaactactgatatgcttttttgtcagtgtagatttgttgcattttctaaagttttatataaatggaatcatacagtacgttctcttatgtctgccttctttcacttggtataattattttgagattcatctgtattgtcccatgtatcaattgtttgttcctttttgttgctaaatatttttctatatatagaaacatgtatttaccaacttacccgttggtggatgttt

SEQ ID NO: 99666 - DNA, 1076 bp, Homo sapiens
ggtcactcagtgaatatataaggagctgggcaaagcctcaatgttgccctcaagaagcttaccctgtagggagtggtcagttacaatgaaagtacctcaggcaacctacacctataggctagaacttcttggaggaagtgccatttggtcttgggtgtgtatggtgcagtcaggcaggaggaaagcgtcttccaggtatatacacaggccaggaggagaaaagggtacctttgatatttctgtaagtacttgatgaatgtctgctatgtacaagacactgtcctggctaccaagaatttaggagtgaagaagacacagttcctgccttcatctcacactgtagtggaaaagacataataaatatgattaataagcaagactgttgtgtataagctagtaagtgttaaggagggaataggaaaaggttgaggttttagatagattggcaaaggcctcaatgagaaagtgacatttgagcaaagacttgaaggaggtaaggatgtaacctatgtgactgtttgagcaagatcattttaggcagagagaacagcaaatgcaaaggcccacgggtggaggtatccctggtgtgtatgtagaacataaggaaacaatgttctgggactggaaaagtacaagagtaatcagaggtgaagtcagagggatggtggtaggggcggaggcttgacacttcttagagggtcttgtaggccattttaagagttttatctcctgagatgggggagtcacaggagtttttcagccgaggggtagtagggtctggctgctgtgtcaggtttagactgtaggagagcaagagcagaagcagggagaccagggagggagttgtaataatagtctgtaacagaggtccagaactcatgcctttaaccattataccctatagaaaatgcatatttctaccacttccagctagctattgttaagtggtatttcttttgatttttttggagatggagtctcactctgtcgcccaggctggagtgccctggtgcaatctcggctcactgcaacctctgcctcccgggttcaagcagttctcctgcctcagcctccca

SEQ ID NO: 99667 - DNA, 1076 bp, Homo sapiens; identical to SEQ ID NO: 99666

SEQ ID NO: 99668 - DNA, 1076 bp, Homo sapiens; identical to SEQ ID NO: 99666

SEQ ID NO: 99669 - DNA, 1062 bp, Homo sapiens
gaggcacacaggctgtaactgttgggcagggctgcaacaagtccctttgccttcccacagcagatgttttttgagcaacagcagcaagccaggctctagggacatggctagtgaactaaatagacaaagacctgatctggtggggctttgcttatgatgaggagactgatagtatggccatggagcacatcaggtagtaagaagcgctggagagattaaagcagagtgagggatgggaagggaagttggctgcttttcgtgagggtgattggaaaaggcctctgaaaaaaatggcattttaacattcactcaaaggacattggagagggagctacagggctgtctagagtatccaggcagagggaagagctagtgcaggaccctgaggctggagcctgctcggtgcattagaggaacagtaagaagaccggtgcgttagaggaacaggaagtggattgtgtgaaagggtatgtggcaggagatgaggggatggtggagcctcgttggtttttataaaaacgttgcctttttctaactcaggtgagagccactggctggcttggcttttaatgcccgcccccgcccccccaacccacgctccttctggctactgtgtggacaatgggcttttgggggcaaaggcagaaacaggacactggttgtatcccaggtgtgtggagtgccagctcaggcagtgggcagaagtggtgccaggtggacagtgatccccaaagagcatgtgggttcttcgctgtgttctgatcttgaccctgccatacaacgggctatgagagcttgaacaaattgtcccacagttcccagcttccacatgctgtctataaaatgggagtaacgatgcctgctgtgaagcaaatgcctatcgagactacccagttgtctccaaagtgttgctcttttttaaaaccacagttccattgagcctcactcatcgcagttgttatgtctgtaatctcagtctagaagagtccttacgctgtttttttcttaataactctgatttcttcaaagagagcaggctagttatagaatactccacatctg

SEQ ID NO: 99670 - DNA, 1062 bp, Homo sapiens; identical to SEQ ID NO: 99669

SEQ ID NO: 99671 - DNA, 1062 bp, Homo sapiens; identical to SEQ ID NO: 99669

SEQ ID NO: 99672 - DNA, 1076 bp, Homo sapiens
ggaccctggcatgcattaggacaaaagctttctttttgatttcgttttgataagccctataaagacgccttagtgagaagccagctctgcctcatgctcacagaatagactgttttcgagcaggctggtggctttgttcccgtgggtctttgtcaccagcctcccaggaataacctgtttgagacctgtgggggcgtgagaggagtgggtaggcactgggagatctcatctgtagcagttaaggcttttaagtcactgggaacagaatccatcttgggggaacatgatcagaaggtggaggttataaaggttccaggggttttcaaaggcagaagcccactgggtcctaagaagggaaaagaaataatcatgatgcctctagttctcatctctgttttttggttgttgttttgtgttttgttttgtttcctgcctgactgcctcagtagtctcctgttagagatttgtgtttgtctgcttctcccaactggtgggtggtggaagtcccctgcatgctcccccgtcccccctcccccctcccccctccccatggccagcttctctgtcttcttttgagtatctggctcagatttcttggctgtgattctgattgttacttctctgagaaggagagtttgagtaaggtgaacactcttgatccagtcagctcttgccaggtgtccactcagctgatttgggcacgggtccagagaaagaggcgtggaagtaaggtggccaaaatctccccttagccatcacaggtgtgcagagcacagactgacctttaccacatggatgctttaaatgccactaatggctgtcagtcaccttgatgtcactctcaagggtccctctggtgacttccgtgaccttctggcagagcacagcatgagcaaggcctcaaaggaatgcctgcactacctctgtggtaccagagggaaaatacaaagttcactatcaccagctaagcatctcctaggagcatgacaggcattgaggtgggagggaggtggtggaaaggtaagctgccaagtaagtgcctttaggagccagggaattctcatggcgcctccctg

SEQ ID NO: 99673 - DNA, 1076 bp, Homo sapiens; identical to SEQ ID NO: 99672

SEQ ID NO: 99674 - DNA, 1076 bp, Homo sapiens; identical to SEQ ID NO: 99672

SEQ ID NO: 99675 - DNA, 1403 bp, Homo sapiens
gggaaacatcccacttcctaagtcattgctttggcccttcctggccttgggggaagtagagctgcacggccttcttccgtctttttacttttgagccacttacaaatccaaggctcagtgacagcgctggctcaggctgaccgaaagctgcacgtgtaatttagtcccccagctcttctagaagtagagacttttctcgtcctcattttaaagataagcatctggaggctaatacatagtgataatacaagccaaaggaaattttagacacctccccctccccagccagaattcagacatcagagtcgtgtgccttggggctgtcttactccttctccttacaagcttgtcctggtttgtatgggggcgggggagggggagagctgagttggcggagactcagtggctgtgggtcccacaagggtggcagtgattggtgtagccacagttgttgatacgaataaccttccctccccctcctccttcccctttctcaaccttcccaccctttcctctgttccccctcctcctccctctttttttcccactccctctcctcctcttcctcctcctgggtagtaggctgtgggcagttctggccaagttgctcacgaataagctccacctttctcttccaaatcatggaaacatggagggatccctctattgagggaaatgactttcactggaaagaggaaaaggcaactaacatcccccctcccatgcccttttatttctgtggcccttccccgtgggtagaaatgggggcaggaggtagaagttaaggactagaactttaaaaattctgccaaaggaggagttactgaaacccatctttctggggagcaggcagtctcatgtccgtgaaggaagctggaaagtgcttttgatgttttagatagctgtccttgtaggccacagtcagcacctgagcctgggaggtctggtagatgaaagcgcatccttttggtgatttgtcatcggaaggatgaggagagtaaccatttacagtgctggggtgagtgggcagttcattcagttccgcagccaactggggcaaagattgggactcaagccgtgaggagctgccttctgccgcaccccctccccaccctagcttgtacatagccacactagggtgcttggcagcatgtgtcccactcccacgtctgcccctcatgctcgcccatgttctggtgctgccaacaggactggaccccagcatgtaggcagtgccgcacttcaccatgtctctttgtgaaatatccccacacagcatgtctggagccttttcctatgagaacagatggtcatgagacccagaacaccatcagggtttccagtgcctcttgaagtgtgtgtttttctcgcgggtggcacgcacccacatgtttccagagcag

SEQ ID NO: 99676 - DNA, 1403 bp, Homo sapiens; identical to SEQ ID NO: 99675

SEQ ID NO: 99677 - DNA, 1403 bp, Homo sapiens; identical to SEQ ID NO: 99675

SEQ ID NO: 99678 - DNA, 1102 bp, Homo sapiens
tccctggtactttcctgtttcctggggctcccttttcacgctcccagccagaaagctaaagctgcagcatcccgctgtgctgcactcttcatggcagggccaggtggtgggagcacaaagaagaaaaagcaacaggggtttgctcccttccttttgggatcacaactctgctgatgcatgaagaacattctcctccctctgagtttcagctcctgcaggttcccaatgctttgaggcctctgtcattcctgccagggactccctggtggctggggcataggagagcaggaagaagaaagaaactcagggcaggagagtggcattagaaattcctggtccttaagccagcactagagggcttctactggagttttcctgtgtggtcccagtccccacttccaggctacattttgttctagccaggaaacaagaagggggcaaaaaggtaaactcaggatggtactttgatttctgatcttcttcaagttaccttctaccatttacttttcagagtcctcacatagctggcctgtgcatcctgtccaggttttatagctgccttcagcaggagaggtggggtggaacatgcttattactccatcttgcccagaactagatctgaccccatcatagtttgccttaacatttccctgattatgaaggatgttgagtatcttttcgtgcagtcagaagccattgcatcctcttttctgtgaacctctatttatatcctctgttcacttatgtataggaaactaatgtctcagaatcagggagacatacactttgagatatgaatcacaattttttttcctattctgttttttgtcttttgacttgcttctggtacatttttatcattgcagaaatttatttttatgaatagatgaattgaagctctttgaggggaaaaagtgacaggaagactttcaattaccagagtcactgggacctgccctagattccatctcagtgcctgtgaagattccagttcacccatcagggtgtgtggacactgggatgtcaaaataaagctgcattatcattgctcccaccagtcccactgattcagtcaaatgtcacgtgcactagactgggcact

SEQ ID NO: 99679 - DNA, 1302 bp, Homo sapiens
ggccttgtttctgcttgtgttctgatgccatcctctctcctcagcactgccccccaggtgttgagtaccagctctccagcccaacaggcagaaaatgaagccaaagccagctcttccatcttaatcgacgaatcagagcctaccacaaacatccaaattcggcttgcagacggcgggaggctggtgcagaaatttaaccacagccacaggtaccttgcattgtgtggcctagcttattctaggagtgtcctctgggcctcacgcaaatgtgtgggaagcagagagccgttcttcctcctaaataccagcaggcactccatgctttccccaaagcagacacgagggtggtaaggactacaagtctgaagccttaagttctggtccccactcttccattagtgtggccagtgactgttcacttccccctgtgtgtctcattcttcatctgtaaaattagagtattagatttctcagggctttttttaagctaccagacttcagaggaagtcccatgctaaagtcctgtgaagacatcaaattagaactgctgtggttgatggaggagaagggggtgcagtgtcagcgtcccactcacctggcttcctccacctccctccccacaaggggcctgtgaaaattactgggccaggaagatctcttctagatctggctgtcgagaattctgggaatgcctgctccacatctcagaccatctgggctggatcagtgccttcttcattttaaagatggggaaactgagccacagcaaagtgaagagactagtaggagaggtgctagaggactgttgccagtaaatatatttggtgcctcctttctgtagaacagaagtgtctaaatgttattggtcatgagccaactaagccagcacccacatgtgggatcagtgaattgtttgtcagtcgttgaatattgactgggctcgcctgtgggtgacagcgggagacaagccccagctgtgagccaggtgcatctagagcctattgagacctccttcatcaggaacattcattacactcaagtgcctggtggttaagcgagtgacccatcccagtgatgtgagttatttgtctcagtttcatttcactcattaagctcagcacactgctgcccattcccagggtggacagcccatgcagaggctttgctaggtgaaaaagcttggtttgctaaaagtcacaggcagaatcctgcaggtccatgcccttagatgtgccaaattgtaagttgcatagattttaggggtttggggcaaaaaggaaacttatgtttaagtgctctagg

SEQ ID NO: 99680 - DNA, 1096 bp, Homo sapiens
ctgttggcagttctcaggaagagctggcaggccagctcctttgaacagatgcgtgtggctgccctgcgggatgattagagcactatggaactaatattctttgaatgatgtgctcttattatttgaaaaatcaggaggcctggtcttcaggtttcccctcctcttccactccccatcctccttgagagcagtatagactgggaatgcctgtcaggtgaccttccacttacagcccatggcagctgatagcatttctagtcgattttggtccagaattgaggcaaatataagtggggcaggaccttgaagaatgatataattagttagtcgagtgttttatgttgttagctaagcgctatgctaagtatttcatttattttatcttctttaatcctgttttaatccccattctacaaagaaggatcctgagacttggtgagatccatattgctggccagtgcagagctgggtccctccagtctctgcctttacctgccaacctgcatagcatcctggatattcttgcatagccacatagacatttgtttgtacttttagtatgtgttgggtacagtgcatgtttttagctattttctcaagtatctgggaagttttaactctgttttattgatgaggaaactgggtcttgaaatccaggcctatacctgtctgagtgtaaggcccaacaggagagtgggacagtgtgaagagcacaggatggagagccaaatagctcggattgtatactgcctctaccgtgaaccaacactgggattttgggcaagttgcttcaccctgctgtgcctcagtttcttcatctgtaatgaatccctacctcataggctgggggttaagcctgtgggttaagtaagttaatacatgtgaagtactcagcacagggcctggcttaggaatgggtgcctcataaatagtcaccatgtttatcaggccaccctgcctcacctaatttttagggagtgtgtaagagaaacagccagtcagaagctacacagccaagtccaggcatcaggctttcctcatctcttccagtgatgacccaccagcagtctgcaatgggacgtgctgggaagcaaac

SEQ ID NO: 99681 - DNA, 1050 bp, Homo sapiens
attgggttctgcatacatgttttgtttggcctatcaaatttgactgacttagtgttttattttgttttacttgaattaatagtcatctgttttatataaaatcgggatttctgtctcctttgagaaaatcaaaaagtctttgatattgtcttgtacccaaattcctacatggtcacggttaatgagagtttagtagcatctgtttcctttagccaggcactgccccttccagctcttaaccccaattctggccacctaattcatttaccatactgcctgggcatgtaggcactgagtctgatatcagagaaagtgcatctagtagctaacaagcttgatcaggaaccctgtcctctttcttcctcttacctaagatatatatatcattgtatctgagtaacccttgtaccatggaccaaccccttaaatgtgtatgaacttgtcccttatagccatttgcaggaggtggctaccgccttggggcagcaccagaggaagagtctgcctatgtggcaggagaaaagaggcagcattccagccaagatgtgagtgcatccaccttcccatgagggaagcttgtggactgttctgccatttttctgaagggattggttacatattgtgcattaaccagcagcctctgaaagggaaactaacagagacagtgcccttgctgtggttcacgaacaaagacgcttactggaaaatcaaaggaggtttcctgggtgctgggtgagagagctggtgagaacaggtggggaaaggggatgggcaaatgaaggagttttttgagcagcccatggatctcaggcagaggtacagtgtatctggggttctctagtgatgcgagtatagctgaagaacttggtcttcagaccaccagagaagacttaacaccaatttttcttttctttttttttagttttcctcattgtccactactttttagccctgtgcatagggtctccttccccacaagtgtaatcatacacacaattttgagtcttttttattcaatattataccacaaacatcttcttgtagtcttgt

SEQ ID NO: 99682 - DNA, 1583 bp, Homo sapiens
gtctttggggaagtgggctgagaaattacatgtgttctattctctattttcattcctattgtgaccttcacaccgactcaaaaccttccttttagatacttctggatataaaaatatatgttaattttggggtttcacactcctgagtgaaaggcagtgtcatcaagtacgtgaatgcccagctcctaaatgtctttctcgttctcctcccacccagtcacgtcctccaggcagtgaccttcctttatttcacattccgcttacttccttgacccctcagcatttcagacctgaaaggacactggtactgttgtccttgtcggggcctgtggctttgcctctcattccctggtgaatgtcaggaaatagagggctgagactaatttttataggttctcaatttttcttgcttggggacaagctgttgacttagctctgaataggagtaataaggaggcagtgggccaggctgcatgacaactggttttcaggcccatataaaaaagtactaactttattatctcaagccatgcctggcctattgcaaagcccagtgtgggtgtcttggggcttgtatttgagattggagcttctctgacctccagtaccctttcctcaggggccacagtgtgtgtcacatgaatggcaaggtgaggtgaggcttgggggagctcctggtgctgtgtcacaccaccttacctgtgtgcattactctgtgcttgttcttttgcatacatctgctgatttgaacctcacggctctgacttaaggagcaggtaggtagggcatgtggtccttccctcccgtttcaaagacaaggaaagtgagtcacagagtagtgcactggcttacccaggacatacagtggcagagccaagactggagcctagctgcttgtactaaccatgccagtgccaccattaaccccaagtcactagtggtagctacttctgactatgactgtagtcactgtctcctggagaggagcctggccaccagattgatagtcccagctgagactctctcctgaactgataagctgttttgcatgcttggaatgcctttccccagtttgttcacctgataaactcatccttatcctcaagattcagcccagaagacacccttaaaggaagccttggctgtccttcccacccagtgttccctcactgacttctgttgctgctcacactgcattttacctgcttgcctccttccatgtgttcccaactagccagtaaattctttaaagacaagcattgtaccctttgcctcagtgtgcccagcaccaacctggcacatgctctattcatgttttccatgagtgtttcatgttagaggtgtattttgtacacaggttttatgctgggggctcagagagaagtggacagcagattgttggccctcccaggaagaaaagtcccaacgagctggtggatgatctctttaaaggtgccaaagagcatggagctgtagctgtggagcgagtgaccaagagccctggagagaccagtaaaccgagagtgagtataagggtcattgtctgtgcccacaggactgagattccagaactgggaatgcca

SEQ ID NO: 99683 - DNA, 1052 bp, Homo sapiens
taaatactttctagtttttattaaagccagggcagcttaaattgggattccattttacctcatgataggactttctaatttatactcaatctgtgtgatcttgaaaaaataaatgccacattattttatgtgtaatcttaggggattaacctttctccacataacgtcctcctctcgcctaccaaaaatgtaacctcagtgtcttcacctccttagcagctggtgatgagggttacctttcttaatgctccctgagatcattttgctcctttctgtgtctccagtgataatagagtgacatccttcagagacctcattcatgaccaagatgaagatgaggaggaagaggaaggccagaggtgagtcttctagagggggtcagggggacagttcacagggaagtccagggtaatgtgtaaatcacctagaacaggacctggtaaacatgtttggttattgttagccattactactgtgggctggtctgtgtgggttatatcttaggaagtctcttctactccttgtagcttagaagtgacccctgttccgttacttaatgtatttattgaggaatattaggggagggaaacaaggaaaagatctagcagtcccactttttggtattgactaaaaagatttgaaatcagtttgtaaagaggtgtctacgttcccgtgctcattgcggtgctcttcacagtagcgaagttatggatcagcataagtgtcttaccagcagatgaatggataaagcaaatgtggtgtatatacacagtaggaatactactcagtctttaaaaagaaggaaattgtcattttcaacaacatggatagagaacattatgctaactaaaataagccaggcacagaaacacaaataaagcatgctctcgtgtggaatctagaacaattccaatctagaacaatcgacagagtgtggttacagaggcagaagtgagggcataatggggagatggtggtcaaagggtataaaatcttaagacaggaggaatatggtttggggctttttcttttttagatctcttgcacagcat

SEQ ID NO: 99684 - DNA, 1064 bp, Homo sapiens
cttttgtggcaagagagtccatggcttttatgagattctcaaagggctgacagacataaaaatgttaaccattgctataggagacagtttaaactcagtaataacagctgccatttattgagtatttacgagtgaggcactgagttaagcttttacatgaacatctttttagtcctcacagcaaccctgtgaggttagtactgttgttagtactgttagcactgaggttagtactattcctattttacagatgaggacactgaagttgggtatctttccaagatcacagagctagtaaaacaaggatttaagtgtagggctgttttctacattcagcatttcagctctcagccccaacaatgttctgcctcttcttgtggacattcaaagtcctccagagtttacccttggacccaccttcctaatctgattcccttttcctcatttcttaaatcctttgttccaaccaaactgatttctttggtgctctaattcttccttatttttggttctcctgcttttgtttgagcctctcacctgatcaggtgtgcccgctctcttgctttctgcctatacaaatcccatgcatccttccatgtttacctccatccccactctgctgagcgtgttattgctaaccctgtgaccaggctgcacgccataattctgttccacagaactccagtcacaactatcactccttcagttctttgactatatccatgtactactgggtggcatctctcccacattgccctgaactcttttcctgatatttaacttaatttttctccccaagtaaattgtaaattcctggaagtgggacggctagtatttcaggagcagtcaccaaagctctgccatgtttctcacctgtgttctcttctgatactgttcaacagctttgaaataggtaaggtgcttaccatttcgctggtcaggatgctaattcttagaaaggtcaagtaacttacagctgctgttaccacagattcaaggcgaagtctgcctaagtccaaagctgcttctgctgccacatgctacctccctgccagcacctccca

SEQ ID NO: 99685 - DNA, 3159 bp, Homo sapiens
gagagggaggaactggcccatctctcatgggtcctgcaggcaggccatgagactgtcttttatgcggggcgagataacgaggcatggacgtgttgtgagcggaggcctagcctgttcaaggtctgaatttttacccctagaatgtaagaagcatgggagcagggactttgttttgctccctgccatatccacagccctagaaaaacgtcgggccattgatagctctcagtaaatgcttgacaagtaagtgaatgaacgaatgcacaattaatgaaatgagggctgcgtcaatgaataactgggaatctgactcctgcagggagccttcagcccacaggtgtatgtaagacccgccccgcctctcatccttcgggctcccacccccgccgttaggctgcggttcgcgccgcggtcgccagagggcgcggagcggcggggcttcccgcacggagggctttgcgtgaggcaccgcgtggggcggggctgcgggcgggctcccagctgctgggccctcatcggctgggcctcgtcgaccggcaagcggaacgcggcagcggggctgggcctgtgcggcggccgccggagcgctttggaaggcgcacggggcgaagatggcggcggagcgacaggaggcgctgagggagttcgtggcggtgacgggcgccgaggaggaccgggcccgcttctttctcgagtcggccggctgggacttgcaggtagcgccgcgcggcgggctgtgtcgggtgggccggggactgctgggagcgggcgcctggtgccttaagcccgcggcggccgaagcgcacagtcatccccgctctaccgcggcccgacccaggcctcatggtcccgggaccgcttgtcacgcgtcgcctgctcggcttgggagtgggggaacgcgggccagccccagccagttctgccgtgccagtttcaccctgcctcgcccgcttgcggcgtcagcgagacttcgggcgctgcggcagccggcgaggagagggagcgcctgggggcgtggctgccgcgccgagtatctgctggaggccgggctggtccgagtgagcagctcttgggtgaagccccactcgggactaggtggccgctcatttccacttccgaagtccagcccgggagttgaccgccgcccagccttcctaattgctgggagaatacctctggggtggtggcgcaaggttggagcttcttcaccttgcgtagttaacttatctgtaaaatgggagtctcgtggaaattgctgtgtagttcattggcacgtactgagtattcactaaatacttgctaagaagacttaagcttcacgaggcagggatttttgtacactgatgaattcccagtgcctggaacaatgcctggcacataataagcattcggtaattaactgtagaaagaattgcataaatattcttggccagcttcgtcttaggtagatgatgacggtgatgactaatatttattgagtacctaccatgagccaagcgctgttctgactgctttacatgtcttttgtcatttaaccttcgcattttgcagctgagattaaagaggttaagtaacttgctcaaggcctcactagctaccaggcagaagaggtagaagtggaacccagttctgtctgattgcaagcagacagagcccaagctttaaaccaccatgtgccaagcactttacataatatgattcgttggatcctagcaacactatgaggtaaagactagacccattttatggatgaggaattggaagcacagagggcaaagaatttgctcagggtcacatagccagtaagtagcggggttggaatttgaactgagtctgctgccaaacgtaaattactccccaaacataagaattcggtaaagcatcacacctagatcacacctagacacaatgggaagcccctatgctgggcagaaataaaaagtttctacctgaaagacctaaaagcacacagtgttgtgaccaacagatcttctgtctcgttcccctcacattgtagtggggaaactgaggatcatgcatgtgacttgcctggcaggaacaggacttgaatgtaggctccctgagaatgccagttcactacatggcctgagacagcacactgcctcccagcagattacttttatcccttgacagctcactgtctcctgtgaagttggtgaccctgaggacagaggccatgtctatttcatctctgtgacctcaatgctttcttgtgtttgtgcaaagcaagtgattagtgaatgcctgtccgttgagttggtgacagagatgtcacaaatgaccaaaggattcccatattccttctgtatgtgtaaacctaagatgcgagtatgcataaatcttaatggattatctcatccagtgtgcaggttggtgagacaggtacccccatttcacagattaggaaacaacttgaaagaaaggaaaagtagcaacctggactgactccacagttcctgactccgggctgtactggaagcgcttaagagtgagggcctaagcacactagcagggatggaacctggctcctctctttaccagttgtgtaaacttgaacaaatttttttttaatcctcagtgcttctgtatcaactataaaatgagatgataagagtactaatagcatagagttcttgaggattaaacaaattaacgtatgtagaatgctcagaacaacctggcatgtaaatgctcactaaatgtgtgctacttttactagatcacgtttcttcataaaatgagaataaagagtgtcttccaccccagccattcttactgccttcttttcaccttagtgggtggaatttgtttcagttgacacgaagactaacagctgagctgttaaccttctggtctaattttctttggcccatggatgcaagctaccttgtaagtgttggccatgtctgtattcctttgtgctcaaaggagatgtgcgttaggtgaaggcctgtttaagggtcccaaggtactacctctctgtttcagatcgcgctagcgagcttttatgaggacggaggggatgaagacattgtgaccatttcgcaggcaacccccagttcagtgtccagaggcacagcccccaggtaagggccagcttcaattatcgctacatgagtgtttccagcagtgaagagg

SEQ ID NO: 99686 - DNA, 1284 bp, Homo sapiens
gggggcggggagggggggtctccaaaaaccgcggcggcggcggcggccgctccaggcgcccgttccggagtcggggggaggcccagccgggaggggggaagggggggagccttagtcatttccccgctccagcctgctcccgcccgagcgcgcactcacggccgctctccctcctcgctccgcagccgcggcccatggagcccgccggcccggcccccggccgcctcgggccgctgctctgcctgctgctcgccgcgtcctgcgcctggtcaggtaagcacccccccgctccccaccgctgcactccccaaactgcgggctcaggcctctcagactggcactgggaccccttcggctaatgccgagcagtaatagggggagagacgcctgtaaccagggttatagatgcagaaactgaggcccagagagggccagcgacatgcccaaggtcacacagccaagggtagaacccaagtctcttctatgagagtttgtctctgtggactctgactctgtgcactgtgctgggcactgagacaaaagagccgagttgcttcactcagcccctgcccggtccaatggggaaggctgactgacagtggctttcagagcagggccgtccggcttccccagaatctgtccccatggacatacgactttccacatgtttgacttcagggtgtgaggggaggaggtgagggcagaggtcctcccgatgctgcctggaatggaacagagacaagctgttgcaattagggaagagtgagccctccctctggtgcgcagagtaaaccggtgttagtgtgtgcctgggagagagggagccgggaggccgcggtaaccccagagcgagctgctgcgagcaacagatccttatgtaaaaacacggtggattgtccctgtggttgccaaagcctctccctggtggtcttgctccttgaggcgctcccagctcccccttcctcctgccttccccgagcttccaggcagctccctgcagttcaggtgctccgcggggatgttacctgtggctctgaccatgtctttctgttggcctacatcaaacacctggctgtcgccggcaggcgggctctgaaggctactgtgcatgttcaccaaagggtgaggtcaccattcaggagtcttgcttcttaaatgggttttgcaaaaccatgggtctcctgggagggcaccgggtggggggcggggggagcagagaaatggcattaagggagttgggagggagagaaaaatggggatcttgttttttgtcgtcttgaaact

SEQ ID NO: 99687 - DNA, 1031 bp, Homo sapiens
tgaacttatgaacgagaggcatttgatttgtagtatgcccgttagcatgtggcctctctccgtttggtaaacggttttctacagatccatgccctcagctgaactctcagctctgtgccttggcccgtgctgttcctgccatcagaaatgccctccctgtacctccttgtcttcctgtgtctgaatcctactcatcctccgaggttcaatttaatgtgcctcctggggagaggtcagaggagcctctccacgcagacacacaccctggcctagcgctaagatggtgctaagacccctgggtgttgatctgagccctgctactgacttggacaatttgcaggaatctgtgtctcattttgctcatctgtaaaagaggaatggtattaaccactctattgcaaggattaagttaattaatgcgtgtataatgctggaagccatgccttgtatgtagtaagcactcaatacatattaaccagtgttgtaattagcatggctttattctggtttgattcctcttttttaacaattgggacggattttcataaaacatctaacacagttgcttacacatagggggtacttaaaaaacagcaaaggctgttcagtgaacaaatgtccttcagcttgatattttccttgtagctttttttttttcttttttttttttttgagatggagtttcactcttgttgcccaggctggagtgcaatggcgtgatctcggctcaacgcaacctccgcctcctgggttcaagcgattctcctgcctcagcctcccgagtagctgggattacagggatgcgccaccatgcctggctgattttgtatttttagtagagacaaggtttctccgtgttggtcaggctggtctcgaactcctgaccccaggtgatccacctcccaaagtgctgggattacaggctgagccaccgcaccacccagctgtccttgtagcttttatgctgttgggggatggacaagttgagtagaaacccaggctagagtgatttaattgcctgttactaggga

SEQ ID NO: 99688 - DNA, 1043 bp, Homo sapiens
agtggttgatcaggaaaaggaagtcgaaatggtaatatttacacccaaagcaggtggagtggtcttaggcactctgagactccactcacctgccatgagaaccgggccccaagggtgatcccttgccagagtcaagactgggtgaggctgggaatgggagaaagaggcaggacaatgggcagatagccctgggcttcctgcagtgagggcagataggggtctgtgagcctctttccctggctgccctgcccctgccagtggggtggtgccaggccatgggttggtgggcaaattcacagggtctctctcctccccagccagagccagaggggcacagcagctctggacatctgccgcagccttgtctgatgtacaaggcaaaggtggcccaggtcagggcaggacaaggtcacatgaagggtcagtggagagcccaactggggccccaggtcacctgtcacctgcataccaggtagctgccactcctctgtctacctggttctctccttctcccctattctagctcgctctctcactctgcgtctgtctctcaggcatgtgtttctctgaggtctttatgatcatgatctttcttttttttgtttcttgtacctcaccttgttcagaatcgaggccctggctctgccttgctctgaactgttctcacttggtccctatccatcttcaacgcatctcatgacaagctcgtcctgccctcttcctgtctgggctccccccgtgcaccccaatctctccacccagggtccctgtcttgtgtgccccagtgtctctgattggggctcaggctcctgcagccaacctctacaattccttccagctgcccatttgggagcccttgaggcctggactgggtccagctccagtgtgtccccatcacagtgaggcctggatcacagggcatcagcaggtgttggtgagagtgaagtttgagccacagccacctccttgtttattcaatgtatagtaacaacaacttcctcagggcccatctcagggctaagtgacttctatgtgtgatctcg

SEQ ID NO: 99689 - DNA, 1029 bp, Homo sapiens
cccctagatgtgccagccacttactaacattttaatggcagtggctgggtgaccacaccacccaccaggtgccaaggactgtgctagccgtttcatttatttcactgatagcaaacacagttaatgagtacctactatgaactaagcctctatgtgcttggtgattttctttattttgctacagttacaacattccaactgcatgccaggggtggtgcttatagatttccctcattcttagcctagtaggagctaccagtccttgagcacctactgtgtgctgggcgttgtgcttagtaatttcattcatatgcaaagagcaccctcaatgtctgagcacctgatgcctgcctagctctgtcctggtgatgacctcaccgtggtgggggagctacgttatggagccctccctgtgatctgtctgtgccacaaggtcagagcttctgccctgtgctgtttcagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctggtgaggcctctatttcagctgacccagcttttttaaacttttagttttgtgggttttttaaatgttaaaagtagtaattcatgcttattatagaacaatctagaagtctataaatataaagtagaattttaatgtcagctccatttccccaaatcccacactccaagagtcaccactggtaagagtttgatgcacatcttgatagatcttttgacatagatttatatcacagga

SEQ ID NO: 99690 - DNA, 1170 bp, Homo sapiens
gggggttcagtgaatatttccccaagaaaaggctgtttaaaaatagcatctgaaggaagaaaaggattaaagcagattaagaggcagcagcatggagcatgcaaaggccctggggcagcctgactggcattcattccaagtcactgtttttgagcacatgtggtgaggaagcatggcaggcaggcaggcagacagcaatagaaaccagatatgcagatagacaggagatctgagattgtcatggaggggcagcccagccagcgcagcactgtcagcagagccatcacaaggtgacaccatagttgagtcttgaaggaaacaggaaagttagccaagaggaaaaatgatcaaaggggtccttcgaggctgctattgaagcatgaagtacataacatcaaatgccaccccccccccgaaatatctggtgggcagatgagtgggtacatgagggcagggcagtgaattagcctggaggcagcacgtcagaccacgtgggactctgagcagggcgatgagttggacttgaaccagccagccagtgggaagctccaggagggctggaggccagtagtgtggggacagatctgcgtgatcttccccagcagacgtgcccctgctcctggagggttctttctgtggccacgtggggcttgtcatgtctcagaactgctttcagagccaagcactcatgccaaatccattaataaccctgctgccaagccccactgctcatttctgacattatccatgctaacatccccggggttgccggcttgagaatttacacaacttctgccaagccagtggctctggtttgctcatcaccttgaccgtgaccctccagtgagtcaagtcatgacctccaattacagaagcaagtgcacgaacaacttctttgattaacttggacatcttggtctttttcttttctttctttaatgatgatacatagatgtttataatacagaacatttggagaatatgggaaactaaaaaggagaaaaaaaataccatgcaaagaccactgcagtttgcattttgctatgtttccttccagtgttatccacacatttttcataattgagataatcctacagagaattttcctttttcacttatcattttaatgtaagcaattttaacttaaaaaaaaaacctcctcataaacct

SEQ ID NO: 99691 - DNA, 1435 bp, Homo sapiens
gctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagg

SEQ ID NO: 99692 - DNA, 1035 bp, Homo sapiens
gccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatgagtccttccggtgttcagtattcttgtctttgtgagtgcgtcccggggccgcctcggggcctgcctgccctcctgccaaagcctggaagaggattgaatggaccccagggtttggaaacaacctacagcatttgagcccctcacgtaggttttagagacgtacaatttttgtttgccctggctcagaaggagccggtgtaaggttgagataaaattccatatagacaactgagtttggatctcggctctgctgctttgtagctgtgggagttcaaacagcacctctttgagacttgggccccgcgtcggcacaatggggcaggaatagtccctgccagggtgactgtgtggattcaaggaggttggaagcactgagcccacgcttggcactgggtaggccatcactgaggcttgtgt

SEQ ID NO: 99693 - DNA, 1024 bp, Homo sapiens
gtggggcttttaaaccgtgccccagtatggcaacgagatgaagcactgccttcttttgccttatttccaaatttgagatactttgtcttattaaaggaaagtatactggcttcattcagcctgcacagggcagaaaaagacttcttgaagaggaaatccctgaactgagatctaaaaaataagtaacaagaagccaggtaagtgcaaaagagccagtgcaaaggagttccaaggagccagtgcctggcagaggccagccgtccctgtgtgcactggcccctactgagctctgcagcccgattcacaccactctctccatcactccctgcactggcaacaccagcctcctgccagtttctaaaatgaaccacaggaccccggcatgagctactccctctgcctgcaacactccctggatctttcctgcttgtcctccaatccagaggctgggctaagttcccttgtcaaacacttccatagtaaccatgtccagcccttctttgtagccctcatctcaatttgtaattatacattggcactgtgattacatgattaccatcctctcctctactgccccagttgctgcctcagggcaaggagggtgttgattcactcatcagtgtaactcctatgctaagcccataggaggcacccagcaaatattagagggatgggaggatggacggagtgatgagaaggaggatgagaggatagatggatggaagaagggaggctgaatggatggctggattgatgcaggagagcacggatgggtggatgggtgggaaggaagaaaggaagggggagagggagggaagagagcaaagggggagaaggaagagcataaaagtcggagtctgcttggcattttaggagaactgagagtccctggctggcaggtttggaactagaagcaaacctcagtacatctgacttttcccactgagtttctctgcctttcatcatgatcctgggttcagggcaatcacttttttaaaaaaatgacgcatgatccccaacaggc

SEQ ID NO: 99694 - DNA, 1026 bp, Homo sapiens
gccccgcggcctacgctcctggcctccccgccttggcctggccgtttaaccgattctttcgcccgcaggtcacaatccaaggtccggctcctccgcgtcccagggccggacggagggatgaggcagggggggcccgggcagcgccgttgctgctccccccgccgcccgcagccatggaaacggggaaggacggcgcccgcagaggtacacaaagcccggagcggaaaaggcgaagcccagtgccgcgggcgcccagcacgaagctgaggccggcggcggcggcccgggccatggatccggtggcggccgaggccccgggcgaggccttcctggcgcggcgacggcctgagggcggtggcgggtccgcgcggccgcgttacagcctgttggcggagatcgggcgcggcagctacggcgtggtttatgaggcagtggccgggcgcagcggggcccgggtggcggtcaagaagatccgctgcgacgcccccgagaacgtggagctggcgctggctgaattctgggccctcaccagcctcaagcggcgccaccagaacgtcgtgcagtttgaggagtgcgtcctgcagcgcaatgggttagcccagcgcatgagtcacggcaacaagagctcgcagctttacctgcgcctggtggagacctcgctgaaaggtaggagcaccgcgggcctttccacccacgcagggcctggaccccctgctctccggacggcttggcccacactgttcctggccttcctaggcctcagacctggtccctgtcaccctgtgccctgacacaccctcctttcctgggcccaggcattcggccctctcttctcaggtcctaagatcagtccctgggcctaaagttggctggtgtttccataacaagagctcgtttaagtgctaaccattaacttaataagtgctcaagaattgcgagctatggttattaaacgtcttctatttttaagatcggttgggggagtggaggaggggtcgggttcagttagtagcagaactgcggagc

SEQ ID NO: 99695 - DNA, 1051 bp, Homo sapiens
aaacaaacaaaaagaaaaaacttgactggacccacccacaccctctccctgtctggttccaagtttcctgacaccctccagctccaacccccaaactcctgtggcttcctcgtctgccttttcctctgaggcccccggcccttcatcccaggcagccgagcaaactgactgtcttctggcttggtcctctgaggggtgcaggctgacaaccctcacaggtggcctgagagctgtcacataacaaagcatccggcatcttttccctccgttttacattcttaatctttttcttaacctcagaggctggctgggaagtggttttacttaaaaggaaaatggggtacattgaggcaagaggtcttgcagtcctggaggaactaattatcttagtttccgggttttaactgcagttagggaatgtattcatcctaactactcagtactcacaagcctttttcatactaccagtagctaagtgtctgcttggagaggagagaggcggtagaaagtttgaggagactttccgaggcaggaggatccaggggaagaaagtttactaatccgagtcccagctgtggtctcagtgctgaagtaatttttaggtaataacttcaaaagtaaattctatcctttttctataaataaactaaggcttagaagtgaacaaataacttgatcagggttaatccgcttgaaagggaagttagactgtactcctggtttccttacatttctcagagcttaagtgacggggatcccagatctgtcttgattcgaggcctggatcctttcgaaggcgtaatgctgttctctgcaccctgaggatgaacttttttaagagtgggtaggatttggggtgagtttggagggggtggtttcccaaaatcttgttacttttgcacaacttaaagatcccccaagtctttcccaagagaacgctttgtcccattgcaagtcagttgtttgacagtggagttggaaacatgaatcagtatcacctagagtcctttaattagatgtctaactttataaagtccatccgtgccccatc

SEQ ID NO: 99696 - DNA, 1895 bp, Homo sapiens
ggttgaggctacagtgagccattatcatgcaatggcactataacctgggcgactgagcaagaccctgtctcaaaaaaaaaaaaaaaagactccctaggggattcgtttatcttacctatattctaggagcgcatcacttactttgaagtctttctattctcagacttctcttagtcttctcctttactgccaatgaatggtctggacttcctactacaggattgccttgggatgtaggaatttgccttgccgaatgtttattccttgtgtcctcagttcattgacgccagtctcgaaccttcaacctcagcttgaagctcttgcttactctctcaacatataaatactatgtggactttcctcacctgaagaatttgtcaaaattccaaagtgaccccatggcagcatagcatagtggttagtaccatggactttggggttagaccctctggctcatcccaggactgactgcacaaaacatggagcaaattgtttgaaccctgtgaggagcattcctttattgtaagatagtgggtatgtacctatgacattaggtacatagggtcactgtgcaaactgttaatgtcagcaagtgctccacatagggaggaattcactgccttatataagttcacaccatgttctgtactcttctaccctcacccccttcaagattcacattgttcttgctcaagtttcccaaacttgtttcatcatagaacacaccttgttttctgtgttgtcaggcacaccaagttgacagaaacactggtgttttcatcctccctttgtgaactaaaactgggacctagaaaaatgaaatcttttgctttaggccgtacactggattggattggtccctttcagttgtttggagtctttaaaatatttgaacctctacggtgttcagggctcagagacagagcagtgaagaaaatatgtgttgtttctgcttatgaaaatgacattcaagctgacttgcaatgtgtggatttttcaagtagtaaataggtaatcatttttgcttcttaaaatagagaacagataccaaaattactccaggttaaactttgcttattctggattccaaaatttaggggtcttgatctgtcctggggccttgggtttacagcatgcaaataccacccagtaatgttaaagctggaaggaatcgtagagataacctggttcagctctctcattaaatagaaaagtcctttacagtcacccttggccctgcctcctaaaactcagaatgattttgaacaggccaaaaagtgtgaatctgccttgaagtctcaactaaacctaatgctgagtccctactgtggtatttgaagggaaagaaaaaaagcaaagcaaaacacaccaccccttgccccaatggaacttacatttgaaaagtttgagaactggaagaagatttaaatgctattcaagatcactggaggaaatgaccagtcaactcataagcaagggctttgcacaagaattaagaggaaagagaatcaggagttagggagaaggtgggcttgaaagtagggtgcctaggactgtggataggcgaagagacaaagggagtccgtttcactatttggccagtaaaataatccagtatcgaaaagagaaatgtcttgaaatgctgttcttggtcttaccccattttgtttgatagccttaaatgcattgtctccttccattctgtgcacagaccaaacacgtcctacccagaggcattaagacagcagaagcttcggaggaatagaaagaggtcttagatgtgtgacctggctgcctgtttcacaaggaaggaaactgaagcccagaaaagggacaaaacttttatccacaatgagttagtgatagcactcaaaccagcctcccaggctttttaa

SEQ ID NO: 99697 - DNA, 1050 bp, Homo sapiens
cggaagactgagtaagaaatctagtcccccgacctcaaaacatctgcagaatgtgccagcatttctcagggttaagtagaagagttaagccatagattgctaaccagaatatctggtataatttaataaaaactaaaataaaaatatgaaactagggccttggctggtcagaagagggaagttactgggaaatcaagtgagtataagatagactggtgttgcagctagccttaaggtgcacatttcaattgtacctgcagagattgtgggggcagcaggcctagggagagggatcacttcaaataggaatagcctggtctgcctagaacatgggtttcagctgttacagcctaagaagtgtgatgtcttagatggaataatacactttcattctaagatctaaatttcatcttttgcctaacatgtaaaaacttactcttacggcctacagcactgggattattgaaatcggtgacttccaaggatttggttggggttgagtgggaatgatgatgttagtgatggtcagtggttcatttccccaaaaagatcttacattctgccaaatgtagttcctatctgacttaagtcacagtactcatgtggtatagtttcattctctcatttgatagatgtgaagactgaggtaccaaaaagactgaggctcagagagcttcagggacttgcccagggttccagccatcttttcatcacacctcagtctccctgtgttttccttgaaacaaagaatccacccagtgaggcagtggtcagagttggggtctgaacccaaactctttgtttcctggtctgtgtttttcctgttacttcaccaagtgcctccgagtgcctggcatcatccacgtcgcctccttccatctggtcgtgaggtagctgagaccccgttagacagtctgcttggagtaaaggactagaattctgacatgtttgttttctcccgggagttcgtgtgtgaaagcatacgctgcagcttctcatgaaagaagtccaggggcctttcctgcgcaaagaagtacttttgaggccagg

SEQ ID NO: 99698 - DNA, 1615 bp, Homo sapiens
gcattaacaagaatccttctacaagtcaggaaaaaagagagggaaggtcatttgctcagcatggagtaacaatgatattagaagcaacagacccgtgacagccttcttgcatgctttcccttgtcccatctgcccagcagctttgggaggtgtgggtggtatggcactccctgtttggagacagtataatgaaacaaaaaggcttcgcagtcaaccagacggcagtaaacccgagtttccacctgggcctcattccaaacccaggtacctgacaccagtccctggtgcctgtgtcataccttagaaaggcactcagtgccagttgtgcaggtccccttggagcagttgtttgtcaccaatgtcactcttgaatacactgcatcctttagttaaaaagaagtgtgactgtgtccatctcactcaagctccttcctgtcttctttgatttaggagaaaggatcctgggttatgctgaggagccctgctatctctggtttgtcatggagttctgtgaaggtggagacctgaatcagtatgtcctgtcccggaggccagacccagccaccaacaaaagtttcatgctacagctgacgagcgccattgccttcctgcacaaaaaccatattgtgcacagggacctgaagccagacaacatcctcatcacagagcggtctggcacccccatcctcaaagtggccgactttggactaagcaaggtctgtgctgggctggcaccccgaggcaaagagggcaatcaagacaacaaaaatgtgaatgtgaataagtactggctgtcctcagcctgcggttcggacttctacatggctcctgaagtctgggagggacactacacagccaaggcggacatctttgccctgggcattatcatctgggcaatgatagaaagaatcacttttattgactctgagaccaagaaggagctcctggggacctacattaaacaggggactgagatcgtccctgttggtgaggcgctgctagaaaacccaaagatggagttgcacatcccccaaaaacgcaggacttccatgtctgaggggatcaagcagctcttgaaagatatgttagctgctaacccacaggaccggcctgatgcctttgaacttgaaaccagaatggaccaggtcacatgtgctgcttaaaattcagggctaagcattttgggtgattttaaactaggtgagtgctctctgttgttgttttttgttttttgttttgagacagggtctcactctgttggtcaggctggggtgcagcgggtgcagtggcaggatctcagctcactgcaacctccacctcccgagttcaagtgattctcgtgcctcagccacctgggtagctgggattacaggcacctgccatcatgcccggctaatttttgtatttttagtagagacggagtttcaccatgttggctaggctggtctcaaacttctgacctcaagcgatctgctggtctcagcctcccaaagtgctgggattacagttgtgagccaccatgcccagcctctcttttttttctgtatgcccacttcttggaccgggttcttcattctggaccctggcatgggccctgtgaacttgcaggggaata

SEQ ID NO: 99699 - DNA, 1049 bp, Homo sapiens
agcactttgggaagccaagtaggggcagattgtttgagctcacgagtttgagaccagcctgggcaacatggtgaaacctggtctctactaaaaatacaaaaattagccaggtgtggtggcacatgccataggcccagtacttgggagactgaggcaggagaattgcttgaaccagggaggcagaggttgcagtgagccaggatcacaccactgcactccagcctgggcgccagagagggactctgtctcaaaaaaacaaaaaaactctagttgcataagtaaacacacttgacccctataccaccaagatgaaaaaacacctcaatgttttaggattgtagatttcagagtcgcatttaagtcaggactaactagtttcagtttttttgcaaaaataaaaggaaatgcattttgggttggaaacctgggattcccctgaaagaagtggtgtctagtaacaatgcagggatggagtctcatatctgcgttttcctgactgtgtggccttaggcaaattattccacttatcagggccgcagttttattatctataaaatggagttgatcctatatatcttattgaggttgttgggggaatcacaagaggttgtgaaagtgccctatgtaaacagtctgaattaattgtaatacagtagcattgtttagatccatactttggcctaggtagaagtattggcttccatttccctctgaagacagtggtctttggtagcctcacttttgtggattgccaaatagcttttcttttgaaacaaagctgtagtcaaggcccacgctgtccaatcacttgttccagaaaagtatatctatttttaaagaccattcagtgatgggtctgatctctttcttatttgtcgcttttgaaagatgtttaataattcctaatggctcctaccagctagccacagccttttatcccatgcaggaagccagccaaactgatgttccaggtgcctccgcccacgtgttaccagggagagtgttgtgggatgagggaatctgcattcatggccaagtctgctgtctga

SEQ ID NO: 99700 - DNA, 1053 bp, Homo sapiens
agaggagctagttcctctcctactctgcaaaggtccagaatatggtgataagcagccaggtagcccaaaggaaagtagaagcaaggaaggttcttccttcatgggaaggtgtaactgccaaggggtcgaagtcagtggtttggttttgcaccccagaagctgatccctacttagtctttggtggagccttgaatttcccaaagggaggatgggaaaagggaaacgctaagctgtaccccgaagtgggtaagaatggaggtgttattaagagcagagagatcatggggtcgaggtggtatctcttgatgatgatcaattctttaatccaggcagatccagaacccctgaggttctttgagtccctgcccatatagtaggggtcacagctttgccacaacccatctcactagcactaaacagcttcacaagaggtgggggttatgagtgaagagtcagagtgtttggttctcttttctcgcaggaaattgaagctcagtcttcaactgtgaagaccctagtggcgctagatacctgtatacaaagagacatgtcccttggggcctcatctctctgctggtgttttctgaggagttttcctccccaggtggggaaggctggtattttattttttttgtaagtccccacaagctccccagtgacctgctgttgccatctcttgattgtttctgccgcatcaacagcaggaagctgagctgtcagttatgtaatggggccgatggccccccagggatcatctgtcccttgcagctctgcaggacttgaaagcatccatgaggggacaggcctggcccggggctgttgacgtcaaggcccagttgctgctcacatgttcctcctccatggcctccttggtgccacctaacctagatagcatccctttgggcaaatcagagtggctcttgtaatcgtccagctgtgagcaaagctgcctgatggttcaggggtgcttccaactcccatttcctcttaccccagggacgcagacactcccaccaacagctactggttatcaaaacctgctctgagggaccc

SEQ ID NO: 99701 - DNA, 2317 bp, Homo sapiens
tggtgggttcccctccagtagtaccatacagtaaagcagccagggctgccatgggtgtccttcacagtctgacactggtttcagcacaggcacactgtggcagggccaccagccatcccttcaggcgaggtcagcctgcatgtggattcctcctgtgttacaatgactgccccaaacattggcagaggaggcaaggctgggatagtgtgaggtgcccatataaccgaggtctggcagcagagaaggcaggagccacatatgcagccaggtcaaaattgccaaaagtttggaaagtaggagatctaaagcacacctccacccaccggcagctgggaaagcacccagcactgagggaatgctgtcattaggccagcgtctggcaccagctgcaaggaaagggctccaataagagccaaaggcatcatacgtgtctgtggtcctggtgccctggcagaagcccattctgagtgaacccagggattttaaagttgatgaggacccagcagaatggcagcggttgctctgtttctttctgacaaatcttccagctcactcactgaatcctgacttaagcaagggattccgtcactcatgcttactccaattgatgtggctgcccatagccctgtgtcgaaagattctggagccaagtcagattctggcatatggtaggcacttgcccagtggaggcattgattgtttagaccccaatatggtctcctaggaacttagtttaataatgcagatgagatatggacacttggtggtaatgggttatagatggctcagtagagatacaggaggacaggaaagagtggaggaggtggtattccaggctggttcttgaaggtaggttttaggggtaccttgtaagccaggtgggatgcgcaggagccacatctcagggtacatactcaggtttggtttcattacagtattctcagctacaggaggaaagggtactactgttcaggtagtgaaattcccaactggagatacactgtggacccaggacctagggagagtgcccaaggctctgtcttgattagggcagccgcattcgtgctcccagcccctcttttcatttccactagtgagtccgctgtgatattacaaaatcagaggaaatggagatctcctccagcgtttctaggattcagaggcatggcaggccttaaaactgccaaccaagtttaaaataaatcaataccataaaacactgcaatgaatttcccaacttttaaagaaatttcactttcagttagaggtgccaggggaaagctataactcagtttgcatcgtacacaggtcagaactctatattttgtttctttattaaagaaagtgatgtctagggacatgggaggaatggattagggccacccaggcactccataggccatagtgaggaagatgaaaatgcttccatttttccaggctgcaaaaagcatcttgatgtggggcttggggaagtcgccttatgaatggtcacctttatttttttttcccctgaactcggaggcctggtagtgtagctgtaacaggaggcaggttggctttgttatatcgtgttgggttttagtattgattatctattttaatgggaaaatcacaaagatgatgtgaaccagttgactcattctgcatttacttccatctttgtggggaaagaaaacccttcaccatgtacagcacccctttgtttttttttttctactttttttggatgtgcttaagacaagccctctcagaaagctaggcatgcctagggcaaatctaaggcatggagttgggagtatagtgttgtcagatcttggcaggttgtatgggcattaccagcacagcccggccttgtaccagacagaaagagaactagaagtcacaagtaaagactctgttgttagtaaccagattgcatcttggatctgatgatgtttggaaggaacccttggtttgcatagaacagcagaaataagtgattataccacaccccagacaaacaggctaactttaacttttaaaaatattttggagtttaggccaagtgcctaaactgaaatccagatgacaccactgacatggtccagaggtcctcctcccttttctgacctgagcatcttaggggccagggtaccaacaggtatagcaggaaaagccttcagagagcacatagctccttcctgctgctctggagtcctgtaagcaggacaacagccgtcgtgataatgccagactcgctcctgctcttagaactgagttgggatcattgccatagagagatccagatgtgagtcttgagcctaattatatgaacctg

SEQ ID NO: 99702 - DNA, 1138 bp, Homo sapiens
cccttggactcggggctgcgttcatggctgagtcttgctgcgttttgttcttttcttggtaatcagcttctcattaggttatgatgtgttgctcttctgtccttatttgcatctgctctctgctataattgtgtttcaagaacatggcgttttgttgtttttgtactgttttgctttttagagctgaaaacctgtgcggggtcttgtcacatgggcagcctggtgatcctgtcacggggcagctctccagtgtgggcatctcgctctctctttatttatttatttttactagttatataacatcagagtcatgattgctggctgtaaaattgattttgagaactactttaatttgtaaattgggaaatactttctattttgggttagggaaaggcatacaggggagggagatgggggaagaaggtctgtagtccctggtttcagtaatcttcaggtttctaagtgcaagcacccggagctgaggggcggccctccaaccttatctggacggtcagccagtggggaaggggctttggagtcactcctttggccatcccgtcacaccgtggtttgaatgacaatagagggcgtgggtagaggttgtgtcatctgcctgctcaccagacccccttccctggaaccccctggggacctaggtctttatacaaattcagcaagtggttactgagaattagcagcttgccgatcatcttgcattcactatatactcatgcgtcacttaatgacggggatatattctgagaaatccactgtgaagcgattttgtctttgtgcacacatcatggagtgttcttacacagtcctggatggtatagcctcctatacacctaggttatatggtagatagagcctattgctcctagactgcaaacctgtacagcatgttgtggtactgaatactactataggcagttgtaacacaatggtgtttgtgtgtctaaacatgtaaacatagaaaaggtacagtgaaaatacggcataaaaggtaaaaaaaatggctgggcttgctggcttatgcctatattcccaacactttgggaggccaagacaggaagatcacttgagcccaggagtttgagaccagcctgggccacagagggagacccccatctctaca

SEQ ID NO: 99703 - DNA, 1875 bp, Homo sapiens
tgggtgagtcagtgagtgagtaatgagtcagtgtgaaggcctaggacattactgtacactattgtagaatttctttctttaaaaataaattaaccttagcttactgtaacttttttgctttctaaacttaaaatttttaaaaaatttcttgattcattaacatttagcgtaaaacacaaacataagacagggtcgcgctctgtcacccaggctggagtgcagtggcacgatcttggattacttggcagcctcgaccttctgggctcaagctgtcctcctgcctcagcctcccaaagcgctgggcttacaagcctgagccaccgtgcctggcccttctttcttcatatccttattctgtatacttttttctattttaaaaaagtaatttttttactttttaaattttttttgcttaaaaacaaaaacccacacattagcctaggcctatgcaggctcagcgtcagtactccccactcttttttaaatgttgtgaaatcctcacctgcatcctaagtattgttgtccccccaactcccactccagagaaaggaagtgatttaccactggccacatggctagctcatgccagctcaaaggccagagctccagtgctcatgatctccatcgagctaccaaagagagttcatctgagcaaatccatatgcaccgcactgtctcagggccaccaggagctcagaaaagggagctggcttttgccaaagaagtaagtgatggcaaagtagaggacacatgacttaagatggaccttgaagaaagaagaacagattaggatatttgaagcaggggccatagcacgtccaaagacagaacactggaatttgtgaagagtgcctatccctgggtgggttcacacagaggctagagtagaaagctaaatagggctaagttgccaagagccttgaatgccagcctgaggagaatgaacttcatcctgccaaaaaagacaagggtgagtgggtggtggtgagcaaggctgtattttaggcaggtgagtcagtaacaatgaggggagaactgtcagtcccccaggaggggaagatgaattgccacactggcagtacctgtctccaaaaagtgtgagactgcacaggcaccttccagagcatgggaaggcggtaagggtaacatctgaataggaagatgagaaacctttgcttctatattggtgtcaagacatcaacagacttgctgttgaacctgttggactggtcaatctaggtttaaacggcagctctcctacttactagctgggcggctttgggcaagtgatctaccttctctgggcccccatttccttgtctggtcagtgcagtaagtgttgctcactgtaggctgtgtccggcgcagttcctagctcctgatgacagttgagtcagtggtggctctgtgtattgcccccatcctgctattttgtttgtttttgccaaatccttataggctaatcacacgttttcactttgcttctcactaacaatttgtgatagcattctttctcccaaagagatctccaaaccccttagcaattgcctccagtgagttccccttggcttagtgggctttaactggttgttgtaaccaaaagtccatgtggacctctctgtgggtgtgaccttcttggcatctttcttataaccacaaattgttctgtccccatatggaagagtgaccgttcccctttagctagtaatggcaccttagcatcttcctcctggcaagggcccctgaggacctcagcctttcccttgggctctttctttgctaatcacagcagccacaactgaacctgtctctggggaccaattgaggcagttggcagcttttattttctgccccacacttaataagttgaggagg

SEQ ID NO: 99704 - DNA, 1120 bp, Homo sapiens
gggcctcggagatgatcagaggtgaagaaccgcctggaagaggaaggccagggtttggccaggagaactaagaaggtctcaactccaggctttgttgtgtttaagctattgagagccccaggccacaccaggacttgcagtggtgggaatccattcctcttctgccctgtgttgcagggaactaggaggtaagggtggagggcgaccatctcgctcttgctggcggtggagcagccatccctgcctttctgttgggaaaaactgttgtgccaaactcttgtgtggaacacagctgggtcttcagcaggcatctgtcactgccgtgaggtcagcgcttctcacctaactgcctcctggattgtcatcttcccagatgtgtcccatagtgtccaggtgtcacagagacggcctgaggccctaagatctggttgtgactttgccatgataacagggtgtcctgaactggctgccgttgtcgtgttctcacagtgaagggcgtgccctgtgtgccggggtccatggtgtcatatgcagtgacacacactgtcaagcgccatttccctcacccctggagacttactgttaggtgcctgccctcagtatagacgtatccaatgggaaaacagcggacctgcccagagcagggaggtgtcgtggaactgggtagaccccctgcagcgttaggggcccatttgtgggctcgccaccttcaggcttccccagccatgacacttcagccccgccacccatgcctgtctgctgcagccatccttgcactctccagcgacactctcgcacctccctaggggaagcttccctccccctgggctgctgctctgagcccatctgttctccccctgcaagaaggggcaatgctcttgtgttgtccctctgtctggacgcgcctggccactccgaaggcttttcaccccattatggccaaatagtatagggccactggggagggggaagggaatcattttgtgttcatttttgttttctgtttcacctaaaccagcataggattgataggggagacggttggcgggcatttccgtttctatgtgaccaaggcagcaggggcttttacctgctaagcggcaatcctttggccctgaga

SEQ ID NO: 99705 - DNA, 3230 bp, Homo sapiens
ctctgtacatgagcaaatgggcaaaaacagtccccaaacccagcacccccctctccctggctgcagcccacactgtaacatccctagtgaggctccagcctaatgagccccttattttcttttttttccctccccaggtctagtagctctaactaaaaagttcttggagccatcgtgctccccctttgttatttttcttgctatcagagtagcaagaaacagcacccctgtaggtgacaggtgggcagcctggtaggggtcgccagcctccatgccccctcatcttccagttcttgcttagtggcacgacctctttccatagcataaatgcaggccagcgttttagccccaagtgcctgcccttgcttcttacccctcccctgctttctcaaacacttgcccacctcaggcactcagcgggctccgccgtggtgagagaactggccgtggctcagccccgggtagcacctgtagtttcagtgccactctccactgtccccttgtggaccagcttccactcactgtcacgtcccccctcctgcgtcttcactgggtctcaggctgccagcagctctctggtgcatcgtctcaacaccaccaagtttgtaggacctgcccaagttctagtagtattcaaaacttcaaacggcagtcatttgttctcctcggctctgtggcaaggatagccctttggagggggactcttgacctcggctgttagggatctgaacttggttttcccgtcagaagaatcagcaggacagatcgtagtgccttattccattgtcctcccctggccaggcctcctggctcagctggaagtgcatggcttctttctccctatctgtgtcctctgtcacttgctctttcactctctctctcattcccagagagccacgggggagggatcaccctcacccccaacaccctcttcctgagggctgtagccaggtccgcatctccccaccaccaccagggcactcactcgcagctatagcccaggacagaaaaactgtgctttggacaggtgcacactctctgcctcttacctctagccaggaggatgcctcagtctgttcattcgagactggccccgtctgaaccttctctgggcactggggactaaggttgcaggccttagcctcgtctcgtcccagaggcattggatcaggagaatgggaatttttttcctcccacctggacatagtttgcccctgtggctgcctttctgagggagtatactaaatgtttacttaagaaacaccctgtttacagccagaggagaaacacccaacactgagtggagatttgactctggacagggcctggcctccttagtggcactgccggggggccccagagcgaatgagggcagagatgcccggggcaggggcaaacgccctccgctccctctgctcccaaccctgtggtgctaggaccactccccgccttccctacggcctcctcgccctgcacattccccacctccacattcccctcctccaagatctcagctccttaacatatcagttgtctcctagcctagaaaaccagtgtttggagcaataagatgattatttttgcttgaatctttttctaagagaaggaaaagagctggcattgtgggaattttctttttatgctgttagctgtttaccttcttagaagacatcctaataggatggatgtctgggttttagccttggggtatcttttggaaacttagaaaagcaggagtcaggctgccaccccctaaggagggaccctaacgttctgcccttgcctggttccatatggctccttccagccctgcccaccaagtgcagctcccactttccatcctgcccatacgcccctcttcccccgacatctgggggcgctggtggcacttactctaggttggtctcagactatccctccccttggctggttttccctcctaggcctgtctggcagcccccagacagacgtagctcctgggagtctcggccctggcaaccttggaagagccaagctgacattgtttagctcttcaggccactgggttttggaggcagaagtccagagatactggctctgccaagctgtcgtactgggctgtggcacagccttcgagacaacacgggtgtatctctgatcctgccctacctaggcttcaaggggcttctgtctggagaaatgccctcaaagggtaaccagtaggtgtggcattgaattggccagtgttagcatctacagccatcaccgagatgagtccactgccgttgcctgcccgagggccccctaaggttatagacggtatcagcagggaggccgtcccgctggttttctaggagagcccacaggaggaagggagcctcttcaggggcactggaatcttttgtgccaggggcttcttttcatcagagccggggagtacattgcagtgacttcttaaacatttgtgtgggacagacgagcgtgagggaggttttaagccaggcacaaagttagtttccaatactagttaataaatctatttttcttcatttcctttttttgcacagaagctggtaatctaggacctacgtgtgaacaactttatatgaatattttttgtacttggtttacttgggttggtatgatacattatatttaagttccttgaacactgtggatcccctaatgtgtatgaatgactgaggctttgtaaattaagggacgtttgtgtgaataaagttatttgatggggtcaaagaagccatatgtgatttgaaaaagagtgttttgtggtttgttgcccctgtttgggagggtggcaaggccagcccatgcgcagccccccatcccagctggtgggtggtgggagagaaggatccttggccgtttccatgtccccgtgcttgaagaagctgcctgatggcctttgactgaccttcccattctacacctgagaaaccagcacttggaagtgcaggaagctatctgaaatcgtgcagctgccactgggggatcctggatccaaactaagcctagtctgcccttccagggggtccggggcctaagcaaacattgtgggcccctcctccagacatctcagaagccccctcaacccccaaccctgtggttctgcaagttctgcctttgagagagttttaacaaagagctaaaaagggggggtctccataccacagcagtaaaggtgtaaggatcaagttttggaaaagctcagcagagaggtcggttccatg

SEQ ID NO: 99706 - DNA, 2177 bp, Homo sapiens
attattcctctatgggtttttatagacataggaacccagtcagcctcagagtagtccctagttagcacatatgccatgtatacccctctcctcactcgattactgcagggcgtgggaggctggggcagggttggggattcaagttgcagatcaggcactgactaaacttcttactcttacttcaggccttctttgacccttggccacagagtatggaagtagctccgcagaggcgtgggctcgattcctcagggccacgttaccacagacctgtttgtttcttatgctgttgttcgtggagtctcatgggattgtctggtttcccttacagggccccctcccccgggaatgcgcccaccaaggccctagactcatcttggccctcctcagctccctgcctgtttcccgtaaggctgtacatagtccttttatctccttgtggcctatgaaactggtttataataaactcttaagagaacattataattgcacctatggatctttatttttagaaaaatctttgatatattgggtgcttaatagagtcaagaagggttgccttggaaaaaattaaccctgatcttaccttcttccctataaaatgttttactacccatttgcatctgtacatcctcatacactaagatacttacaaaattgaacattttcacttatcagattcaaagatcagttttgttgaaatcagtacccataatatcctcttgggaaggcacttgtctagatagcttctccatgaagcaaatgctaaaaatgaaaattctgctgggagaggaacaattttggcataactttctgccagggtcacacacgtaacatataacctaacgtaacttttgaattgtggtatcttcatgagttcttccacccaaagcctgtgttcactgagcagcactctagtacttagtgcatcaagctctaagggtacaaaaataaggtgaacactgttgtaaagttactgtgtagggggaagataattgtaaatgcaatcagtggtacttaccacattaatggaagaaaaaagccataggatcttctcaacagatgcagaaaaaacatttgagatgatttcaacaccctttgatgataaatacacccagcaaattaggagtagaagggaattttttttttttttaaagagatggcggggtgcaggcatgagtcactgcacccagctcagaaggcaatttttaaacaagattaagggatttatgaaacacagctaacataatagtgaaagactgaaagttttacccttatgattaggaacaagacaagggttcccactttggccactttcaacattgtactggaagttctagccagaacgattaggcaagaaaaagaagaattggaattggaaaggaagaggtaaaactatctctgcagaagatatcctgtatatagaaaaccccatcaactagatagctactagagctaatgagtgaattcagcaacgttttagggtacaagatcacataaaaactattccatacaccaccaacaaacaatctgaaaaggaaatggaagagaattccagttaggatagcaaccaaaagaatacctaagaatcaaagcaagcaataccagaatacccaggaatcaatcaaaccaaggtgaaaactacaaatcctgaaagaaaactaagtagatgaggaaagccaacatgttcatggatccagacttactattaaagtaacaaataatagtctccaaacattcaatgtaatccctataataattccagtggtcattgcagaaatggagaagctaatcctcatatatatgaagctacaaaaggccccaaatagccaaaacaatcttgatcacattagaagtctcacaaaacctacaaaattgtaataaacactgcatctggcataaagatagacaatggatagatgagagtacagaaataaacccttacataaatggtcaattgattttctgcagtggtaccaaaaccatctattgggaaaagagtagtcttttcagatggtgctgggacaactggataaccacatgtaaaagaatgaagttggaactctacctcatatgccttcatttatcactcattaactcaaaattggtaaacaatctgtaagagctagatctagaagaaaatgagtaagtcctcatcaccttggatttggcaatgg

SEQ ID NO: 99707 - DNA, 1211 bp, Homo sapiens
ttagccaactgtatttaaggaaaatatttccatgacagcatttgaaatcatgagtcatatttgaaaatgcagttgccttctctcacttggattggacatgcttacattcaggtctagaagatgggagttgggcattcaagcttgatctttcccgacatgtggttttggatgggaagtctggtgctgagagttgtagcattaagggatttggtgtctgttatttcccactgtccttccccaagttggggaggagagtgggaagctgcattgtactgtactcttctaactctttcttcttatgtcctcttaggtgatgaccccacaaggaagaggtactgttgcagccgctgcagctgctgccacagccagtattgccggggctccaacccagtacccacctggccgtgggggtcctcccccacctatgggccgaggagcaccccctccaggtgaggagcccataaggagaccagtgctaattgatagaagatgccttagctggattaatgatgagatataaccttgactgaagctgatgatgagtttgtataattaagcaggattactctgagatccagcgtggctgactgatgagactaggtggacaagagccattgggagccctgggtgttaggctcaaatgtcagttttctgggagctgctgagagggtggaatggtccatctatctcagaacttggtggaaagctttgtagtttttttgctaccttttcaagatagacacttgagctatattcttggggcttttctcttgcaggcatgatgggcccacctcctggtatgagacctcctatgggtcccccaatggggatcccccctggaagagggactccaatgggcatgccccctccgggaatgcggcctcctccccctgggatgcgaggtaagtgcctgcagtggtgactttggcttctttccctagagcctagtgggataggaaatggagggaagattgcatttagatcatatcccatgggctttcaagccttaaatctagggaaatccagaaaggaaagagaagagggaacatttcttaaattgggcttacctcccctcttagaaaagttagagcagccatgcacccagggtgtttctcaatatctaaggcagcggcctcaggacacaatgaaataatgcattctgaggatccctaacagaagttatgagattgtcttatgctctttggtttgac

SEQ ID NO: 99708 - DNA, 2420 bp, Homo sapiens
gcagctcttttgtcatatgcagtgtccatattattctgtcactcactttgaattccctttgattctccttggggctgatttcttctgtgacccaaggtcaagaagtatagtttaaaaatgtggtagggatgccttggtgccaggtacgtattagagaggggccaacagatgagcgtggagctactccaaagttccctcctgattataaaaaatgtttattggaaaatatttttgaaaatacaaagaagtctatgaatagaaactaaaataccccgaagggtttttttctaattatgaaaggacaatacatggttattattttaaaaaataagaaaatgtgagccaaaaaagggaaaaactgtccatccacagacaaccagttaatatactgtaaaatatcaaaacaaaatcttttgagttctttttttaaatcaggctattttttcccctttatttttaggatctagctttagcttttttccccactttcctatcctgttgcagttatttttcctacttcacatttatattttgttcatctttttctggttgttgctttttgggggtttctgtttttatgcttttgaggaacagatatgaaatttcaatttctgtgtatgtgaaatttctcttaaccttttccttctatggcttctcctatttctgatgtaagatgaggggcagaattataggcctgtgaggttgaattgatattagaaggacactgcacgtaagtgaggtgggtgggagtcatttgattggaattgtttaggcagcctcctgatgttggcaagaccttaagctgaagggagggaatagggtcctaagaaagaagacttggctgagggaagggccttcacggttgctgtggaatagcatttgggcccgggctgggctttgttgaccttgtcctatctcttggtcagtgtgtcctcttggcatggtaggaaacaggtagatagccacctaagaggttatgtgttcagcctgtagagactatccaggagggctatcttgggaaagtttgtgtactgtttgttaggagatgcagtataagcaaatcttggaggccactaggcaggtgaactttacccacctctaacactttttttgttccttctaaacctctctttaggccaaagaactccaaacaagcagaaagggaagagaagcgagtcctcggtctggtgctgctgcgaggggagaatctggtctcaatgacagtagagggacctcctcccaaagatgtaagtcagagcaggaagccttgtggaggaggggaggccctactgtgagccaggctctgtgttagattctgtttcattgcagttctcacaggcatcctctggattttgccccctttttcagataataaatgaaatcttaaagaggttaccctgcaagaggccgggcgcggtggctcacatctgtaatcccagctctcagggaggcaagaggcgggaggatagcttgagcccaggagttcgagacctgcctgggcaatatagcgagaccccattctccagaaaaaggaagaaaaaaaaaaagacaaaaaaaaaaaaaagaggttaccctgcaagaaagaagtggaaaaggggaactagaatttgggtatctcagactttaaagctctacctgtttctcagttgatgtacatagtgagtcagtggaggaagcacctgaagccatctgggtcagttcttaatgtgacgacaaagcctaggtagaccttaaaaagttgtaactccgaaacaataggaaatgtgtgtattttgttttgtacagttacagttcatagttactgagaatctaccttgcgccaaccacttcagtattttatttgatcctttaggtctctttagagataaattctcatcttataaatagaataaaccagggcttagtaacttgcccaaggtgccacagccactaagtggtgaaactgacatttgatctcagacagtcttgattctgtaaacaccaagctacacatagaaatagagcaggctttagagacctagtcaaatttgttttccctttccctttttcatttgaagggttttttttttttttttttttagatttttagatggagtctcgctctgtcgccaggctggagtgcagtggcacgatcttggcttattgcaacctctgcctcccgggttcaagtgattctcctgcctcagcctcccgagtagcggggattacagatgtgagccaccacgccctgccaagacgttattttaatcaaaagagaataatccttttaactttttaaaaatccacatatattatctggatttttttgtacttaacacatagtgggcatatattatgttgttctgtgttttcacttaatgttaacatttttctagttgctcaacacttttaaagtcaagttaatgactgagattttctca

SEQ ID NO: 99709 - DNA, 1491 bp, Homo sapiens
tgatctgcatatttgcaggttcagaactttgttgtctgagctcacagagatgaacagatgtccatagaaggcacttggtgggttaggacttgggtatagcagtcagactgatgggaggatgatatacagatcaaatgccaggtgatttgtttatagagagaaatacaactgcttagggtacctgacagttcacaaagtgatacctatatagtcacttctttattttagcacattggaacccaggttatgaaagcagaaatgtttgttgggttaaagaccattatatgtccaaactggttagcaccctaaccatcagaagtttccctctgccaaatatagtcttggaggcacactaacaaattcttgatatgtggatttcatttttcaccttgaagctgatctccttcctgataacaagcttcttgttgattagatttttagtttcagccctattctagctcttcctttactcagtgtttttaatgagatttgaatgttccatagcacttgagtcacatatctataatctgcacactggtagatggctctagtatgtatgcattggattattttggggacaccctatactctcatccctgcaactgacacgacaaggagaaaggcaattataatatgagaaagaccgatttcaagggaagagagaatagcagattactgggtagaggtcagggctaaaacagggtggcatgggagaattcctaggaaaaggctgtgggtgggagactgagctaagaatctgttgagaaagttggacacatggacaagaacgccatgggaagttttggggagggccagaggtgcttgggtccaaaagagcagagtctcatccctgtccatttctccttgcagacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagtgaggagtggactgtggggggcggagactggaggatgggaatggattgagtgggtgggccaagcaatagaggtggtgatgtagctagttggttcttctctgtttattctccagttttagagggcagacttaaatggggacattgaacgctaagaaatctttttgagtccagcaaaccttgctctctagtctagcaaagtacaagttgtgaagggctgctaggctttttgtttctctcactttgcgtgcccctgggtactggggtaaagggctctcatgttctccccacaggtgtgtgaggggggagagcttgagtttctggcctcattgcctatttgtaaagctgtagcctaaagggctctcccaatgcagcctggtctgaaactgctttaagaagcctctgaccctcttcagggtaagtgctcagctccccatgtgggtttggggccagtgatttttgttggcattt

SEQ ID NO: 99710 - DNA, 1028 bp, Homo sapiens
tttaagcttaaaccttgaaagaggtgagggcagcagccttctggtataccttggggactaccattccaggcagaggcgaaagcaaatgcagaggggctgaaaaaggagcacgtccagccagtggagggaaaagcaagaatagtgactgtagaggagagagccggggagggtgatgggaaatgaggaccgagaggttaatgggaaaggcggggtgaagagaaatgagtgtgacacagagcagctctcagtacggatttaagctaggaaggtgtccaaacaggaacttaaggctctccttacgtcaaagccggatgttaacgcccagtccccaggccccgcctctgctcggcagaagctccgctccggggccggaactccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatggtaaggagggcacaggctggcggcgcgggagcttccgagtctgttgtggagtgggaaccgcgactgatcggggaggaagccgtgggttggagccacttagggcggtgaaggcctgggccgaggccgctcggtctgggcgggaaagaccaggaccttggcggttcggctaggcatggggtcgaggaaaaggttggaaccggtgtcggaggccgaggtcgctcggcaggggcgagggtagaaccgcggctctcgacaccgctgtagccataattcctgggacccagtaggcactaagttaacttttgccgaataaatatatgtcccgggcttcggagcaggcactggagccgcagggggacccggtaaaaggctcagacttgcggaagtttgtgagtctgagaaagagttggcggaagtgggtggaaggggctcgtggaccacgctagagtctcgctaggtctgctggatggagaggagggcggaggagggt

SEQ ID NO: 99711 - DNA, 6629 bp, Homo sapiens
actattaccccgaaagggccttcccaagtcgtttcgccgcctgcagtgcccgaccgggggccgcgcgtccccggcaaccacgcccgcccgcgcagctgcagaggccggaaaaggcccgctcgcccgcgctcggcaccacccagcccgcgctccgggcgataccaccctgggcggcccctccaaaggccggagatggtgtcgtccccggcctccgattggtcgggggggcgggggcgtggcctctggagcctggttccgcgcgccggagcgcgctagccgcattgcgagccgaacccgggagctggcgccatggtgaggagtggttgcggggcgcgggcgacgcgacggtgggggtttcggcctgcgttcgggccgcagacagggcctgggcctgggcctgggcctgcgcctgcgcctgcgcctgccctgggaacgggttccggcagacgctgaggttgcgttgacgctcgcgccccggctcccgttccaggtgctgttgcacgtgctgtttgagcacgcggtcggctacgcgctgctggcgctgaaggaagtggaggagatcagtctgctgcagccgcaggtgggtgagatccgtgggctcctttggcggccccgcagaccctcatcgcgcgggtcccagcatgcacagcgcgctcccacgtggccggccgagcggttcggggcggggggacgggcctggaaagctctagatccgggggtctttaccttgacccatgggtagaatcgctctagcaattagaaataagcctcccggacgccgcccccgaacgattaaagcagaagctgggatgtggggcccaggtatcagcatattttaagagcttccaaggctgagaaccgctgcttgactgcgccgcagaggcaggagggagggaaggaaaccacttagcctctttctccccccaggtggaggagtctgtgctcaacctgggcaaattccacagcatcgttcgtctggtggccttttgtccctttgcctcatcccaggttgccttggaaaatgccaacgccgtgtctgaaggtaagtcggccaccgccaagtgtcacagagagatgtggttcctttcggtatcctctcgggcagcttgtgatagtatttgccgtccttggctggctctgagtctgataggcgtgaggcagtatttgagccatacaatgtgtaatttgaaataattgtcttcacagagctcaaggtctgggaactgtgctagaccaaactgtttaagcagacgatgtggaatgtgtgttaacgtttccttgtgggcactgtagtgacaaactattttttatttttattttttttgagatggagtctgtcccccaggctggagtgcagtggcaagatctgggctcactgcaacctctgcctccctggttcaggcgattctcctgcctcagcctcccgagtaactgggattacaggcctgtgccagccaccacacccggctaattttgtatttttggtagagacggggtttcaccatgttggccaggctagtctccatctcctgacctcgtgatccgcccgcctcgacctcccaaggtgctgaggttgcaggcgcgagcgacggtgcccggccgacaaaggggggtttcttaaagggggtcggcttaacacctacttgtgcctgaggttttgcctaaacacaatcaagtgtctggttctctgctttctgttcgattggaaagggcagttgggtaaacacaggctgagaaaaaaaggtttggttccagaaggcaaattctacgaaatactcgagggtgtgttacaagctattatttattgcccacttgtgctatcagacctgaatgcagttgttcccatggctgggccaggctttgcagtgatgacttgcgaatcaaatctgtcaatcccctgagtgcaatcactgatgtctccatgtctctgagcaatgcctgatggggagggatctaggtatgccatcccagcgtgctcggtgggaccagggtagtcagctgagggatgttagagttgatcgtccttcagcctgttagtgggaactgtgttctttcccctgaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgaggtgagaccatcatctgttatattcctgttatcctggacattttgggggaggaggttctggaaacttggttgcttgttgtgatttctgggaaggccttcaggctgggctggtgcccgtgggtgcgggagctagctcagagccccttgttgctcaccgtcttgccctcttcttaggagttcgtctgcacttccacaatctggtgaagggtctgaccgatctgtcagcttgtaaagcacagctggggctgggacacagctattcccgtgccaaagttaagtttaatgtgaaccgggtggacaatatgatcatccagtccattagcctcctggaccagctggataaggacatcaataccttctctatgcgtgtcaggtaaagtgcaggggccacccataatactggagcctttggtctgtagttcagttaattttgagtcttgatgaggactgaccatcctgtgggtagaaccatgtgggctggggctgggtgtaggcctcctggtgcttaccacaggctgtgttcttacactgactgtatagaaagaggaggtagagtaaacctaccccatatacacctcagctcaggccctgtgcctggtctgtattgtgaatgggggaacatagaattgaggaagatttggatctttgtcccatttcctccaggcagagtaggtgtggagaaggcaaggctgtagctctatggtttttgatgaagcagctgggccagggagtgactgtggctctttgcagggagtggtacgggtatcactttccggagctggtgaagatcatcaacgacaatgccacatactgccgtcttgcccagtttattggaaaccgaagggaactgaatgaggacaagctggagaagctggaggagctgacaatggatggggccaaggctaaggctattctggatgcctcacggtcctccatgggtcagtgcagagcctggcaacctgcataaggtatggggctctaaatagctggcctcttgcattcacacttggtttttcctaggcatggacatatctgccattgacttgataaacatcgagagcttctccagtcgtgtggtgtctttatctgaataccgccagagcctacacacttacctgcgctccaagatgagccaagtagcccccagcctgtcagccctaattggggaagcggtgcgtcacaggggactcaaaaatgggagaataaggactgttgccatgtgcacctgcactgctgtatttcgtgacccaccatgtcttccctagttgtgcttgatggggaggtggggagcagggctgtcgtgcaactgggcaggtcagcagttcatttctctgactgcttccttgactctctctccaggtaggtgcacgtctcatcgcacatgctggcagcctcaccaacctggccaagtatccagcatccacagtgcagatccttggggctgaaaaggccctgttcaggtaccagtgagggcacctgcccacaatcaggtgccacttctggtgcccactgcttgttgggggatcacggtgatggctgaccagggctccctgacctatacaggcctctgctatgggggtgatggccagtcctggtgtctgagtgattcccagggcccagcaaagggaccaagtttccaggtcagcgacattggatgccttccctctgcctctgggagctatgggttggcatgcattggggtagagatccaatctggcctgaggctcactcaggacttcggggtgagaggaggggaggagctgagctgccttggctaatggggttgaaatttctgatcttaaactctccactgaatattctctcagagccctgaagacaaggggtaacactccaaaatatggactcattttccactccaccttcattggccgagcagctgccaagaacaaaggccgcatctcccgatacctggcaaacaaatgcagtattgcctcacgaatcgattgcttctctggtatgggtgggggggcgttggcaggtgtgagaaggggctgggtggctgggtggggaggcttgcaaccatagcttccacaatgatggcaatatttttcgtcaacagcagttcacctagtgagtgttgagactctgggtctgagtgaagctgagggtagagggaacacagggttggggtagtttctctctttgggctgacaggctttgtcacccacacacatccagaggtgcccacgagtgtattcggggagaagcttcgagaacaagttgaagagcgactgtccttctatgagactggagagataccacgaaagaatctggatgtcatgaaggaagcaatggttcaggtcagttgggctttgctgggtgtggagtggcatagctagctgttggaggtgatgaactgtctgagcctgaccttgtagaatggaggcaaaaaaactgatttaatgagcctgatccaataaagccagaaaggagtcctcagagcaccagaagtcttcaggcccttttagcacttttctttgaccaggcagaggaagcggctgctgagattactaggaagctggagaaacaggagaagaaacgcttaaagaaggaaaagaaacggctggctgcacttgccctcgcgtcttcagaaaacagcagtagtactccagaggagtgtgaggtcagtaggcagcacggccctggcagagatcctaggttgtaggattttcaacagcagaacaaaggatatgctgcatcaagctgtggtcttgagtccaggcttttggactgaaacaaggacctgaaacatctaaaactacctcttgattctataggaaggagataggtgctgaacttgctcaagagcccagagagctggttgtagctcacacccgttccctgggcatgtgtgttctgtcctcggctgcctcccaggagtcctcaacctggggtagtgtaaattcctgctctgcttattatcagacgtgtgtccggaggtggtcgtgtttcacagtggggatgggggcagggaggtccccaatgtgctaagctacaatcattctccctgagattttcatttagcacccagtttcttaaacagtgtttcagggccctgtctggaacttggcatgatggttctgttgcgaccagcatggtgggtgttttttaggtttttttttttaatgggctgaggtaatttctcatgacatgttttccttctaatttgggacagcctttggggtggatttctaaagttatacccacacaattaaactatcccagaaacactgggcaatgttaacgacacgcgttcccctgccttggctacttaattgctgaagatgtaatgagcactgttctcacagcctgttcccctgtccttccctttaggagatgagtgaaaaacccaaaaagaagaaaaagcaaaagccccaggaggttcctcaggagaatggaatggaagacccatctatctctttctccaaacccaagaaaaagaaatctttttccaaggaggagttgatgagtagcgatcttgaagagaccgctggcagcaccagtattcccaagaggaagaagtctacacccaaggaggaaacagttaatgaccctgaggaggcaggccacagaagtggctccaagaaaaagaggaaattctccaaagaggagccggtcagcagtgggcctgaagaggcggttggcaagagcagctccaagaagaagaaaaagttccataaagcatcccaggaagattagaatgcaaatggacattctctgggaggtggggcataccatagcccaaggtgacatttcccaccctgtgccgtgttccccaataaaaacaaattcacaagagttggttcatgttctttattgaacaccttacatgggtatggacagggcctatgggtggggcaaggcagcaatgacagcctcagtgaagtcatggcaagtagcatagccacccatgtcagaggttcgaacctgtgggggagaatcatcatcatccatgtggcctgggctccatcctaacaatccccatcaccacccaacagtctgtcccctaaggaagccggcccaaggacaacctaggctctacccagcaaggtgaccatggtccactgcttagaggcacaaggtctcttccctggtacactgcactgaagggtatggggagtgtggtccttgcaaggttggaagaaataaagggctctagctccctttagtctgcaggtgaccgatgacagacttgatgaagtcggttgtggtgctgtagccgcccatgtctcgagtccgcacctacagccaccaccggcaacagccgtggggagggagaaaagagagcccatgaagggaggtagggcaatgtgattgaggaaatggaagccaagaatgcgtgacagccagaaaaaaggcaatgcacaggaatggaaggaggagcc

SEQ ID NO: 99712 - DNA, 1881 bp, Homo sapiens
tctgacctcaagtccgccattcctctcccatcccaatatctccacttcctaagtgatcttggcctgttcttcccccacgctgcccaccatgcctcttttcagtgaccctggcctgagctccccctcccataatgtccttttccaacctaagcctctgcatacccctcctgcctcctcccagtgtctagcctgcccctctctccacagggtgcccggcacccatttgcccaggcagtgggcaggaatatagccaatcccacggccatgctgctgtcggcttccaacatgctgcggcatcttaagtaggtcatgggaggctgtcggcagaggttgggtgtcgtgaggaggagcaggtggggaaattagcgggaggtgtcttgggggagtcacagtttcttcctgtccatatccacagtcttgagtatcactccagcatgatcgcagatgcggtgaagaaggtgatcaaagttggcaaggtgagttgagaagagtagtgctggcttcaggatttagagtagttctggtgtcagcacctcggcactaccctctggggaacctgaatgggggtctcctttccccccaggtccccagaacatctgctccctgacatccctgcatccctctcagggctgttcttcatctcccttctcttggctgtttcatcctcttgatctcttttgcctcttagatcccatctgctgttccctctttcctgctccatccactgcccttttcatgggccatctgaatgcagaacttgcagctctccttgggggtggaacagcaagggatacaggcaggctgaagcatcagcttcaccttcacgccccatctccttttcgctgtgattctttccttccacctggtcttgtctctatttcttccaaggaaggtagccacatcctgcctctgatctgcgtttcccatcatctttgcctgctcagcctcctgtcctgccctggctgcagcacagctaatagtggcttaagaggagtggcaggtccatgtgcttcccatcctggctcctccttccattcctgtgcattgccttttttctggctgtcacgcattcttggcttccatttcctcaatcacattgccctacctcccttcatgggctctcttttctccctccccacggctgttgccggtggtggctgtaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaaccaactcttgtgaatttgtttttattggggaacacggcacagggtgggaaatgtcaccttgggctatggtatgccccacctcccagagaatgtccatttgcattctaatcttcctgggatgctttatggaactttttcttcttcttggagctgctcttgccaaccgcctcttcaggcccactgctgaccggctcctctttggagaatttcctctttttcttggagccacttctgtggcctgcctcctcagggtcattaactgtttcctccttgggtgta

SEQ ID NO: 99713 - DNA, 1054 bp, Homo sapiens
ctcagacctctccatgccccagggttcccggcggagaccagcgcctgcaacagggacacacaagcctgtaaggtcagctttgagacatccagaccccgaacactacagttgactttgccctgtttaggaaaccctaggacaaactctccgctccttcgcccgcccctgcccgacatgtcccggggcctcactcgggtcagccagcggactccgctcaatgccgccatgtttcccgcaggaagtcgcgtgggaagtgacgcctgaagctggcgcggccccgtaccccgacttccggcctgtactgagttcctggtatttctctctctgcgccaaccagcactgcttgctcacgcctgtttctccttttccttgccggtggggaggtcatgggatgcgcaagcactttgtctcttgctttgttttcagtcgccatatttaatctacgtcgaaacttcaaaataacattagggggaaaaatgtagcgtcatgtttatcagacgaggacctgagcttaacaagcgattgagagaaaatccttgggaagctgttaaaatttgtgtgtcaatgcgtttgttattcttttaaccagtactcactgaatacctgtatgtcaggctctcgaggaatacagtacagacatgggaggtgtgtgtcgggtttctccgccagtctccgagagtgcccaggacctctgtattacccgtcgcctcgtagttttttcttacagggttttgttctttgctctgacagttatttccctaatagtgtgtcccggacttgaactccccaggacaggcccataactagtgtcagaaatgagttcaagcgtgtaagtgtgactaaagggaatttcagactgatccttaaagtaacaatcataaaaactaaaaaaagcctggacaacatagggagacctcgactctacaaaaaatttaaaaattagccaggcgtggtgacacacctgtagtcccagctacttaggaggctgaggtgggaggatcacttaagcccgggaggtggaagccgtagtgagccgtgatggcaccactgcact

SEQ ID NO: 99714 - DNA, 1086 bp, Homo sapiens
ccccagctatgactgagccttaactcagtgccactttcctgggctgactgattccaccttctgcgcaggttaattctgagcatctatcccccaatctatcttggggacaaccttccagaatgaaaagcactccaaccaaatcacttcaaccatcacaaaaaggaatgctgcaaagtgagggcattccggcaggaagggccagccagcatgaaggctggagctgggagacagggagctgggtttgggaaacggtgtgatctcccatgctggataagcaagaaactcacacagcaagggagtggaggtaaggctggccggcaagagaaattggatagggcatcaaagggcctagaatgttcccaaactaagggcctaaatgtttatttgagaagccacaaaagacatttaagtttctaagcaggcgatggcccaatccaagcaacactttttaaaactgtggcaggaggatgggggtgtttgggggtgagcagctggggacgggagctaagggaggaggctgtgggcagaactgggaattccatatctgctccaagccagggtggagtccagtggaggaaaagtacgttttgctgttagatattctctgtgggcactggggtagggaggaaagggaagggggacccgttaagaccaaacaaacaggtagctgcaggacagggagagaaaagtattggagatgattcccaaactccaagcctggtgggcagcaggaggaggtgcccagcacagacacaggggagtcaggaagaagagctggctggtggagagtgaacctgtggagaccaagaagccccatcccagcctagggacagagcctcttgggatagggaccctccccggaggcaggtgctcctctcctctctgagggccaagcccagccctgtcctcacccactgatgttcaggactgacagaagtgagagtcccatatggggagaccatttcctcaaagatgttctctgagactgtggaggaacgtgaattctgtgaggggagaacagaagaagagcgccaggcacagcagcttgaggtgctcagagggcagaggagaaagacagtgtgctct

SEQ ID NO: 99715 - DNA, 1051 bp, Homo sapiens
ctaatcacaaatgggtgcatgtgtgttcataccaagcgcctagggccgaggacagaggctggctcagtaaatatttgttgagtaaacaaacgaaagaactgaaacttccctgaatctcgctgccgggggtgcctggagttttccgggggacttgggctgggcctggtggagggggctgcagcgaggctctcggactgggcgctggcctgcttttggcgccctgcgtctcaccctgggagtggggggctgcgggggagacgtcctccaaacgccgcccccttccccagctctgaacgagcccaccattgactacggattccagaggctacagaaagtcattcccagacaccccggagaccccgagaggctgcccaaggtactcagaggggcggggcggggcggggctgagggtgtcctgtgggcaagggggtgaggaggggctcccgagggccccttggtcgcccccaggggctgcccctccgtcccgctgtctctccccctgtccccaggaagtgctgctgaagcgggcggccgacttggcagaagccctgtacggagtgcccggcagtaaccaggtatggcgcctccgccctcccagcgccgccgggaccggggccccccagcacgcggcgcccgcggctgccccggccgtgccccgctcttgtcttcgcaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggtgcgtgggccgcgcctccccgccgtcctcgggcgccgccaccgcccctccccggccggcaccgccccctgacggccgcgctctctctcgcaggctacgcgcgcagctgcagcagcgcgtccccccgcgggttcgcgcccagccccggctcgcagcagagcggctacggcggcggcctcggagctggcctgggcggctac

SEQ ID NO: 99716 - DNA, 1032 bp, Homo sapiens
ctggaagaggttgggttagagcacgtcctattgagtattccccaagacaataatgggtcagagcaacagagcattaggaaagaatcagtgttgaaattacgtaagtggctactgaagaatttgtcagagcctttcatgtgccagggtacgttgtgaaccttctaggaaacaggagatgcaaatttatttgagcacaaaaatgtatttttctaacagcatcttgagattagttcctggggaatgaccttgagatgcaggaagagacaccctcatggtttcctcagcctgatgtaggggctgatcaggctgggatgcctatcacaagagcaaggccagtggcttgggccccagaaccatctccaaatccaaggcaggggcaggtggggcagcctccaggctgagacaggggagggggctgtggaaaatgctctatggagcctctgtgctccagggtccctgtatgagagtccggggacgctggaaagaggatgggaaagctcagggcctgggagaacaactgaggatgatacatgtccgcagcgtcccacagaatcggctaccctgagggcagtcagagcaactaggtgcagcccagaagcttctgagaactgtgctgatgccctgccctgcacacagaatggggtcccttcccaccagggaaccccctctgcacagttcaggcaggcctgtgatggtgactcaaacaataacagacttttgtgccagggagggcgggagggcaagggggctgcttggtgacccatccagagggtagcccatattcagggaaggacttgcccaagcaaggtttgaagaaggcaggggttcttagtgggggaggaatgccctagatagagtagaccttaggctgaaggtatgtgggtgggaaggcagagatttggagcccacgttcaaaacattaagaacataacatggccagatgcagtggctcacacgtgtaatcctagcactttggcaggccgaggtgggcagatcgcttgagatcaggagttcaagaccagtctgggcaag

SEQ ID NO: 99717 - DNA, 1048 bp, Homo sapiens
tatgagatcgcctaccaccgggtaggccacccagcatgagggccactctgtccttctgccctggtggctggacctgctcgacttgaacaagcctcttgcccggcagggttcagagctggtgggctgggccgagggccgctggaacaaccagagcatcgatcttaaccataattttgctgacctcaacacaccactgtgggaagcacaggacgatgggaaggtgccccacatcgtccccaaccatcacctgccattgcccacttactacaccctgcccaatgccaccgtgagtattttgagggcggcagtggaggtctgtggggggcggaccttgtctctgtctcctgcccctcctgacctgccccatccaggtggctcctgaaacgcgggcagtaatcaagtggatgaagcggatcccctttgtgctaagtgccaacctccacgggggtgagctcgtggtgtcctacccattcgacatgactcgcaccccgtgggctgcccgcgagctcacgcccacaccagatgatgctgtgtttcgctggctcagcactgtctatgctggcagtaatctggccatgcaggacaccagccgccgaccctgccacagccaggacttctccgtgcacggcaacatcatcaacggggctgactggcacacggtccccgggagtatgtgcctgagggtggagttagccctggccccgtaacccccgccctgataagacagcctgcggttgcgtacagtgctggcgtctgttcccactctgaagtgtccctcagagaagggagggtagcgggaggatgggaccgcatcccgcctgcttaggcagcagtgtctgtggtccccttaggcatgaatgacttcagctacctacacaccaactgctttgaggtcactgtggagctgtcctgtgacaagttccctcacgagaatgaattgccccaggagtgggagaacaacaaagacgccctcctcacctacctggagcaggtcggatctgcgtcccggcccccagcctgcctgaatcactcctgctgtccatttagg

SEQ ID NO: 99718 - DNA, 1047 bp, Homo sapiens
aacagagaacttgctgcccccaggtatttcctgccaattcagacccagaaactccagtgctgaacctcctgccggagccccaggtggcccgcttcattcgcctgctgccccagacctggctccagggaggcgcgccttgcctccgggcagagatcctggcctgcccagtctcaggtgggcagtcaggccagggttggttgggcagggcttggatgcagggtgcatccttcactgtggacacaccctttaccataaactcaacctccaccagaccccaatgacctattccttgaggcccctgcgtcgggatcctctgaccctctagactttcagcatcacaattacaaggccatgaggaaggtcagatataacccctatgacctgggaaggagggcccacccatctcaggtccccttcccaccttcccaccggggcacaacctgctgtgactgcgcttgtatgcccctgctgcctcctgatgtctcagccttctctcctgtggacccctaagctccatcccactttcccttattatggcgcccccccagtcctaccccttcctcccggctctgctgccgctcccctcctgtaccatgatgggatgccccctctgtgtgggccatcgctgactttttaagtctttccatggcacatgtgatctgcccctgggtgtacccctcccatgcctcatgccacgctacactctgcccaccagctgatgaagcaggtacaagagcaatgccccaacatcacccgcatctacagcattgggaagagctaccagggcctgaagctgtatgtgatggaaatgtcggacaagcctggggagcatgagctgggtactggcatggggagtggggagaggtaggcacagggcagggccccaggcatgaacccgctgcaagcccccatgtgtccccaggggagcctgaggtgcgctacgtggctggcatgcatgggaacgaggccctggggcgggagttgcttctgctcctgatgcagttcctgtgccatgagttcctgcgagggaacccacgggtgacccgg

SEQ ID NO: 99719 - DNA, 1922 bp, Homo sapiens
tgctgccgtcacctcctccctttagcattgagcagccccggaggggctagccctgaggctgacctgcccagagtccccaccatcgcgctgcttagtggcctctccctgcagcctgtcgttgctggtggcggcatggtcttctgtctgtcgagcgaggagccgcgccgcccgctgcgaagcgacatggtccacttccaggcctcggaagtccagcagctgctacacaacaagttcgtggtcatcttgggggactccagtgagtgcctcttctagggtgacgcttccagtcccacaccttgcagcccgttcagtgtgtctggaccatttgtttccatctcacatctcttgtctgtcttctggtctgttccgtccagtaggttttctctttttatgtcccacacatcttccacaggagtcctgacaggtgtaataacctgtgcactttttagcccatccttgctcagcatttctcgccctgacagctccccataatttccatcacgaaagcgttgcattgtgtagtgtgtctcctgggtgacttggccgacttaatttctgccaggtgatcttgggtcactgtatactgctggccaggaggcacacagaacagaggcaatgccaggactttttaacctcatcttttctcctgcgtctaagtcaaccacagagctggtgtcgggcacctcagccctgggaaaatggggtcctggacttggaaggagctggggcaggctgaggtctgcctcagccttgggatctctgtctcctcccagttcagagggctgtgtacaaggacctggtgctcttgctccagaaagactcactgctcacagctgcccagctgaaagccaaggtgagggaagcttggtggccatgtcagtggtgggtgggcacagaccctggcctggcagggttctcctccctggcatgggtctgaccagtagggtggggggggtgggtagggggagctgagctttgaacaggaccagctggtggctgggggccagctgggcgagctgcacaacgggacacagtatcgtgaggtccgccagttctgctcgggctctggccaccaccttgtgcgcttctacttcctcactcgtgtttactccgagtaccttgaggatgttctggaagagctgacatatggacctgccccggacctggtgatcatcaactcctgcctctgggatctctccaggttggggcgagggaaaggggaatactggttggggctggaagtacggctgaggcagtccacccttgtgctcttgcccaccctgtgtgttatccaacagatatggtcgctgctcaatggagagctaccgggagaacctggagcgggtgtttgtgcgcatggaccaagtattgccagactcctgcctgctggtgtggaacatggcgatgcccctcggggaacgtatcactgggggtttcctcctgccagaggcaagtgactgaggcccatcaggacaagagatgggatagcagactggtagataggacaccctgctttcagaccctgctgcgttctgtggctcttagaggctgcactttctcacttagctccagcccctggcaggctccctgcggcgggatgtggttgaagggaacttctacagtgctacgctggccggggaccactgctttgatgtcctagacctccactttcacttccggcatgcagtacagcaccgtcatcgggatggtgtccactgggaccagcatgcacaccgccacctctcacacctgcttctgacccatgtggctgacgcctggggcgtggagctgcccaagcgtggctatccccctggtgagccctaccataagtgggggggtagtgatgcactggggccctcagaggacagggctcagaaacagaatgggacacagccactcaagggaagtagaggtcccttgaa

SEQ ID NO: 99720 - DNA, 1689 bp, Homo sapiens
atgaaaccccgtctctactagaaatacaaaaatttgccgggcgtggtggcacacacctataatcccagctactcgggaagctgaggcaggagaattgcttgaacctgggaggcggaggttgcggtgagccaagatcgcaccactgtactccagcctgggcaacagagcaagactccatcttggggaaaaaaaaaaaagaaaagaaatatgcctgtgcagtatgaaaaaattgcaaaaacttcattaaaaatccataaatgcagtaggaaatgatttcaacttgtttctgtggagaaggaatttcagctgaccaaggtagccatgtcatttagtatttacacaccagctagttgatacaacattcacttttaaaatatcaactttacttgtattattttgaagatacctgttgcctacccaggcttattaaatcaaagagtactgcagacattgacctcattaccacagagctcttatttgtcagatgtagtctttgctttgttgacatgttaataaggttttaaaagaatgtatgtgttgggtgcatgccacagacacaatctgaatgattaatctactcttacctgtgctgtactgccagaaaggattaggggtctaaggcttgctggggaggatatttatgttttaagttgctaacagctattgagcctttcttatgtactaaacatgctaagtactttatgtgttttaacttgcttaagccttacaatcccatgaggtaggtaccatcttactgatgaggaagccgaggcacagagaggccaggttatacaactagtgaccaggttacacagctattgagtagtggagtcaggctttgaacccaaacaggttctagacctctgttaaaaaatagggttttgggggcgggcaggttaacaggaaaatataagagcatgtttcaccttttccaccagaatggaaatgctttaagagcaagtacttagttttgttcatatgtgtgcatagctttatgcataggcaggacttgatacatgtctgagtcagtgaatgaatgataaaacaggtggcagacattacatttcaagtcctatctgcctgacaggattcttttgtattgggagtagtattctggagaacccactcaatttgggaaggcaaggaggagaaacggtgaccagttcttatgggactccagaagttaagctatttttttaatcctaaaaatgcaacttgggctaatctaattaattaatttgtcccatccctttggcaggctgagccagtatgataaaacagatgtggaagagttctgcctgccatcatagagcttacagccagcaggcgagacagttgataatcactcagtatttgtttgatcataatcactataaagagaggtatagtagcaaataacctaagagaacatgttacagactccaggagtcaaaggtagagaagacactctgaaagaagtaataataccctatccaggggatgagtagatgtaggtgcatgaagtgggatggaggtggagaagagcatatacacaaaagtcttgaggcaggaaggactgaggcatgcacagtgacctaaagagagccagtgtggctggagtgctgtaggcaacaagaacaggacatggatgaagttgatgcccttcgtgtaggggtcacacgctgcagggacgtgtagatcaccgttatc

SEQ ID NO: 99721 - DNA, 1045 bp, Homo sapiens
actatttaagtagttatatttttgtttcattttgtttttttgatacataaacatgaacttttttttcaaaaaagtcagctgtgtgtagtggcacgcacatgtaatcccagcaacttgggaggctgaaaaaaaaaaagaacattttaaaaaattgtggttaaatatacatgatataaaatttactctcttaaccatttttgagtgtaccctttaatagtgttaagtatattcacgttgttgtgcaaccagtctccaggactttttcatcttgcaaaactgaaattctgtaccctcaaacaactccccatttcctcctccccccagcccatggcaaccaccattctgttttctgtctcagaatttgactaccctagactccttatgtaagtggagtcatatagcacttacttcctgtgactggcttatttcacttagcataatatcttcaagatttatccatgttatagcatgtgtcagaattttcttccttttcgaggctgaataatatgccattgtatgcatctaccacattttgcttatccatttcatctttccatggacacttgggttgctggtagcccttggctattgtgaataatctgctgtgaatgtgggtctacaaatatctattcaatattttctgtactccgcttttttttttttttttttttttgagatggagtctcgctctgtcgcccaggctggagtgcagtggcgcgatctcagctcactgcaacatctgcctcccgggttcaagtgattctcctgcctcagcctcctaagtagctgggattacaggcacccaccactgtgcctggctaatttttgtatttttagtagaaatggggtttcaccatgttggccaggctgctttcgaactcctgacctcaggtgatctgcctgcctcggcctcccaaagtgctgggattacaggcataagccattgcacccggcctctgtactccgcttttaattattttgggtatatatccagaagtggaattgctagatcatatggtaattctatgtttacttttttccatag

SEQ ID NO: 99722 - DNA, 1377 bp, Homo sapiens
gcacatgcagttggaaaaatgacgctgatagatttgcttgactcagtgttgccacaaaccttcaatttgtaaaaagtacagtaaagcaaagtgcaacaaaatgatgtatgcttgtagtataaaagtggacagctccgcaggtgtctaccccatctaccaccctccccaaaggtaatcactgtgtctggtttagtatggaagtctcttgagcatttttctgtatattaacacagaagtaaaataatgaaatagcatttattgtggttcttcctatatggcccatagtctcgtttcaagtatcaatttccaccaatttgaaatgctagctttattatttgctcaattctgagatcttttcctagacgccatcctcttccattgatctatttgcacattcctgtgccaaaataatagttttaattaattttatatagtgtgtgtatctggtatacatctgttctcatattttcaaaatgttcttaaatattttgtggtatttcctctttcagatgatctttttcccctatatgaacttttttttctttttctttttctttttttttttttttgagacagagtctccctcagtcgcccaagctggagtgcagtggcacaattttggctcactgcaacccctgcctcccaggttcaagcaattctcatgcctcagcctcctgactagctgggatttcaggcatgcgccaccatgcccagctaattttgtatttttagtagagatggggtttcaccatgttggccatgctggtctcgaactcctgacctcaggtgatcttcccaccttggcctccgaaagtgctgggattataggcgtgagccactgcgcccagccccccatttgaacttcagaatcagtttgtgcattacccttccactggccagataattggcagaaggtgtttattggaattcctgtacatttatagatcattttggatattgctccatgttttctatatccttggaaaatatttaattttgtaaaattttcattagatgtatcatttgatatcttacagttttatcgccataattattaggatctcttaaaagttgtatttctttcttttttttttttttgagacggagtctcactctgtcgcccaggcagctggagtgcagtggcacaatcttggctcactgcaacctctgcctcctgggttcaagtgattctcctgccttagccttctgagtagctgggattacaggcacccacaaccacacctggctaatttttgcatttttattttaattttatttatttgtttatttatttatttgttgagatagagttttgctcttgctccccaggctggagtgcagtggcatgatcctggctcactgtaacttctgcctcct

SEQ ID NO: 99723 - DNA, 2295 bp, Homo sapiens
tctgagagaccttttctgagagtctcatttcctgctaaagctggcctgagccagccacttcactttagttctatctcagtttgtgccttggatgttggccacgcagcctgcctggctcaagagctcctgccatccttggacacttgccccaagaaccacatccttccctgccaacaccctctgctcccttgcctgctgtccctagacatgcatgtggtcagttcacccaactttctggtcatcaccctcctccctccctctgggggtagagagtggagacttcctctacagccttgtggaagacaaatggaggctttaggaattcctctggggttcactccatacggatgcagggtaatgaggctaatttctgctcatctctgtgtgggcaggaaatatgagctgtacagcatggactgggacctgaaggaggaactcagggattgcctggtggctgctgcaccctatgggggccccattggtatgttgcccctccaccaccacctgctctgggaccctgggatgaactcaaggtccttgattcctggggccctgctgtcaggttgttcttgttgccaccccccactcaccctgctgagatgcttttacttctggtttttataggcctgcttcacatggggtgggcctggggagccaggatgtgaggcctgcttcacatggggtgggcctagggagctaggacagaaggtctcttctcaaactgcagcactgctgaggaacccctggcggaaggagaaagctgctagtgtgaggccagtgctcgatatatactctgcttccggcatgcctctggccagcctgctggtgagcacttctgatggtccctggggctcagggctggacagggtttcctcacctgaggacagccttaggaacctctctcccctgcagtggaagagtggacccgtggtgtccctgggctggtcagctgaggaggagctgctctgtgtgcaggaagatggtgctgtactggtttatgggcttcatggtgacttccggagacacttcagcatgggcaatgtaggggtcacagagggctggggacgcggggtagagtttatgaccctgtggctcccttaacccatggccccctttcctcaggaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtaagccctgacaccgctgagatagccaagcagtacccacagatgtgcctctagcctgtgagacccataaaaacagaagctgtggctagagacccatagaaacagaaacggtgggccttggtcatcctaacactgtccttttccctggccataggtctgcaaagtgcaccctcctgctggactgtgctgtgccaggaccgagtggcacacattcttctggctgtggggcctgacctttacctcttggaccatgcagcctgctccgcagtggtaagggccctgagtgggaatgaagtggacgggctgggttaggcaatagggaggttctgaaaagtcagtatgtatctgtcccacccctaccctggctctgcctcagacgccccctggcctggccccaggagtaagcagcttcctacagatggctgtctccttcacctaccgacacctggcactcttcacagacacaggctacatctggatggggacagcatcactcaaggtatgatcctggggcaacacaggggtactgtgccttgtccagggtacaagatcttttggtgatgcgggagggcttttcgactagaatggtgactgctgggacagggccatgacattgcccacaccatttcaggagaagctatgtgagttcaactgcaacatccgggcacctccaaagcagatggtctggtaaggatgggggtgttattgctgggggtgtgggtgagacatagcttgcttcctgggacaatcagttccttgattcgtcatgtctactggccaagcctagtggagtttggatcttaccttctctgccattgcacacttgaaggaaaccattgtcctctgtgggccacagctgccttgagctgagagctcagggataagagggaagtggagaggtcagtgtacagtcagtgatgcaagtgtatacaggctgtcccgagacaaaggattatgagcagccatgtgggagacatggccatgggacagtgtctagccagtgtgtatatgctgctcacaggtgcagc

SEQ ID NO: 99724 - DNA, 1020 bp, Homo sapiens
cacggagctggccatcaaggtgtgggtgcccagccctccacagacactctgatgtggttgttcagggcccccatgccagctccttctctctgtgccttccttctcacctcacagctgctggagtatgagccacgctcaggggagcaggtaccccttctcctaaagatgaagaggagcaaactggcactaagcaaggccatcgagagcggggacactgacctgggtgagggcaaggctggggggcccctgggctaagtgggagcctggctggaattcccactccaccttactctcctgcagtgttcacggtgttgctgcacctgaagaacgagctgaaccgaggagattttttcatgacccttcggaatcagcccatggccctcagtttgtaccgacaggtgtgtgtagtgggcagggttgtggtgtagccttctgagcacttgagttggccttgctgactgattgcctgcctgtggccccagttctgtaagcatcaggagctagagacgctgaaggacctttacaatcaggatgacaatcaccaggaattgggcagcttccacatccgagccagctatgctgcagaagaggtctgagatccatggggcgtgtggggcgtgtggggcatgtgggctggggctgttggtccggttccttcaggaatctaggccttcgtgttgggtgcacactccatctggtcctcactgtgagggagactctgacgtgaggccaggatgggggttagtgtcagaggagctagccatccctctaggacatcagagtggtgcacctagcaggcaaggctgaccctggcgaccctgggcacagggatgggggagaagactgtagcctgggtgaggagggcgagggtcctgcatgctgtgagttcaggccttccttcttgtctttatagcgtattgaggggcgagtagcagctctgcagacagccgccgatgccttctacaaggccaagaatgagtttgcagccaaggtttggcccacctttttccaagagcctcc

SEQ ID NO: 99725 - DNA, 1056 bp, Homo sapiens
aagctgactgccctggcagatttggaagattgggaagagctagagaagttttccaagagcaagaaatcacccattggctacctggtgaggcagggtcctccctccagcccacttccagtgagggtagtcttcgggagagagggctaggcagggagacagataggatggcccgttcatgctcctgttcagctgcccgcatagttagcgagtgcttcctgtatacacatttgtgggcaggcatcatctgctgtgttgggtgcactggaggatgggtccaagtttgcctgcagatgttacggggagagagaatgagctgctttccccagggagggccacagggggcactatgtgctagagggaaagtcttgtctgaggagggtggagggggcacagggagggtgcatatgggaggcagtggagatactgagggctgttttctgtggtgggtagttcagaggtgtatagggcaggtttgagaatgtcaatcacaagagaacacaggaaatgtgagggctggtggcaggaacgcctgttgcaaggggtaatggtgggtggtagagcagaagcgtggaaataattggtctcaagtctctgacagagctttggtttaggtgatttctgccctaagaatgttgagatcacaactgtctgtgcatgggggttgggggattatatgtactgacgggtgtatacatatagaatatatatggacgatgtatgcattgcgcctctgctcgtaagagagaggacaggagggctgtgcattaccttctccctccacccgcttcctctcctccaagccttttgtggagatctgcatgaaacaacataacaaatacgaagccaagaagtatgcttcccgcgtgggtcccgagcagaaggtcaaggctttgcttcttgttgggtgcgtcaactgagggcctgtgggtgctgggtggctgagctgtgggctggtgagaggcagggtttgtgcccttgagcagccccaacaccacctcctctcttgctcaaaccacagcgatgtggctcaggctgcagatgtggccatcgaacacc

SEQ ID NO: 99726 - DNA, 1036 bp, Homo sapiens
ccctagagcaatgctgaggagcgggggcatggtagcagggctgtctggttttaaataaagttggaacacttcacagtgcttgtcttacacagtccagcctaagcaaaggcaagctcaagacaggatcctccagacaccacagcaaaactccatgtgttccgttgtgttgggaccggaggtgggggcttctccagccatactcgcaagaaacgtgtcctctccacagttaccaaggaaagctttctctatctcacagctcctaggaagattatagggagagatggcacaaaacttaagcaccagctcaccaagaacatactgtaaagcattctgtgtgtgtgcgtgtaaacacgcaagaaccacgctaaacacttttgctgcctgtacttcctttattcctcgtgacagccctgtgaggtaacatcaccccactttacagaaaggagattgaggaccagggagttcgataataacaaatatgtggcaaaacagggatttgaaaccccgggccaagtgcaagctggaactggaatcgggccctctgtgagaagggagcctgaggcaaggccccaatttgcactgcagtggtgattggaggactaatgagaagtgtgtggcctgcgggccataggggtcagggggtggtggcctttggaactcttgcccactgaactgtggtgagcaattccaagttgtctctgggccaaatagagaaggaggatggaagatttcaattctgccaaaaagaaccatgaacaccagacccgcaatcagtaggagtacccgcggggccctctgctctctctatctagccttccgttggcactccagtgcaccccctctgctctccctgtctagccctccgttggcactccagtgcaccccctctgctctccctgtctagccctccgttggcactccagtgcaccccctctgctctccctatctagccttcccttggcactccagtgcaccttggcttcatgcccagggccccacccaacactgagggcattgccttttcctttgtcgcccc

SEQ ID NO: 99727 - DNA, 1579 bp, Homo sapiens
cgagtgcggcgctgacagagacgcgcgcgcgcgcgatcgcgctcggaccccggccgctgccgccatcactgtcgcccgcccagtcgcccctcagccgcttcccctcgccatggaggcgaggccgccgccgccgccgcggggctcggagccgcgggccgggcggcggccctgagggctagtggcggcccgaaacgccgccgcggagccgaggcggagccgctgtcctcgtccccagcggtcccgcccaacgcccgactctgtgagtgttcgcggccgctgcgcccgggtgggctccggaagggggagcggctcccgggggcggtgggaggggtcccgggccacagcccagagcccggagcccgaagccctaagccatcttttccgggtagaagcctgcgggcgcctgcaggttgattgtgcatccttgcgggtccgtcgcggggagggggtccccggaaacgtgccggcccgagtgccgacccctcgcgactgcccaggaactttgcatgcgtccttctgggaccaggccagggcactgccagagttgattctcagagaagaaacttagaacggcgagaacagaatttgctcaggtccatttaatgggaggaaagaggaaaactcttggcatgagaaaatttgcttttgcagtgaccaacttttctttcccttcaagtccacctccctcggtcccccggcccgtctcccaggcccctctccttgccgccctctcccaactgttgaggctgtttaagaagggaaataagggctgagagctgcccagaattcagaataggccaattgagaacgcaggtcccctccctttttactttcggtaaataaaaaattttttttgaaaaaattagttactaattatatctcctgaagattaaaaaaaaaaaatagcagagcagagtcctgtcttgagggtttcgtttttatttttgagatcactgatgatatttgtaagacaggaaaagaagaatgtgcaaatccaccctctgcagggtgaacgccatcagaagcctttgctcaggagagggattccggctctagaaccagtccacatcaccctggagatggcttcgtttgccacctgctagctgtgcaggcagcctgagaaacagaagatggtgggcgagaggaggactgactaggaaagggcgaacatcttcctgcctggccactcctttcagaaacagatctgatgctgtcacttgtttacttaaaaactccctcgcttttctttttcccatgggatgaatgaagcctaaaatgccttatcaggtcatacaaagcccttgacaatcttgcctcaatttactcctttacttttagcctaatcggatcctccaattctccttcccctcatcccgcttgctggctagtattcagagctgcttgactgccccctcacatgttgggatgtttttgttttatgtgatcctctttcttccccacctttacctgccaagctccactttttcttttaaagttcttctcatttgagaagcttcttgcgggcaggagctgtgtcttgcccacctttctatctcccgtggtgggagaatcctccaag

SEQ ID NO: 99728 - DNA, 1056 bp, Homo sapiens
ccttaacctttgaggaactcagagtctaatgtaggacaggtggatataaatacatcacaggtgctataagattgtgataataataatagctattttttatttgccttgtgacaagctatgtaatgttttccatgaattccctcagtcttttcaacagtcataaaagggcttattcctactctacagggttggaaactgaggccaaacagtgggcaaatgagggaatagtcaagatttgaattttggccgtgtatttgcagagcctctgccaggctgtgtagggagcatcccctgcctgggtgatttgggaaagctttcctgggacgggggggccttcggatcatgaaggatgcataggagtttgcgcgtggtggactgcacacataggcaagagggagcagcacaagcaaacttggtggtggaaggaatccactgtccttggggaggagggaagaggttaatcatagctggatcaggtaaggacaatggagagctactagaggatttaaaggaggtcagggacttgggctgaaagaattttggaaagatcatttgggggcaatatagggccaaatgcagatgcccctgcaatataggaggcactggttgggtctgacagaggtagagtcacagcctcttagacccagaggaaggtgtagagagaatcctgctcaattttgggaaaagataattaatgcagatgagagaaaaattcaaaagttctagcaatacaaaagagtatatagagaaaaatgtccctcctaccctggccccaagtctcctgtctccctaacctcctccccagagatggctgaagttttcagtttatatggccttccatagacactgttgctttataaatatgtgcctgcttatccatactcctcccaccatgggacgtaccactcacaccttactgggtttttttacttaacatatttaggaaatcattctattatcaacatatatagagagttatttgttctttctgttgacatgcttttacttatttagttgtatggctgtactgtaacatctttgggttaaatatttgtt

SEQ ID NO: 99729 - DNA, 1093 bp, Homo sapiens
ttatttttctccattttcacatggaaaaaaatgagatgcaggggaagtttgagttatgagagggaaactggccaaatatagaatcttgtcattttacttccagtgcaataataaatgtttccaaatgacaaagctgaagagatgttttttgtttgtttgtttgtttgtttgttttttgagatggagttttgctcttgttgcccaggctggaatgcaatggcgctatcttggctcacgcaacttttgcctcctgggttcaagcgattctcctgcctcagcctcccgagtagctgggattacaggcatgtgtcactgtacctggctaattttgtatttttagtaaagacggggtttctccatgttggtaaggctggtcttgaactcctgacctcaggtgatccgctggtcttggcctcccaaagtcctgggattacaagcatgagccaccgtgcccggtgaagaaatggttttttagtgagtctgagtacaacaaaaatagcaataatataacactaacttaataaaactgaacagcaggcccaaaaatagcccaacattaaaatttattttaatgtattctctatggaaaagagaatccattaaatgtaaaactatttattttactctaaattcacatccatttgtgtcagtgtacaagacataatttttatagtagcagtcagtacatatagaatatgatttttgaattcttcaatagcataaaatattttatatttactcatttaagtatttgttcatttaaaatcacaggctgggtgcggtggctcacgcctgtaatcccagcactttgggaggctgaggcaggtggatcatgaggtcaagagatcaagaccatcctggccaacatggtgaaaccccatctctactaaaaatacaaaaattagctgggtgtggtggcgcgtgcctgtaatcccagctactcgggaggctgaggcatgagaatcacttgaacccaggaggcggaagttgcagtgagccaagatcttgccactgtactccagcctggcgacagagcgagactccgtctcaaaaaaaagaaaaaaaaaatcacagtatagtattccatgcatcg

SEQ ID NO: 99730 - DNA, 1213 bp, Homo sapiens
taaaataggtgtcttcagaaatcttggaattgaatgctcagcattgtttttcatacatacataactgctttaaataaatcaaagagattatgtgttctttcctgaaaagtaaaataaattgttgacatttacaactctatatatggtttctgaggaactaagtgaagaatcttgtgtctttctcccttaaaccgtagtcctttggaggaggtaggaaaggtccagcatgagataaaaacgtagggggtgggtggtgttgagggggattggtctttgcttggtctccatatgtttgagagtttattaaggcttgctgctttgtgtctcacagctttttagcctcacattcttcatgtgctatttccttgttttttggtgtttgtagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtactagagatgattctgtttgttcttttgctctttgagtttagtcttccttttattatcttgtttgtgttttctagccttaaaatttcttcaaataagtaaaattgctcaagtgaagtaatgaaacctgtatgtggaatttttgggttagcatgagtgaagaggaaagaagaaagattctggagaatatctttctgctaggtgggatcctggttagattgagaggacttaaatgtgtttaaaggtagagaagaaggcttaaaaagacaagagaaatagaggagctcattgacgatgcaagagactgaagatgaaaagatacagagaatgagtaataagattaggtttggaaagggagggatccgtggagaccatggaaaggagaatgggtattgatgtccatgacagttagatgtgagatacagagaatgagtaataagattaggtttggaaagggagggatccatggagaccatggaaaggaga

SEQ ID NO: 99731 - DNA, 1051 bp, Homo sapiens
tgcttgctgttcccagtgtctagaaagctcttcacccagatctttgcgtggttcacttcacgttatttagagctctgcttgtatattacttcctcagagagaccttcccagaccactgtatcactgctccccaacctgtcactttctctctccccaccctgctttttattcctcatagcacttgtccctgtctaaaattaagtattgacttgtttataaacagtgtcttccttcctccccacagaatggaagctttctatcacttgtctccttgaacacttctctgttcctagtgtctcaaacaatggcatgcaattgctggcccacagatatttgaatgaatgctgctaaaaggttgaatcagatgaggatgggaatgttcctgttggatttggcaatatgccatttgttggtgttctggctgagcagtttaaacagagcactgagggtgggagtcagggcaaatagattaaggagaacctgaaggtaaggaattagacaagacgaattagacaactgtgtttcggaaagtcagctgagaagagagacgcgaggctggtggtagctgggggagggtaaatgaggtcaagaagacaagtctttgagttgacagcagtggatgtaatccagagcacacatgacaggatggaagagacttgtcttcccttttagcaggtaggaaaatggtgaagatagttaccaagccactctgatggtgtagttcatggagtcgggtggagggtgagagtggaggcggatgagtcagtgcctggccagctgcatgagaaaacaaggctaggtattgggtgaaagggagccaggccctgtggaatgaggtgggattgccatgtcttcaaaccagatgttgccatggttggggtcctggcaaaaggtgactaagggagcagggtgtggaaagaggaaaaaagaagcaaccagcagttttgttacatggtggctgaggatctaataatgtctccttgttttattttatttttatttagctggtctcaaattcctggcctcaagcaatccttctacctcagcctcc

SEQ ID NO: 99732 - DNA, 1098 bp, Homo sapiens
gcaccgcctctgcctcctgaagtgctaggattataggcgtgacccaccatgctcggccttgtcttcttatttatgtgcacatgttggaggagggggatgtgtgtatgtgtgtgggtgtgggtatgtgtatatataatacatattttttaatatgattggtatactgtacacatttctctcttttaatagtatatattgtcagttcatctgtcaagaaactttcttttttctcaactacttagtattccacattgtagatgcatcttaatttatttaactagtcccctaatgatacttaaggtattcccaattttttgctgttatactgttggagttatattgttggagtggcatctttatacaagcgtgagtctgtgcacataggcacagatgtctcaactgtcctggttgcgtcaggttctgtgagaaataaattttgattttactgaaatattgttggtttgtttcctagatgaccactctagagtccacctgacaccggttgaaggggttccagattctgattacatcaatgcttcattcatcaacgtaaggatcgggtgctttccctgtcacttccctgcctgaccattgccactatctgttggctcctccccagctgtgtgttaggagaaatatttgtcatttcatgttttccctgacaagtctggtttttttaagtgactgaatttttttttaaggtcagtcaaatagttttaatcattttctatatttaccctgtcgtcattccctatggtttcccatgtagaaatctgtgtctaaatatgtattttgtgataagagtcagtgaatcctttattgagctgattctaattacaaacaaaagcaggccttgccctcaacagtaaaaataagggagaacaggacaagaatacctgacatgacaccagctatattatatatgtgtgtgtatgtatatatgtgtgtgtgtgtgtctgtgtgtgtgtatatatatatatatatgactatctggttagccatatatgaaccaaggcctgagggaagagctgatactaagaggaggtttttaaagatgatttagagaatgtttatagaacagtctgtatgagagatttg

SEQ ID NO: 99733 - DNA, 1068 bp, Homo sapiens
gctccttgggaagctgaggcaggagaatcacttgaacccgggagcagaaggttgccgtgagccaagatcgcaccactgcactccagcctgggtgacagagcaagactccgtctcaaaaaaaaaaagaaagtggctcctcagatttaggccacttcttatatttggccactgccttgcagccttgtagttcacattgccaccctggtgttggtgtgacatggtgtcccatccctgaagctgcctcccttgttactcaccttattgctgtctgagaaaggaaatgggtgattcacaatccttaaatcaagtggctttctcttacctagaacttctgaattgaacatacatttaaacaatgacgttgaaaagatgtataactggagcaataaagactgaaaaagaaagctgcggccagttgttagtttttccgaggctccttatctgttgagtggcaccccaggctcccttgctcttgtcccccactgcctgtgatagagaagcctcttgttaaacactgggagctacttcaccacactcacaggctattcccagaaagattttgcacctgggtaaagcatccttgagaaaataacctgttttctttcccagagtgaacccagcttcatccctggaaccaccacatatgcttttcccctggtgggttcttaacctgttaacactgaaatctacattgttagctgctgataaagcatcagaaacatggtctaatctgggagtcagtatttggatttcttttttctttctttctttttcttttttttttttttttggagatggagtcttgctctgtcaccaaggctggagtgcagtggcgcaatcttggcttggctcagtgcaacctccacctcccaggttcaagcaattctcttgccttagccaccctagtagctggaattacaggagtgcaccaccacgcccggctaatttttgtattttagtagagatggggtttcaccatgttggccccatgctctcacactcttgaccttagatgatccgcccaccttggcctctcaaagttctgggattacaggtgtgagctaccac

SEQ ID NO: 99734 - DNA, 1024 bp, Homo sapiens
ttgctcttggaagctatccaaagctcaggcaacagaaaaagctctaggcctctcatggcaggtttacagtctgcatcagtctaccctggtggccccctcatagcagactgctggttcgaggggttcaaacaggctttctcctagagcatgacctgaaatgttgtgaaagtgcagattttgtaggtaagatggcttcagattcgccctgaaccaagggagtgtgggtgggaaacattgagaagtatggggctagggctgtgtgtaagttaggagactgtgctcaataggatggcggctaaggaacttgagaaaagggcaaatttgaataagtaagtgtgcaactgactgagatagagaagaggtcaaagggccttctgggggactttaatctgggctttgtgggctcttccttccaggccctttgcatctgccatgggcaggaggtctaaggtcagggaatgtatgtctttttctttccagtgcaagtgcgcccagtactggccagaccaaggctgctggacctatgggaatattcgggtgtctgtagaggatgtgactgtcctggtggactacacagtacggaagttctgcatccagcaggtagtgtctcctctgtcctttctcagttcttatgttggatctgctgaccagtaagagggaacaggctggatcatcccgctgtggtcaggagttgctgagtatgcagtatgtgaattctgaaaccagatatccgggctcaggggaacttgtctgtcaaagctaaaggagcagtattttcatgactggtgaaaaattacctgttgagatgaagtctgatcatttagatatgaccaagcactgtggaaagggagcatggggaggcagtgcagtctcctaggtgcttgactcacctttctcctcctttcctactccaaagactcctgacatcaaggatgtgatgggcctgcccctggccctccaggcaaccctggagacctgagcaaaggtcaccttcagccaaggggcagtgtggtactgcgaaaag

SEQ ID NO: 99735 - DNA, 1262 bp, Homo sapiens
gtcaacaaatagtgaattgatactcacccacccactcaccctgtgcattaggtctgtccagctccatagagcagaaggtgggggaaaacagatggcatgcagtagtataatacctggaagaaaaagttcacagagcagaccacagccaagaggaacctggctgccccctgatctttcccattcctgccctcttcatcctagctctaatccctgttccacttccctgtctcttacagaaagcaaccagcttgtcagatagggtttcgtccttggccacaggggagctctgcatgggctgagtttgcctccgagcagtccccattcccttctagtggtctgtcttctccactagtccctctgtgattaaaccatctcacccttgcaattaacctggcctgtgcagggctaccggcagaaggactcctatatcgccagccagggccctcttctccacacaattgaggacttctggcgaatgatctgggagtggaaatcctgctctatcgtgatgctaacagaactggaggagagaggccaggtgagttcaaaaggtcctgggtggtgagagacagagacagcatgaaaagatgtgtgtgtaaatggggacgttgggaaggcaagaaggtgtttggaccttgtctttgacttatacggtccaaagagtacgtttgcatagtataagtacatacttaaaggtatataaatacatatgcatttccaggattgcccagcccgttggtgtctaagcagtcattagcttctcccaagactagaaaagcaatgtgatctgagcctccatgttattcccagacagctcacacccttgcactttctcctgaatacagtccccctagcctagcctttgcacagtgccccaggcggggggggcaccctctccttcccagtgccccaggcagggcagataggtcaaggttctgaggtggacccaatatgagtgtccctaagaagggattgcctcattgctgactacataaaataaagcagtagaatttgagaaattatacaaacaagaaacttacagtctaatattcagtaataaggaaatcttttaaagaaaaaagccctcaggtctattaaaaagcagagctgtccggaaactcatactaaaaagggacactagcagtcccctaggtcaacttcctctcagtataggaaacctcctaatattgttcctgagtcagaatcatacagcctctactaagcacattcaatctcagggatatctccctcaccccccacat

SEQ ID NO: 99736 - DNA, 1051 bp, Homo sapiens
tgcactgtctcccagcccagcacatgcctgtctgacctctgtggggcctgggtcagctctggtcagctctgcttgtagaaggtctgctgcattcagcccggaaggggaatgctgtcagaactctggcaggcagatcagagctcaggtgaaagttcaaaaacattcagttcctcttgattttccatcttcaacaaaaaaatgagtctgttaggaattacaggtactgtgtgttcttcagtaaccctgactttttccctacctttcactctccaggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctgaggaaatgtctctccctttgtctgggggtggggcagccatacaggctggggctctcctcggctgttcatggccctcctgttgctgttctctctgagttatctgagagaggccacagtcccccagctcctcctgtccaccaaacacagcccttccagttcttaggtgat

SEQ ID NO: 99737 - DNA, 2410 bp, Homo sapiens
gttcttcgtgctgatggagcgttaccagcactaccgccagaccgtgcgcgccctcaggtgtgcggccggggggaggtggccgcccgcgcgcgctggtgacggtgggagtgggcggagagggtgctgattcctggcgcgtctgcacccaggatggagttcgtgtccgaggtgcagaggaaggtgcacgaggcccgagccggggttctggcggagcgcaaggccctgaaggacgccgccgagcaccgcgagctgatggcctggaaccaggcggagaaccggcggctgcacgagctgcggtgcgtggggcgggaggcggggcggggcggcgcggcctggccggcctgggagaagcccgggccccgctcagcctcggccctttgaccctcacaggatagcgaggctgcggcaggaggagcgggagcaggagcagcggcaggcgttggagcaggcccgcaaggccgaagaggtgcaggcctgggcgcagcgcaaggagcgggaagtgctgcagctgcaggtgggcaacgtctccggagggtgggactccagccggggacgcggcttgcggggcactgggaattctgggcaccgcgacgcgggcgctggctatgtgcagagacttacagttggcaggtccggatttggagaggagagtgccagtcaggcgcaaagacccggaggtgagcggagtaattggacagtgttcaggtacctagcaggtctgtgggagggaccctgcgttccacaaagaggttgtattttgcataacaggtgatgaagccatgaagggttaagtatttcaggctaggattagcaggtgtgcgacttaaaagcagggagaccacttaggagtaatgcagtgagaatggatgaggcttgatttaaagtatagaagggtggctgggagcggtggttcacgcctgtaatcccagtactatgggaggccgaagcgggcgtatcacttgaggtcgggagttcgagtccagcctggccaagccccgtctctcctaaaaatacaaaaattagccgggcgtggtgtgcgccagtaatcgcagctactcgggaggctgaggcatgagaatcgcttgaacccaggaggcagaggttgcagtgagccgagatggcgccactgcactccatcctgggcgacagtgagactccgtctcaaaataaataaataaataaataaataaagtaatggggggaaggatgagttagagtgattcagaggggaccactgagggacggatttcacctaccaggacgtgagattttcatagctggcactcggggctatggctgaagtgtctgagaaaagaggaacgtggaaaagcaacctgatatcactccactgggaggccagaggggctctcaaataggacctgggttccaggcatgcttccccagggagagcaggagctgctttctcagtggggtgagaggccagcaggctgggtgggctggctggcatgtgcccaaggctcctgttcagctgggcttttctctcccgataggaagaggtgaaaaacttcatcacccgagagaacctggaggcacgggtggaagcagcattggactcccggaagaactacaactgggccatcaccagagaggggctggtggtcaggccacaacgcagggactcctaggggcccagtaaggacagtgcccgccagggaccatgtatgtatcatggcggaagagttggccctgacctggaataaagcagttggtgttgcttatgaggaaggttcagccttatccagcacagccttcacgttttgccctctgctgtcaccacttggtcagaaacttccaaacgcagtgccctgttctgccggtgtgtacagcctcagcgcaccaggagaccctagagtggtttccatctcacagagaatcagacagggccacagccccctcaggcagccaggtcatctgagtatcattaagagtagtgatgggaagattacagtctgagggccaaacgtgcctgcttcctgtttttgtaaataaagttttgttggaacacagccacacccactcattgacttctttttactacagtggcaaaggtgagtagttgcaacagagaccatatgaatcccaaagactaaaatctttaactttttacaggaaaagtgtagtgatctctcatctggagctttaggactctagcctgtgtcacccaggacctgagccacaagctaaccattggccaggcgcctgcctctgctctatactgtgctttgctggccagagtctggtgtatccaagacccagaaggcaaagaggagaccccatttttttctgggttccacaaagaggttgtattttgccttacaggtaatgaagccatgaagaattaaatattctaggctaggattagcaggtgtgtgacttaaaagcagggagg

SEQ ID NO: 99738 - DNA, 1079 bp, Homo sapiens
cagaccaaggctccatctcaaaaaaaaaaaaaaaaaaaaaaaggagcgtgcagttctgcagttgagccacgaggtggctcatgtctgcccagcagtttctccaggaggagaaaagcctgaagccggtgggatgggcaggaactgccggtgttcctagggctttacctcccggtgttctgtcatggtccgccagtagacattaggatggagtttcattacattgatgtgtgagattggaggtgccgtttttacagccctcgaaggacttgaggctgttctcttttgcggagcctgtctctggatgttgtgctgtgcgcatctctcgacaggtccactgtcccacgagcagaagctgtcacaaagcttggaaattgccttggcatccacccttggctctatgccctccttcacggcacggctgaccaggggacagctccagcaccttggcacaagagggagcaacacttcctggaggcctggcaccggctcgggtaacatgggccccgccatctccttggagccttggaatgggtggtctgttttctgtctctggatgctgggccgagtccctgggggctctgtggacctgcctggccagcctccccgtcagttccaacacccaccctgggagagaacctgttctcttgccttttccaggggtagttgaggggctgcctatgaacttaaactccccacaagaaaggctttctttagtcaatccttagtaattctgtggatgtagggcttggccaccctctgatgtgtttccttgtgagatctaatgttaattattttctcctgaggatttttgtttctcttttttttgtttgttatttatttatttatttgagactgcatctcgccctgttgcccaggctggagtgcagtggcacagtctcagctcactgcaacctccgcctcctggattcaagctattctcctgcctcagcctcctgagtagctgggattacaggcgcccgccaccatgcccggctaattttttgtatttttagtagagacggggtttcaccatgttgccaggctggtctcgaactcccgacctcgtgatccgcccgcct

SEQ ID NO: 99739 - DNA, 1021 bp, Homo sapiens
tgcttgcgataaacaactcttctagtactgagaccaaagagaaaattttcttatgggtctccaagagaggataccatatagaacagacaatgatcattttgtccactaaacaaaacagtaactgactttaaagagctgtttcttattgaagttccttgtcacacagtgccaatgagtagcttggtgaagagtatttgcagggggtggtgagggtggtgatggttgtggctgggatgaacatgaggataggccggtgcactggtctgagggtcagctcaatggagtggtatattttagagattaaaattatggttatcacctgatatgtcctgctactctggtgtcctatgaatcgtcacaagtcggccactgaatttttatcaatgtgttacatttatttttgcaactggtgaggatcaaaactgctaagaaatctgtcagatagtggtgtgggataagatctgcagcagccacgaggagtgccagacaagaggcaagagaagctacttggaccagcaccaaggagcatgtaacggggctggactgaacactcttctgtaaatgttccctcaacttatattttgatgagtgctgtggagagcaggtagtctgtgtctggtcagggttaggtccatatgcttttgtagttgactggggtagttgacagcccctgacgcgggtggagaagcctcatgagctgagatgcttgaacagaaggctgactcgcttccacacagaggtgggaagaagtagctaagggtataccaagattttccttaatttcaggtctgatctaacacatattggaaagggcagtcaaggtttccacatttctatatcatagagcataataaccacatttaagtctagaagaactcttattttattttactttattttttgagacagggtctcactgtcactcaggctggagtacaatagcacagtcatagctcactgtaaccttgcactcctggcttcaagtgatcctcttgcctccgcctcccaagtagctgggact

SEQ ID NO: 99740 - DNA, 4019 bp, Homo sapiens
caacagccctgtctggtacatcagttgacaactcaggtctccttgggtcttgcttgtcaggctttggcacttaagtggaaagaaaaagaataagcattaaggaaagcgagagcacagcagaatcaatttcatagtctctcatggtttctgccatgggagaaaaatgggcattatactgctcacaggcagaataaagactcactggaaacattgctaagctgccttctccagaagatgtcagcggggcagttgcgtcaattggcgttccctgaaccctgagcccagctttggggtactctttgcttcccacccgtgaagtgacagtgagcagaccctcaaccttctgctttctcccaccaaaatgagtgagttttttagtatactttctaataacaccattactctgtgactactctctaatagtgactcaaattctgttataagcttcctgaagaggagagtaggcatcttctaaaaagtaaaagaacagcattagaatgacagaattttggaattaacagttttgcgctataagaacagggagggttatcgtaggtataactaattaaatcttttttttttttttttgagatggagtctcactttttcgcctaggctggagtgcagtggcacggtcttggctcaccgcaacctctgcctcctgggttcaagggattctcctgcctcagcctcctgagtagctgggattacaggtgtgtgctgccacacctgggtaattttttgtatttttaatagagacgggatttcgccttgttggccaggctggtcttgaactcctgacctcaagtgatctgcctgcctcggcctcccaaagtgctggcattacaggcatgagccacccacacccagccaactaattatcttttataccagatcccactttttacttagtgctgttagcatagcagtttttataaacattcttcaggtaggacctgtttgccttgatatcaaagagatggaaggagttgctcacttttgttcccagccttctttctagaaatctgccttccttcttcctatcaaatgttagcggagcaccgtctcttctttagccgtcactgcttgccttgtacagtgaaggaagtctggtgagcagcagtccaggaactgcccacgggtaccctgggttgggggttttcctaggcctttacacagaccgcagaatttatccttgatatatgctgtcatgtggtttgggcatttactagcattgaacttatttgagtagacagcagtgtagtttcaacctgttttttataatgtgtaaatttggatgcttttataggtagaagccactcattcttcatctacccttttttcagtatctggcaccaattctgacccagtcatttgtgatccctggctcttgtgatatgctgaagatttccaggcagtttttgtggaacacctccccgtccagctctaatcaagcaccatataaacaagaaattgcctggtcaaatctgtgaggactgtattctgactgccaaagagatcaatactgacaccagaatggcagctactctcaagtcattaaaacttgtaagataccgagcattttgcagtccttctgcctttggtgcagtccgaagtgtgtcatactggaatgtgagcagcacacagcatgggggacaggaccctccagaacacattagcctctgccattctgccaaaaaagttaagaacatatgtagcaccttctcttctcggagaatcctgacaaccagcagtgcccacccaggtttggaattcagcaagacttcttcctctaaggccagtacattgcagctgggctcacccagggccacaggagttgatgaagaggacgtagaagtgtttgattcctttgaaaacatgcgagttttcctacagctaagaccagaataccgtgttcacagctataatgcatctgagacttctcagctcctgtctgtttcagaaggtgaactaattttgcacaaagtcagagttaatcaaaataatctccaggctcaagtcattgttgattatttgtgtaagctgagctctttgcctgcagagcagcatcctgtcttgctgggcagtaccagctttgctctgctctgccagctgagtgtgaagaagatacagctctttgatacccaagatctgatcaatgttttgaaagcttttgtcattttaggaatccctcactcccattcaatgctagatgtgtatgagaccaagtgttgccatcaggtatgggagatgaatatggatcagctccttttggtggctgatctctggaggtacttaggccgcaaagtacctaggtttttaaacattttttctagttatcttaatttgcactggaaggatctatccttgtctcagctagttcacttaatttatgttataggtgaaaatcgtcaggtatcccaggacctaatgcaaaaattggaatcattgatccttaaatatatagatttgatcaatttggaggaggttggtaccatctgtttggggttctttaaatcaagtactaatctctctgaatttgtcatgcggaaaattggagacttggcttgtgctaacattcagcatctgagtagtcgctccttagtgaatattgttaaaatgttccgtttcactcacgtggatcacatcaatttcatgaagcagattggagagatagctcctcagcgaattccttccctgggagttcaaggtgtcatgcacctgactctttactgctcggccttacgcttcctgaatgaaggagtaatgaatgcagtggctgcgtctttgcctcctagagtggcacactgtcgaagtaaagatgttgccaagattctgtggtcatttggaactctgaattataagccacccaatgcagaagaattttactccagcctgataagtgagattcacagaaagatgcctgaattcaaccagtacccagaacacctgcccacctgcctgctgggcctggcatttttggagtactttccagtagagttaattgatttcgctctcagtccagggtttgtcaggttagctcaggagagaactaagtttgacctccttaaggaactatataccctcgatggtacagttggcattgagtgtccagattacagaggcaatcgtcttagtactcaccttcagcaagaggggtctgaattgctgtggtatttagcagagaaggatatgaattcaaagcctgaattcttagaaactgtctttttactggagaccatgctgggggggccccagtacgtcaagcaccatatgattttgcctcatacccgatcttctgacttagaggtccagcttgatgttaacctgaagccattaccatttaatagagaagccacgccggctgaaaatgtagccaaattaaggcttgagcatgtgggagtcagccttacagatgatttgatgaataagttactaaaagggaaagcaagaggacatttccagggcaaaactgagtcagagcctgggcagcagcccatggagttggagaataaggcagctgtacctctggggggcttcctttgcaatgtagcagataaatcaggggccatggagatggctggcctgtgccccgcagcctgcatgcagaccccaagaatgaagctggctgttcagttcacaaacaggaaccagtattgctatggctccagggatctccttggactgcacaatatgaagaggcggcagctggctcggcttggctaccgtgtggtagagttatcctactgggaatggctcccactactgaaacgaactcgcttagaaaagttggcgtttcttcatgagaaagtattcacctctgctctctgaagggcatttaggggcatttctatggcaaagctataggtgtatactgtaccaggtgttgcaaaatgattataaaagccagaatgtaagtttggcgataaaatagtgtgttgaggagacttaattgtatccaaggcaggttagagctagtgtatgttactgtgaattgtaatgtagttggattgtacaaa

SEQ ID NO: 99741 - DNA, 1041 bp, Homo sapiens
aactgtccccacattcttgaatccccccaatcttggccttcagggcccaccttctcctggccttcttcctgctcccagagtgccttccagacttctggggctttgctccctggctcagtgctggcctacacccccagcacccttgaaaactgatgatctcaatctctctccatctagtgctttttttttttttttttttttttttaaggaaagagtctcgctctgtcacccaggctggagtgcagtggtgcaattacagctcactgcaacctctgcctcctgggttcaagggggttctcgtgcctcagcctcccaagtagctgggattacaggaatgcataccgcacccagctaatttttgtatttttagtagagatggggttccaccaatttggccaggatggtcttgaactcttggcctcaagtaatctgcccaccttgacctcccaaagtgctgggattacaggcatgagccaccttgcttggcctccatttagtgcttgagaggtatcttcctctggtgtttcccaaagcaactattttccccaagcagtctccccctatcatgttaacagtgtcacacgcacgctggtgcccagtccagcattatcccttgtccccaccacctgacctcatctgtatgaaattttgccagttctttcccaaaccctgcccaggccttcctactggttccaagcctcaggcctttcaggcttcatcctcccagtccccagctgctccccacattgcacccagaggtggcaagagaagggtccatacttaaggtaggagggggttgcagggctgaggcatagggggctggagtatgctggggagtagaggcagagcagggactagagtgaggccagagagggacccaaggcacaaagggaaggaggctgtcaccctcagggctgtgtacttgctgtttgtgcccttcatttgtgccctacgtggctctctgtcctcatcctagtcctggcccttgcttatggggacagacgggtccaagggaggagggtggcgaagtgctcttctcca

SEQ ID NO: 99742 - DNA, 1043 bp, Homo sapiens
attttctgcctgtcccccacgagctggagaagcgcgaggcggctccaggaaattcctgaagctctctcccttcccgccaaggagagggcccactctccctccccaatccgctccccgatcagaaggccatgtcattggccagggcacagaacagatacacccatcctccctctttccccccatttctggtcagcgggcgggtttgtatatgtgttttcctgctccctgggcccacaagctacctctgagcacctgcgcgctcccaggagcggaagggacacgctgagggaaggcggagatccagcaggtcttcccgggggaggctcggccaccgccgggaagtgtactctctggctggggagccagataaaaccacaggtggtgttaggcgagaaatcagtggattcctgcagggggtactcgatgagagctggggacatcaggataggggcctcctgacaggccagctggaaaggtggagccgggaggggagaggagtattcacacaggcccgagggaagggctgagcccccgcctgggaccaagctgtgggcctggtggaaaaggccttgccagtcagactgagaagtcggggccttgtgctgtgggcagcaggccgctaagcagaggaggtgaggcttccgggctgccgctcctcctgccatgggccgggctgggcttataggcagcattgtcatttctgtcttccctacagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctaggtgagaggggcccagcctggtggggagagggtttgggttggagggggggataaaagggcccccaaagctaagtgggggagtagggtatgaagcctcagggtaggagggacgtctgggagccaca

SEQ ID NO: 99743 - DNA, 1629 bp, Homo sapiens
caaccttctgtgctcaagcaatcctcctgccccagcctcttgagtagctggaacttcaggcacatgccactatgcccagctaatttttgtattttttgtaaagatggggttttgccatgttgctcaagctagtctcaaacttctgggctcaagcaatctgcccaccttggcctccaaaagtgctaagattacaggcgtgagccacaggacccagccccttaattttaaaatatcaagataaatgatattttgagatatctgcagcaattgtaatgagttataacaacatctgtgattttagtagggttaaaagtcacaggcactgctagtaatattttggtttgttacctatattcataattgaaaaagttactacatttcaattaagggttactaagaataaagttttttttcccaatccatgttcataggccttctgaattctgggtatcttctgttagagaattcctggtctaggaggatggctagggtttctgggagcattgagaagagaagagtgtgttctggatgggggcttagcacaagcagagacctgacgtagaagagatagagaagcaaggagatggaaggggctggcttgctggggtgggaccctgaaagccggggtgaggcccacaggcctgagttggtaagctttaggagatgggcagcagagttatcgatgagaaaggcggatgacagctcacgtgctcacatggagaatcactagatggtgataagtgttctcttttctcttggaacaggtcgttcagattctaggagataagtttccatgcactttggtggcacagaaaattgaccgtatgtctctgttttgttttatttttaaaagatggttggatttctctgtcttcctgtgacctgactttctgtgtgtctgtttccctgataagtgccggagtaccagggggagccggatgagatttccatacagaaatgtcaggaggcagttcgccaggtgcttgccctgcccttgtcccacacttgctcttcttgtccaggtagcttccagggcctgcgcctgctagaaacaatagagtagacacagtttgttgagctttctaggaccggcccagagtcctctagggttcagttaatattggctttggaacactgccttcctttgccagccttgaatacatggtatctcccccagaccaccaccatacactcccacgtacacacagactccccttcccccaaatgctcagacaatggattccagccctacatcctccccacacacatccaccgctgcattcacacatgttcgtggaactgagaaagcacgctgcggagagtcaggctgagtgtgaatcccagctctcccattgctgtgcctggagcaagctttaacaatcggccaaagcttggtgtcctcataagataagagattggccaaagttaagagattggccgagggcagctcccatggtgctgtctgccacagatctcagctagctgagggctggccccagcctgggtgacgcgggtgacctggacgttccaggtggggatggtgatcatgggtctcagggctgtatgtctttgtgctgcaggtacaggggcccgtgctggttgaggacacttgtctgtgcttcaatgccc

SEQ ID NO: 99744 - DNA, 1062 bp, Homo sapiens
gcataaggcaaaagcactgggcgtgccacactacccagcccccaacccagcaaggcttcatggaggccctggcactacctgcgggtggggggcagcatggatccagggtggaggtcagcccgcaatccatgccattgaatgaggcaagaactcgagtggagacgtaacactccagctcacagtggcatccgaatgccttccacacggtgctgcccgtgtccccatccccacccccacccaaaaaacttcctgcacctgccaaaggagactgagacagacacctgcctggggcagggttcaaaacagatatagctggtttattttggaaacaagtctcatccagaaatgttatttactgcatttaaaaaccatggaaggcgatttgcatggttcctccccacgccctcactcccaccaagtacagctttaccacccaaggtcctttcaggaccccaggcctggcggctgtaggagagagcagtgaatcctaagggcaagagaatggcgtccacttgccagagtttctcagagcagagccagctgctcctccagacaggccggtgaggctactcgacaccctcacaaaggggaaaccctgaaggaagtacttcagggggtgcctgcccgatgcgggaggttttgggctagccctccccagatccccggcctgaggggcctcctccagctgcagaagtcaagctgccaaactgccaaagtactcctgcagctccagcagggcccggaagcgatgggagacagcgttcttctccgccttaggcatctctgcgtacctgaggggtgacagtagcagctcagggagcccagattcaggaaggaagtgcaccccctcccaaccctacctcatctcatccctggagaccaaagctcacagaccccaaggaaaggggagtggggcccagcagctcctggcagccagtgaatttttaaaaatcggataaagttttcaattcccctgtaggcagaaacccccatgaatgagcatggaggggtattaaacttgctctagtgtgcccaaaagtcattaagggaagctggggacag

SEQ ID NO: 99745 - DNA, 1057 bp, Homo sapiens
aggctggcgggcaggaggagcccagcctagaggtggagagtgggcgggctggggtgggtggtgggcaggaggggctccagtctaggagtggagagtgggtgggctgggggtaggcgggcggggaggagaggcctagcctggccctgtgggtgggctggggtgggctgggatgggtgtccactgccttctctctgacccaggctcatcctcctgtccctccctccccacagctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgtaggggtgcagtggtatgtgcccacccctctcccattatcctttagctttaggccaagagcgttgctcagggcagcttctgcccagggtgggtgggactgagcaggatggattttcttttgataaaagagtcgatgcctgaaagagaaaccatttccttgattgtgtaaggaacttgctggacgcacattagagaataaagctcctgtttctaggctcctatgtgccacctgtgtccctgctactgccactccacccccactctggggaggggaagccctccctggggaagtggaatgcaagggacagagtttgtggagtgccacctgtggtctgtcacctccaacgtcgcacagtgggtgctggcccaacagtgaaacatggaagatccaggaggccttcgcatggccatttctccagggacctgcagggaaagcgttctgggaacagcatgtgcaagggtccagaggagcgagggcttggggccactgaggcgctgtggctggtgaagagcagtggggcgggagggaccatcagggtgacagcaaagggccctgtgactctcagatgaaagctgcctgccgggaggccgaggcttcgtgtggagca

SEQ ID NO: 99746 - DNA, 1005 bp, Homo sapiens
gtgcatgggcacgtcggcagggtcccctcaccttccccctggagccctttctccctgagatcccctccctccagggcctccccctgccacacgctggagagggctgaggcctgtgggtgtgtgtccacagtcttctggaagtactactatgggcattacttggacgactatcacacaaaaaggacttcatcccttgtcagcctgtcaggcctcggcgccagcctcaacgccagcctccacactgccctcaacgccagcttcctcgccagccccacggagctgccctcggccacacactcaggccaggcgaccgccgtgctcagcctcctcatcatgctgggcacgctctggctgggctacaccctctaccaattcaagaagaggtgaggggctgcatggggaggggaggggccgcatgggtcaaaggctgtgctcatgcacctgctgtccccagcccctacctgcacccctgcgtgcgagagatcctgtccgactgcgccctgcccatcgcggtgctcgccttctccctcatcagctcccatggcttccgggaaatcgagagtgagttggggccgggcggtgggtgacgtggggtagctccccaggcgctgcaggcatagcagtagcctgtcccctactgcagtgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggtgtggagggtgggtgagggtggggtgggcggggcccgggcctctgctgtggggctctgtccacgagtgcccgtctgctgcaggctggtgaagggcactgcctaccactgggacctcctgctcctcgccatcatcaacacagggctgtctctgtttgggctgccttggatccatgccgcctacccccactccc

SEQ ID NO: 99747 - DNA, 1112 bp, Homo sapiens
ctcccagcgccccgagcgccgagcttttgggagcctggcgggccgccgcctcggaaggtctcattttaccttccgcccgggcatcttcccgtccggcgccgcggtgggagccccggaacccctggagttttgggagtcccgggacccctgaccgtgccctgcgcggccgcagcggtttctcccttgctctgacacgggagggccagccctgggtccccgccaggacccaggtttgtacgaccctttacctgcacgtgggccgccgggacggaagcggagtgtgcaccggcccaaccctcccagaccctcgtcgcccacggcctgggacgcgccccagcgcccccgccccccacttcaggatgcagccccggctcccgccccgcgcctgcattcacatcctgcgccccgacccccggggtctccgagtctggaggcgctttcctctcgtgcacgcggcccctcctgtcgcttccttcctccgacagcgaggcacaaacagccgggaccatccggggaccggcccagggagggcgcagcctcccccgacccatgtgtccctcagatactcctcccacccccaattgttctcccttttggaccaacggctctggcttccaggcggccgggacgcggtcccaggactggagaccgttgcctgtcggcccccgtgtgacccggggcgcgtgacgggggtcgggggaactgcgcctgcaatgggcgtttatggcccccaggaccggtctgagagtgagaagagggatgtgcagagagatcccccgccttggcatccgaggagagagggggagaggcccgctcgggcccggtcccttcctctcgctgcagcggggcagggttttctcaggaaaacctggattagcgaacatggtactggtactaactcggtgggaagacatccctggaacgtctctcctcctcgcctctggcccgcctgggcagcccctagcagatgggctaagcaattgaatttctgagattaaggctggcttcccctgctatggggccccctcccgagcactgtcccctgcttccctttctccctagggtggcgtgggttgcatccctcggaagagcgaaggaatgagccaggtcgg

SEQ ID NO: 99748 - DNA, 1325 bp, Homo sapiens
gattacctcaacttgaatatgaaactgtgattgaaaaaagtcaaaacgtgaagaagcatcaaagccaaaaaggcaaaactggctgaggcctctgttgatgctcctcagcctactcgggaacgtgaaggggcagctggcgaaagggcattcctggggccacttgctctgccccactgataaggcacacccgcggtgcactgtgagctctttgaggactgaggccaggggatgcctcctggaacctgccaggcctctctgttctgtgaaggtcagtatccacttgattcctccaggcggcgctccaggtgggaggagcagggtcttctgctgtttccaaaggaatggccatgacactgcttttgaccttagaagtggatccagggacccagcaaagagcgggggtgggttcccagggacaggcagtcctcccggggcttacatgctttttgctaactttcctattagcagcttcagtttatatcacccagagtgcgtgggataatgttgaagtcgctgaagttacgggttattttatgtttttacatgggatttttctgtttttgattggaagaaggagacagaaattggaggaaatgggattattatcctagggaagggccgttggcaaggagttgagccggcccctctgagccctgggggctatctgacctgaagcctggacactgggcccttcaggtcgcaagaaaaagttccctcctaaattctattaggattttggagaatttttgcacagtaagaagctctgggttgctccttgggcttctcaaaagggaaaagttcaattcaaagattgtaaactacgaagtattccagccgtgttgctgatctagttggatagttgtacctcaaaaaagtaggtgagaactggcttcctcattgtcccaggatgtcaaatactaatgacataagagctcacttacgtgccaaaattcacttttatactagtttttcagtgctttaatatttgtaacttaaattttaaaactcgtatttacaaacactactgtaacttcagtgaaactgaattgtgcgattgaagctttttgcttatcatagtatttattacactacttaattcagtaaatatataaaagtagccttcaatttatttttatattattttacatgtttttacctgcagttgtgtatgtgaatttaccttggtaatcgagatgtcatgctaaggaccaataaactatcactgaacaagcaaggcctccagacgatgcctgtgccatacactcagtcccgtgtgctcctggggcgggggtgacgggggccggccctcagcctcccctggacgc

SEQ ID NO: 99749 - DNA, 1012 bp, Homo sapiens
tgctccacctcttgggctccaaactgcgagccttcttagatgtttcaatttagggaatcatcctgtaggcagcaagcaccgctgtgccctgtgttcctccagcccctactgagggcaaagtgcctggcacagaaccaaggagctataactttcccaggtgagactcgcttctgacaataccgtcagtcagtcctctagggttcccatctgctgggttccctgctcatatggcccagggaatgttctctgtaggatgctgcacagcctgtggacctctccagaggagaagaggacaaaggagagagtgtgctgcaaagttactgtaatcatactaataccaacacgctggaacatttactgtgtgtgctagctattgttcaaagactccactctctatatggcagctcctagccacatggctatttaatgaaatgtaaattaataaaaatcaaaatttataattcagtctttcagccacacagccacatttcaagtgcttcatagcttcctgtggctggcagctaccgtgtccaacagtgcagatctagaacatttccattgccccagaaggctctgttgaacagtgctgttgtgagagctttgtttgtgttgtctcatttacaccaatcctgtgaagtggattccgttattttatcattttacagataaggtaccaggggcagcaaagagttaatgacttgacaatttatagcttagtagatgaaagaactggatttcaaacccaggttgaatggctcagagctttttctcttaggcatcgtgctacacttattcctgtatagcatggacaatttgtttctgctctgttgaaggtttaggggaagacattgttaaagcttggccagaattaatctctcatgtttatttggattatctttgttattcttactcacttttcccaagcacctctctacatcctccataccaccccttacaccaccaacttttttcgtaacaaaaaatgatctggccaggcttggtggctcacgcc

SEQ ID NO: 99750 - DNA, 1052 bp, Homo sapiens
tggggctttgaagaaacttggaggaggaggtagggaatgccaagaagcgagggttgcttgatcacacagggtgtatgaagtcagaggatgcctgtccgtaagatgccgcctgagcagagacctgaagggagagagaaccacccatgcagatacctgaggaaaagaacattccaggcaggggggcaaagaatgcagaggtagaagtatgcctggcatgttcagaaaagagccaggagaccaaagtagctggattagggcaagggaagtgatagtagatgaaattctttgctgctccatagggggtcagatcatagagggctgcctgggacattgtaagggctttggctttcacacagagtgagatggaagccaccagcgggttttgagcagagaaatgacatgatctgactctgggtttagcatatctctctggcatctgtgttgaaaacagatcagagagaggcaaggacagaagcagtgacagctgggaggctgttggggtgatctaagcaagagattataacagtttggacccagtgggagcttgggggtgtaagcagtgatctcttctagttatattttgaagacagaaaaaaatggagtcaaaggagaccaaaaaaaatatatttgagcctagcatctgaaagagtagagtccatctgctgaaaaggacaaggagtttggagtttggagagagttccaggcaggagataccaatgtgagctgtatttgacatggatgagtctgctgacctggatgggtccggacgcactctcttgcctgtgtgttctgagaagtgggaaggagagaaaggagctactaaagaaaataagcaagtggcaggagctcctaacttgattagaaaacaggcctaaggacactaggtcccaccctcagagctccaggatcgcctgcaggcttccttttacctccagagcagggtggttcttccctcactcttgcccagttatgaggactaatggaacttgggaatgtagaaacactgtagcttccaggggctgcatgtcatgaagtggagtgacaccaaggga

SEQ ID NO: 99751 - DNA, 1059 bp, Homo sapiens
tcaggcaggcttggctggacccagatctcttgaggtcaaaatcaaggcatcagccaggctaggctcttatctagagcctctggggaagaatcttctcccaatctcagcaaggatgttgtttcctttcgcttgtaggaatgaggtccccattttgttggtggctgtcagacagggatcctctcagctcctcctcccagaagtccttgctcttgtgaccccctccatctcagctataaagaaccttcttgtattgaatctctcacacactttgagtctctctaattcctcttcggctatcagcatgtcaagtttttgcctatcccagcccaccctctgccccccataattcatgtcccttgttacctcctcccaagggtctcatcccattatggctacagttcaaagtcctaaatctcatgggcttaaatatctaaaatctcatgatcaagctcatctaagtcccatgtaaatgaggcttgggagtgtaatctgtctacagctcctgaacatagttctctccatgtctgtggacctacgaaactaaagagacaagtcatctgcctgcagccctcccaacatgcaaggtgggactggcatagacttcaggttcacaaagaggaaaaacagaaggtaaaaaggagtcaccagcccatggcagctttgaaattcagctgggcagacttcagttccttgataaggtttcaaggcctgggaataattctggctctcagctctgcctcggtgctcttggttctaccctgtttgctcttggtttgctctgggctcatggctccaccctctgagcttatagctacaccgctgtcatccttcctttttcagtgaaaggtagtactttgtttgtagctgagcagttttaacagcctgcctcttgccagtagaattttgagggtccaacagtctccttcaattttatatgttatctgtccctttcaatccaaactggcagtgtttctgctcatatgaaatcctcaaaaaccttgttggtcttgcatggattttacagggatttactgcaagttcctctttggcttcctcaaa

SEQ ID NO: 99752 - DNA, 1019 bp, Homo sapiens
gtaagcagccttcttattctcagtgtgaacattatatcaaaaaataatgtaagcaattcataaaggtattaaaatgcttcatctcactactaatctaaaagacttgcactatgttgtcttcacttcctatttgcattcctccccttcccagcagagctttagaaataaccatttatgggggatacaattagagggattctttattccatcagggccttctggtgttcttttaaaaatctccccataatattaaaagcagatcccagattggcctagacatgtagagctgagacatcaaggctttaggccaaggagaagctgcctctgttttcacaaaggaaataaatccactggaacatgaacaagcattgcgggctttgatgcctggactcagagagaatcttaatgttctttttctcagcacaaatcaaggatgccagtaactgccaaagagccagacaatgccaaaggccatggaatacattgggcatatctgagcctgactcagcttttgtagacggacataattgggcaggacttttgattctgtgaatatttatgctataaatcacctattcttttttggatttttgtttttgttgttgtttttaaagggggatgagtctttcctgggcacttatctaacaggaggagaaggagcatatctttattccagcaatctacagtcctggcctgaggaaggtaaggagctatgactttaatgtttttggccatgtctgggtccctcatttgcagatgtcagcatgggtgttgtaattaataatacatcttctatttgaacacaattgtggtacagaaatgttttcctacagcttttctctcgacccacccactttgtagatgaggaaatttatgctaggaagggctgatcacagaactgtacctggtccttttgttgctgcctgaggttagttagctctctcaatgggctagggcagcagcatttccagaaatagaatttgtggacctaaacagaagctggattcatttctcttgct

SEQ ID NO: 99753 - DNA, 1040 bp, Homo sapiens
cattttcggaagctgaggtgggaggatcacttgagaccaggaattcgagaccagcctgggcaacataagcagaccctgtctctacagaaaataaaaaattagccaggcatagtggtgcacacctgtggtcccagctactcaggaggctgaggtgggaggatcacttaagcctgggaggtcgagatttcactgagctatatgattgcaccactgcactcttggcaacagagggagactgtgtaaaaaaaaaagaagaagaagaagacatctggtttatgacatgaacattactgtgttgtttcccaagtttctctcagcttggaattcaggccagagaaccttgccagctttgccatctgctcttctctctagatttcagagacttcttacctgcacacccatgcatttatgatgtaactctccttgatatgttttctatataatgcatttttaaattaagggcttttctaagaataaaccatcctgaaatccattgggagaatcatgtgaaaccccaactggtctgaagagtgtctttctctggatttgacacttaagcctatggaacatagtgagagggtgtgaacactggctgtgcaacctcagaaagggtctacctagtgttgacttctcttctttcacatacagcaggaaaccaaagacagaaaataaactcattagtgctgaaactattaaattccagaaagcattgtccttcagcaatatggacataatggaattttattattacctaattaaatactgcagcttaacttggtggggtctagatcaacacttccctgtgaccagcagtgagaggctacaaaggattatctaaagatctctttaaaatataggttctccaggcccaatcccaggattacaatcagaatttctagggcagggcccacaaagttgtattgggaaaaatataatagaagaaatataatcatactatagaaaatatggaattagagaaacgaaattaagatcagctataattcctcctgtctggcactacccattagtatcttaattta

SEQ ID NO: 99754 - DNA, 1106 bp, Homo sapiens
agccttcttgggcactcactgcagccctcaactctgctgtgctcccctgtggctcagagcaagccctcctgctgatggtatggagctggaattgatctttgttgttacgcattttacctttgaaatggagtctcactctgtcgcccaggctggagtgcagtggcatgatctcggtgcactgcaacctcttcctccagggttcaagcaattctcctgcctcagcctcccaagtagctgggattactggcacacaccaccatgcccagctaatttttgtatttttagtagagatgggttttaccatgttgaccaggctggtctcgaactcctgatctcaatcgcccgcctcagccccccaaagtgctgagattacaggcgtgagccatcgcatccggctacctttacatattttataaactccacaatacaatgctcttatgtttccttaaacaatcaattacctttcttaaagatttaaataatagggaaaaagtcttatatatttgccagtgtatcgcttctcagccttttggctaaggtcaagtgtaatatatttgcccatgttgttgctctctctggtgctcttcattcctttgtgtagacccagacttccccttggcatccttctccttgaaggttggtctttaatatttttttgtggtattaatcttctgatgataaattcttgcagcttttgagtgtctggaaaaaaaatctttatttcgccttcatttttgaaatatatttttgccatgtctagattctagattgacaatttttaccttttgatacttgaaagatcttgcttcagtgtcttcttgcttgcattatttctgatgagaagtccttcatcctaatctttgtacatagcatagtcttttattctaatctctgaatataagcaggcctttttttttccccctctggcagcttttaagattttctctttattactgattttgagtagtttgattatggtatgtcttgctgtagttttcttcatgtttcttgtgcttggattttgttgagcttcctaggtctgtagatttatagtttcctttaagtttggaaagtgtttcgctgttaactcttcaaatgttttttct

SEQ ID NO: 99755 - DNA, 1009 bp, Homo sapiens
ggtcaagccaaccaatttcggggatctgctgtgcacaccgggttctttcttaatccctgctgaggatcttgagaagcagcagcagcaccaaaaccaaggcatgcaccggattcaaggttctttttgttccagttttcagattccaaactagaccccaatggattgcaaggatgaccatgaaagccctgtttaaaacttcaatttttaaaagcaaaagccattacatgaaagtaaaacaattcagaaggatcacgtgtgcttccaagtgtcttcatgtggcctttctccgagtttaaccaccaaggactctgagagctggcaggtctgagtaaccctggtgactattcttttcaccttatcaaaacctgagctaaaaacaacgcatcagccaatgacagcagagggtggcagggctgaggacccaatattcatttcccaggctggtggagagtgaataagtatggttacaaaattaaacaagggaggtcaaagactctttccaaccttacctgatgtcttctggccaaagcaaggaagtctcatggaaggtgttgggtggtgatggtgcaaaaaggatcttgaggagggaataaaaagcagcacccctcgataaaggtgggggagagaagatatggggaaagctctgaattcctcaccaaaggccaatctcagaggtgagtggaagggttacaatctatgctttggccaaaggtgggagtggaggagtgtggggacaggatgatggcttggaaggggcatcatttaagacttaaaccaggggtgcaggcaaagcaccccacacacccagcagtagtcccacaggctgcgacctgaagccttcacatctactctaacaagccccccaggctagacggctgttgttgcagggaaagtgggaggtgggagggtaaggggagaaggcagagaccccaggccgtgtaatcagcagcaaaatgactgtgtgatgtgtcttttcacagttgagttagatgtgccccaccagttatga

SEQ ID NO: 99756 - DNA, 1067 bp, Homo sapiens
cgggcttgaggacgaggccgggcggcgctgtggcaaccctcaccctgcggacacgcgctcccaacatccggtccggcggcctcgcagcttaagaagtggggtccctgtggccgtgcgccgacccccaactccagccgctcccaacgcccccatccgctctcggtgcgcgcgccccctccacgcccccgcccccgcccccgccgggcccgcgcgccgcgccccctcccacccggcacgccctgccgccccgcccggccgcagctagcgtggagccgccctgcgggcaactgagaccctcgcagctgcaccgtcctcctccgccgccagtcgtccgccgccatggacgtgtaccccccgcgccggcaggggctgccccgcgctcggtcccctggcggctccagccgcgggtcaccctccgtcaggtacgcggggcagaggcagccgaggggcggccgggcgggggatgcgggctgtcggggtccggcgacgcctcccgccgcagggcgtggtccgacatggcttcctcgggacggttctttgctgaacggctcagggaggaatttttcccaggaacggcgccctctgtagaggccccacaatggctcccctttggacaaccccgcaacggtttccccacaatggctcccccacagacaaccctgcaacggtttccccacaatggcttccctagggacagcgattccctgtgaagacactgttatgacgtcctcacccccatagaacgtttctcccaggaaggattcttctacacagaaccccacagaggcttccctatgaataactcactcgccttccccagggaatgtttccctcagaaactgctactctacagacctcacacctccacacacacaatagctccctcgtgtagaacccccaaatggattacctagaaagccccctcccgtgggtctctagagcctttgcccttgacaacggcttccttaaagagtgtcccccgccccctacgtacataatgacagcatctcccctgtcgcgcgtttccccagctccccctgcctcagcctgcatcgcgacgccccctc

SEQ ID NO: 99757 - DNA, 1045 bp, Homo sapiens
aggctgatctgttttccccagtgcaatgtaagttccatgagggcaggggcctggagcatagttcacaagtccagtttaggctgatctgctttccccagtgcaatgtaagttccatgagggcaggggcctggagcatagttcacaagtccagtttaggctgatctgttttccccagtgcaatgtaagttccatgagggcaggggcctggagcatagttcacaagtccagtttaggctgatctgctttccccagtgcaatgtaagttccatgagggcaggggcctggagcatagttcacaagtccagtttaggctgatctgctttccccagtacaatgtaagttccatgagggcaggggcctggagcatagttcacaagtccagtttaggctgatctgctttccccagtgcaatgtaagttccatgagggcaggggcctggagcatagtgagcagtaaatatctgttgaatgaaggaataaaattctgtaatttacttcttatgacttttaaaaaagtcgtctttacccacatgactgccatatatgtcttctgtccttatattgctcctgaacttctctgtcatccactgtttggtgggcatcttttattgtcacctcatactgaatcatgtataacaccaaacttctatcctcattgaaaaaaatagtctttttctttgtacttccttatttgttttagctaaatccaaatttagctaaccaaaggtcaaaacttagcagtaatctttggctctttctacctgtttgtttttttctgctctcacactgtataaatttgtttctttccatttcttctgctgccattctaatgtacctaacccttcacctcattgctgacctgcttctgttgcacttttactgttttcttacacctgcagagtctgcttcacactttgtcatatcagtcttctaaaaaacatgtgtctctatgcacacgtatgtttattgcagcactattcacaatagcaaagacttggaaccaaccactgatgggctatccagcccatcagtgatagactggataa

SEQ ID NO: 99758 - DNA, 1051 bp, Homo sapiens
ttattctgtcatctaggctggagggcagtgctcctgggctcaagtgatcctgccacctcagcctcccaagtggctgggatcacaggccagtgtgcccagccaatttttaaattttttgtagagatgaggtctcactatgttgcccaggccaatctggaactcctgtccccaagagatcatctcgtcttgacctcccaaagtgctgggattacaggcatgagccactgcacctgacccctattatcttcttttgaaatgagtcatctgctaattcacttcataaatatctgctgaatattgtgtgttaggtactgtgcccttccttgaggatatgaaggtgtgtaagaatcaggccttgctttcccctaagagaagttataactatgaagggaagacagctacgtacacagcaattagaatttcataataaaaatacaggcaatatgtggtgctggactaagatgtgattgacttaactcttttgggggttctggtggaagacatcacagaagagaggacatttgggcaggtctgagaggtttagtgtgagtagaccatctgggggagaaagacattccagaaggaatgaagagttgatgtgcaaaggcaaagaattatggattatcatacttagtgtattaatttccaagggctgttacagtgaagtgccacaaactcatggcataaaacaacagaaatttattctttcatagttctggggactagaagcctgcaatcaaggtactggcagggccacgatctctctgaagactctcagggaggatctgttccatgcctttctcttcgcttctggagttgccagcagtccttggcattttggcttgtagatgcatcacttcagcctctgcctccgtcccttcaatctcatgtgatactctccctccctttgtgtctctgtcttttctcttaagggtaccagtcatagtggatgaacgagtatgacatcatcgtaactttgttgcatctgccaagaccctgtttccaaataaggtcacattcacagggacccagggttaggactttgacatat

SEQ ID NO: 99759 - DNA, 1051 bp, Homo sapiens
tgaatctctggatcaaaacttgcctgaaggtgtagtttttggtttgtgaagtactgcagtccatgtttttcttaagccggttagagttggatttccttccacttacagtagaacaattcctaacatacagagggagggaggtagagccagctgactagggttagtcagttagggcttctgtaacaaattaccatagactttacctcgatgaaaggttcccaagatgggcagatgctttttatttaccgcagtatagaggacaggtatgtacgcaggagaaaaaggagagtgtgtgtttatgatcagaacagttttgatcatataaatgtgattaagtgatttaatacatttgtaggttatttttatcttaagaaatacagaagtgagtacctagtgttatgattgaacagaaatcttacactggtttttcttgttaatacaatcatatttccaaaactgaaatgaaactatagttgtactttttgaaatacttgtgtctggaaattggccattaacttactatgatacttgtttcccacttaaatagtactctcctattttctgtgaattcccaaatgcattttggcaagtgacttccatctatatactatatactgttctcatctttcatttttactttgttccttccattttcccttttctttctatacttcaaactgctctgttattattaacgtgacttccttcttatgagggctttcttatatttgtcttgcttttttcccacttttcattttctttatgtcatatctctttaactgcttttcttttatcactgagaccatggttcgatatcctttcaattaaaacattgaaaaagttttttttctttttctgctagtggattgatcttcgagtgtttgagacaggggcttaccctgtcacccgtgctgaagtgcggtggtgcaatcactgctcactgcagccttgaccaccttgagcctctgggctcaagtgcctcccacctcagcgtcctgagtagctagaactgcaggtgcgcaccaccatgcctggctaattttttaatttt

SEQ ID NO: 99760 - DNA, 1096 bp, Homo sapiens
gctggactgagccacagttaagagactgttgcagtagactagactaggaggaggagaatttgaattagagcattggccttagcaaggggatcaaagagggaaaaagatgagattggtttgtaggctgaatgaatggaggtgaaggtaaagaaagagtcaataatttttggaagatagggtagatgacaaagttgtttaaagaaagcataaaagaaggggatttaatgacttaaatttttgatatagggaatataagtctgaaacatgggtctagccttgagctggaaatacagcttgggcagttagcaacatagagatggtagatgaagccacggatgcagatgtaattacctgtaggagtatcatggagaccttgatctagccaggacaatttcagggacagcccaggatttgagcaaaggacttgtccattgcttttattgagtctttcaaggttgatgatttattattgtttaaaaatatgagggagccatattatggttgttttaattatccttgtggatgggtatagtagaatgtcctaaatattaaaacatatagaattcatttataatgttatatcatttataatggttgtagctttattattatttttaataattaggacaaatgcttaatattttacattttagatcatagtatgagtcaatattcatgatgaatctttttctttgtatttctttcgaatttaagaaattagatcaaaattttctgatagagacgaaactttggaatgcagaaatatttttagtattggtgccaaaaatttaagtcacttactttaacacttagaaattacaagatcatatatggaaagtttgttattggtttggtgtattagaatcatttgtggagcttttaaggacaccaatgcagtgctggattccactcaagaggggtttgtgttagggccacatcatctgtattttttaaagctttgtggatattttgatgttaatctgagaaccctgtatcaggggtttgggtaggggctttgttagcatattttgtgtcttgcttatttagttaacctttttgtttaaagctgttaaagcaaaggccagaataccagcag

SEQ ID NO: 99761 - DNA, 1028 bp, Homo sapiens
ggaagaaaaatatctggaaacagccatgatgaaggaaatagcgtccttcttaaatattaaacatttttatatagtaacagatacttgctggtggcagtgctcatgcctgtaaacccagcattttgggaggccaagataggaggattgcttgaggccagaagttcaagcgtgggcaacatcgtgagactctgtttctacaaaaaataaatttaagaaatttatcgctgggtgtgagggctcaagcctgtaattctggtgctttgggaagccgagatgggaggatcttttgaggccaggaatttgagaccagcgtgggcaacatagcgagacctgtctttaccaaaaggaaaaaggatgacataaaattaagataagatttaggtatgttttgttcattcctgttggttttaatatttttctgtcttcttttttaatgtatgcaataagtatttgtttcatctaaatttatgcaatctgaatataactagtcattttctactggttatagtgtttgttaatgtacccattatgtttaatttgtattatattaagaattaagaaatattaatatatgaaaatatataaaatatataaaaatatatgaaattaatatagcagacttaagttttctttcttgatttaaattacagactaactggatcttctgggtttgtgacagatggacctggaaattataaatacaaaacgaagtgcacgtggctcattgaaggacagtaagtagaaatggctgacttaatttttgtttttttagcatagaagtcagtgtgacattagttttcccacaagtaaaattaacaatctgtagcataaagttcttaaaacattacttgataacctttcatttgacaagtgaattttatcttagccttcattaatttaaaagtttcatgttgatttaatgctgcaaatgaattgtacacaccacaaatttgtgtatttccaactgtaatagttcagaaacggttacacacacacacacacacacacacacacacacacacacatat

SEQ ID NO: 99762 - DNA, 1050 bp, Homo sapiens
atggtagtttattgttggcagtttgttttattcttttccttcccagacttccaagcatgaattcagcaactctgtaaagctcatcattaggaggctaccaagaagaataggatagtcctcccacccatgaggagctaacagttctgcacaaatctcctacctcctttaatttctttgactttatgagttatttattcttatcctcttattatgagaatccagcagggttgatttgatttcattacttgtacctcgggctctagctatgcagtgttgagcaaacccatttggactgaatccttaagtactgcagttacacttgtgaatgaactgagacagtgagattcttaaacttgtgtgggaggaagttatgctaagttaatggaagcgttgcgttgtgttaatgtaattttccctgctatttttacagttttgatatgtgtccaaataactgctcaggccgaggagagtgtaagatcagtaatagcagcgatactgttgaatgtgaatgttctgaaaactggaaaggtgaagcatgtgacattcctcactgtacagacaactgtggttttcctcatcgaggcatctgcaattcaagtgatgtcagaggatgctcctgcttctcagactggcagggtaggagcttctttcatttttattttttcttccatttatagaacattcccactaaataaattatagattgactttattcttagcacctatataatttatattaatcaaatacgaggtagcatttaagcttgaaacatccctctatctagctgcttatgaatttcggtttcatacatgtgtggtcatggtctttagaattatggagggttggccattttttgcatcctgtgtgtgaaagttggagaacttggactcagtcataaaaggatgtagcagagagccaagctgggagatgggacaagagctgacaataatgatatttcctcagaaacacactctaagttcagagaaaattggtgtcagttatacattagaatcttaaaggagttagctaatagttatctacagaaataa

SEQ ID NO: 99763 - DNA, 1127 bp, Homo sapiens
taaccaccagtctactctctatcttcatgagatccacttttttagttcccacatatgattgataatgtgatatttgtctctgtgcttggcttattttacttaacataatgacctccagttcagtccatgttgctacaaaatgactggatgtcattctttttaacggctgaataatgctccattgtgtatatatacaccacattttctttatctaattatccattgatagacacgttgattccatgttttggctattgtcaattgtgctgcaattaacatgggagtgcagatatctctttgatatgttcatttccattcttttggatatatacccagtatcgaaattgttggatcatagggtagttctatttttagtttcttgactaaccttttttaagctgagaataatattgagcttttgttcttctctgttctcagatttaatcttttcaatgtttttaaaaattttgtttgcatttttttcctaggataaaatttacatgtatggaggaaaaattgattcaactgggaatgtgaccaatgagttgagagtttttcacattcataatgagtcatgggtgttgttgacccctaaggcaaaggagcagtatgcagtggttgggcactctgcacacattgttacactgaagaatggccgagtggtcatgctggtcatctttggtcactgccctctctatggatatataagcaatgtgcaggaatatgatttgggtaggtatattttttccagtagatgccttttgaacatcagatttaaaacctctaagcttattattttgactgtttagaaaagttcaacctaatcttgattcggtactttatcttgaaacatagtaaacactgggcccaggcgtggtggcccactcctgtaatcccagcactttgggaggctgaggcgggcggatcacctaaggtcaggagttcaagaccagcctggcaccaacatggtgaaaccctgtctctactaaaaatacaaaaattagcctgtcctggtggcgggcacctataatcccagcaactcaggaggctgaggcaggagaatcgcttgaacccgggaggtggaggttgcagtgagccaagattgcaccactgcactccagcctggg

SEQ ID NO: 99764 - DNA, 1554 bp, Homo sapiens
acggccatagcagtgtttacgaccataggaccagggccctatacgttcatggtggctacaaggctttcagtgccaataagtaccggcttgcagatgatctctaccgatatgatgtggatacccagatgtggtgggtactttttcttgagctttcactttaaggtgtaaattctgtagaggcaattgtggagaaaatattgtgctatctttttgttttcatgcctggcagataattctgttcggcattatatatagagaaattgggaaataaacagagggtaataaagtagctagtatttattttgttacgttattctgtaattctgtagcaggttggttagaaaatacttagagttttttaacaaatgtaaagcaaatttgagttacgaaataatgtaattataaagcgatggtttctcctctttttcctcacatgtttgataccttgctatgggtactgttttatattctgtcataaaaataatcatttttagtagctgtgcaatactccattttgtgggtatgctgagactatgcaggtgaaagttttggtttctttctagtttttatgtcattaagaaaccattatgcattaagcttctgtcaatatttcacatgatttctgcccagaaactggaattatatagctacggggtatgaagagtttaaggttcttaatatattttgccaaaactcttacaggtctttaaaattatctgtatttattgttgaaaaacttacttttatgtagggaaaactctggaaggatttgtacatttgggtctgaggttaataaagtggttgtgcttgcattagcagatacataaatattctttaaaaactaaccttgtatttattatttctaaataaactcaaaaggaccattcttaaggacagccgatttttccgttacttgcacacagctgtgatagtgagtggaaccatgctggtgtttggaggaaacacacacaatgacacatctatgagccatggcgccaaatgcttctcttcagatttcatggcctatgacattggtaagtttcccaaaaccattttctcttcaggcatctttttgcctatactataagcagcatttaaaaggagactgaaaatattgccagttcaaaatgatcaggccatttgaaagaggtccaaatggtattttttatattcatttgactaatgttacacatctggtaaaaattatttctacattaaattctttttgaaatcactcctgttaattgcttgaatgctaatttttaaggctgagttgaggtgtctagtctctcctttgtcatgttatgcctacctggtagtgttacatagttgcaaccaccagcattgtgttaaaattggttcacgtattagctttatctcattccctagaaaactggtttctcacatggtcttggtgtggcaatataccagaccagaagagggcagtatttgttcatgcaaagcaaatgcataccggatgatctctttcataaaaattgtcagatgttcattttaaacaaattattatttttttgattgtggtaaaatacacat

SEQ ID NO: 99765 - DNA, 1069 bp, Homo sapiens
gtgtatggttttactatgagaacatttgacagctagagactaaaatggaaggatttctggccaccttgctaatttgaagtgttattataaatcataatcttgaacttcctcagtacagaagacccttaaagctttctagcaagtgcctcttgagattttcatctgaaacgcagtgggaccattttgtcattatcatgcctgtgggagcctggcctcaactgtcttcgtttgtgttcctagttctcctagcacaggatttggcacataatagacatttgctaaatggcaggtattagtacagtcataactagcaaacaaatgaattttttataaaacattcttaggttttattcaaactcagagaagttgagactttaccataaaatataatttaatcatgagtcaaaattgggaatgccttgcctgagttgtaatgttttcattttatgtgattccagtggtatgtttgaaccctgatatgtaagtatctgtgtgtgtgagacaggattgggtaggtggcaggagaccctgagggaggccagctactaaaaggccatagttttggtttaattttatgaaataatttactgaaaaagaaacttcgattcacagcatttcttcatgctttaagtggatcaacagcattgggtgagctgtgccttccttggttttcattgaggttttgagggaggcaggaaggaggaggagagatggctgtgacataccaaggcggcaggagatgcagctgtgcctctcagttgcctgctccatgtgtctctgagagactctccctaactttgcagagcccctgtgcaaccagatggattcacaattgctgagaacaccaactgtactgggaagaggaggttgcttatttggtttaagcaacaaattaactagttgaatctagcctgcttaatgtggtactgagtaagcctatagcaaggtaaaaaatgaaacctggccgggcgtagtggctcacgcttgtaatcccagcactttgggaggccgaggcgggtggatcacgaggtcaggagatcaagactatcctggctaacactgtgaaact

SEQ ID NO: 99766 - DNA, 2397 bp, Homo sapiens
cctgtctcttaaaaaaaaaaaaaaaagtatagcatccaattgttatctgagtctctagtaaatttcttctctccctttttcctcttagcaccatgtatgtgttcggtggtttcaatagtctcctcctcagcgacatcctggtattcacctcggaacagtgtgatgcgcatcggagtgaagccgcttgtttagcagcaggacctggtattcggtgtgtgtggaacacagggtcgtctcagtgtatctcgtgggcgctggcaactgatgaacaagaagaaaagttaaaatcagaatgtttttccaaaagaagtatgtttttttttctctacttagattttaatgaatttgagacctcattttatctgaattgtgaaggaacttagcatatgtatactttttatgtttaccttatccaaaattattcagtaataacttgtacaaagtgtttttggatatttgataattggtttgtaaacatctcggatgggaacatgccatgtggctcctagaagctgtctgcgagtgatagagacataaccgttttggcattgcataggctttgcatactgaccccagattctggctgcagttgctctgaggcagtgccatccagtagaactttatttttgatgatggaaatgttgtgtgtctggactgtcccgatatggtagccactagccacatgggctatcagatacttgaaatgtagctagtgtgagtgaagaactgaatttttaatttaatttaattttaatttaaaagacatttgtggttactggctaccatattggatgcagatctaacattaaggatgaagttaggagagtcagcccagaaaagccatgttgaagtaaatttttttggtggagggagggagagctgctgtccttgcaaagtatttttgtctagcgtctctagttggatacaacagtgatatcaagacagacagttactgaggatgggcgatgatccctgcttctagaacctcccccatgtttttcaagctgtttccgtccttctgcctgctttgcttcttgtcctatattgctgtgacatagagcacaatgcggtacagtgaagcgatatattaaaaatttattttttgttttattttattttatttatttatttatttatttattttgagacagagtctctgtcgctcaggctggagtacagcagcgtgatctcagctcactacaacctccacctcccaggttcaagtgattcttatacagtcacctgccaccatgctcggctagtttttgtatttttagtagagatggggttttaccatgttggccaggctggtctggaactcctgacctcaagtgatctgcccgcctcagcctcgcaaagtgttggaattacaggcgtgagctactgtacatggccagaaagttctttaaaagtaagaatgttgtctctacatcaattaatttaaagtatgttggctgaatttcttactagtaggattggtgttgcagttaacttgagagttatgatggatagaagcagctttcattcctgggatgctgctccaagttaaacttttcacgaatataaattctcagtaagaacacccagggccagccacaggggctcatgccggtaatcccagcactttgggaggctgaggtatggggatcacttgagcccaggagtctaagactagcctgggcaacatagtgagaccctgtctctaccaaaaacacaaaaattagccaggcatgggcatggtggtgcacgcctatagtcccagctactagggtggctgaggcaagagggcttgagcccaggacgttgaggctgcagtgaggcatgagtgtgccagtgcactccagcctgggtgacagaatgagattctgtctcaaaaacaaaaaaacaggccacccaggcaacccactcaggttcattggtgggctggtgggtgctggagaaccaagattaccagaacttagcagggttagcttgtctcttgaaagggataaaatcagtgaaatagttaatttttaaaccaaattttaaaagttcaaattaaatatgcatgtttataggaaatagtgttgaattaccttaggtgttcatatcaacccatttgctgtcatctcacctgagacttcagttccctgtttcaccccactttctgggtgggcccagtccttgggataatgaccaggacaggaagagcagcctaaggagccgactgctggggtctttgtgagagcggcacctgccttttcctgtttgtgaattcccccatgtgccatgtccacgagatggttgaacagatgagacaacatggttgtgcagcttctctcttttttttttttcagacagagtctcactctgtagcccaggctggagtgcagtggcgcaatttcagctcactgcaac

SEQ ID NO: 99767 - DNA, 1003 bp, Homo sapiens
attcttgcagtttttaccccagccctccaatatgcatattcatttgtctgctcttcacttaggattttagttttctaattgttcttcagaaggaagtgtaccagtctaatattggcaccaaactggtgttttcatctaagacataggataagtgacctcagaatatgctttttaggatccgggagatatcaccagtaaacattttaaaattcttgtattctgcatttggtccttaataatgtgtcagaggctcccacatcctaatgaagtacctagaatttaaattagaaaggccatttcggtattcagtaatttgaactcataatacagtagttttgtctgatttctaaaattcttttctttctcttttccccttaatgaaagaaaatatctgtggcattggctggcatttggttggaaactcatgtttgaaaattactactgccaaggagaattatgacaatgctaaattgttctgtaggaaccacaatgcccttttggcttctcttacaacccagaagaaggtagaatttgtccttaagcagctgcgaataatgcagtcatctcagagcatggtgagttaaaatcctcaaaacttaagtttctggttatccacctttctaccaagggcatgactgcagcttgcatgtggaaggctgtggatatgtgtgacgtgcttggcaagaaggggagtgctggtgaacgcagcctgagggactgtgggtttgtgctgtcagagtctcttcctcttaaaatttttaatactttgtatatataagatctatgaataattatatgggggatgaattgtaacatgtatatgtgtacataatctggtgacatcagtagattatttcatacctgttttacctctggattctgctaggggagaaagagaggtcactgataattagctaggttggattaagccacctgagttccttggagttaaggtattataatagtgcataagactgtataattaccactaagaagtgtacat

SEQ ID NO: 99768 - DNA, 1100 bp, Homo sapiens
ggtggatcacaaggtcaagatatcaagaccatcctggctaacatagtgaaaccccatctctactaaaaatacaaaaaattagccagacgtgatggcgcacccctgtagtcccagctacttgggaggctgaggcaggagaatcacttgaaccggggaggcggaggttgcagtgagccgaaattgtgccactgcactctagcctggagacagagtgagactccgtctcaaaaaaaaaaaagaaaagaaagaaagaaaagtctttgaccttagcggacatggtgggagctctaagtgtctctcttgggtttcattcccagcaaaccacagtgctaagcagtgccggacaccatgtgccttgaggacagcatgtggagattgcaccagcggcagctctgagtgcatgtggtgcagcaacatgaagcagtgtgtggactccaatgcctacgtggcctccttcccttttggccagtgtatggaatggtatacgatgagcacctgcccccgtaagtgaaaaagggagccctaggcacttatgcatgccctctgtataggcaacaactcagccatgaggctgtgctgtcagcctctgaacattttagaaacaagactggacatgacctctgctcaaacctgaccagagactgccatcgagaccttgctgcctattgagaaccttcatacagaatcaggcacattgacagtaaataaatgtaagatagatcacagagtacagaaataacttgtccaacttcagtgtcatattgctcaatccatgtaatatctccatatctgaatttcctaatttgtaaagtaaatgctttccaatagataatctctaaggtcccttttgccttcaacatcctgggattgagagaggagggaagggtcatctctgttatgtattgggcaaaatactgggctctttacattcattatctcttttaaataatcaagacagaataatatttttgactcaagccagttgaatagtctgttaaaaaaaaagtaaatacagtgaattcagatctacctgtgatagtcaattgcaactttttttttttaatagctgaaaattgttcaggctactgtacctgtagtca

SEQ ID NO: 99769 - DNA, 1030 bp, Homo sapiens
gaggttggttaaagtgatgcctaaaatggatagatcaggaaataacaataaaaacattaatgataaaaaggcaactgccagaagaactgaaaagtaacctagttcaaggtgggggtccctggagagaagccttcagaagagcagaggaagagcagggaacattgcttttcatgactagcctttcagtaccttttgatatttcagctaagtatgtagttctctaatgatttctaaattgttaatgagtgtgatagaataggaattctggagaatggtcaaaaggaattgctaggagaaaattagggaaagaaagcacagagcagtattgaggtgggaggttgggagcagacagatggtgagtgttcgtttgcatggcaggaatgagtggctgaatggcattaactggccatggggctctgaccagagcttgggtatacagtttctgtgccagcacaaaccagcattaggtgcgtggtgtgtgaggccgggtgatggtcatatggatctggtccagagctgtggtcttgacatagagttccatgtatgaactttggtggtggtggtggttttgtttcgttttttaagaaaaaaggaagagttgttttatgtcacagccaaactcaaggaggtgacagcacaagacccaggttagaatgtacttagccagggctcacggaatcttccatcctttgcaaagccaagaagagtagaggcctcaaggagaatagaggagcacatgggctccttctgggctgagctctcacccttggtggggccgctggtcccagggggtcgttgggagcctgcggagattctgcccagtacatacataccttgcgttttctcggagcctgacaggtgctgccttgaagcggaaagacttcacctcacagggtggccagctgtcctttctcttcctctccctgtcttgtgtgctcatgataatggatagatagacatctccatggtagaaataatgcagccctttctgcagtccatggttccacagcatatggtcagtagacttaga

SEQ ID NO: 99770 - DNA, 1101 bp, Homo sapiens
cttgtttatataattctccagtcttatctaaaacttttatgtgaggaccatggctcatattccgcagctttccttctctcaaggagctaggactggttattgtgataaatgaaggaaaagaaaagaaagtgggtttctgtttattgtatgaaattgatgtaactttgtatttctgattataaatggtagccagagggaggacacaaaaacttcaaattccaagccccataatatattatggcctgaatagtgttggaatttatttatttatggaatgtcaaaaagaaaatagggccatcaaaaaagcaaacagtggaagtctattttctggcccctgtgagtctggctctaaaaacagtgcaaggggttggggtttggtgggactaggaaagcagatgctcgtcatttaccttcctgtgtttgtcatgagaattgtctgtactgggattgtcaccttggtcagtaattgtttcgtttatagtaccattgtctctccaaagagggctgagttccctaaaaaaaagcaggcagcgcaccacaacatctggctagtagcacgtatattatcggtgatagtaaggacacaattctcgtatttaatcaatttggaggtatgcattttttcgtgggctaatatccctgaaatcatgatgcatcttatggtcagtgacttaaaaagcattatgtcatagttaaattgacagtgtttttcctaaattatacacagaataatgcctttttcagccaatgttattttagagttgatgaaatatgttgcatttttatattcttggtatgaagactattaactgtataataaaattatttaagttctgatgacgtagtgtcagatgatgttcagtgtagcaaaacgcgaggcacaattttttgtaaaaaggacaatatcttgcagtcagtacacactgagtacataaatgttgaccaaatgaagagcacagaatggggctgcccacctggaggcagagccatgaattggtactgaggcaaacaaggagagctttgtgtgtgggtggaggcgcagggagggagcgccaggcttcatggaggcatgcgagggtctccagggtcaaacagacagaa

SEQ ID NO: 99771 - DNA, 1114 bp, Homo sapiens
cccagcacttaagcacagaccccaaggagcattgctgcatatattagtcgagtaaatggacctacagctttaaaaaatgtaagaatgttggtattttaagaaaatatttataaaaatgcccttctagaacagagccatatctatccaggccaagattctgtcttctacagtagttccaaggaggcagtttgaagtaaggcctacttgtatcccaaggcataacctcaaagcttcagcatcatgcccagaaagatctctaatatccttaatgatatgtgaacggccgttcaccatgtgctaggcgctgtgctgtagtatctcatttgatcccagtgacaaccttatgggctaggaacacatttcagagggaggacacggatgcccagagacttcaaacacctttcttaaggtcacacagctgtagactattggagcaggagttcacatcaagcctccctaaatcccgagcccctgtttgtccctctactctgcaaaatttcacatttgtttgtttttagcttataccacctctctgaaggaagggttctttcagttcctatctgccgtataatgaggcataggtttttgttgtcctgtgaatccttggtgccagtttcagtaggaagaaagcaagcctgactttagtagtagaaatacgaggagatagagccacaccattttatgtatttgacaagtcgacgtcatagcattaaatccacagtacttttatttttatctttattttcttattttactttaagttctgggatacatgtacagaacatgtagatttgttacataggtatacatgtgccgtggtggtttgccgcacctatcagcctgttatctaggttttaagccctgcatgcatttggtatttgtcctaatgctctccctccccttgctccccacccctgacaggccccagtgtgtgatgttcccttccctgtgtccatgtgttctcatggttcaactcccacttaagagtgaggacatggagtatttggttttctgttcctgtgttggtttgctgagactgatggcttccagcttcatccgtgtccctgcaaaggatatgaactcatttattttatggccgcatagtattccatgg

SEQ ID NO: 99772 - DNA, 1055 bp, Homo sapiens
tctaccaagcactcaccactgccattcctgtgacctacagttatgaattagaatttcaaatcgagccaaagtacagcatccagaagaaacccacttggcgtggccccttccctacagttcaagcagccctctggaaggggactgcgagacctcagtggaaggtagcaagcagtaccacccgtgtcactggtgctcagagagtactgttagctctctcctgccctttttcattatcttaaaaactgcaatgtaccttttttatatacctgaaattgatggttcttataagcacaaatgaccgttaagttgtccgtatacattaaagcttgagtatcacttaaggtaattttgttttcttctgccagactgttcccaaacccattgcactggagccgtgttttggcaacaaagccgctgtcctctctgtgtttgtgaggctccctcgaggcctgggtggcatccctcctcctgggcagtcaggtgagtagatgcggtccagcgaaagacaccttctaagcatgtgagggagctaagcatgggatacttccctttcctagagaacaaggttataaaggtgataaccaacagtgcctgcccatgccatggcaaggattcagtgagataacccattttcacctatatgcccaaaactgttttcccgaggtcatcgtcccttcctggggggacgtcccgggacctcctcaccgttctggcctccccagcctctcagtgctcgtggatgcctctgaccacaccttcctttgctgtcggagtttctggtccccctttgcctctgctgctctttccctgtctcttttgccctgtcctgcccctgaatctgggtgtgctcccttcaccctgcatgttcttcctcagttgccttctccactccacaacttccagccatctcccctgggctggtgtttcttcaattggtatttctagccctcctgcatttcttttgctttttcactgttttaaatataaggcacaaacacaacgataacataaaggaaacgtctgaaaatccacgcacagttctgctatcccacaac

SEQ ID NO: 99773 - DNA, 1050 bp, Homo sapiens
gcctcccaaagccaccgcatcttggtccctgccattcccttagcctggggtgccggctcatcttttccctctaggatttctttagactcagcatatcttgcaaatgtccactaggtggtgctcactcatcgccagcagggagctaacaagccgctcctggggttgggagggcggaggtgccccacagcggggctgacagcctcagcggtcctcttcagcctccagggagccaaccacaggcctgcgtgactctccctgtcatctgcaccctctctggggtcctctgcccatccagccacccgcacagatctgtgtcagtccctgccccccaacactgatcccctcctcccagccctaccccagcctggcactcactggttcttctccagctcaagcaggagctcctggccttcagcctccagggccaccagccccatgtctggcttcgagacctgggcaagaaaatgtgtggagctgagatggtggcctccaggcctcctgcctgccagggagtaggtggcctgtggagccggctggggaggaagttcttggggagaacgtgggctggggagtcagcaggaccccccacatactatggagggcgtggaggaggtgagaacatacaaagatgttcccaaactcaggatgtttgcagtcctgacaacagccacttggaagggcgttggcacagcctgccaggcacaccagcatcctccctagagaccagaggtcccagaaaggtgcccctcccctggcccgccctcttctttcatgcccagaaggggcatcaaaagcaggggaagacagaggggtgctgaggacattatgggggcatcgggtagccatggtcagggcctcctcagagcctctgctacctgaggcttgtttccaaatgagctgctgctcattccctatagaattcaaatttgactcctccacttccaattttggcaaactgctccctcttccaaagttttcctgggcctccagcagcccccgtccctccggctccgacacctgcttcactggacccacgaagtaaacatggac

SEQ ID NO: 99774 - DNA, 1798 bp, Homo sapiens
gctcagcaagtcggggatgtggcacctctttgtgagcttgcactgtggcagcatggcaggtcccacactccaggccttgctccctgtcctgaacagaagtccatgagctcatacttccctgtacctgcccatggtgtgatggttacctccgtggggcagtaaccaagatgggagctgctgaggaactggtttgaagcctccagccttccctcctgcctccctaaccctctagaaaaacctgctggagctacacacaccgtgtggataactcctagcacccaccagtcccagaccttgggtttcaggctgctgttcctatcaggctcacttcaggccctgccccatgccccactcccagcctggcagaggctagggtgtcagtttcgtggagctccagcttcagtttcatgtccccgtcaccagcctcttcatgaccttgcccttcaatggattgacacccctcaggcctttacctcttgccatcggatctgctcaaagcctaccctgccctgcccccctcactcctcatcaccgcctctccctgccttccttttgggagaaaacagccagaccttcttttggaagcctgaattggaccctacttcattcactcttggagccacattggggtggcccacaggctggaggcatgtccagctcactgaagaatgggtttttgagacctgtgcacccctgctagggggaatgggtctctgggctccagaagggccatccctgcccctttcttgggggggcttagcatgcagtccccccatggtggtgggtaggggcccgtgagtgccaggggcaggatcggggaggctgggggaggtgctgaccaattgcccctgtccccgggcaggttatagtgtcaagtgtgagtactcggcgcacaaagagggcgtcctcaaagaggagatactgctagcctgcgaaggtggcactggcacctgtgtgcgcgtgacggtgcaggcccgcgtcatgggtgagagcgtgaggctcctggttggaggagggatgcacaagctcgactgcgagggtttctgtcctcctcagggaaccaaggctgaacaagggatccttgcccggctcaggggttctcaacctccttggcaggtccctacctccagctgatccctgagggaaggggaggggtccccttagtgggccgcatgggtggggccgggggccagcatggcactgacttgcaccctgccttgcagaccggcaccacggcacgcccatgctgctggatggtgtcaagtgtgtgggcgccgagctggaatacgactcagagcacagcgactggcacggctttgactgaggcccgaggccccgcctgccccgggcccctcagccttaaaccccgccttgtccccccgacatgctgcgtgatggtgtggcttcctcgcccctctctggggtgggtgtgggggtggagtggccttgcccacgcctctcacctctgccttcatttgtgctgccaccctgcccctccctcgtcctcctctcccacttcctcctctctgtgtgcctcagtctcctgccggaagaaatgggttgagcccgaaaggaggctgtctgaggaagggagagggagggcctggggtgggtcccccactccccaccccaagccacagggactcccaccagggtctgggagaggacggagctggctctgtggcgtcgtggccccattactgctgccttgcttcagccacctctcctgcccctccctagtccccactgctgtccaccatgagtaggagggaggtgcagtccccagcccccacccctc

SEQ ID NO: 99775 - DNA, 1048 bp, Homo sapiens
cactggttcttgttgcctccagcatttgttcctttaggggttgcagaatgacttagcatttggtcatttctttgttatttattagcaagaattctttccgaaagaagagctttccatcaaccaccagggcaatttggttacaagaaaggccaagagacaggctgaattcttcctctttaatcctcagctttcagagtaaagagggcactgctaccgtcagtggtgacaaatgagggcttttgagggcttgggtttgtttgttttgctttctctcttcttttctaataatctctgtgaatgcactgcttttatgtgttccatctgtttccatcagttgcactcattattctttttgatgctcagatggtcccagctcggcccattggaggcttcctggggcgcctctcactgcccctgtgctgaggctgccgttggggagctgaggcggaggcaggcctgagactcagggcagggtctgaatggggttcaggtgggggcacaccccctccacaggcatctgttttgcatatggccctgaccgatcaccaggagggaaagctctaagggcacgcttactttatgtggtcccctgttcttgcccaccatcgagcaccctgttgcctctgaccgcacccagctgcattgcttgtgtgacctgaataaggtagctccaggcccagcctttggggtcagcagcaccagaactggtccctggaaaataccaataaagtcctcctttccaggctgcccctcctgccagtctctgggggtgctggggataggagtcctatgctgttgctttggcacctagaagctgcagctcagcacatgctggcaggaccctgagtcactggggtatcaggaaggggtgagggctcttggtgaatgtgggcagtcggtagagggtgggcagaagcccccgtgctagagagtacaggcaccacttgggctgctgagagcggtaggggtttgagtccttcctaaagggagctcctctggtgtccctgagccatgggtccatgagtggccctgacccctgccctcccca

SEQ ID NO: 99776 - DNA, 1059 bp, Homo sapiens
cttaccatcagctgtgtaatcagctgtagtttgctgctttcctatctagaataatctccctcgttttatttttcttctttcttttttttttttcttgagacagagtctcgctgtgtcacccaggctgaagtgccgtggcgcgatcttggctcactgcaacctccgccttccggattcaagtgattctcctgcctcaacctcccaactagctgggactacagctgcccgccaccacacccggctaatctttgtacttttggtagagactgggtttcactatgttggccaggctggtcttgaactccttaccttgtgatccgtgaaagtgctgggattacaggcgtgagccaccgttcccagcctgctttctttttcttcttgacatttgaaaacaaaaacaaaaacaaaaaacaggtcagtcatcctgtagaatatcctgccttctgggctcgtctcattgctttctcatggagtcattaaatttgttcccctctcctctgtgtttttagcaaatgagaagttgaagttagaggctggtttagattccaggttaaacctttttggcaggaatcccttgtcagtgatgctgtgactttgggctgccttacttcaggaggcatcagtgtgacaggctgtcctgcagagagtagagagatagaccagtgtgtgactgggagaagtcacatacctccattgcaaacttgtgccattcctcttaaacaccaggtcctcggccaggcatggtggctcacacctgtaatcccaacactttgggaggccgaagtgagcggattgcttgaggtcaggagttcgagaccagcctggccaacatggtgaaaccctgtctctactaaaaatacaaaaattagctaggcgtggtggcgggcgcctgtagtcccagctactcgggatgctgaggtgggagagtcgctcgaacccaggaggcagatgttgcagttagccgagatcgtgccattgcatcccagcctgggtgacaagagtgaaactccgtctcagaaaaaaaaaaaaaacaaaaaccataccaggtcctctgtcagt

SEQ ID NO: 99777 - DNA, 1032 bp, Homo sapiens
accgttagctggtgcagctggggtgttttccgcgaagcgattgtccgggggcatgagtgcggtagtgagggcgggggcgtaatggggtcagcgccccctcctccccacgaccctgttcattgccgctgcctcgctgcatgaccttggaccagtagcatctctgagcctccgagcctcagcaccctcaggaaggagggcagtgatgtctgggagtgcgggctccggagactcctgcgtcagccgaggtgagtgaaggtggggagtgcacaggattatctccgagggacagagccgccgcctcgcagctcaggatggattggatgggggggatgtccgattacatttcccccctccccctgagatgacaagaatggggtgtggcgggggtgccacacccacagggatggctgccggagaggataaagggtcctacacctggacccttggggcctcgggggcttgggctgcacctccctcccggtggtatgaaggaggagggactggatttaggttctggacccgtgtttccattagtaagcagggactgagaaagggaagtctccgcttgcctttcttcttgaatcttggcactggaaagtggaggtagggcatttttctgctccggggagttgaagaaagtcggggcagcaccccatccctctcccattctggtcttttgtggagggaaaatgtagctggatatccccccacattctatccatcctgagctacgaggcagcagccctgtccctgggagataatcctgtgtgctcccaccctcaccttggctgaccccctggatccagcctggcctctgcttcttgggacctctggatcacaggcccagggcagggcctaggtggggcatgctatctggaggctaagcacccactagctgagggcaaagtggggagaatgctgggcagaggagggcagcacttgttggggaggcaggaaggtgtgggtggtgagggtcccttctccatattcccccacccccacccccagcacctcactgttagaaggagagag

SEQ ID NO: 99778 - DNA, 1048 bp, Homo sapiens
tgaggcgtgggatcgccaggagtagggaggacatcgacgatgtgcccgtagcagtcgcccctccctcctcgcgcacggggtactgaggcggaaggtttgaaggttacggctcagggctgccccattaaagtcagtgttgtgttctatttcctgtgcctgccttctctttttgcatctgaggggagccagtttcttcttcacttgtcctccatctccccacccccgccttgagtgaaagagctttctggacccagagtggatctcatcttgtgggtggctgggtcctgtgcggccacagcttggtaggttgatgatatcaccaggggtcaggttttgcacaggatgacagcctaacttctaaccctggccttagattgacccccaaacccaccctcacagtgttctccaaccttgtccaaacccaaccccaaaccagacttcaaattgttcccaaatgtggccacacactcaccctcaaccctacgtaaggactgacccctaactcggccctctgtacgactccaaccctgcccacagacaatcccaacttccatggattgaggccaggctttactcccaaccctggccaacacactacagccatggcatgaccctaactttaatggttttctgactaccagtaatgtggaacatttgtaaatcctgagatccagctgggcatggtggctcaggcctgtaatcccaccactttgggaggccaaggcaggtgggtcacttgaggccaggagttcaagaccagcctggccaatggtgaaaacccatctctattaaaaatacgaacaattagccaggcgtggtggcgggcacctgtagtcccagctacttgggaagctgaggcaggagaattgcttgaagctggggggcagaggttgcagtgagccaagatcgcaccactgcactccagcctaggcaacagaaggacactctgtctcaaaacaaaacaaacatcctgagatctaacaattccattcctaggcatatacccagcacatacccaagggaaacctaggctcttgtgttctgtgtt

SEQ ID NO: 99779 - DNA, 1050 bp, Homo sapiens
attcctccacttgccttgtctcaggtgtatcccagaaggcccgaggtgaaggtgtcccggacccccagggagggggtcagctcaggtaaagaagctgggagttccagacttcaccaggctggtgatctctgcacacagctggggttggggggcacggtacgctgagcctgagacgggaggcaggaaaggggctagagggggagaagggaaggcctggtcgagggccctggaagggtgagtgtagggcccgaggtccaagcctccgctaagctgcttcccaccccagctgggaccggccgccggcgcctcggcctccagcgtataaccgggcgttgcagggcgaccccagcttcgtcctccagatcgctgaaaaggagcaggagctgttggcctctcaagagaccgtgcaggtgaggggtctaggaaggctgcgggtgggggctcgcggccagcagaggccgggcaggagggagcagaccgccaggcttgacgcctgcgcggtgcggcttaggtcctgcagatgaaggtaaggcgcctggagcacctgctccagctcaagaatgtgcggatcgaagacctctcccggcggctccagcaggcggagcgtaagcagcggtgagcggcggcccgggccgcgcggggacgcccgggtacccgccagagccccgacgccgcgccggacccacccaccgatggatagaccattgggagggcggagcccgctgctctcacgagcctgctggggcccgagtgccctccttccttgggatgggtgagcgtgggaggagatgggacaggaactctaggagcgcaggcccgggactgagccgcctcctaccactccggagatccgggtcaggagaatggaccgctttccagagcccagaagccacgtgcagagacctagcctgtcccccaaagcagtgtccaacaccttgggcccggccttgcatctcccggcgctgggccttggggggcggtcccttggctctgtccacacccccagaatcaggtccccgcccagctccgaggacggcggcgtctccatcc

SEQ ID NO: 99780 - DNA, 1049 bp, Homo sapiens
aagccattctgggaagggctccagaagaaggtccagcctaggccccctgcaaggctggcagcccccacccccaccccccaggccgccttgagaagcacagtttaactcactgcgggctcctgagcctgcttctgcctgctttccacctccccagtccctttctctggccctgtccatgtgactttggcccttggttttctttccagattggaggtttccaagaggccccccaccgtggaagtaaccaagggcgcttccttgtgggcagctgcaggccccatgcctctcctccctctctggcagggccccatcctgggcagaggggcctggggctgggcccagagtccagccgtccagctgctcctttcccagtttgatttcaataaatctgtccactccccttttgtgggggtgaacgttttaacagccaagggtgcatccttcatggtctgggcttgcgtctgtcttgggggacttattcgtcctggctctctttggtccttgctctggtgggacatggaggcaagtgttgagagggttgccctgaccggaagaggggcaggaggagacctcaagcttggggtcacttggctggggcaggagggagccatcagtctctgggggcaaatcaatatgcacgtggggactaggcctaccgaggctggtttgaaggcctttgcaggagtggggtcaggacagaaagaaaggagtgttggggcagcttctggggtccagattggagtttggaggggcatataggtcaccctttggtttacctttggtgccttaagagggagccctttaggcctttcagtgattggcatatccaagcctggtggccacctctaggcacagtggcaggaggaaggtgaaattgctaggaacaggttgcacccccaagaggcagaggatggttggtaactccctgtgcagtgccttccagggggcccccagtacaaaggtgaggtcaggtccctttgctgatcctaccctttttcctttcagagccagcccctccctccctacccctcctcactgaggccctcagg

SEQ ID NO: 99781 - DNA, 2257 bp, Homo sapiens
cgccgcgcccgcgagccgctttgtctcgggcggggcgcgcgggagaggccgccaggtgccccccgccacgggcccgggccccccgccccggggcggcggcggcggcgccgggccccggggcggggggcgcgccgggatgggccccaagaggcgacagctgacgttccgggagaagtcacggatcatccaggaggtggaggagaatccggacctgcgcaagggcgagatcgcgcggcgcttcaacatcccgccgtccacgctgagcacgatcctgaagaacaagcgcgccatcctggcgtcggagcgcaagtacggggtggcctccacctgccgcaagaccaacaagctgtctccctacgacaagctcgagggcttgctcatcgcctggttccagcagatccgcgccgccggcctgccggtcaagggcatcatcctcaaggagaaggcgctgcgcatagccgaggagctgggcatggacgacttcaccgcctccaacggctggctggaccgcttccgccggcgccacggcgtggtgtcctgcagcggcgtggcccgcgcccgcgcgcgaaacgctgccccccgcaccccggcggcgcctgccagtccggccgcggtgccctcggagggcagtggcgggagcactactggttggcgcgctcgggaggagcagccgccgtcggtggccgagggctacgcctcgcaggacgtgttcagcgccaccgagaccagtctatggtacgacttcctgcccgaccaggccgcggggctgtgcggaggcgacggacggccgcgtcaagccacccagcgcctgagcgtcctgctatgcgccaatgccgacggcagcgagaagctgcccccgctggtggccggcaagtcggccaagccccgcgcaggccaagccggcctgccctgcgactacaccgccaactccaagggtggtgtcaccacccaggccctggccaagtacttgaaggccttggacacccgaatggctgcagagtctcgccgggtcctgctgttggccggccgcttggctgcccagtccttggacacctcgggcctgcggcatgtgcagctggccttcttccctcccggcaccgtgcatccgctggagaggggagtggtccagcaggtgaagggccactaccgccaggccatgctgctcaaggccatggccgcgctagagggccaggatccctcaggcctgcagctgggtctcacggaggccctgcactttgtggctgccgcctggcaggcagtggagccttcggacatagccgcctgctttcgtgaggctggctttgggggtggccctaatgccaccatcaccacttccctcaagagtgagggagaggaagaggaggaggaggaggaagaagaggaggaggaagagggtgaaggagaggaagaggaggaggaaggggaggaggaggaggaggaagggggggaaggagaggaattgggggaggaagaggaggtggaggaggagggtgatgttgatagtgatgaagaagaggaggaagatgaggagagctcctcggagggcttggaggctgaggactgggcccagggagtagtggaggccggtggcagcttcggggcttatggtgcccaggaggaagcccagtgccctactctgcatttcctggaaggtggggaggactctgattcagacagtgaggaagaggacgatgaggaagaggatgatgaagatgaagacgacgatgatgatgaggaggatggtgatgaggtgcctgtacccagctttggggaggccatggcttactttgccatggtcaagaggtacctgacctccttccccattgatgaccgcgtgcagagccacatcctccacttggaacacgatctggttcatgtgaccaggaagaaccacgccaggcaggcgggagttcgaggtcttggacatcaaagctgagtcactggacctagctgtgcccccaacctagattggcagcaccaccccagggcagaggactctctgggcacccgctgtgcatggagccagagtgcagagccccagatcctttagtaatgcttcccctggtcctgcaacaggcccggtcacctcggccgggcccggggctgaggtcagcctcactgcctgcttattgcctctttctcagaatcctctttcctccccatttggccctgggctcaggggaccaggtggggcgggtggggagctgtccggtgctaccacaccgtgccctcagtggactaaccacagcagcagcca

SEQ ID NO: 99782 - DNA, 1048 bp, Homo sapiens
cgtttgtcactgggggtctactgtatcagactggagctgactgggggagccctaaagcaggccccagtcctcagaggaccgggagccaggccagctcctcacaggggagaggaagcctagccttgctgttgtccaggccctggagacacccacattgctgggtgcccctggcctatcataggatggatggatgcctttcctggcagccatatggccccgctgaggtgatttgcatacaggtggaaggcctggtgcaggctggcgagactgttgccttggtgacgcctccctgaccctgacctgccccagctgtctctatcactgccattctctgggctttctttcattcagggcagcctttaaaattccaagctgcctcttatcttccccctccccaatacctgggccccctgatggtgggcgttcttcccaccccaccccttccactgccttgagccttggcccttgtctttgcccttactcccccctggactgggggcctggtgctggggtgggtgatgggtgcggagggagcatgggttgcatgggacccttctctgtcctaggtttgaacaggccatccaggcagccagccggatcattcgaaagtaagtgttcctgggcctcttccatctaccacaagctttcccttaggacagggctccagaagggcatgctgcatgctcttggtccctgccctgcctctcccagctctcacctgtccccatttcctcctgtagcgagcagtttgccatcagacgcttccagtctatgccggtgagtgtcttcgaggcctgactgaggcttaggcatgctagccaggcatggggtagatgagcaggatgcattcagggatcacctcccagctgggtgtccccaggcaggctgtaggagatggggtttcagaggtaggtaggtaagtgggaggagctggaggagaggtggagaaggtagggcctgggctcgtgccggaggaatgcagccttcattcctctgcctgccgccctgcctggctctctaggtgaggctgctgggccacagccccgtg

SEQ ID NO: 99783 - DNA, 1014 bp, Homo sapiens
tgtcccaggcccttgggcgtaagaggcctctcccacgcagcacccaacccatacccagcctgcccgccagccaaccttggcgtccctgccttgcgcctacctacccagcagtcccccgcccgctcccactcccacaggcccagcgtgcacgtctccaggataggcatccttgcccctgtgacttcagcggcacccaacgtttattgggcactaactgtatgccaggccatgggggtgccggagagaacgacacgaagaccctcacccctcaaagttcccagggggaggaggggctgcttcacttgggaagcgtggggatggaattctcagccccccgatgactccgaggccggccacctgcctggtttctggccggacaccggacttcccctggaagttgctcgagactgcgcgcccccagcaaaaaatcaggtcggttctccgagcccagtctagcgcttcccgacccgcaaaccaaggcccagtgaccgtccccgctgcgcagccgcctgcgtcgccagccaaccacgcgcggccgagtagccccgcccctccacatggccaatggccgcgcgctctgcccgccccgcctcctcgctgcgggaagggtcctgggccccgggcggcggtcgccaggtctcagggccgggggtacccgaggtaagatcgcttcccgggcgttgggtcctttcggctcagcacgcacggacgcctttagggaaggtggctgcagcggcaggacggagtccgccgggacgccctgggtctggggtgcgcggggggcccaggaggggacaggacgcgcggggatccggaagagcgggccctgtcgcaagagtttcgggaacactgagggctccaggcgccgcatccagcatccggggaaaagggggtaggtggcgctgggcgtctgctcaggctgggggaaaggtagggccagaaggggacgggcagcggccgctgacctcctcctgccgcccgcgggcccagggtgacgctaaggtggggccgagc

SEQ ID NO: 99784 - DNA, 1070 bp, Homo sapiens
tatgtctcttcatgtgtggagattaatagtgatccctggctgggcacggtggctcacgcctgtaatcccagcactttgggaggccgaggcgggcggatcacaaggtcaggagttcgagaccagcctggccaatatggtgaaaccctgtctgtaccaaaaatacaaaaaaattagctgcgcatggtggtgcaagcctgtaatcccagctacttgggaggctgaggcaggagaattgcttgaaccggggaggtggaggttgcagtgagccgagattgcgccactgcactccagcctggatgacagagtgagactccgtctccaaaaaaaaaaaacccaaaaatagtgatcccctgaatacaatggctgtggtagggcctgatgaggggtgggggcaaaggggaggggctcaggtggcagcatcagggcaggggtcagtgagcaatgatagtcatgtggaggagaaagccactgggtcctaggatgcctggggacagagaagagtgactgctgacacggcgtgggtgactagagacccacgaggcccccccatactccccttcctcccttgctaccttgtcctccatctgctctcaccctcccactcctgcccccttgccaagtgatgcttgtcactccttttttttttgaaatggagtttcgctctgtcgcccaggctggagtgcagtggtgccatctcagctcactgcaagctccgcctcccgggttcacgccattctcctgcctcagcctcccgagtagctgggactacaggcgcctgcaaccatgcccggctaactttttgtattttttagtagagatggggtttcaccgtgttagccaggatggtctcgatctcctgacctcgtgatccacccgcctcggcctcccaaagtgctgggattacaggcgtgagccaccaagcccagccctgcttgtcactcttgaggagtgggcccacatcagaacagcttttggacctatgggtggggcggggggtgtacccaagagcacccaagcctctttaatcatgaggagaacccccaattcctttttttttgagacagagtctt

SEQ ID NO: 99785 - DNA, 1043 bp, Homo sapiens
atggagttgggttttgattcctggtgtcttgacttcagatccagtgttcttggtccacattttggggtgggggaaggtatgtgtgatgtaatccagagctgtggttctcaagtttttaaaactttccctcaacctaccattgcatgatataggtctgcaaaggggtctaaaattatattttaaattttattgaggcataattaaatagagtaaaatgtacaattttggcaaatgtagacactcatgtaacaagagaacatacatttttatcaagggctccaggtgttgagcatatgtgcagcaggtgtgcagaaggtgtggaagccctgtgatcagagtgctccacagtagtgtggacaacaaacttatcctttgaagatgactcgcaaggcatgttgtagcatgccagggagacctttggggcttgttgattttggactcctacaaatctaaccttcataatacagtttttgtttgtagcttgacaacactagcctagaaaatggatcattttttcttggctttccgaggagcgttgctgttggcagtatggaactggagccggggccctgttaggctgcctttattaggctcagcatttcagcttcagggaattaggacggattgacccctgggagctgaggaaaaatgttagattgctatagctttgtggcccattgggagaggcaagatgggagttttttttttgtttgttttttgtttttttttttttttttttagaggagtttcactcttgttgcccaggccagagtgcagtggtgcaatcttggctcactgcaacctctgcttcctgggttcaagcaattctcctgcctcagactcgcaagtagctgggattacaggcatgtaccaccatggccaactaattttttgtgtttagtagagatgggatttcaccatgttggtcaggctggtcttgagctcctgacctcaggtgatccatttgcctcagcctcccaaagtgctgggattacaggtgtgagccaccgtgcctgaccgaaaagatgttgtttgtttgtttg

SEQ ID NO: 99786 - DNA, 1884 bp, Homo sapiens
atatcagattttgaaagataaattgaccattggaggttatatgttacataggtttgggaatttcctgtttctagtttgctgctaaaccagaactctgaagtctcaatgtttttttttaagccgataggaaagagagattttcattctgaatctttgtttttcacagttgaggcttacgagtagtcatcttgttatttttaaaacacttcatagtgcggtttgcgcttgtctgacagaatggttgggttggctcaatactttgatatttttctttttcgtctttgccgtagtattttttttttaagttatgcatctaaatcaagacagaatcacatttctttgccccaaaacccttttgcctagaattatgttctttggaaaccctagcgtttgaaataagttgctactgtggtaagggtaaatttaattttcagaaaaaagctgttctgacttatttttcttccccatttagtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacagtatgcattttttagcttatatacaatttatggtaatttgattgttaaaaataatgccagtagcaagtggtgaaataatttccatctctaatggaacttgaattttcttgagtcaaatgaagattaaaggtacgctagtgataggagttggccatctagaggtggttgtctagttcagatgtatggacgacaatcagaaccactaaaagggtagcattttattgctcctttagtatgaaaaattagggcatctgctatacgttgaggaagaaactacctaaaaggaacatcattagatcatgaacaatgagattgaaatataattaaaatcatttcatgtcataaaattgttttcagtcttgtctaccacataatttctcttgtctccctcagttgtttgctggcatgttcactaactgaaaaaaataaggaactctggtcaaaagtggtgttttcaggctcagggctggtctgagatgggtgactgcagagccctcctctcccagaatgctttctgatgtgttctgtgctgcacacttaactggagtctcgccaccatgtctggcccctggggaatgctgccaggcgctctatcttgctttcattgagtgaacactggagaacattgtgagcaagaccttgaggctaggtcctttcagggtggatggtgggggtaggccggagaactgacaaatgaataagccaagatcctgaccgtcagggtgcaatacagattgaaaatgtcttcagtgactgactgtttttctgttgctaaatgagagaatattagtctgaaagagattctgcctttttgttttgttttgttttcttgagatggagttttgttcttgttcccaggctggaatgcaatggctcaacacaacctccacctctcgggttcaagcgattctcctgcttcagcctcccaagtagctgggattacaggcatgtgccaccacgcccggctaattttgtatttttagtagagacagggtttctccatgttggtcaggctggtctcgaactcctgatctcaggtgatctgcctgcttcagcctc

SEQ ID NO: 99787 - DNA, 2344 bp, Homo sapiens
gacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactaggtaagttgtatataaaactcactgtttattcttagtatcctaacgggctgagttttcaggtattacatgtaactacaccttcaagaacctgttaggtgaaagtgtttctggattatgcaaacaaatgtttctctttgaaaattctgattttatgacctagttttctttaatctctactgttcaagatttattatcctaggtgtttcttaaaagatcacatcagcagactcattgtagcctttgccctcagatagtttatggtgtgcatacacaaagtagctaaagttattaggcagcatctgtaaggagaaggcacgggaaaggacctagctctgaaacctgtgtaaatttcatgcttccacacacatgtgtgtgtagaataatgatgtattctatgtatgtgatttagaagttgatatgtactgatcagtagaaaaattattgagggaaggtagtatgaaaagagaggattagccgggcgtggtggctcatgcctgtaatcccagcactttgggaggctggggcgggtggatcatgaggtcaggagttcaagaccagcctggccaacatggtgaaaccccatctctactaaaaatacaaaaattagccgggcgcagtggcaggcgcctgtgaatcccagctactcgggaggctgaggtgggagaattgcttgaattcagagggtggaggttgcagtaagccgagattatgccactgcactccagcctgggtgacagagtgagactccgtctcaaaaaaaaaagaaaagagagtattagggccaggcacggcagcttatgcctgtaatcccagcactttgggaggccgaggcgggtggatcaccagaggtcgggagttcgagaccagcctggccaacatggagaaaccccatctctactaaaaatacaaaattagccgggcgtggtggcacatgcctgtaatcccatatacttgggaggctgaggcagaaaaatcacttgaaccaggaggcaaaggttgcggtgagccgagatcgtgccattgtactctagcctgggcaaaaagagctaaactccatctcaaaaaaaaaaaatgaggattagatggaagaagagaatgtttcggcttaagggtcagaggtcacttcaggaaaaacaggcatctagggattgggataaacaatttttttaaaaaaacagttgtgatttaaatagaggagtaatttttttgtgacaaaacacgttgcaggaggagtatgtttgggggtgtactgataagccagggtgacaaggtgcttggatgagaatgactcagggaatgtacttggagaagggaaagggaggaggtgttagcatggccccaggcgtgtcaggctaatttgcacctgaggctcttcatacttggcagacagccagactgcactggggacatgggccctgtgttttgtactttgcatgttggctcacatgcatatgtaccttaaaggtgtatatcaggcaccttatcttttcacagacttgtttcctaccagtggcatttgcatgattgggttggatatgtgaatatggttttggggttcataaatgttaacttcttgttcttatttttaaaaatgttataatactgtgttaattgtttttaatcatagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaaggtaagggggcatgtgtgttctaagaaatacaggcgggccgggcgcggtggctcatgcctttaatcccaaaactttgagaggccgagatgggcagatcatgaggtcaggagtttgagaccagcctggccaacatagtgtaaccctgtctctactaaaaatacaaaaattagctaggcatggtggtgcgcgcctgtagacccaggtacttgggaggctgaggcaggagaatcacttgaaccctggaggtggagggtgcggtgagctccagcctaggtaacggagtgagactctgtctcaaaaaaaaaaaaaaaaaaaaaaaagacataaaataataatattgggcatattttttaaaaaagctctattgagat

SEQ ID NO: 99788 - DNA, 1050 bp, Homo sapiens
agtttaccagatgtgcatgtggccatctgagtggaacagctgtgcagttgagatgaattgctgttagaggtgttgtcctggaactgtctggttgcaggagcaatggtgccttccagtgcatctgatgagattctaactgaatatgtgaatatctggtatccaagctagatttcagtagaaaccgcagggaaagctgtctgctcatttagaatgttggagggctctgtttgaagtttgcatttctctttgaacagatgctccattgcaaaataaaaggtttgaagatttcaacaatgttgccctaaaagctaattttatttcaataaagtaacattcaagttctgttgggctttgttgctgttggtttagcaatgggattttttttcccccatcacagctttggaaacatgatgagcaaggagaagcgagaggctgtcagtaaagaggacctggccagagcgactttgatcaccatcaccaacaacattggctcaatagcaagaatgtgtgcccttaatgaagtaaggggacatggatttctttaattgctctaaggaaaatactgaacttaagtgggccccatcacgtctgttttctcagaacagtgcctaaatgtagtcatttggggtggggtttgttttagcacgaagttaaaactcttcaaatacagattaatcttcttttttttttttttaaactgaagataaacattgctacttgtctagaggtaaaatgacatcttttgaggagaaagtagaggaagagtggaaggtagccagtgttccagatattggggactgttgggggtgatgatggataacgatgctgaatgtagactccacactcactgctgagctctagaggccctagggaggaatccagaggaagtcacggaagctgggagaagactgagcaggccgaggggtgccctccttggctcccccacctcagcagagctgcgtctttgtgctttcagcttctttacagtgctgccttgtagcattcaggtcaagcagcattgtacagggctatgaaagaaccaagaatggg

SEQ ID NO: 99789 - DNA, 1033 bp, Homo sapiens
tattctttggttgaattttattcttgatatggggcttaggagtgagatttctggtctacagaaatgatcatgctcatgaattttgacatttatcgtcatgatgctttgcacaagggctgcaccaatttagatcatctttagcggtgaatgagtggattaattttactacaactactgatggtggtggtggaatttcagttgcttttttttgcgaggttaataggtctaaaattttacttttgtttgatgactagtggtttgaatttttcgctgcctgttatattgcttgtatactttgcctgtttgtgtcactgtccttttggattggagtcatactgtttttttttgtttattttaacttatctgtataaaacattgtattcaaaactagttattgttggtcagatttaatacaaatgtttttcctaatctgttttcttctcctgtgacattatctagcatgctttgcagtgggtccagagttgtctggggatcaagtttaagtagccctggaccaactggactaaatttgatcagcagtcaaattgttgctaagagctatgcacatggtgctgtatttggggtagcttttatgagaaaatagaaattaagatgaaaactaattgcctttttttggtgtgctcagaacattaaccaggtggtatttgttggaaatttcttgagaattaatacgatcgccatgcggcttttggcatatgctttggattattggtccaaggggcagttgaaagcacttttttcggaacacgaggtaagctgacttgttcgttgtggtatattatgtacacagagggcttgtgggtcacactgtcatggaacttgaggtagagggtggaggtgaaatgggctgcagtgtttcttttgttttttgtttttttgagacggagtctcgctctgtcacctaggttggagtgcgtggcacagtcttggggctcactgcagcctccgcctcctgggttcaagcagtcctcccacctcagtctcttaagtagctgggattacaagtgtgcgc

SEQ ID NO: 99790 - DNA, 1090 bp, Homo sapiens
tggtgtattttctttcagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaaattaattgggcaggttaattgtgtacctgaaacttaacaagcagtttttggaagggcagttccacgttactttacactaaatcctgggaatgaatgtctggagagacagggcttcttttcttggcagaatttccttgggtagtgggcggactgttctgatgcaagtgggtacactggcagaagcagcacaatctggaggactaacatgagtcagcagggccactagaattgacaccccctcaggggatcagggagaatctggtttttctttcaggctaagtagaaaaggaagaactgaagtgtctgtcaaagaactcatggggagtggggggtccttcagggcactgtggcacttgggaggtgagtctcagaagactgcctgaggagagtgccaggctgcaggtgctcttggtaggggctgaagcttttctttctgctttgcagaataatttcaaaagcctttcccaaggagagaatgcaccttttatatctgaggtcttaagtggtgcccatattgc

SEQ ID NO: 99791 - DNA, 1281 bp, Homo sapiens
aaaaaattctctatcacatccactcttctggcatttgtagaatctctggccctgggtgtgtcttttcctgtagctgttacagatttcttaagcagatttcttaagcagatggacatgtccagattcatgcctaaatatccagttgataactggaaaatgctggttcacggttctttagtaaagattaataagggatccccatgtgctggggagtgtgcttccatttgagtggggatatcagaagaaaaagaggggcttgtgtagtaaaccttactttgccaattcagctgtagagcccaaattgttacaagatgcaaagatgtactccactttttgaccaagcatcagcacctttggcttaccatccagtccttacttctgtgactgtaagggccccaccagtgtcagcagacttgtttgtgctttgggggaactctcttctcagctccctttgccagtcccaagcctggtggatctgcatctcacgcccactgcacaccgttcctctccatctgcccttccctcccaggcccccggtcgggggagcaggtgtggcaagtgttaggaactcccttctggtgacagctggtcttcctagagtgttgctggtaactatcgcctcttggtcttctgacatcattgccaggaacggggcactttttcgtcttgtagtttggccctcgggtttcctcactaggtattgtgtaactccctcaaaaaaaggtttatgaaatgctgaacctcaggtttcatagacgtctttgtacactaaaaattctgcagcagaatatttttaaacattcgcagttttttgtaagctatatttttgtatatttaattgctattttaaaattttaatgcattttgctaatcactcctcaaaaataaaacatgcatgtaattgactcaaacgtgtaaataaaagcaaattttgaaaaatagtgttgtgcatatgcctttgaacagagggaacatccatgtgccacttacgcaagcaccttcagcaagacttggaaactcaaggtgagtaattctatcagagctggtaactagtactgagtgattgtgatggaagcccctgcccttcctgtggcatagtgtgcaagcgggggtggggtcagtggtgaagagtgtgtcaggccaccacagccagagaacagagaatcctggaatgcagagtacagtggagtctgaagccccctggcctccctgagctctgcaaacagctggatacagataagcagtcttccacgtgaacgccagcaccagggtgacctgaaa

SEQ ID NO: 99792 - DNA, 1060 bp, Homo sapiens
attttaaaatagcaattaaatatacaaaaatatagcttacaaaaaactgcgaatgtttaaaaatattctgctgcagaatttttagtgtacaaagacgtctatgaaacctgaggttcagcatttcataaacctttttttgagggagttacacaatacctagtgaggaaacccgagggccaaactacaagacgaaaaagtgccccgttcctggcaatgatgtcagaagaccaagaggcgatagttaccagcaacactctaggaagaccagctgtcaccagaagggagttcctaacacttgccacacctgctcccccgaccgggggcctgggagggaagggcagatggagaggaacggtgtgcagtgggcgtgagatgcagatccaccaggcttgggactggcaaagggagctgagaagagagttcccccaaagcacaaacaagtctgctgacactggtggggcccttacagtcacagaagtaaggactggatggtaagccaaaggtgctgatgcttggtcaaaaagtggagtacatctttgcatcttgtaacaatttgggctctacagctgaattggcaaagtaaggtttactacacaagcccctctttttcttctgatatccccactcaaatggaagcacactccccagcacatggggatcccttattaatctttactaaagaaccgtgaaccagcattttccagttatcaactggatatttaggcatgaatctggacatgtccatctgcttaagaaatctgcttaagaaatctgtaacagctacaggaaaagacacacccagggccagagattctacaaatgccagaagagtggatgtgatagagaattttttctcaagttttgggttagggcaccagttgcaattttaatccaggggaggatctgggctgctgctgtagggggcaagtacaccagggaggtgggtgtggacagaggcactgggcagctgctgggaagcgaggcacaagtctgtgcccctactcccagggctgcctggaggaagcagctctaactttcatcagcggggacaaaaatgaac

SEQ ID NO: 99793 - DNA, 1074 bp, Homo sapiens
ctatgggttagtggagcataactcagccccaactggactccacgggtggctgaaccattagtagttgctaggggtacaactgaattcaactgccttcagaaacagggaacaaaaccagcctgacttgattcctggttgggtcagtatcagacactaggaagttgacatctgctgcttttctttgccacgtgtgatttggttaggcctgtccctggcagataaggtccttgaagcctatgcttgcctagccagggaaggcaggacagaaatggccaaataggggcaggtggcccctgggaaggtctgagctgagggatacaggggacctcccaccattgccggataccctgttcttgacaagaagatccttttccccagtgccaagccccttggatccatcagagaaatagcctcgggccttgtcctttttcacaaccccacttcaaaatcatgtcatctccctggcctgatcccgctctaagctactttgaacaactaggaattatttttctcagaggctttttgggcattatgaaatacatcctgatacatccagggcagtatacccagagctccaggcagagagtgatggaatcacctcttgtcactcactagccttaggcccttctgcaggttagcctctcagtctcttccttagcttccttagctaccacccagggattgtagtaacgtccctggcacctcttgtgggggttagctggtgcccagagcctggtaggcagcaggcctggtgtcatgggggctgctgataccacataacatcatctgggttacatgggctcctctgccatcatgattgataggaacagaacctcagccaaaaagcttcctgagctgtaggggctttccctgaggcccaggttcacctggcccctttcttccttggtcatctctgcctttgcccacagtgaactctgacttggttgttcagtgctgaatatttctttcttaatgttttgaataggtaatccattcatgtggttcacaaatcataaagtagttaaaagcctttcttgagttcctgatgcctagcaagctccgctcctcactcca

SEQ ID NO: 99794 - DNA, 1852 bp, Homo sapiens
ccccctgtggtgtctccttctgcaggtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtgggggaagtttttcattaggaatacagtctgcgtgacatggagaatggatggagggagctttgctactctgctcttggcatgactccaggatttttttctggaatccaacctctgtcctcttaggagaaggaacctgtccttggttcagatggctgggcatgaggaggaaaatttccattagtgtagaacagtgctggacagaatccggtttggaaaattacaaatccagttggtcaaaataggccatttcctatgtgtgacctattcgtggtatgccaactggactgctt

SEQ ID NO: 99795 - DNA, 1046 bp, Homo sapiens
gattacattgtaatgttagatttcctgtattctaattagttgcctaatgtagtgtcataagtatctatagtcttagcaaaagccatatttttctgtccaggtgcagtggcttacatccgtagccccaacactttgggatgccaaagcaggaagatcacttgagcccaggggtttgagagcagcctgggaaacatagggaaaccccatctgtggaaaaaaaaaataattagctgggcgtggtagcacatgtctgtggttcgagctactctggaggctgaagagggaggattgtctgggcatgggagtttgaggcgacagtgagccatgatcacaccattgcactccaacctgggcaacagaacaagaccctgcctcaaaaaaaaaaaaaatcctgtatttttctgacctagaattagaatccatgatctgttattctaaatggtctgtgaatacaaaataatttaaaatagtactgacctacctagaacatcagtatattggaaggtttcagctgtgagtgacagaaaacctgaaacaagtggcttaaaataagattaaaatgtatttcttttttttttttttttttttttgagatggagtcttgctctgtcggttgcccaggctggagtgcagtggcgcgatctcggctcactgcaacctctgccacctgggttcaagcaactctcctgcctcagcctcccgagtagctgggactacaggcacccaccaccacgcctggctaatttttgtatttttttttttagtagagaatggggtttcaccgtgttagccaggatggtctcgatcccctgacctcgtgatccgcctgcctcggcctctcaaagtgctgggattacaggcgtgagccaccacgcccagcctaaaatgtatttcttattcatgtaaaagttggtacagatctggaatggagcttcatggcatcagggacattttaccacttactcctagttctctcttaccactctgccctcctcttgggtgtaaacctcatttttattgaggaaaatggtagcacctattgcagg

SEQ ID NO: 99796 - DNA, 1112 bp, Homo sapiens
tgcttgagagtgagcctttcgaagagatactcgcccagcccagcctctgggcctcccagcctgtggaggttcgtcaggtggtcacccatcttcttgatgagcttcacttcctcatctaggaagtgagtctccaggaagtcacagagatgggggtccatgtgggcagaatccagggcatgaagatccaaaagggcctggttcagctttttctccagggccatggcagctttcatggcatctggggttttaccccactcatcttcagctggcttcttgatgtcctggaagagagcgcggccgccacgctggttttgcatcttcaggagacgctcgtagccctcgcgcttctcctcggtcaattcgcggaagaagtggctcacgccttccagagccgcatcatcgcggtcgaaatagaagcccagagagaggtaggtgtaggaggcctgcaggtacaaattgaccaggctgttgacggctgcctccacgtcggtggaataattttgacgaatctgggagctcatggttggtcgccaagaaggagctaacgacaaaaacggtgctggcaggtcccagaagcaggagatagccgagaagatggtcccggaggttgcaagtggagaggaaattggagggcggtcggaggctggaagaccgtccccggatctgttccgtccaaacactgttgaagcaagagacagacccactggaccgccgaactgcctatcacctcttattcttaaaaataaatcttggtttcctccaacttgcctttttctgtttattttaattattagtttgcttgcttgttttgacttgtttttattgttatttattttctatcttccatgttagcagctttcctcagatatttggtaatctggtaatctacagtagatgttattggtgttctgcccataccttcagctgctataaatctcggtcataaatagaccagagctgccactttatctaaagaattgtcctcaagtaggaactaccttgcctgggaattcatggcttcctccctggcagcccacagccagtgattgatcaatatatggatacaaaagctggccctcttgcttcaaggtgagatcaaccctgtggtgcaa

SEQ ID NO: 99797 - DNA, 1254 bp, Homo sapiens
gaaagctgctaacatggaagatagaaaataaataacaataaaaacaagtcaaaacaagcaagcaaactaataattaaaataaacagaaaaaggcaagttggaggaaaccaagatttatttttaagaataagaggtgataggcagttcggcggtccagtgggtctgtctcttgcttcaacagtgtttggacggaacagatccggggacggtcttccagcctccgaccgccctccaatttcctctccacttgcaacctccgggaccatcttctcggctatctcctgcttctgggacctgccagcaccgtttttgtcgttagctccttcttggcgaccaaccatgagctcccagattcgtcaaaattattccaccgacgtggaggcagccgtcaacagcctggtcaatttgtacctgcaggcctcctacacctacctctctctgggcttctatttcgaccgcgatgatgcggctctggaaggcgtgagccacttcttccgcgaattgaccgaggagaagcgcgagggctacgagcgtctcctgaagatgcaaaaccagcgtggcggccgcgctctcttccaggacatcaagaagccagctgaagatgagtggggtaaaaccccagatgccatgaaagctgccatggccctggagaaaaagctgaaccaggcccttttggatcttcatgccctggattctgcccacatggacccccatctctgtgacttcctggagactcacttcctagatgaggaagtgaagctcatcaagaagatgggtgaccacctgacgaacctccacaggctgggaggcccagaggctgggctgggcgagtatctcttcgaaaggctcactctcaagcacgtctaagagccttatgagcccagcgacttctgaagggccccttgcaaagtaatagggcttctgcctaagcctctccctccagccaataggcagctttcttaactaccctaacaagccttggaccaaatggaaataaggctttctgatgcaaaaaaaaaaaaaaaaaaaaaaaaaaaaagaataagaggtgatattacacccatgaaacaagaataagatgctattttgagacaagaaacaaaaaataagctttaaaataaacacacacacatacacacacatacacacaacagcagaaatgaaaaattcaatggatggcttgagaaaaatgtctagaatatctcacagaaaatagatctgaaagacaaaacaatgaaaaacaggaaagaaaag

SEQ ID NO: 99798 - DNA, 1022 bp, Homo sapiens
ttgtatttttagtagagatggggtttcaccatgttgcccaggctggtctcgaactcctgatctcaggtgatccacccatcttggcctcccaaagtgctgggattacaggcgtgaaccactgcgccaggcccatctactcacttttaaagatgggaaaccaggagcacaactccaccaagagcaagtccttttggttcttttcacaacgttgatctcaagcctgccctctgtgctctgactccactgttaaggccccaggctacctgccccaagccaagccaagccgcgtaaccctctccccaggtctacacttgcccttctctgatctattttagtagagcagcgagaatgttatagaaacttttgataggaccatctcatttctctaaaattcgtgatagctctctatcacacttgattaaaatctcaaagctttccctcagcctaccagacccttcccagtctggccacagctgacctccccagccttatctggaccactgtcccctttgcattctccctgacagacacatctgaatcatttctgccctttggacaacctaagctttctcctgccccacggcctttgcttgtgctatcttttctgccaggagtgttttccagtgccctttactggcctggcttttctccttcttatttttaaggtcttcacttaattataccttcctcaaatgccttcccagtcttgggaagtcccccgtaattaatcgtagcacctgacttattttctatattatatttatcacagttcacaaccatttgttacaattgtttgtatacttgacttatctggcttcttaagggccggaaccttgactgaatggaccagtgctgtatctggagcatctagcacagtgcctggcatgtagctgatgcccaggaaatcttcagccaggtggcaggttggggctggattgggcagagaggtgggtattgcagtgagcacaggagtcctctttaaacttcaagtgaccctgaggatttttattttctttccacaa

SEQ ID NO: 99799 - DNA, 1796 bp, Homo sapiens
ttctatcattctcccctgttgaaagcttatgtattgagaacatctgggtaagagtcacaggcagcttggaaaagagggcagtgattagggatttctagttttattatttttttttagcatttgttgagattggtttaaaatccaggacatggttaatcttggtgaatgctccctaggcacttgaaaagcacatgtattctgctgttatagggttgtttgttctgttagatcctgttggttgaaggtgttgttcaattcttctatatcctcattattttcttttttatttttttagagacagggtctatctctgttgtccaggctggagtgcagtggtgcagtcatagctcactacagcctcaaactcctgggttcaagtaatcctcctgcctcagcctcctgagtagttaggactacaggcttgtgccactatgcctggctaatttttaaaattgttattttttctttttctgtgcctaacgtagccatggctcgtggtcccaagaagcatctaaagcaggtagcagctccaaagcattggatgctggataaattgactggtgtgtttgctcctcatccatccaccagtccccacaagttgagagagtgtctccccctcatcattttcataaggaacagacttaagtatgccctgacaggagaggaagtaaagaagatttgcatgcagcggttcattaagatcgatggcaaggtccgcactgatataacctaccctgctggattcatggatgtcatcagcattgacaagatgggagagaatttctgtctgatctgtgacaccaagggtcactttgctgtacatcgtattacacctgaggaggccaagtacaagttgtgaaaagtgagaaaaaatatttgtgcgcacaaaaggaatccctcatctggtgactcatgatgctcgtaccatctgctaccctgatcccctcatcaaggtgaatgacaccattcagattgatttggagactggcaagattactgacttcatcaggttcgacactggtaacctgtgtatggtgactggaggtgccaacctgggaagaattggtgtgatcaccaacagagagaggcaccctggatctcttgacgtggttcacatgaaagatgccaatggcaacagctttgccacttgactttccaacatttttgttgtttgcaagggcaacataccatggatttctcttccccaaggaaaaggtatctgcctcaccattgctgaagagagagacaagagattggcaaccaatcaaagcagtgggtaaaatggtccctggatggcatgttagatctttgtatgtaattaaaaataatgtggcatgattgatagccaaaaataaaataattattattattttgtaaagacagggtctcattaagtttcccaggctggtctcaaacttcaggcctcaggtaattctcctgccttggcctcccaaagtgctgggattacaggcatgagctatcacgcctggctccttgtggattttctatctagtagttctatcaattactgagaaaagagtgttgaagtctccaactataatagtagatttgtcaatttcttcctttggctttatcagtttttgcttcatgtatttgaaagatctgtttttggtgcatacacacttaggtttgctatctcttgttggtagattgatcttgatcttttatcatcatgtaaaattcctctccgtgtctggtaatttctttgctctgaagtctaccttgatattcatatagccactcttcctttttaaaatttaatacttatgtgatat

SEQ ID NO: 99800 - DNA, 1071 bp, Homo sapiens
gacacattaactgaaatgaacattatgtaaccactaaaaatcatgattttggagcctgtgatatgtggggaaaaactgacaagtaaaaaagtgggttattaactgcacctgcttactctaacgtgaacgcatatgtgaaaaatctgaaaggaaaagcacagaaaatggacgttttcattgaaattgtcggtgatcttaattttcctttggtgaatatattgctctcactaagggcgtttaaaaaatagttcacaggttttaattttttagatgaaatggacccacagttttctgtaagagaaaggagagattgttatatttgctacttagaataaaagatttttagccaacgttgtttcctttttcaaatatttttccatttttttagttgattaatgatttagtaatttgtgtattgggtttttttaagaatcagttcttagattcatttatcaattctagttttttgttgttgtttttaaggactcctgaatatttttcaaaactgaacaatttcagccatgtctgagctttccgtcttcctggaggcacaaatctagtttagctgaaccacaacagattgtacatatcctgcagaacctctgtggtcttaggaaggttgaaagtcaccaaatgtcacagaaaatgagggtcaggaaaggctgtgatcacaagctcttgatccagaggccactcgggtgcatctgtgtgactgacacctcattgcatcatcatttcttgtaaaatcagcttaattttgcagagaaatggccacagatttttagaattatgctgaattatgtaagggagcagccattttaaaaataatgtaatcaaataacaataataacataacagaagtttctgcaccacactgacactgaacatggctgtcaaccaactagccaaaccaaggtgaaagattctctgaacttcagttttaacttacttcgtccattctcccttttcagatcttatttcttcttccaaggcaactatatccactgtgaactgctgcatattaaacattcaaaacatgtctgtatctaacccagtgatggctacagcatt

SEQ ID NO: 99801 - DNA, 1028 bp, Homo sapiens
atcattttactattgtcataggtctctgctcttggagctaagtgcccagggtaaatgagatctttaatttgaaaagagatttttgatttgatgaatgtacattctccaaagggtcataaattgtcattctggatgtttgatctgtttgttgttttggtacaaaaattagaagaaaataattcactcataaaatgttaaataatgaactaaaagtcattcatcaagtccataacttagggtcacatttgtccttggagcaggagaaagagttgtgttcacccttttcttacttttgcttttgtcctaagtgcttcagagaagtacagggtggcaacagtgtttctactgagcagctgataccattgctatgcactcattcattatgcaggaaacatttagtaatttcaacataaatatgggactctgacgttctcctcttcattttgcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcac

SEQ ID NO: 99802 - DNA, 1050 bp, Homo sapiens
catgaactcaaggcccccaggaggcacacgatgaattcgagtgggaagagaagggggtaggccacgggacagaggcctccctctggagtcttcctctaaccgctgcaaatgttagaggcagttctacccccaaagcttctaggggaaaggagtgaaggatttggcaataaagtccttagtttttgcaaatgtctgcaagtcataaaagtgcttttaagttctccacaggtcaggactggtcatgttaggttcttacacctctcccatagtccctccacccctagacattgggagactcccagtcaattcaccacccaggatggctgcccctcaccttcttcccagggccccacatccaattaatccaaatacacccatgtattcaagcacctttctgatgaacctctagaaagtagccagtgctgcagaaatttcttgtagcatgtgctgaaatttctaggatcctaccagtcaaagaacaacagtctccttgcttccaccagggaatttgctaacacttgcttctaagatctgacctctcagagccactgtggtccatcaatcaattcaaaaattatagtggcctggggttgtgtgggtgaggtggctgcttgggaggctgaggtgggaggatggcttaagcccagtagtgcaaggctgttgcaagctgtgaccgcaccactgcactcctgcctgtgcaacagagcaagacaccatctttataaaaacaaaccagcagccagacgcggtggctgacacctgtaatcccaacactttgggaggccgaggtgggcggatcacgaggtgaggagtttgagaccagcctggccaatatggtgaaaccctgtctctcccaaaaacacaaaaactatctgggtgtggtggtgtgtgcctgtagtcccagccactcgggaggctgaggcagaagaatcgcttgaacccaggaggcggaggctgcagtgagccgagatcgcgccactgcactccagcctgggtgacagagtgagactctgtctcaaaacaaaacaaaacaaaacaaaacaaaacacc

SEQ ID NO: 99803 - DNA, 1067 bp, Homo sapiens
agagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagagatgtgccccgtggatgggtctgtgtgtgactgctggctgcgggagctctgtgttgtgagagggtggttgtaaggtgggtgacaggaacaggaaggagcacccaccagataagttaattttcttccccaagtttatggtttgaacatgtttgggcctggctgttacgtcccaaataggaagtaaaatgagaaggttgtcttaggagctgccagttgagggctctggagagccaggagttgtggaggaaagagcttggaacttctattcagtgaggctggatttccactctcactccaccccttcctcttggaccctgggaccaactcaatgatcctttctctaggacttggttttctcacctgtaaaatggctaagcccccctgcaggggttgggcacctgggcttgctt

SEQ ID NO: 99804 - DNA, 1055 bp, Homo sapiens
aataatgataacactccatagtgacaaatggagaccaacagtcatacattagttaaccatggcatgtctatactttggaataccaagtggctacaaaaacataggctgcaggtgtgtagctattaacgtggaagaatatgatatatatgtatttttgagatgtagtttcactcttgttgcccaggctggagtgcaatgccatgatctcaactcactgcaatctccgcctcccgggtgcaagcaattctcctgcctcagcctcccgagtagctgggattacaggcatgcaccaccacgccaggctaattttttgtatttttagtagagacagggtttcaccatgttggccaggctgcttttgaactcctgacctcaggtgatccacccgcctcggcctcccaaagtgctgggattacaggtgtgagccaccagaatatgatatatttttaagaagcagcttaccaaactatgtgctatttttacaaactgtatcacccatctatattagcatctggaaggatgtatggtaaaatgtcaatagtgattatctctgggtggtggaggtttgcgagatttcgatcttcatcttttttcatatgtaataatttatttttatgttttattgtggcaaagtacgcataccataaaatttacccttttaaccgtttctaagtgtacaaattagtggcattaactccattcacaacgttgtacaacccatcaccattatccatgtccagaactttttcgtcgttccaaacagaagctctgtacccattaaacaataaccccctcactcctttctccttccagctcctggtagcttctagtctacttaccgtctttatgaatttgcctgttctagctacctcatatcaatggaatcaaacaatatttgtccttttgtggatactaatcttttcatttatctatatatatttttcgtttttgtttttgagacagggtctcactctgttgccctggctagagtacagaggtgtggtcatggctgactgcagcttccgtctcctgggctcaagtcatcctcccacctc

SEQ ID NO: 99805 - DNA, 1052 bp, Homo sapiens
atcagcgaaggccgagtgaagatcagagtgcagagatccgaaggagcctggagcacccagaccttgaactgcacacgctgcaggcgtcagcagtagatgccagcccagtactcaggaatgggaccagcccgtccagcattctgctttcaagggagggtccagagcaggccatctgcagcggggcccagggaggacccagaggcctccccgtgatcctgagcacgagcctcacttgccaccaccagagtaaggttcaatctctcccaaagatgcgtcttaaaaagagctgggcaggaaggaagaactctgagagagggtttgcgtaagaagaccagagggaccatttagtattgcataagacttcatttaccagactaatattcagatatttttcccctctgctatccaggaggtaagaatttacagaggaagatccaatgagatatagagaaataaggaagcctaagtgaggtctacccctgggctgccgccacctcttcacacgtctggtgcaccagcgtggcaggccagctggacatctgcttgacgggtgaaaaaagaccctcttgggagagaatctgcattctaaagaaagaagaaaacaagtggtaacgcggcttgagttgacagaaggctaatgagattgtcactcaactctgctcccaatctggtcccctggacacacaggagggggctcctgggaagaagaaggggctctaggttacaactgaaggggctgttttgtaaacctccgggtattctcagacccaagcaaccatgttttgggaaccctcctgctgagtaatacttaaggggccaaccctccactgttcagcttctctatttcaagagcttgttatgttgacaacactacctagaatgagacagcttgattgccaaaacggtcacgactactggctcccagcacacttgctgtttgcaatgtgatgctgcagttcctccaataaggaagtggagtctacttctccaccttgaatctgggctgacagtgtggcttgctttggccaatagaaggaggcagaagtcatgtt

SEQ ID NO: 99806 - DNA, 2222 bp, Homo sapiens
aggccggttagtctccagtttccacagagaccacctacccaccaccttcccaggtcacctgcctggtccctgaaagaaagcatttgtgtgggcaatcccaacatgaaatgtagacagcgtgaatacggacaggaggtgatgccatattcacagtgggggatggagggcccccacccctgcttcacagaataatgggaagtgactctagtctttgtaagcaattttcattctcattaggaagttaaatgtagattcacagatacatttactttcagaatcctcaagaggatttcaaatgctaacttttagtttcttgggattgatcaaggcaagagaagtggctttaaccatgccagccagaatgaagcatcatgggtcctgatggtttcccgttttcatggtaacaaattcgcacagaggttttgctttatgctgtagaataccgactttcatgatgacaacttggtttatgcatgaatattgcagtatttccatatagcaaaataacatttctacccaggataatagtcacagttttccagggagggaatgatataattttcatgacaatgtcatgtgatgatagaatttctccattgatgaatctctagtatgtgtgtatactttatttacccatacgtatattttatgaccatgagctaagttgttatttctttcattcatatccctgctgaaatattggtactagcaacttaaagttggcaagtctcatcttcagtaatacggatgccatgggagtggccaggccagattgaaggtgaatatggagcagtagcagaagcctcattccagaacccatctggccagagaagcagcagcatcctgggggatggccgtgcatggggtgtacactcgctataggcataggcccggcatggctgtcgctggacgccagctgtgcacacccagccacacctgctgcacgccgcgttagtgtgcggctccgggcctgagcattcgcaaagctcgcttctccagggagcctcctcttggctttggaaaagagcccagggacttaacgtgctgcctgttgtactctgtcccctcatgactttttagacacagggactaggacatcgaccaccctctgcccctcctgcagtcagaacccgagtagtgcaagaacggccacccggttttgccagcgttcagcgtctgcccatggacccataaggcacattagcgttgggggtctcttttcagcagcctcacagacattcccgtcctttctggttggtgttgactgtgtttcagcatcactctaccctcccatgtccttagcattgctgtgcgtgtttccaggcacttaggacacccttccccacgttgccatcttactgacagttcaaatgactctccttttttgttcgttagtaacaatcttcatttgacaccttaatacatttctgactgttcttaaaacagtggggatgcctatattttccttgagtttttgtgactgactttggctatatatacctttctggggttttgtttgttttttatttttattttgattaccgagggtatttggggtggggttgttttttgagatgtgtaattcttttatggagtttttaaaaagaattttcatattgtttttctaacatggcttcattaaacgtttaagtattttaaaaatatgtaatatttggaccagatgttgtgaataatagtagagataaagctattttattctgtatttttaaaactgttccgtacaaataaaagctctcctggacacagttttgctcttcacgtgcctccttcttgggctactctttaagaaaagagtcatccctcagaatctgtaggggattggttccaagacctcctcggataccaaaatccgagactactcaagtccctgatataaaatggcatagtgggtcaggcacagcggctcacccatgtaatctcagcactttgagaggccaaggcgggagaattgcttgaggccaggagttcgagaccagcctaggcaacatagtgaaacccgccccccccgccccgccccttcactaaaaaaaattaggcacacatggtggtgaacgcctgtggtcccagctacttaggaggctgaggtgggaggattgcttgagcccaggagttcaagactgcggtgagccgtgttcgcaccactggaccccaggcgaggtgacagagtaagactgtctcaaaaacataaaatggtgttgtgg

SEQ ID NO: 99807 - DNA, 3332 bp, Homo sapiens
aggatagggaggtcagaaggtcattaggtgattgcttgaatgaggacatggaggggttagtgcttcttagacttctggtttgggcactggatagctgagcaccttcacctcctcaagtattctttgctgttatctaggcaggtttgatctgtgggaccatgtgtgtgtgtgtgtgtgtgtgtgtgtgtgtgtgtgtgtgtgtgtgtgtgtgtatgtgtttgacgacagtttcattttcagtagagctgctaaacgaagcattcctttgttctatcttgggatgtgtgacaggcactccagaggaaagaggaatccggaaatggaagaagggtgtgggcaaagggaacaaatcactcgacggcatggagtcgtacaatttgccatttggcatgaacattataaaaaaatacagatgcttcagctacttacccatcagcccaacctttgtgggctacacatggaaaggcctcaggaagagcgacaacagccggagttcagatgaagactcccaggccacgggatagcctttgctgtgccctgtggcctggccgcagtgaggcatgtatctgtagttccttgctgagtaacaagaagtaaaatacatgtttgtatatctacatttacattctgcgccccagagctaagacagactgcgaatcacttttctgctgtgagggtgatggtgcctgatgcggtgtctcgcctatctccttatttaagcccttaactccttgccctttgagagtgtccattgctggccatggtcactaaatttgaagttccagtcctccctttggagtggacatttaaaatctgcagccattccttgcttcagttcccttccaccacccagggctggctttcctataagccacctccagggtccaggggctttctctctctctccgaagcccctggacctgtttccttgtcatttgaccctcgtctgtgcccgcggagacctcctctgaccaaggggcactagtatgccttgcgctatcatgactgactggcccagtatgattctgttgtcgctgatctcccggaggaggaggctgttgacctgaaaacagtggcgtggctcccctgtgcccagatctggccatgggtgaggcctgcacagatgttgaatgaacatctgtttggggcattggagggaaaaggaaaggaccctgaagccaatatctgattctcggctgcaccttctcttggccaccctggccctgaccgggccagcacgtgcacactggcctcttttcatttcactagtggccgagacaccctctctggcatttatcactgttggccggtgtgatgagtatagagtgccacccaaggcaccagtcacacaagctgatgggcgtcttggctctgccgtcatgtggatgttattgtcgcgcgcgtctataattacaaggttttattcctatttaatgttattgactatagcagattttggaaatcagtgttttccatgtgaccctctttccttgcatccctattccttgtcccccacccactcttccccccatcaagaaaagaaccagcatttgtaaagctgtggacaccatcagggaagcttgttgtaacggcttttgaaggccagtaaccattgttgtggttgtgttttgtattgcttgataccatgaaagtgtaaatactgtaatgcctaatctatttatcaaaactgactactggaccggagcccagaaaccatgggtcaagttacacgtgaatttgttttgtgaagaagggaagctggggcaggtaacacgcagagccgccacgtggaacggtctgtccgccggtctgtcccgcttgccgggcttctgttgcaagtcttggcttaaggagacttcctgtgggttgccatgtcgcacgtccgttagatcttgattttacaggtgagggtggttgccaaaggtgataagaaaagcagccaacaggctccctctcacttaagagagttctaattaataacactaaattcttcctgagaaatgactcctcttggtttggtttgaagtttttcagtgaaggaaaaggcctgagataggaagcagtgccctcgcttcatgaggtggcacatcttcggtggccgttggcctggtcgagctttggtcagctgcgtgggtgcctgtctcctgtctccagcggcagggcatggttcttggcagcctggtgtccacacggtgcattcctgtccccctcggccccaggctggctcagctctccagtgctgcggcgctgtctttgcagcattgccatgtcaccgtagcccccttcactcttggaagtttggggcttcaaggtttattctggcaagaacacctcggagccactgcattgttttgccaaaaacttactgcagattaagtaaagaacttagatgctaaattacatctaattttgtatgtttttttaaatgtgtctttgatgcatactttagaagcacactggctcgcggtttccatccctcttgccttgggacactcttgaggctggcagccctcctgcaatgagttgctctcagttccttctgtttggattttgctcaacatctccagtttctctgctctgaaaaatggggaaaactgctaaacatcccagagatttgcaatcttctagctctccaggtgagcagaaagaccaaatatccaaataaaagcctgaaagccattggtgatccaggggcaccttctcttcagcttgactgggcgtcttccgctgcataacactcaaggtgtctgctctagtcatccagaaacccactcccttctgaagcccctccttgggccgggttgtatcaggaggattcaaccccgctaacatgtggggtgccctctgtaggccttcacacagggaaggaagccctaccctttcaactcctgttggagtgagagtttcctgttctgattccactgtggccaacccaataattctgtccgaggaggggtaagggaataggaggtggggagcaaagagggcagcctgactagatgcccctgctgaatctggtactttctgcacagccttgagtgattggagtcccctaatgactaataaacttgaacatgtaacacacacacacacacacacacacaccattttaggaagtggttctcctactggaaaatatgctacagaatgaaagtttgtaattgaaagaaaaagaatgtattcatctgcttcttgggtttaagcacacacctgaaggggagatattgggggacacggtggccactcgcggtctgtgtcatgacacttcccattcacatcattggcctgcgttgctggggctttgaaccaccaccccgtactttgttttgcct

SEQ ID NO: 99808 - DNA, 1044 bp, Homo sapiens
ttagtatttctgaccaatttaactcaaataccatccctctgaatgggctacttaaaactgaccattttgacagtgggactctgggtttgatctctgcaccatttagctgtaataaccagagacatgcaccagatatttaggtaggtctccctgtttaatcaaaatgtttgtgtagagagagaaccaatgtccttagttttctatttgacaaacaaaatgccacatggtgtttatgctcccgtaggagcccaaatagcgcgtacgccgagggtcatttggctcagagcgcagggtggctacagtctgaccccacacgtcccccttcctgtccctgcactggtctcattggtttctgttggacagagaaggggtgccagggagcctgccctcacctgccttgagctgtccccgctgtagtggtgctggagcttgtggtctggtttgtttttctccaggaatgatcacagctgttggcctctctaacctgcagttcattgatttaaattcttcccggaacctctttgtgcttggattttcgatcttctttgggctcgtccttccaagttacctcagacagaaccctctggtcacaggtgaggaaatgggctttacatcttggagtgggagctggaaccacagccgccagtccacacgcagctctttgcccattggagaggactttgggcctccaggagctgtggtgcagatgcgtctgtggatctctcttgaatctcacttttcaatacttacctggaagcgctgtgggcttcctgctggcgtgtacacataacagtcatggatgctaaggtctctttttcactgggaccctctcctttgggagaatgcctctctctaaatgcttttgatttcattagtctatcttaatagactaatgctccattaagataatttttttttgaaactcaacttcatagactttgaacacgttattctactatttgatgtctatcctattaactcctcagagcaaaatcacgtggcttgtgcattcaagattaacctttttaactcctccttttgttt

SEQ ID NO: 99809 - DNA, 1034 bp, Homo sapiens
ccaaaggttggtcaaaacattcttcacaccagcagagatgggaagatggcatgtgagaatagtctttcagcgaaatgtaattaatgccaaaatggataaattgtaggtatagtacagtaaaatttgaaaccagtaacaaaaggatgaacaaaacccacaaagcacttacaagcttaaaaaaaaaagtgttaaaaatcactctcagagaggaaattgaaactttgcaattaattactgatagtttaggaaatgatggcaagaacagcaccagtcacacttagtagccagaggtgttctcaagaaaattcacaacctttaaagcagatacagcacatgaagaatttcagtaactaagaaaacaggacaaaaaaatgaacctagtaaaagcagggggaacgaattaataaagatacagaaaatgtgacacaaatagaagtggtaaatctaaaagctgatctcttgagggggaaacaaaacccaatgtagacaaacttctggcaaagctaagcaggataagaggaagcctgtgcacatagatctgccacagatcccgtcagagggagcaaaactgttacctccccccaaattaaaacaaaaagtaagaaaatagtggttttcagaaaacttaagtaaccaaaattgactcctcctcactcttatctctaagtatgggggtgcctccacacttgatcctggcccccttctctccatgcacttcccccaaggaaatcgcatttctttgatggtggatagttccatggaaacctgtagttcagacctgtaaactcgatacttacagatccagcccctattttgcccctccacttactgttacacaagacatctccatctgtaaatgaaaaagccccagacttttgattcctttcctgcccctgaaaccagtttcttctgctttcctcctttcggtgaatggcacaaccgtgcccctagttgcttcagccagaaatgtctatctgttcttcagtcttcctttcgcctcatcccccacacagcccatcctgcccttcctcctc

SEQ ID NO: 99810 - DNA, 1045 bp, Homo sapiens
ttctgtaatacacctgcatcatgaatgcaggccccagttagtgccccctgaagtttcttgtcgggtcctggggaattttctagctatctctcccaagttagatgatgtaataacttattgccttgcagaattatcagttgtggttgtaggtgacattctgagtgtgcagtgtacaagcagctcactctcatgtctgtgccatctcttgttgcagatccagggggccatcatcatgtcctcactgatagaagtagtcatcggcctcctcggcctgcctggggctctactgaagtacatcggtcccttgaccattacacccacggtggccctaattggcctctctggtttccaggcagcgggggagagagccgggaagcactggggcattgccatgctgtaagtggaaacatctcccctcatcccaccactgcggggcagcctttaggaacattcacacagacttcaggagataatgtttttcaataataagaatggtctgacagtttcaactttatttgcttcgtgctggggaatagttgaagggtttttgacccagagtttgggaagtgacatatagttgacgtattacaaagacagacttagcagcaatatgaagagggtggattgtaagtttttaagctttggtagtggggtaaggtagtggcgccatttgtttttgacttttgaggtcttgccaagtctcatgttcatgagttgacatactgagaagccaaatttttatatcatgagactcaaaaatattccagagtggcaggaatctggagtatttccagagaagtcgtgggaaaggtctgttgccattgatgatgtgactcttctccccaggccacactgagctctgcactcctgacgggtgggtggttgggggagggacatagtttctgccagggtcctgctagtcagtgcctgtccttttgtacagaatgtcacatccattaaagatgtcccttgccctttaagtaaagttaacattttgtgttaatgaagtcacaggggagtttgataatattactgatgattagag

SEQ ID NO: 99811 - DNA, 1801 bp, Homo sapiens
aaatggtagtctttttgaatagctaaagtgttcatgaagtcaatatgaagtatctaaaatataatcaaatcatgtcatttgaggatctctgcatttagtttgaggatgtgggcagcaaatttaatggagattctgcaagttttctgggccctttaaaatatattagaatgtctttaagtatttttatgattaagcagaatatttattttatctgctgtcacgttgtaacttacagctctgtagatctagatcactattatgatttatctgtaatcggtgattagggcagtttttgatttacaaaatgaaacaacggagggaaatttgttcctgtgataaccaataagaattttaaagggaggaggagggaggtaaaaaagcagaaatacactgatgtttaaaaaggagtttataagctcagcaggaaagagggaacctcaaatgcccgcagtctcccgcctgcaagaggaaaggtggtgatggcaggggccggtgttggggtgttggcactgaccacggggcccaccctggagctgcctgggtgggaggagagtggcaatggggaggatgaagaagccactggctgtggctgcatggcacaggaaacctttgcaaactggggctttttcttctaggtgtgcctgcatttactcatgtgctgtatgtctatggaaaagactgttaagctgtcaaatagtgaactacctcggtagttcccgatgccgtgatcatggttttggtctcgtttcttttaggttacccctgtttcaggccagtgcttttgcatttttggcccctgctcgagccatcctgtctttagataaatggaaatgtaacaccacaggtaattgcagttatttccacatatgtcattggggtcctttaatgcaggtgtaaagggaggcctggacgtgctgccctcagcagcgctaaatcctttcaagaattagggacaaagcacacaaacccacaaacagcttagaatgctccatctgtggatcgtgtctgtctctctctttctgtccacttgttcatccctaaccctagagcaagaaaggatcagaattgacctcatttctctatgttaatgaaattgacaaatatgggaacggaatagaaaaatatttgtgctatttttctgcctctctctttcagtggattttatgacccaccagtaatcactctctttgctgcgtcagcatcccttctctgaaacatctttgctttttaaggatctggctactgtggtttgctgcaaatgactttcattccccttctttagtgattgcaaagatccttaaggaacccgataaggtcaggaaaagatagggaatttaagaaaattagagtcagacctgtactctcaaaaatacaattacattttgaccttctaggagcaaagttttccagccttcatttccttccttgctcctaggagttactttgtgaccactgatttgatctgggaactggaaaaggccctctgttttatctaagtttttcaaacctcagtccagcaaccttgctgtcgggcatttcaatgagctgtgtgcaaaggttggtttttttgtgtgaggctggtgctagtaacgtgtatcaccacttcagttagcttttgacaatttggggagctcttagtcgatgaattcatttggttaaattagcatttgaggatccacctttcagtgagataagctatactgttggaggttgaattttagggatggggattgaaacagatgtaataaaaacagggagaaaattcttcttaaaaggtaaaatgaatatgtcatgtgagaca

SEQ ID NO: 99812 - DNA, 1062 bp, Homo sapiens
atgacctcaggttatcctcctgccttggcctcccgaagtactgggattacaggcatgagccaccacgcctggccttgcttttctttaaaagtagttggtacacacactcctagtggtagattcaataaagaacctatggctcctcaaagccaaacctgttacatctcttaaggattatttttcaaaaatttttcctgcagtttagactcttgagtgttcatttgacaatgcagggttttgtaccaactttggttgttgtcttggtagatgaaggaagccaggcacagagtatatatgctctgtgttggtgaattttgtttttgttttattcattttcattaacagtttagttctgggcagatacattttgtatcttcatggtgtttcccataggaaccattggcttttaaagtttctctgatggcaccagaggaggactgcaagccgcccggcatctggaggcttatctggttgaatcatgaaaacccatgcacatttcacccccaactctgagtacttttaatctaatcaccactctcttccaaatgtgcagtcaaaaccaacttgccacaaagacttaacctcttatttttagtttaatagaagtcctttctgagaatataaatagctccttcatttcattaagtattcattggtgctgaggatacatggtgggtcaagatggtgggtgaagccagtccacttcctagtatcgggggatgcccgcctcaaggttgagatgggcaggacagcttgtggggagtgcaccagcacagacagcagcagcccgaggaagggagcagatagaggctggacacaggcggagatctgattcaggctggctcgtcatgtgagcggatgccaaagggaattaaaaagcaaagatgacacacagagccatgccacagcctattgggatgtcctctgtggcttggttccttcaagactgagaatagcttcagggttaaggtcacctctcccagttctcctacggtggtcctttcagagcaggtccttcactcatttccctcttgctgcaggaagaatgcggggcatttgtca

SEQ ID NO: 99813 - DNA, 1089 bp, Homo sapiens
gctcatgccaaggaggccaggcctggccagcagctgagcctgatgggcaaagttgctaatgggacacagaagggagggcctgggggaacttggggtaaatacttttggtcacagagggcatcatcttgcccactgttggggcacaagacctaaacagaactacctgggtcagcgtggttcacctccctgctggcctgggaagcagtttgagcggagtaagaacaggagagggatttgacaccctactgggatggctcagggacccaaaatgcagagctgtggcctggaggagggtgcgtgtctgtgcgccccatgcccacaaggctgggtgaaagcagcctttcttgctgtgtttgtgaggagtcagagtgagtcccccatgacctttggctgtgcaaggaatggcagccccacccctgcttccatcctccccacagtgtggccatttgcttagtcataaatcaggtggtgctgactctaatcacgtcagcaactgtgtgctgctgggcaggtgcaggtgtgctggggactttggtggggtgttgggcttgtgataggggttttctatggttgtcggggtgtgggtggtgcccgttctcttaacctgggcaaagagaaagagtactggctcagccctgcagatattcagtgactggtctatgtggcaggtgcggggcctggccattgtggggcgcaatggtgacatcgaagcacatggcttgcagcacgaagggcagcgccatcagggagacacagtgcatcctccaggggacttggtgggagccctggaggaggtggtgtttgagacaggccctgcaggctccaagggctctgcccaggagggctgagggagcagcttccatcccagcaggggcaggagcaaaggcaggaagtcacagcctggcatgatccccctgcccaggcacacagaggccagagcttgggacttatcaacaggcacagggagcattcaatggctttgttagcaggggactcgcccccggggctgtgccttgaaggacgttacttggttacttagtatagggggtgaggaccatcccaggggatcagtgacatccatgagaaagg

SEQ ID NO: 99814 - DNA, 1061 bp, Homo sapiens
gctgggcgtggtggtgcgcccctgtaatcccagctatttgggaggttgaagcaggagaattgcttgagcctgggaggtggaggtcacagtgagccaagatcgcaccattgcactccgtcgagggcaatgggagtgaaactgtcttaacaacaaaggagaaatactgaaaaagaaggaaaaaagtatggcttggtcgaaaaaccaaggagattctttatgtgggctattttttaacgacaataagagagaagaattaggatgaaatcaagaataaatgaggaagggtttactgtttctcctctgacccttttcctgcccacagcactacctgacatgcttcagcggcacgatcgcagtgcccttcctgttggccgatgccatgtgtgtggggtacgaccagtgggccaccagccagctcattgggaccattttcttctgtgtgggaatcactactttgctacagacaacgtttggatgcaggtgagattggggtactaatgggggatgccaaagcccccagaaggcattgagcgcagaaggcattgagctgcgccgtttgcctagggctgttggcaaggacagaatggaggcacgggaatgtcctagtggccgttggtccccacccctcagtgttcctcccagtcatttcctctcttggtgaatggcaccaccgccaccttcccctacccagttgtccaagctggaaactcagcctcactctccttcccctgcccccttggcaagtcatgctcgctccccagcacccctctgtgcccctattccttacgttcagaccagagtgtcccaccaggctccccgttggcttccctgcctccagggcactgctcttggactcactttgtgccccacacccagtgccatctttctacttccacaccctcctcagggtgagccacactgcagctctcctccctttttacacaccaggctgcacccagcatttaggcttgcccttgctctctgccccacttccatctccagccatgcctctgagccctgtctcctgccttccctggcctcactcccaagggcccgctgtc

SEQ ID NO: 99815 - DNA, 1067 bp, Homo sapiens
tttaaagtacaaagatcctttttacttgcagggatgaagtgggctgggaggggcagatcagtgtgctgtctctttgaaagtggttaaaattttctaagatttttttcatctggggtctcacgcaaggactgctcgtgccaaggtatcattttgtggtctcaacctgggaacatctctgtccatgcaggaggatccccaggcctggggagaagctctgagcaagtttggtgttctcagggatgagatgttgcccaaggacgctgaccccccaaattctgaggattgaccatcccggtgggcgactgtacttgagccaaagagaatacttggcttcaaagatagccaaggctcaaaactgcaggaagatggcaaccacttgataaagttgtttttctgtaatagtggcctgtacatggccgagctaacactggtcttcacgtttaatgagcaccttcttttctccttctggctcgcagagctctctcgctgagaccctggatagcactggcagtctggacccccagcgatcagacatgatttataccatagaagatgttcctccctggtacctgtgtatatttctggggctacaggtaagatggttcctgtaggatgtgtaactaccagcaggtgtttgcattgtctaccatctggaattgtttaaaaattccactttggtttttgtttattgaagacttttataaattcctcttttaagagtgatgagtaggggctgagcacagtggctgatgcctgtaatcctagcagttttggaggctgaggtgggcagatcactggagcctaggagctcaagaccagcctgggtaacatggcaaaagtccatctctacaaaaaatacaaaaattagccatgtgtggtggtgtgtgcccacagtcccagctactcaagaggctgaggcaggaggatcgcttgaggttgaggttgcagtgagctgtgatcacaccactccacttcagcctggttgacatagtgagaccctgtctcaaaaaacaaatgatgaatgggaattgttgacatcacagcaggaggaagaaaagaacaggtag

SEQ ID NO: 99816 - DNA, 1013 bp, Homo sapiens
agtctggactgagctcctgcagggaggcaggactgcattctcattgcctgggatacaaccacaatttgttgaatgaatgaatatgtgagctttttttctaggcttaggagtgtctgcattttataatacagatgttccttgacttatgacagagttacacccctaaaatgcatttaatacacctaacctactggcaattcatagcttaaccccgcctacctcacatgtgctcagaacccttacattagcctgtagttaggcaaaagcatctaacacaaagcctattttatggtgaagtgttgaatatctcttgcagtttcttgaatactgaagtgaagagcagaggggttgtatgggtacttgacagtttctacggaatacatatcacttttgtaccactgtaaagtcaaaaaatcctaagtttaaccatttaagttggggatcattatacttatttgtgtatgtataagtagtgagtggaatgtgtcaggggagcagtaggaattgctaactcatttcaaaatctatcttcttagtgccatgtatacagatgattttttttaatgtatcgaggtgaagtttgcataacatgaaattaaagtgaacaattcagtgatattttaatacactcacagtgttatacagcctcgtccatttggttccaaaacattttcatctcctgcaaaggaaaccccttactggtaaagttgctgttccctgcagcaacccgagataaatgcaggtgaaggttagtttggctagagtcagactttcaatcatatctaggtttctctaatgatttagtaactgatccgtgttttaggagagttcatcctgagagcgtgttgctcttggcttctcagtgggttgagcactgctgcgatatgacttggagcacagttctctctgtaagttaagagtttcatctcgtggacctgaacttggccaggaatgtgtatcctcccagcagccagtttttataggtaaaccagctccacaaactcagttggctt

SEQ ID NO: 99817 - DNA, 1065 bp, Homo sapiens
aattttgatcaccacgtatgtggtgttaacctggggaagaattagtgtcccagccccagataattgcagtgcagtttaggcaaacccactcttcagcccttaggtaatctattagagcaggtgaatccctcagagctcccttttccttatcttgggagagtctgcagggaagaggaactcttggtatactggactagtggggagcagggggtatggtgtggtggggagaaacagtactgcacaagagatttgcaaatggaatgtcttccagatgagaccgggaaagtggttggtgttgagaggactgaataaatgggccaaagtccagcaaaaccaagcaggcgtaattgggtagttaggaaatagaggcaaagtggagctggatctttctctgcaggtgaaagaaggaaatttggctttggtccttggagaatgacatggtctgaagagcagatcacagagagggctggtgagtccgttgagttacttgagatgcttctcccagcacctgagcctgccttctcccagcaggggcagctctggcaacagtagctggaggtgaccaagtgccctactgaggcttcctcttcagggactgtgctggaaagaggatggagcaggcatcccagacacagtgggactgaatcagcagggcacagccatctcctggaagttatccaggctcccaagatttttgtattgggtgagccagggggagcatcaaatgacaaaaggcatctggagacctggaagagaagaaagcattctttctattccctgaaagtaactcacaaattttcctcagcttccttcagaatgacttttagatatgaccttctcaggcctattctggtcttttggccttttcttcagagtctcgttctcttagcttggaaggtaacacgaacaacgtttgtcttccagaatgattgttggacccacaacattggccctgagcttttttgcagagataaatcaacctctctgtgctccagtttctcatctgtgaaatggagagaataacaacccctcccagaatttttataagggctaagtgaaaccatg

SEQ ID NO: 99818 - DNA, 1074 bp, Homo sapiens
agaagaagtttttaaaaatcttacatttaggtttcttctaccaagtgccattagatttcgtaacactagagggtgctgttaatgcatttgcttttagcatttctagcatctgcccccttgtcttattacagagtcaaagtaggttttgtctagctgataatcttgaatctcttttgttgttttactcagttttacaacagcaggggcacagaaatgtcaatatctaacatttatctggaaagacagaaatgatgattccaaatgtggaattaaaagaaaaacacattttagattttattcataaaaggaaaacaaatcagagattatgttaatcagattagatattttcaaatgcaaaattatttctgaagaattaaaagtttttttcttgtatttgtccatatttagcattttagttgttttgccctattttctgccctgagttttctaaccatacatacatactaagaattgagctattgataatttttcctcctaatataaggagagggatataactaaaattttaagaatgcagataaacacaaaaagaaacacccgtaacccctatattatagagattaccaccataagctgcttggtgcatagccatttttttttttaaagctcaatcgcacatgtatatatacagtacttttttaaaaaaaaaaattatttttcagacagaatctcacattgttacccaggctggagtacagcggccccatctctgttcactacagcctcgacctccacgctcaagcgatcctcccacctcaacccttcaagtagctaggactaaaggcactgcccccatacccggctaatttttttgtattttttgtagagacagggcttcactatgtttcccaggctggtctcgagcccctgaggtcaagtgttactcctaccttggcctcccaaagtgctaggattacaggcatgagccatcgcacccaacctatacggtactttaaagagaggggaatcacgagttagtgctcatgtatgggaattttttgtatattcattttataacttactatctttctgaagtatcttattctagggtgt

SEQ ID NO: 99819 - DNA, 1074 bp, Homo sapiens
gttccagtgtccttgagctctcctgcccagctctatggttgtatgtgttttctctgatttgctaggtgtccggactgtacaatcagatgggaaagagcctcagcataatgtatctccatctccttgctccagcccaccaagggcagtcagggatctagttggatggttggtgtcattccatttgccttgagatgatcagtacagatcctaaaatatcacggtcttactaaactgagaaaagaggaggcttgctcgtacctttcgtttttgtcattaataacatacaggtgattgttgagtgcctggctttcatagctgagaacacccattctgcttggtgcctgaagcctgcagactgggtgcatggttctggttgaagggtattttagcatttgctagaaccaccacagatgctgcggaactcagttataaactggatcaaacacttggagcagtgaagagaattttctattttattggtgcctgatttccaagaggcctatgtatcgggaaatcctggtgtttttggtttatagactttgtgctgttgacgtcaatgtctcattttctcattaccaaacatgtcgtataaaaatgttgtgttgcttatggtttgatcagtagcaaagagaattaaatatttactggagaaattgggtggtttcacaaacctatgtaaacactgatggtgattacagagcttacataagaaggtaaggaaggaagatggaacagttgtgtaacagttactatgaaagagattccaagcaaattagaacaagtctggccttttcaactggttattttgaaaaatcaacatgttagtgttggattaagaccagctgtttataaattgtctaagttgtttgctgatttttctgtatggtgttaaaaaaaaaactcatcaataaatttgtcccatgacttctaatgataatcctttttaaatacacatattattttgttttaggtttgccataaactggaacttgcagatcaatagcaataaagcctttctggatttgagtaatgtttacctttggatgggccctgtgtttatttagatttcttgta

SEQ ID NO: 99820 - DNA, 1272 bp, Homo sapiens
aatggaaagcatatggacaggtctacgccacatcacttaggtgcgtgtaaaacacaatctccagttgtgtttccttttccttttcttactttttctgaaacaggttcttgctctatcacccagggtggagtgcagtggcacgatcacagctcgtggcagccttggcctactgggcttatgtgatccttctacctcagcttcccaagtagctgggactacagacgtgagccatggtgcctggctaatttttaaatttttttttcttagagatggggtctcactatattatctaggctggtttccaactcctgggctcaagcgatcctcctgcctctacctcccaaagtgctgggattataggcttcagccaccatgcctggctagttatgcttcatggtagaattgggctggcagctctgtagcattagaacccttttgtacttgaccttacctttgtacgttttttacgtgttgagaacggtctaaatgcacaacctttggaataatgaattgttaggttaatgctaatgataaggtaatagacttctttaggccaaattccacgcaagtagattaaactagaaaataaacaggcacagtcttgccacttatattaattacaaagtaggaggtaaatattttcagttttctttcatgcttttgactttattatcagcaaaaatttgttgagtacctcctgctcttggccctccgtgaggtttatacgtgaggaacctggagtggaaagagatttaagaattgtttcctcaccccttttcaagcattctctgcagtttaattaatgagactaaccacatgtacattactcaggagcattctttttttcctccttctgttgtttcccttatccccaaagcttgatgaacattttgattatttttaattttttgctattataagcaatactgcaatcaaatttcttcttggggaaaacatcttagcagtagtagtgatgggcacagtgcatgaccttttaaaatttgatacatgtataggtaaattatccttcagaaaagccgcaagtgtttcacatctgccgatacattctctcagatactctgcttctggatgtggtggtgcacgcctatagtcccagctactctggagactgaaacaggaggatcacttgagcccaggagttcaaggatttagtgagctctgattgtgccagcgcactctagcctgggtggcagagtgagaccctgcctcaagaaaaaaaaaaaaaaaaaaaggatgctgtcagatacattg

SEQ ID NO: 99821 - DNA, 1048 bp, Homo sapiens
aaaaatacaaaaaattagccaggcatggtggcgggcacctgtaatcccagctgctcgggaggctgaggcaagagaatcgcttgaacccgggagtggaggttgtagtgagccaagattgcgccacggcactccagcctggctgatagagcgagactctgtctcatttaaaacaacaacaacaacaaaaaaaccccaaaaaaccccccaaaaacccccacatagcttaagatagatttatgtgtagagattttattttgagaaataaattactactttttttttccttgcatgcaaaatgttttagaaagggaaagacatcaatttcttcattcacgttctaataatttaaagtgagtattttttcccaaatagcacaagaccagtgtttagtttccaaaattaaaaaaaaaaaaaagactcattaatggttccttgaaggctggactggtaccagtctgatggcatttgtgtgctatttaacttggggccgttggcgattgttgatgctaacttgcccaagaacaaatggtaaaagttgatgtctcaacataaggattttccagtgaaaatctggctaaactgttggttgccttgcacgtttttcttcacaagggagggccaggctcatggctggggctgggatggctgttcccaagacagccactgagtcaggctctgggttccctttattgtggaacatatgcataggtacaagagtggataaaacatagccgtttaataaatagtaaaagaaacatctgtgtacctgctcatatcccagtttgagaaacagaatgtgaccggctttttgagaagcaccctccccgtgtgctagtacatttttaagaggctttaacagaaagtgacttatttatttattttttttaaatcaaagaccctgtgctagggaatatggagtttaaaagttatcaatggagaaatcccaactgagtgcaaatcactttttttgcttttgttttgagatggcgtgttgctctgttgcccaagtaggactgcagtggcacagtcatggctcactgcagccttg

SEQ ID NO: 99822 - DNA, 1045 bp, Homo sapiens
tcaggaggctgaggcaggagaatcgcttgaacctggggggtggaggttgtggtgagccgagatcttgccactgcattccagcctgggcaacagagtgagattccatctgaaagataaagaaaggaaggaaggaagaaagaaagaaagggagggagggagggagggaattgccaaccccaaccactgatttgagtactcactcccatggaacattcattatctgttgtttgaaaaatatgcttcatgtcagtggtcctcaacctcgacagcaaattgcgatcacctgggaaactttaaaaaactacggatgctggccacatccatgagaccaggatgcagttgatgagaaattcagcccgagcacttccaggtgattccagggtacagccagagctgagcaccattgctataaataaactaaaattcagatatttatactgcttttaaagccttttcatagttgactgaatgggatggaaatgtgcgtattgctaacttacaggtccttatgtgtcactttgatgacaaatgtattaggtctgttcgtgcactttcttttaacgtaatatgacctgtgatgcagttctcctgagaaattgaatgattatgctattgacttgcccttgggtatgtagggttgtccctggtctatgcagagagcaaagatagagcagggtgtttggagatcatctgtcatttctcagaaatttttgtgtctgcctttttgcagtaggaaatggattgagaagaatatgtaggaaattcacagctattttaggaactgtcatatagagaccactaaatctaaatatactgttgatgtatatgaagctattggttagaactaaggtcagaattagtggaaaaatatcgggactggtgtcctgtcttagagagattaaggaatattaggattgtggtggaacgcgtatacataaagtagcttattttactcattgaatattcttttatctggttatatttgaaagtaaactgtggctgggcgcggtggctcacaccggtaatcacccagccctttgggagg

SEQ ID NO: 99823 - DNA, 1054 bp, Homo sapiens
ttttttgtcctactttgcaaatatttttttctatgccttgacttaaattcaagtctgttggccaagcgcggtggctcatgcctgtaatctcagcactttgggaggccgaggtgggcagatcacctgaggtcaggagttccagaccagcctgaccaacatggagaaaccccgtctctactaaaaatacaaaattagcccggcatggtagtacatgcctgtaatcccagctactcgggaggctgagggaggagaatcactcgaacccgggaggtggaggttgcagtgagccaagatcgcctcattacactctaacctgggcaacaagagcgaaaaactccgtctccaaaaaaaaaaaaaaaaaaaaactgtcaatctttttttatttcccatggctttgttatccctaaattttataggtattcactcatgttttctcttagttctttaaaaaaaaattggctataattagtctgatatttgttttggagtatggtatgaagtaaggattatttgtcccctctagtttatattttttgggtactattaattcatccttattaacttaaaaaataacaccttaatcatatgctgaatccttggatctgttgttttagtcagtttatctgttcttttgccatgaccttactattttagacattaaaatcactttatagtaggctttattatctggtagtgcctatgctcagtttttactccagtgtttttcaatttagggtttcaaaatactccctccatcttgagatggagtctcactctgtcccccaggcttgagtgtaatggcgcgatctcggctcactgcaacctctgcctcccaggttcaagtgattctcctgcctcagcctcccgagtagctgggattacaggcatgtgccaccacgcctggctaatttttgtattcttagtagagacagagtttcaccatgttggccaggctgtcaaaatactgttaatgggaaatttcattaaatgcataagttaatttggggagacttgtcatctttataatattgacttgttctgtgtatgaacagaa

SEQ ID NO: 99824 - DNA, 1319 bp, Homo sapiens
gttgttgttttttttttttttttttttttttgagatggaatcttgctctgtcacctaggctggagtgcagtggtgtgacctcggctcattgcaacttctgcctcccgggttcaagggattctcctgcctcagcctcccaagtagctgggattatgggtgcataccactgtacccggctaatttttgtatttttagtagagatggtgtttcaccatgttggccagcctggtctcaaactcctgacctcgtgatccgcccaccttggcctcccaaagtgctgggattacaggcatgagccaccgtgcctggcccactcatgagttttgcccactcatgagttttgctcaaagcagctgatggctcgggcttccttcccaaaggcatcatctcattgagcacctggtggaggtcatccatctatgtgtgtaactcttacagagatgaatccctctatcttctaagttgaatggaagtgcagtttgataaggtgcgcttctctgttggaccctctccaagcaatagaagggaccctagaaagacaagagagccccatgtgatagggccaaggaaacagtgatggtgcccataggtattgattatgcattgggcactttaggttattattgctagtcctagcaactggcaggcaaggtggcttctggtccttcatttattgatgaagtcttgggtaacttctgtaagttaattcctgagtcttgaattctgttccattaaaccactgtagaacactattcccagctctcatctgaaactcagggtttctaagttctcgttagtatagaagagggcagagaagccagtgtcagttgagtgccagggagctctgcccagcactcctgtgttctttcacgttgatcagtctctgcagccctgtgggctgggtattaacgcttttcatcctacagctgaggatgctgaggtgtggcaggagggcagcttcttgcctagggtcttagcgctgacaagtagagtcaggatttgaccctaggccggtcagttgccaagctcgaagttagactctaatcatgctgtgttccaggatgacttttggggacttgggatagaaagtagggttaggctacagaagttgggaatgacattccagatcgagggatcagtgtgagcaaagggtggagcaggagaggcatgtgactgggagagggtaactgagttaggacagttggaaggatgctgaggatgtgatgggggtcaggtggagaggtcctttgatactgtattatggggcttgaatctttgtctggaaaggcacggggagattcccagaaggggagtgactt

SEQ ID NO: 99825 - DNA, 1092 bp, Homo sapiens
cccccggtggtgcgcacgggcatcgtctcgccccctggaattcaggggcatcaggaggggcggcaagagggtgccttttacattcttgctttcttcccttctacaaagactgcgcgaagtaattttagaagcagctcctccgaccccggggcctttctggcctgttccctggggggtcgcgagtccccctccttgccacctttcggggggaaaaaatgacatttcgagtgtgactactttaaggcgcaggattttctccttcgtttggtcctagatgcccccccttggatgggtggctgataggatgtcggcctgcaggctgggggtttaagcgtgactgatgggaaattatcgattgtcagggcaaagggtaaatgagggcaactgcaggtggaagaaagtcacccataagggctttctgggtctgcagcgtttgtagtaggtgctacttctattcttgcagtgctgggagacgggcgggggaagatgcagtccctgctgacaattgggtcatctgcgcgcagagaaggccccgggatgtgcgaggacatgggactgggagtccggaggcagtctggtttgagctgtcactaattggccatgtgacctccctcagccggcttcgtcctctctgaagcaaaaggctggaattggggtggctggagcatttttattttatgcttttgtatttgaatgctgttgggtttgggcctcaccgtttctggttgtctacacctgcctttttcaccgttgcaggtgacgttgcctgcctcccctgaaggtgtttgaacctggtgagatgtataaagggcccttttcagctcaaaaaatcagaattctgtgctgggttatggttggctctatcagggtcacttatgaacgtattactactgttctcttttcattcatccccaatttaatggcttttgggcaccagtgggtgtgcccagtgtaagctctcatggcacacctgctagttaaagggaggcagcaggtgtgtccagcctgttccatgtgacatcctgagcatgaggtatctgctttctaggctatttcctttgccaaaatggcaaccagcttctttcttttaat

SEQ ID NO: 99826 - DNA, 1025 bp, Homo sapiens
catcagcattacctgggagtctgtgagaaatgcagaatctcagacccaccccaaactccctgagtcacatcctgcattctcaggtgattcaccacaaggaaggctgggaagtgctagcctaggctgcccttatcaatcaatcaaagccattctatgggatgaatgtgtgtgtcctccctatttcagaggcacactacatggctctgtccttgctcctgtccttttccaagcgcttatctatgcattgtatgagaacataggtcataggctgatctgatttgctgacagtaagaatctcaggggaaagctgaaacactggattggggaatcatgatacaaacccactgagaggatggagcaaaggaccaatttcaacaattggctaaataaagttcaaccaaaaaaaagacttcacaggagtatacttgaaaatagggcattagggggttcacagcatctgttccggaacaggtacctggtgttcttaagagggttctattacagattagtttgggaagcaccactgtgctttttcctcctcttagaaagtccatttataggccaggcgtggtggctcatgcctgtaatcccagcactttgagaggccgaggcgggcagatcacctgaggtcaggagttcaagaacagcctggccaacatggtgaaaccccatctctataaaaatacaaaaaaattagccaggcatgatggcgggtgcctgtaatcccagctactcaggaggctgtggtgagagaatcgcttgagcctaggaggcagaggttacagtgagccgagatcgcaccattgcaccccagcctaggcaacaaaagtgaaactccgtctcaaaaaaaagaaaaaaaaaaagccatttatgtggctgggtgtggaggctcacacctgtaatcccagcacactgggaggcagaggtgggagaattacttgagcccaggagttcaagaccagcctggacaacacagtgagactctgtctcaattaaaaaaaaaaaaaaaagtcaatttatgcact

SEQ ID NO: 99827 - DNA, 2100 bp, Homo sapiens
taactccagctacttggaggctgaggtgggaggatcacttgagcctgggaagtcgaggttgcagtgagctgtaatcacaccactgtactccagcccgagcaacagagcaagactcttacctcaaaaaaaaagaaaaaagagaaagaaaagaaaacctgaaaggctgagaaaaacacagagtttattgtagtggtatctgtacaattacaaaaggtgaaaaacaaccaaagtgtccagcagctgtatgtggggcagttaggtaaaactgtagtatgtccatttcggtggaatgttacacatccttacagtttaaatgtatgaaaaggttttaataatattggccacaggacacagagtatggtgtgttcacaactaagagctttaaaaaaaggaaaagaagccaaaatatctggatgagaatgggtcatttttttctttataattgttaatattttgtagtttgtcttcaatttataatcaggaggaaaccttttcccttggtggtatacaactcaaagaaaaagtactgaagagtataaaatactgatctaaggattaggtctgtgacgttttattttaaaatgtgtaactcttacggtactaatgtgtttgcctccttctgccaccagggggcagaccgggccgttccagtgctgatcattggcattctggtgttcctacccggattttaccacctgcgcatcgcttactatgcatccaaaggctaccgtggttactcctatgatgacattccagactttgatgactagcacccaccccatagctgaggaggagtcacagtggaactgtcccagctttaagatatctagcagaaactatagctgaggactaaggaattctgcagcttgcagatgtttaagaaaataatggccagattttttgggtccttcccaaagatgttaagtgaacctacagttagctaattaggacaagctctatttttcatccctgggccctgacaagtttttccacaggaatatgtatcatggaagaatagaggttattctgtaatggaaaagtgttgcctgccaccaccctctgtagagctgagcatttcttttaaatagtcttcattgccaatttgttcttgtagcaaatggaacaatgtggtatggctaatttcttattattaagtaatttattttaaaaatatctgagtatattatcctgtacacttatccctaccttcatgttccagtggaagaccttagtaaaatcaaagatcagtgagttcatctgtaatattttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaagatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaacatttcagaaaacattttaatgattttatgatatctttaatcccagtacctagatctaccttagtttctaggtagctggcattgtgggtcacactcaactttccctaactctgaggttatggacttgggcaactggaagcctggacatgccatcagctgagttgcaaggctgtgggaagagcaagttttagatgtctactcaatatccaagtggagctgttgaggaggcagttgcgatgcatgtgtgtgtctagagtttaagagtgggtcttggatggaaatagaaatttgggagtcagcatttggacagtatcttaaaagctagagggctgtttgagatcaccagtagagtgagtatagttggaggaaaaaaaaaaaactcaggaagtga

SEQ ID NO: 99828 - DNA, 1040 bp, Homo sapiens
ggttcttatttctctccctggcaaggtctgaagacgggtaggagaataacgtatgtagaggcgcgtaatgccaggcactgtgtgccaaacgttttatgatgcttttagaactctcgtaacattcaggtgctgagggagtttgggggtagcggtgagctggtaaaaagcctgttggcaacgaagactgatactttgaaaatgctcgtttttatttttcccgtcttttagaatcctctttgccaagagtaaacattcgtctcccctctccctcacgcccctgcgatgtattgttttgatgcggatgtatgaacagttaatgtcaggggacgtactttaaaaaaaagtctaattgcaagttagatgtggttaaatgccctcaaaaaccacacatactggtagtttgaactttgttttatagaattaaatgcagccgggatcacaacactaaaaacctactatttgacacagtttgatccaatcttttttgaaaagtatagagattaacattatgctaatttttaaatacttgatttctagaccaggatgtaatcaataaaaacggatattaatatttagcaccaattatttaattatgctagttattttacattgactgcaagccacgtaaaacagttaggccgggcgcgctggctcacgcctgtaatcccagcactttgggaggccgaggcggacggatcaaaaggtcaggagtttgagaccagcctggccaatatggtgaagcccgtctctactaaaaatagaaaaattagccgggcgtggtagcaggctcctgtagtcccagccacttgggaggcagatgcaggagaatcgtttgaaccctggaggcggaggttgcagtgagctgagatcgggtccctaaactctagcctgggtgacagagcgagactccgtctcaaaaaaaagaaaacaccaaaaaaaaagaaaaacaatttgttattttttggaattaggtatgtacaaagtacttagaacagctggcatctaacaaagactaggtaagtactaaccaccattattgt

SEQ ID NO: 99829 - DNA, 1173 bp, Homo sapiens
aactccagggcttaagtgatcctcctgcctcagtttcccaagtagccgggactacaggtgtgtgccaacacacctagcctggtttcccctaatttcattttcccccttccattacaatctatttgttgaagaaattagatcatttattaagttttccagagtttggattttgctgattgcattcctgtgtatacataaattcctctaccctgtgtgtcctacagactggtagctatagccctggagccttgatattcagggtgttttgtttcgggggtgagagagcaagaatataggtggtggtgtgtgcctctagtaggaggcacagggtgtctggatgtgtttgcaatgttagcagctataatagtcattgtctagatccattaagtcattaattagagtttgcagagctgaaattaatacgttttattcacttattggctgcttattagaaaaacttccataaagaaaagctttcccatattatataatttggttatctaaattatagctataggaaagacaagctagataatcgagtcttttgctttatgtatcagtcttcaaaattttcatagctccctccaaagtgaccaatacaagtgtttgtgggtttttataaatatataatgagctaatagattgcaactttcttgatgtttttcaatgatgaatcttttgttttgtaggttaccatagagatgaatgaaccagttcaactaacttttgcactgaggtacctgaacttctttacaaaagccactccactctcttcaacggtgacactcagtatgtctgcagatgtaccccttggtaagataataaatttgaaccttgttttgtaggtagtcatatgtgatacatactcctcagtaattaaccatcttcctgtctttcagttgtagagtataaaattgcggatatgggacacttaaaatactacttggctcccaagatcgaggatgaagaaggatcttaggcattcttaaaattcaagaaaataaaactaagctctttgagaactgcttctaagatgccagcatatactgaagtcttttctgtcaccaaatttgtacctctaagtacatatgtagatattgttttctgtaaataacctatttttttctctattctctgcaatttgtttaaagaataaagtccaaagtcagatct

SEQ ID NO: 99830 - DNA, 2097 bp, Homo sapiens
ggctcagtcgcggttgactttaaatgctttataatgcccttgcgagaaatgtggcagcctgtcatcctacttagtggcaggagattgtttctatccagaagggacactgctggtggtattttagtataaatactgccagatgcgtcccaaaacgtctgcattaataatggcatcctccagcagtccgcttaccctccaccagttctgagacggcctgatgggtgagagtggtaaccccttctaaccgcgttcgaaatacagcccttcagcagacggcgttgattttaaagcatgtgtctcctgtcttctagtatgtccaaaatactaaaatgcgccggcaatgaagatatcattacactaagggccgaagataacgcggataccttggcgctagtatttgaagcaccaagtaagtcgtacctttttaccgagtcacgaagctacagaaaatcaaaactctgtgtcagtatttctcaaaagcatctgctttcttttggtagaccaggagaaagtttcagactatgaaatgaagttgatggatttagatgttgaacaacttggaattccagtgagtatcagtttctcattgtagagagtgctgtacacaggcacgatagttatgtcatagaatgtttgtttatttttacagacagggtcttggctctgttgcccaggctggagtgcagtagtgccatatagctctctctaacctgggattcctgggctcaagcagtcctcttgccttagtctcctaagtggctaggaaggactacgggcctgtcccaccacacctggctaattttttcatttttgtgtgtgggcgtgggggcagtcttgcccaggctggtctggaactcctggcctcaagtgatcctcctccgtcaagatatgttaatataatttaagcctacttcataacaactttttctagaaatatatctactggtgcatgtttcaaagagagattttagtatttggatagttgttcaccacaagtctaaaactcacaggttaaatttattgtttactgccagttgtctatttgcattaacttccatgaacctcttttaaaatttgtttccttctagaatgcttgctttttattaagtggattttaaagctgacttggaagaaatttatccaggttaggtttataaacaccaaaggagagaagaaatgtttgaatgttgaaaatgcctaatatattctcttgctttcttttagaaagtagttaggcctgcttgcgccatcatgatttctgtgccatactctaatgttctcttactttatccctggaggatgaggaggaggaggctcttgttccctggatggtgcatttaatagccatttatttttttgagtggagtttgttaagaaattacgcaagtcatattttaaagtaatcagaaaatattgattctgagttgtttaggtgttgccttttaagaaagtgagggtgccaaatcattaaatttctaacaattaacttttggaaaatttttgttcttaataggaacaggagtacagctgtgtagtaaagatgccttctggtgaatttgcacgtatatgccgagatctcagccatattggagatgctgttgtaatttcctgtgcaaaagacggagtgaaattttctgcaagtggagaacttggaaatggaaacattaaattgtcacagacaagtaatgtcgataaagaggaggaagctgtaagtagtttttaagtaaaaagaaaatagtttgaagagaattataatactgcttattaggttaattgctaaaattaaaagtagacagaattggatcccaagtaatttctgaaaattgagatactgttgaaatctgcgaatgatttataagtgtcatccaatttagaattatatttgcaagaagggaatacaaattcagcacgtgtacataccacagaacagtggtttatggatcaagtccacaccggctcttaagggtaggattgggaagttaggcgtataacctttagctttctggagatacttactctcttaccaaataattgagcataggacagcagctcaatagaaggatatggttaggagtaaaagtctacctgtttggagca

SEQ ID NO: 99831 - DNA, 1117 bp, Homo sapiens
gaacaattcacctctttatcttgtgacacctacgagcgcatcaattctgtaattgaaaaataaagtgcatatttgcagcagctgtactctcttcaggctgcaaggaggcttttcctcccggtaggcttgatttgcatttcactttcactttcgtggctggaaactttctacccacgtagtgggaggctgaggagccaccataaagctggggcttgacgagccgggaccgggacccgatctccacatatgcccggacttgttctgcggccgggttcaggagtcaaagaggcggggagacctgcgcgacgctgccccgccctgcgcccgcttcctccaatgtatgctctagggggcgggcctcgcggggagcatggacacgattggccctaaagtcttccccgcaaggccgtgggctggacagcgtggtgacgtcgcaacgcggcgcagggtgagagcgcgcgcttgcggacgcggcggcattaaacggttgcaggcgtagcagagtggtcgttgtctttctaggtctcagccggtcgtcgcgacgttcgcccgctcgctctgaggctcctgaagccgaaaccagctagactttcctccttcccgcctgcctgtagcggcgttgttgccactccgccaccatgttcgaggcgcgcctggtccagggctccatcctcaagaaggtgttggaggcactcaaggacctcatcaacgaggcctgctgggatattagctccagcggtgtaaacctgcagagcatggactcgtcccacgtctctttggtgcagctcaccctgcggtctgagggcttcgacacctaccgctgcgaccgcaacctggccatgggcgtgaacctcaccaggtgagcctcgcggccccgggaagccggccccggcccgcctgcacctccggtgcttggcgggagcgctttcgagcctagccctcattggctggcgtgggccatccgcgccttctcattggcctgccacgcagtggggtggggcccagctgagcgcgcggttcggaaaagcccgcgctggctgctgcgcgaacctgctttttcgcgccaaagtcacaaagcgggtggtggcgggaaaatcaagggtttttccgcagtgcc

SEQ ID NO: 99832 - DNA, 1757 bp, Homo sapiens
cagctccggccatccgcggttaagcgggagctcccattggctaatcgcacactgaaacgcacgccttttcccgcccctgacgctgccgtccaatgcgcgcctctcgactctgctccgccccgccccgcccccgtcgccctgcctccctggcgtatttgcgccattggtggatattccggaccgtgatggtggcgctgcgcgtgcgcactcgctccgagccctgctcccgggagagggagctctcgggtcggggctagggaaggctgaccccgctcggcccgggtgaaagggcggtgacggcactgggtggggccgagctccagggctggctgctgggctgctaagggaactgtgagccgctcagagccgcgcgcctcccgggcggggcggggccggccgtgggagtccgcgcgtgcccgcgccgagctgcctgctccggcggcttcgctgctagctcgcggcgacgtcgggccgattttcccaggatgacagagctgaggcagagggtggcccatgagccggttgcgccacccgaggacaaggtagcggcagcgtcggggtgggcgcggccgggacagcggcgcatccgggaggcctgcgggggacgcgcgcagaggggtcgtcttgttctctgaccctttgtcgcagccgacggcggccccgggcccgggtagcgcgaagggccctcgggtgcccggccttcgcggcgcgcgcgtcaggggtcggcgggtcggggtcccggctcagggtctgactgaagtggctcccccggggcgcaggaaggagcttctcgggagtggcgcacggcctcctgcctcgctgggctggctgcggggactcccctctcccccaactccgtgaggccttcctggaggtgaagatatgcagagccttcttagggaggcggctcctctgagcgcaacttaggctctccgttcccttttacaatgttattattttggggggtgggggaatcaggacaaggccatagcatttgcctcctgggagatgtaaatcccttcttgggcatgaaatcatcggctttgagcaaaggggtgttacccagtgagccagtccgtcatcagcaggtgttggagggcgtcctcccggttgatgggttgtttcctgcaccgtgtgggctctggtgggtaggggaggagagtaggaaggaggccatcttggcggggacagtggcgggggtgacgggtgggggagtggactcctttgggtgaagtgaaagatctgtgtaggggagttaaggaaggtagggattggttttattactgtggaggttgaatggcagtataggactttgtagcagtagttgtgctttccgagatagcagtgatcaggagccctgtgtttgggaaactgatcagacagtgatgtgtagaagggactgagggagcctggaccagactgagggagcctggttcactcgggattgcccatgagtgacctgtagatgttttctttggcccacatattgccttaaaaatcagaaagtttctcctaacaatctaaatttcttgcctgtcttagataattggagggtccaccatcactttgtcacctgctcaatggttggctggagctgaggatcatcggttcccaccaatccctgttgccttacaccaggctcacggcttcccctaatgcagcctgtaactttttgatgactggacgcaacggacattagggagacacccagaaggaagaaagcacaagatttggtgacaggatgtcaacagagcagt

SEQ ID NO: 99833 - DNA, 1025 bp, Homo sapiens
ccagcctgggcgacagagcaagactctgtcttaaaaaaaaaaaaaaaaaaagctctggagtaaacttgaaagattcctcaaaatgttacagttgcttaactgctgtggcaaaactgtcttgtaaatagaaaatcattagtatcaaaataatctggagcatgtttatttataaaagtcagaaggtattttgttatatttagcatctgagaatggaattttcaaagccaattgctaataaaggaaatgttctcctctgggaactgtgcttataattttaaagtcccaaagcacagtatagttgccaaactaagaaacttggagtttaggctttgggaatgatcctcttcctacccaaccatatttttctgatggagcttaggaaagcaaaggatgagatatggtctgaaagattggcatcttaaaatttatgattgagttggcatttcaggagattttgtttcggaagttagcgtataggttctggggttttctgctttacttaattgctgaagtgctatttaaattagagctttacttatttcaaggcttcctttctagatagatgaaacccatatggagaggaaatagtgacatcatttagaaaggggagtttaaatcttaactgaagatagcgtgtaagagcaggggcttgggtcagttacatctaccttgagcctgggctccgccacataaaggctgtgtaactttgagtagatcatggaagttgtggcagcctcagtttgtccatcattaaaatgggggtcataaaattgtatgtgctttacaggatattcatgtggattaaacgtatgtatgggctgacagcagagcttgtcacataatatgttagctatgttgctactgattaaaatagatttttatagaaaaaactttaatattcatcttacacacttgaaaggtgattaaatcttcaagttatatatatttgtagaacctattcatattcattaccttttaaggaaagttttatagaaaggacttagccttctatgacctatcttcgg

SEQ ID NO: 99834 - DNA, 1052 bp, Homo sapiens
cctgggtctctgatgtggagaggatgtctgccattgacaccgaacccctgagtgggcaactctcagagccatatctccacagtccatgcctggctagtcctgtggtttcagtggtctacaagacattcctaggtgcatgcccttcagtccacacaaactgactttgtctcaaatctgaattctctcattctactcttaccaccctccttcagtttctttcttctgcgataaaatcccagatgactcggttactcaggcttgaaatctcctattcctttgttcccgtgcccagggcaggatgcagattctaaccaggtgtgacttggaatccttatctgtttgttgtttgttgtctgtttgttgctcttggagacttcaacatttcaggactgcagtattgtaaatgcctgcagtatcctaaatccgaattccttacctctcctggaatccttatctgtcttttactctttgagatttcccaaatttcaggatttattgcttgccttattgtaaaccctgtgaattgagctccctcctgttaggatttgctctaggtccctcctaatccatcttgttctttgtatctttcaggagttctgaaactgccctaataattattgggggggtggggtggagtgatagaattctggctctttttcataatgcttaaactttaagatcctttgtagtcttctgtctctcatttccttccaattcttgttttaggttcaggggatacatgtgcaggtttggtacacgggcaaattgcacattgctgaggtttggtgtacaaatgattttgtcacctaggtagtgagcatagtactagatgggtagtttttcaatcctcaccagcctcccactctccaccctcaagccctggtgtctcttgttcccctctttgtgtccatgtgtagctcccagttcactctgcaagtgagaacatgtagtgtttggttttctcttcttgcattaatttgcttaggataatgacccctagctgcatccatgttgccacaaaggatatgattttattcttttttatgtagcct

SEQ ID NO: 99835 - DNA, 1066 bp, Homo sapiens
cctgcctcagccttctgagtagctgggattacaggtatgtgccaccatgccccgctaattttgtatttttaatagagacagggtttctccatgttggtcaggccagtcttgaactcccgacctcagaagatccgcctgcctcagcctcccaaagtgctgggattataggcgtgagccactgcgcctggtctgactccatggctttttaaaaaaaaaaaaaacaaaaaaacaaaaacaggcaatgatcttttaaaatacgcatcgttggtgacattgatacaagtatatttttgttcaagtttttttttctttttttcctggtgctgataaactaactaggagtaggggagtgatgagagcactgaactgcaactcattcctcttaagctttcatctctaaagaatcccacccttttgtttgataactttaaggatttctttttttggccaagattgcagccttttaattgctagtgtcctatggtttttgtttcaaagacagcatttcctgtttatcttggtgtactttcgtttcatctttagtttggatactctttgaactggcataagaattagtctccaggcaggccaggtacggtggctcacgcctgtaattccagcactttgtggggccaaggcgagtggatcacttgagatcaggagttcgagaccagcctggccaacatggtgaaaccctgtctctactaaaaatacaaaaaattagccaggcatggtggcacacacctgtaatcccagctactcgggaggctgaggcaggagaattgcatgaactcgggaggcggaggttgcagtgagccaagattgcgccattgcactccagcccgggtgacaaagtgagactctgtctctcacacacacgcacacacacatgaattagtctctaggcagaaactttgctttattgattggttttcttcctcctcttgaggattatggaggaaaagaggaagccttttaaatgaggacagcttggtgtgggtaagtctcaaaatataagtggagtaactggaaaagcatgccatttagtatgcatttgtaccacacg

SEQ ID NO: 99836 - DNA, 1080 bp, Homo sapiens
tgtcccaataccaccttgcatgcacagatcacttggaaacaaaagtttcaggaagcagtacttactgtttgtgatatattcggaagttttcttttctgtttgagtctatcttatactttttatgtacactttttattaaagtataacatatgtatagagtgcgtacatatcatatttttacaatgacttttcataaagtaagcacatctctgcaatcaagataaagcaaaatggcaccagtcccagggaagcgtctctcctgatgtctcctaatcactgctcccctcaggggagccactagcctgacttctggctccatatcttattttatattttgctagttgtgacccactgaattgatttcaagacccggtaggtctcaacctatagtttaaacaacacaaccttgttttattttcccaataactcttaggaattcctttttatggatgaaaaagctaaggcccagtggtcagatttctcccaagatcgtatagcttgtactgtttgctttttcccatgcatttgagctactcttcttcctgagatgaggaatgacttgctttggaaagacagttgcagccctttttgttttatgtcttgtttatcactctcccttaatgtgtttacaagattgatattcattattaatgtagctttagtgagttcctgatcttaccattcttaagtactgagaatgtttttggtttgtgtttttgtgactgagtcagagacatttgcttttgctttggaggtttgtggcttggaaactttcatgatatttgtctttggcctccccctaataggatgaagctcttcaggtggcatgcaggtatgacaaatgatgactgtgcacagcttcccaccttcattcactgtgctgacctgcagttccttccttgcctgtaggcttttcctatagagagatttctttccaccccgttcccacctcatgtctcccttaggctccagaatacctatgtggagggcctgagtgctaagctgtcctgtcatctgcaagcttgtctgattgtgagattgttgttcccagccagcacctctgggagtagaagtcccata

SEQ ID NO: 99837 - DNA, 2247 bp, Homo sapiens
ccactgcactccaacctgggctacagaggaaactctgtctcaaaaaaaaaaaaaaaattatgcatatttatggtagctgttattatcattgcataatgttactattattcccataattattcagggcagtgcagtgtaggatcctgctgctggaaaaaaatatttttttcttcagatagtcagctgtagaaaccatccaagtggatacagaagcagagggcactacatttcccttggtttttttgtttgtttgtgttttgcctgataccttctttaagatataagctaggtttattttttgccaagtttggttgtgacttaggcattggtactagtggtcctgctcctgccagcatgtggctggtgcctccgtcacggtgaatctggaaaggactgagctcagggccctcatctcaggaagatccatatcccttgagtttgtgcattggtttttttctgggctcctaactggtgttttctccttcccctgctctctgacctagatggaagaactggtgggtgagaggcatcctgactttggccatgattgcatttttcttcatcatcatttacctgggaccaatggttttgatgataatcgtaagtgccatttcacactattttagttttcccttcagtttttgctgcaggcccggttgtcttaagtgcgaggtgttgggttggttgtgggaattgacgggggtccaggcttctcagaaaacctctgccatagaacatctgtgacttcccacttctcagtagccacctggagggtcattggtgtaggctggttgtttatggttgaagatgtctcagtgtcttttcttttaaaaaactgactttattgcctgtgatcccagcactttgtgaggctgaggtgggcggatcacgaggtcaggagtttgagaccagcctgaccaacatggtgaaaccctgtctctactaaaaatacaaaaattagccacgcgtggtggcacgcgcctgtaatcccagctactcagggggctgaggcaggagaatcccttgaacctgggaggcagaggttgcagtgagccgagatcatgccactgcactccagcctgggtgacagagtgagactccatctcaaaacaaacaaacaaacaaacaaaactgactttattattccaactctgtaaacttttaccctgggcatgtctctatatgactcctggtttcgtttcctgttttcctggggcctcccttctgggcttagagcttttgttaaggaaatcccagtccacagagctgctctgtctgtcttcccactgtcctggacagggtcaggtgaccatcagctgcatgtgagcaaagcatttgactttgaatacttgagacttttcaagtattcagagtcaaaaggagaatggattggttgaatcctgggaggttctagaataaaaagttaaaaaggaggttttagaataaagttaattgagggtcaggcatggcggctcacgcctataatcccagcactttgagaggccaaggcgggaggatcacttgagcccaggagttcgagaccagcctgggaaagaaggtgaaacctcgtctctacttaaaaaaaaaatccttttggctgggtgcggtggctcacgcctgtaatcctagcacttttggaggctgaggcaggtggattgcttgagcccaggagttcaagaccagcctgggcaacacggtgaaaccctgtcttaaaaaaaaaaaagttaattgaaacatcagggtgtgtattttattgtgagtggaaaattggatctactccctgtgacatagagggctgcattgctctgtgggatggtatgagagaggaagaaggagggaagcagaaccactggaggcccgatatttttcttaagtataatgggttttctggaaggctcatgacctgttggtttccatttccaaaaatcataagaattggggtgtcagtgaatgttttgtgtcccgcaggtgatgtgcgttcagattaagtgtttccatgagataatcactattggctacaacgtctaccactcatatgatctgccctggttcaggacgctcagctggtaagctctccggccccacagaggcttttagaatttggatgatgtgctttgtggcaggtacttacagtgacggtgggtatttctatcacttgctatagagataaatgctggagaggcagttatcatgttaggtcatacaaagtttcatgaagaaaatggtatttgagcaataagtgaagaa

SEQ ID NO: 99838 - DNA, 1050 bp, Homo sapiens
caaagagaatgtcaggagcaggaaaaaggcaggagaacagcagacaggtgtggcaaagccggaagaaaccattttgataggagtgaaggagttcctgttgggaagagtggaaacgagactggggaagcaggatgaggcgtgtttttgaaggtcatatggttcaaggatccctcagttaggtatgggaatgctacaaaaggggcaaaaacggagtctcaagtttgggagaaatggagagtgaatgaaagctgctgtctgtttctagataaatttctcacctacggtgtcaccagagagcaggaaaccatggtctgcctgttgctctgtgagctgtcccgggggactcaagggtggggggtattctgctgccctctgtcccttcctctgggatgtctgactgccttgctgtgaaggcaagggtgctccccacggcaatgacctgtcttcatttacaggtactttctcctgtgtgtaaactatttcttctatggtgagacagtgacggattacttcttcaccctggtccagagagaagagcctttgcggattctcagtaaataccaccggttcatttcctttactctctatctaataggtatgcattaagcagttcaccatttcttgtgtctgtattgtttttgtatgtctgtcaggtaggaattggggaatttcttggttagtatacagttttgtgacattaactgtgaccatgcaggggagcagagctgatgctctatgttaagctgtagcagctgttaccttttttttttttttttttgagccagggtctcactctgtcacccaggccagagtgcagtggcaccatctcggctgactgcaacctccacctcccaagttgaagcgatcctcccacctcaggtcccgaagtagctgggactacaggtgcctgctaccatgcccagctaatttttgtatttttagtagagaccgagtttcgccatgttggccaggctggttccgaactcccgagtttaacttatccgcctgccttggcctcccaaagtgctgggattacaggtgtgagccacc

SEQ ID NO: 99839 - DNA, 1777 bp, Homo sapiens
ataaatactgtaggcaattataacacaatggtaagtatttgtgtatctaaacatagaaaaggtactatatggtaattagtaaatcttatggtattataatctatgggtattataaccttagggaactgttgttgtgtatgtggtgtgttgttgacgagaacctcgttgttcagagcatgactgtactcagttctgctgagttgtagcttgaaagcagccatagacaatatgtaaacaaatggacataactgtgtttgaataaaactttatttataaaaacaagcagctggcctgaccactgtttgctggcccatgttctaggaataaaacattcctatctgatgaaccatgttctaagtttagtgtggtctgcatgattataaaatattgccttccttttactgtttgggaggagttattttttccttgtgactgtttatctgggtaatgtttttctcccctgggctttgacattgtgcactggttagctgctgggaataaattagccaaagaaccacttaacatagctaaaggagggcaaagataaatgcagaacataattcatttttcttttctcctcccacctcaaactaggattctgcatgtttgtactgagtctggtcaagaagcattatcgactgcagttctacatggtaaaggaaatgcatgcgtgtgtgtcagaattcttgatttaaatgaagtttttcaggaactcaacaagcctttcatgctttctgtgacaaatcaaaactcaggaacatggtctgatatgtatgcatctagagcatgaaggaagaatgcccatttaggtttaatggctctacgttgacttagacccagtcactgttacttacaccttaagcagcctctccactaggaccctgaggtgggctccagagaaggcacaagctgaagcttcagacactgcccacagatgtcctgtctggtacatcacttgctaccacttattccctgactcactagagaacagctcctctctgagtgctccaggtgctcaataactactaagaaaatgaaaaatacccaggctttcagagcatgggagagctcactcactagtgggctgtgggggacaaagtattactctcagaagcctgatcttacctgttcactttcaataagtcagatacaaaagcagatatttttcctacctgcttctcagcagttttctatttggtattgattgttctttgaagttactttcaaggtaaactggtaagtagtgtttatttttcttttttttgcagtttggctggacccatgtgacattgctgattgttgtaacacagtcacatcttgttatccacaacctatttgaaggaatgatctggtgagaattgggagttggattttcccttttattttgtgagtgtttctcgtgtacagatacccccctctaagccagtggccctcaccttgagccacatcagaatcctctgcagggttcattatagcacagattgctggaccccacccctgactttttgattcattagatctggggtaggcttgagaatttgaatttctagtacattcctgggtggtgcttatattgctggacaggacctatgctctgagaaccactgttctagactaataggtacaggaatatttaaagactcaaagacaatgcaacatgtatggcaacagatttgaaaacctagaggaaatattcatgatttcctgacaaaatatatactaaaagtcatgaagaagaaaacgtgaatagatcagtaactgtaaatgagctttgaaa

SEQ ID NO: 99840 - DNA, 1747 bp, Homo sapiens
aacagcaagaaaagtcagtaaataatgaaagagtcattaaagcatactatttagaattggggaggtaaccactagaaaaataaaaattagaaacgattagaagtggttatttttgggaatggagatagggatgggagaaagaaggaaaactttttgttccttttacaattaaatttctctcattgtttacgtatatttctttatcatgaaaaaaggacagatgaccttttagtttgcaacctccacttattcagtagtcattcagtaaacacttgaatatgtactctgtgctaggtactaggtatgacttttttggtattttttatgtttttaacttactccttaatgggttaccagaattttatgggtgattttggtgctggaatttaagaatggcactattttgtgtacttttgaggtactgtcaccttgcttgagttgatccttactttggttcatttctaggttcattgtccccatatcttgtgtgatctgtaatgacatcatggcctatatgtttggctttttctttggtcggaccccactcatcaaggtaaatggattaccctaatgtgaaataccactgtgaggggagggtggtgctctcaatgtgagtagatcagcctggcagacagaagaaatctagctgtgttgtattgtggccatgtcttcatgtcttcctggagaaaggccaaaggaaaacactgacaactgattaaaaaaaaaaaaagataataaagaaaataggctgggcgtggtgggtcatgcctgtaatcctagcactatgggatgctgaggcaggaggattgcttgaggccaggtgttcaaaagcagcctggggaacttagtgaggccttgcctttactaaaacatttaaaaattagccaggcatggtggtagcatgcacctgtagtcccagctccttgggaggctgagatgggaggatctcttgagcccaggaggttgaggcttcaaggagctgtgatagtgccactatactccagcctgggtgatggggcaagatcgtgtcttgaaaaaagaaaggaaaatatttttacagatttatataatcttttttggggacacattttttgggactttgatctggatttgagtgtagtcacttaattagtatatcgttttctaatataaaactattcgaatgactgattgaaacagaaagggaaccaaagggaggaggatataagatagggaacaaggaaaccatatttgggggagctttaaaaggtgacatggttaagagaatggggttttatgaaagaaaggttcttaacaagtaatcattgttcgcaaagctatagttatcaaaacaccctttgctgagaacttgctctctgtccacagctgtccccgaagaagacctgggaaggcttcattgggggcttctttgctactgtggtgtttggccttctggtaggtggtggctttcagctgtgtaagggattgggtggacagaggcctcataccaccttccaaggcctgtccagagctggagagtgtctttggaggccaggactgtcctgctgaatggcaaccttgccctgaagagggccactggccatgccagccatccaccagctttcaggcagggtgctagcagttggagagcaccttctatgccctctcgcgcccaggcatggtgacatcagcaggtagccttcttgtcaggcatttgatgttccaaggtcagggtgagtgcacccaagggaagatgagatacacagct

SEQ ID NO: 99841 - DNA, 1108 bp, Homo sapiens
gcaccattctctgcttctgacccttgggccagtcctccttcttcagcactgtctggctgcccttcagtgctcaccgcccagctttgttgctttccagccttgttcctcctgagatctgcctctcactgtgccccttccccatggcctctctccagttatcactgacttcagagatcttgaggaaagtggtcctagctccccaaatggggagagtcttcttgtagttctttgccccagtcccttcaggttttcccggattctttcggggcctgggtgtttgggttcctgtatgtaaccttggtgggtcatgagcctctttttttttttttaattgaggtaaaatatgtatggtaaaacatgaacctctgagcacatagctcgcagttagcagggtactaggcaccctcaggaacatggccaaaccaggtgcctgtgtctgggctggatggttggaacttacttccttgccggtctctctgttattcctcctcagctgtcctatgtgatgtccgggtacagatgctttgtctgccctgtggagtacaacaatgacaccaacagcttcactgtggactgtgagccctcggacctgtttcgcctgcaggagtacaacattcctggggtgatccagtcagtcattggctgggtatgtgccactcacagggggtgagcggcctccatggacagtggctacaaagagagatccccctccatcacctgccctctgaaaaaagctagcttcctccttcccaaagctgtaagccccaggatgaaggagaattgctcacgccaggtcagggtatgggcaggacagctttcccccaacatcagattgtttagaccagtggttttcaaagtgtgttctgtggatccctggagggccctgggatccttttagttgcgggggtagggtgggggggtctgtgaggtcacaactgtttcataattagactatgacattattttcctttttcaatgtgttgacatttgctgtgatacggcgcaaaagcagcagtggttaaaactgcgttaaggcagtgggttcctcatgccacacactcacagtacaaacaggccagttctaatgaatgtctatgaaatagtaaag

SEQ ID NO: 99842 - DNA, 6597 bp, Homo sapiens
actttaaagaaaacaactgaggctaggcacagtggctcacacctgaaatcccagcactttggaaggccgaggcaggcagatctcttgaggtcaggagttccagaccagcctgggtaacatggcgaaaccccgtctttactaaaaatacaaaaaaatatagctggggatggtggcgtgtgcctgtaatcccagctaccagctactcaggaggttgagttgcttgaacccaggaggcggaggatgcagtgagccaagatcgcaccactgcactccagcctgggtgacagagtgagactgtctcaaaaaaaaaaaaaaaaagaaaagaaaaatgactgacagtaattgttaccaaggataaaatttggctttcaaatgaaaattagaattttggaaagcttaacctgccactgtgaacttgacagcttcctaatacttaaaagccttttctgatgaggtctgtgatgattcttaacgtacgtgtgtgtgtgtgtgtgtgtgtgtgttgatcacatgagaaaaaacacaaacatatttgacacggtataatgaaatgtgtctacatttggaagatttacataactcagtgaaccattattttctaaatggctgatgcatggtgttatatagtcatgcatgggtaaaagatccgttcaagtataagatagaccaatggattttaatgtaagagagaacaaagtccattgatagaattctagattccatatcacacctaatattcaagaaatgactacttgtcaagctctggtgtagtgtcagagaatacccaaaaccatctgaggctacgactaaaatactcttttcaactatgtatctgcgtacggctggattttctttatatacttccaccaaaacagcatgttgcaacagattgaatgcagaatattttaatgttttccattaacttagatattagaaatttacaaaatgggaaaaattcactcctcttattgatttaaaacctacatgtatataattagtttcataaagagttacgaggttggatgtcttggtctgtctagtgttgatagaacacttggggctgggtaatttacaaagaaaagaggtttacttagcttctttctgcaggctgagaagtgtgagaagtgtggcattggctgctgcctggcttctggtgagggctttttatgctgcattgtaacatggcggagaaggtcaaaggtggaagcagacacatgcaaagaggcaaaaccaggggcttcatcacttcataacaacccattccctcgggatgccagtgctaatctagtctcttgacagaactcactactaggagaaaggcaccaagccattcatgagggatttgcccctgtgacccaaacacctcccactaggcatcacctcccagtgaggccacaatgaggatcaaatttcaacatgagttgacaactcaaaccgtaacactgggcatgtatgcacctaaacttttacttcatttactcttctcagaaaacggtccggatgtaccccttccagattcacagcatcgctctctccacctttgcctcgctcattggcccctttggaggattcttcgcaagtggattcaaacgagcctttaaaatcaaagtaggaaaaccgtcttacgttcctctcatctcactccctcacccatcttctgcctttctcccccttccctgccccctccaaaatactaggctgtacaccctggcatttaatgtgtgatcttgacccatgcactgaatttaggtgagttaattaataacaatattttcaggaaaatgcaatcgttgtttttcagtttatttgttaatatatctttcttcaaaagaacattttgggccaggcagtggctcatgtctgtaaccccagcactttaagaggccaaggcgggaggatcacttgaggctaggagttagaaagtagcctgagcaacatagcaagactcctgtctttattaagtaaatgaaataagaacattttgtaatgcaataaaattgtgtcctaatatagcctcaccattagatttcatacttctcaccttctattgccctcagctactcagcacagaagcctgacattggggtgggaccattaggctgggattggttagtggctgagcccaagttcacccatccttcccctgcctctaacaggactttgccaataccattcctggccatggaggcatcatggatcgctttgactgccagtatctgatggccacctttgtcaatgtatacatcgccagttttatcaggtatagtacctttccatctgaaccaagttggtggatttttaagtacggtgcaattctagaattttagcggcatctaagttccagtgaaaagcatcccaaataatgcagttttcagttgtttctgcttacagattttctgaggcctcctgtcatctgttaatagataactctctgatccagagatcagagcagccactcagataatcaggccctggaagcttccgggccctagctcagtgctgtttcttcacattctgttccagaggccctaacccaagcaaactgattcagcagttcctgactttacggccagatcagcagctccacatcttcaacacgctgcggtctcatctgatcgacaaagggatgctgacatccaccacagaggacgagtaggggccacccagggccaggagaacaggaacagaactgagcaggggcaggtctccaaggcaagcccagctggtgtgacttagacaatgacgaggcttcaactcactgtcttttttttttttttttggagggtattttttatttgtgggttcaaaaaatctgtatatacagtctatgtgtttagaatttgtgttgtaagtaaactacagctttgagttggaaagaagtcacgggttgtaaaaccatttggatttttttaaaacaaaagtattaataatctggaagacagtgttgcccaggtcaggagtgttttcttggtggttccagcccccatcaattgaactgtttctgggctcagtcagacacagacattcatctgtgtctgaccaaatcaggggacttccccacctgtggtgggaggcacagcttagatgttttgtacacctggtcttttctagaaatccctgcttggagctgcagaagggttgccttctgtaggtcggaggaatggaggcttactaaccaggtaagccttctatgcatccacaccaaaatcctgcagaatgtaagtaagctctgctttataagatgggttcaccttcatcgcagactgaaagtttcagtttttatttttttcagaaagcacgaaaaattatttataatagtctggagaaaaaacacactgtaatatttcaagtgtatgcagtagaatgtactgtaactgagccctttcccacatgtctaggctccaatgtctcctgtaggtccacctaactgtgtgttttcagggacaatgccatccatgtttgtgctgtagacttgctgctgctgaatcctttctggggactttctcatcgggcagggagcagagggcttctcgttcatgcaccctttgcctgaacacccatgtagctgctgtgttgtgtatatattactcttaagaggagtgtgtgtgtctgtgtttgttttaaaagtcacttatttcttacagtgatttcaattgcaccatgacttcttcactaaaaccacaaagtcctgcttaaaactatggaaaacctaacctgattagagccttgactattttgaagattaaatgcacactttttatataatgtgaccagtttaaatgtagtttgtattgtactgggggacctttcgttgttgttgtttgcttaaactgtgattttttttcccctccctaatttcaggggtgagattgactttgggaagacagattagttctttgtcaggccaacaagtgatggagtgcgggagagagaacttggcacccaaatatatcaaactattccgtgccgtggatgttttcattgccaacgagggtgtaatgatttgcttctgcaccttggtctagtgctggtttgtggtgtttttgtttgtaaattagcctcactgcctccctgaaagtgcacagtcagcccaggtctctagagtgtccagcagaggatggagccctcgggatgtttcagctcacacatccttgagtgacttcccatatgtgtgtggggctgaagcggcttctttccgctgaacttttatttccatttcagcctcgtggcttctcttattcaggtccaaggccccttaaaaacaaaacatattatcgcaagggctttcatttcagtattggctgtgtcactggcaggatgcatcactctccagggcctctttttcggagctactcccaattccactcttctgtgattctggctgagcaagttcatgccggtagaggctcattaagtgaggtcctgggcaccccccaaacaggaagtgttttcaggcccttacatgcttatccttaaggtgagtaggtatctcagcagcacacccgaacagtaaaggtgatcaataacgaaactgtagttttcagattgaagaatgaacctggatcaccaaactagataccgaaagggctcctcatttgtctcttttgtcccattgtgggcatatggtgggctccttgagaggagggagtctcagctggggcctggctgcagagacctgctcttgaatagggctgcctttgggatcagggagccgagcatactgggcaaggctcatcatgttcctttgtggaagtggttacttggtgggggtggggtggggaaggggggtctaggaagccgaagctgagtgcgcactagagctgctagcaggcaggccagagggtcagcttgtgttttattttctgatttctcctgcatgctttctggagatgaggattttttgtcaggtagctaggagagcactgccaccttgtgtccatatagcacaatgtttctctttcctattcacagacaagattcaagaaaccatttttacgtgtgtacattcaaatcttcatgaatggcatcacttgctttagacccattttttttttattggtcagaaataaaatgtgactgcaactgtgtgccctcccttgtcgtgaattccctgtttatcacttccatgcatggttttatgcttctcatttgtttatgtattcatgaatactgcatagtcctgattcagagacttttgctttgctttccaacttgtatccctacattctcacaacagccttcttacctcgggtgagagtcatgagcaccttaccaggcagggagcttccccaggatagtgtggtggagtcaggactcactccatcctgcactttacccacaggacacctggagggtcccccagccctgcttgcttttgtgaacgtcgtgtgagtacaccgaggtgttgcagctttccttccctctagctcaggaggcctggcctgagccaggttggagcttaaattgctgttggctcctgcctggtggaacaagggggtcatagaaaccagggctgatgggcaccccccagcccctgggagctctgctcatgaccgctcacagggtaccgagtctttgccttttgtgtgtgcgcatgctgccctcttaactgcttttagtattcagaaaggttccatttatgttttactcctgaaagtgaaaccctcttaggcaacttgtttcatattctgggcattttagtagctacagtattttgcatttaaaatgtaattactcttagtattgtacagccctataatgtatgagaactagtttcacatcctttgaaactaatctctttcattggggaggatacaacttttgactttacacaggtggactttgaatccatttttatagaatttttttccactgtaacttgacctatattatgcaagaaaatcccaaaaatatgttttaagggagactacacagaccttgtgatttggtctgagctagttgctgagttgactggagccttatttgaatggatctttgagttgagatcttcacactgtcagtgagcccttggctcagcccttgtcacctgtttgtatggggaccatgtttcccaaagctcaggttcatctccactattgacagagtcgggtagtgggagagtataagtgacttgagacagagtgtccttgctcagaaaactgtgaagcaggggtcttgttagttacaaagccagtcctagttgcatgtccaagggggtagattttcatcaccctactaaatgtggtatgtcactgctgaagccttttcctgttttagtaatatcttaggcactattgtcttttgtcttccagagtaacatatctgggcccacctttcttgcacactgtgattatgtgctaagaaaagggtggagttgggaggacaatttcacttgaacaggtttctgttcttctgaggtcagggtggggaggatgtccaggtgacttttatggacacattgcaagacagtaagccgcggatggactctcacttgtgctttggaacactggactccaaagagcaggtggaacaaactctggcctgaagatgatggctaatactcaggcagagccccgtattcttccctgacttggtcaa

SEQ ID NO: 99843 - DNA, 1620 bp, Homo sapiens
gtggccttacctggcctctcaggtggatggaggctgttctcatctggggctgtctcttgattaaggctgtcacctgtttgtatagggaccatgtttcccaacgcactttgagtgcagtttaggaggtatcctttggatgctgaagtgttgggattttgaggacatgcggatgatttatgagaatagaggggcagagtttgtgaagtctagggttttttgtccagtgggtttcaaatttgttggctgtttaaagaccctgtctcctcccccaccctccccttccttttcccatcaaatgcctacctactgaggcgccttctctttttattcttgagccaatgagatatcagtgtgtttattaataaggattgcaatagtatagtgcttaatatgtgccaggcatagtgctaagggtttacatacgttatcccttttaatccagaaaacagcctttgattaggtattgttgtctccattttatagatgaggaaactgaggcagtatgactgaggccgagagcagtggttaagacagactttgggatcaaatcaccctaggtgcgggcaggtttctaggctgctctaagcttctaccttgaaggcagttgggtctgataatagtaccttcttcctggggtggttgtgaggatataacgaggtaatgcatgtaagcatttagtaccatgcctggcacatagtaagcactcaataaatggtagttacttttgttgagctcagctggtagtttgacctccgttggtgcaatgccagagatgggattgtcagccaccacactgccaccaccctgcacacagtctgggtccctccgagagaagcacgccaaccttaacatcccctacagcatcttggtgcttcacacaccatttaggaggccaccctaacgaggcaagaggacatgggggtgtgcagaagttctgttcttagtgagaatggctggcctgagaatccagctcacctcctctgcccacagtctggactgcttgtgggaaggccatctcctcctgtctggtggtacctccactctgggcagggagggcctgtctgtgactcgctctggaccccacttcccgctctggccaagggctgtcttctgtgcacatagctcaggagcctgcagcagttccctgtatgggtggatgtcctcaggggccaagaagagaagaatggggacaacagaaacctgctttgtaggggattatgtagactaaaagcctagaagttctgcccacatccttatgacgcagccaatctggagcttcatgtttccttctaaaagtagtaaccgggtagaagtgggtgacccattgaggacacatgatgtgaggtatttctgccggattctaggttagcaaagactcaaatgggtgactcatgaatgaagggagaacaggcacaggacttaatgaaaagagtttcttgaacttagttttctgaatgggggtggggagttggggcacgtgtgtgtaaggggaggctgcctcactttgaaggaatggtgttggctaacaggatccatgaaattcctaggtcagttgaataataactgaactactggtttgactgtggattatttcctgggtattagtgggacccaacagca

SEQ ID NO: 99844 - DNA, 1091 bp, Homo sapiens
ccttctgaaacaggagggtaagatcagatgggaagcccctctgttgaaggatcttgggaaccttggtggttttttttttttttttggttttttttttttgatcgagctgtggacatccttcttaattcgattctgaggatttgtttaactaaaaagttcccaaacacagaaagggcctccccacctgctttggggagctgtctgtgctgggagtgccaggcatcccatgggacccatcactgccagtgtctgtgcctcccagaggtcagccgtgtctgccctggctctgtctcctctgtgacagggcagagcatttctggtcagtttctccatggtgcctcccacccctttgtaaagtggatggacatgatggaattcagttgtctcaccctgatagcctgggtgttgatattcactttacccgcactcagacacaggcgaccttgaagcagttctcggtgtgtagagtccacgtgacagtccccacagcctccccagatagctgtgtgcctgtgcgctactgctgtgccattttcccaacttggcgtttcactaaatgcagctgatctctctctctgtgcactcgtgatccatgttgaacaatacatgtaggttctttttccacgcaatgtaagaacatgatatactgtacgttggaaagcatttaccttatttatatacctgaatgttcctactacacaaataaacatatattaaattctagatcatgtgtggttttcgatggtgggggtggcggaaggccaggggtgtggacgtttggttgcttatgtggagccagcattatttcccaggatgctgctgaccaccgcttgcttctagagactccctctgtccttggccttggcaacctgcccccccggctttcctcctgcccttggttgctcctcctcggtcttctttctgggtgtctcttttctgggccatcccttgggtggtggcattctgcctgaggctctctttcgcccactgaattctcccctctaggtgttcccaccccctcccaggatcctgatcaccacactcatttcaacacttcccaagtccatgtctctagcccaagtgggcctgca

SEQ ID NO: 99845 - DNA, 2029 bp, Homo sapiens
ctgggtcccaaaagtccgtctatgaactctagggctgccagtatcatgtgcagcactttaaagctacgctatctaaatagcttattaattctgcataaatcaggtcaagcaatgtgtcaacctgtaacagactgtgcgctttaactgaacatggcaaaatattcactcttttgaactttacatcatcatttgatgtcaaacaatgaagcaaatcccaacagtatatacaaaaaacagctttgcatttataaaagatcatttcccatactgactaatccaggcagctaactcattggtttatttaactttattgaagaaaaataaatcaattactagcagagctgttagttgatcactcatccattgacaacttgcatcatttattcagtgctatatcaaacagtgtattggaagatagattaactaatagctccgagcctcctaacaatttaaatgaaaattacaaaatgtttgagaccctattttggaatacaaagggtgtttgacttccaatttccattctctgtagaacaagaacaggtcattcctttattgacatgcataaaatacatcacattttctgttctgctgatgctataaattcaataccagttctctagccacatcagttatgagcataaagtatatcatgtaacctcaaatctgtaacagtggaaggcttaaacaagaatggatgctgctggaataatgctgtatcctttgatgtgacaactgagcatccttctccctccccctcagatgatttcttcagcatgttagagcaatgaggaatggttttagtctcataaccaagttagagtgaagacattggctacataatacacatgctccatttttttttttttaaattctgagtcttgggcagcaactgttctcttgtaactactttacagtttctaaaagcagttattgtccaaagctggaagaacttaagtcttctcagataagcatgtgaatgaatggagggaggtaaaaaaaaataaaattaaaaaaggtgaggtctgataggggagcagccggataagaaaatcaaaaaagaaacagtaatttaaagtttattccagctataatgcaggttattctgactttaaggtaacatcacatggcatacttctgagtccattcccgagatattctgttgtacttatctctgtctgttttatagatccgtgcaatctctggcactaggggatcatctgggtttggatcacatagcagtgaacaaatggataaaagaactttagaaagtgttaaagcaggcgaccactgtgatcttagaatgtcaagaaaaatgctgccattactgttaatatttgggtgataaattcttgttgtaaatgcaaccttagatggtttgaaggggtagtctgtaggaaaacgaattgtccaaaagaatacaccgccttgatatggtctgtcatgaggtcccataattgtggcttgccagtgaaacatatcatccccaactggacctgcagaacattgtgctggagggtcacgggccaaatcactaagttccttattaatccgtttcagcgccatagtgtgtgcttgtcgtctggctcctcactctctcagtgtatgctcaaaggtccggccaaaactcttgattatcctggcggcggggcaggattgtctcgtctcacaccagctctgcccacggggctctcttgagggaagatatccaaagtttaacagaactctagaaaagatagagccttgacattcatgaaagactcatcctggaacttagaattcccctggaaacccctagttatataaccaccaccatggcacacaatttcttccagaagatgtatttttttcctctataggctggagcatgaatgtatgaatcacttcttatttatgttaaattacatttttataatttataaattgtattatattaaattcactcatgccatggactggaactagagattcttaatattcattatattctttaaagttatccaaactttagatgggctaaaatctatccttt

SEQ ID NO: 99846 - DNA, 1064 bp, Homo sapiens
agagagccccgtgggcagagctggtgtgagacgagacaatcctgccccgccgccaggataatcaagagttttggccggacctttgagcatacactgagagagtgaggagccagacgacaagcacacactatggcgctgaaacggattaataaggaacttagtgatttggcccgtgaccctccagcacaatgttctgcaggtccagttggggatgatatgtttcactggcaagccacaattatgggacctcatgacagaccatatcaaggcggtgtattcttttggacaattcgttttcctacagactaccccttcaaaccatctaaggttgcatttacaacaagaatttatcacccaaatattaacagtaatggcagcatttttcttgacattctaagatcacagtggtcgcctgctttaacactttctaaagttcttttatccatttgttcactgctatgtgatccaaacccagatgatcccctagtgccagagattgcacggatctataaaacagacagagataagtacaacagaatatctcgggaatggactcagaagtatgccatgtgatgttaccttaaagtcagaataacctgcattatagctggaataaactttaaattactgtttcttttttgattttcttatccggctgctcccctatcagacctcaccttttttaattttatttttttttacctccctccattcattcacatgcttatctgagaagacttaagttcttccagctttggacaataactgcttttagaaactgtaaagtagttacaagagaacagttgctgcccaagactcagaatttaaaaaaaaaaaaatggagcatgtgtattatgtagccaatgtcttcactctaacttggttatgagactaaaaccattcctcattgctctaacatgctgaagaaatcatctgagggggagggagaaggatgctcagttgtcacatcaaaggatacagcattattccagcagcatccattcttgtttaagccttccactgttacagatttgaggttacatgatatactttatgctcataac

SEQ ID NO: 99847 - DNA, 2518 bp, Homo sapiens
tgtcaggtcaccagaggctctttcagagttctccactctggacgtgtctgacgttattgagcagctttagagtagttcccacgctggtaagcagtcttcttatctcgatctttagtgactttgaagtcagagcagtcagttttttatagatttccatttgttaaaaaaaggcaagttggagggcaaatactttaagctagatcacaagtaaactagacatttcattttctgattcagctgctttatgttgagctccattgcatcgggggtacaaaagggcaatgctgctattctggattattggaaagactgggaagaagagaaattttaaaaaagagaatggatactttcatctttaaaacaaaacaaaaactctgatgtggatgttccaggcattctgtaaatgaattcttatgaaaaggttgagtcaggcaggtcttaggtaaaccataaaattacagtattttatgtgttttgtatttgtttcatcataggatatatgattggatgcctgaacaaccaaatatattccaagtggagcaattggaacgcctgaagcaggaattgccagagcttaagagctgtttgtgtcccactgttagccgctttgttccctcatctttgtgtggggagtctgatatccatgtggatgccaacggcattgataacgtggagaatgcttagtttttattgcacagaggtcattttgggggcgtgcaccgctgttctgggtattcatttttcatcactgagcattgttgatctatgccttttgggcttctcagttcaatgaagcaataatgaagtatttaactctttcactacagttcttgcaagtatgctatttaaattacttggccaggtataattgccagtcagtctctttatagtgagaaaatttattggttagtaatataaatattttaaactaaatatataaatctataatgttaaacatatgttcattaaaagcatagcactttgaaattaactatataaatagctcatatttacacttacagcttttcatttgatcaggtctgaaatctttagcacttaaggaaaatgactatgcataattatacctgaccatgaaaaaaataagtacctcaaatgcatgcatttgcactggtgattccaactgcacaaatctttgtgccatcttgtatataggtattttttacatgggttgacatgcacacaacaccattttcattcagtatgaaccttgaggctgctgccatttttccacttaaccaaaccagcctgaaggtgaacctcgaaacttgtttcataaatctttcaaaagttgttttacatcaatgttaaaatttcaaaatgctgcagggtaatttaatgtataaaatattagtaagaaaaagtatgtattgcatacttagtagaatagatcacaacatacaaattcaattcagtgcatgctttaggtgttaagcatgagattgtacatgtttactgttaggtccttgcatctgtggtgctaggtgagtatgagaagatgtcaaggactggacgtattttgttgcctaaaaaaaaaaggctgtttgtaggcgttttaaatatgcttattttgtgtgtctctcactacctattacacactgttgctttgtgggtttgttttgtatgtgcgtgtgttatacagtagttaaatttccatgcagaaaaataaatgtcctgaattttcatattagtattctttattgtatatcatgcatgtaatttatttagaaatgtaggtcttactaaatgtatatgcatgtatttcagattatactaggatttcttggattagaagcagattgtgttaactgtaacttaaagaatgaatgttaaataaaatgatacagatttattttcttcattacaaaatgaaatttcaagaaggtgttacttttgtagaatggttttataatatgacaagaaattttaatatagtgtctaccctaaagggatggcttatttgcatctaccttttactgcatgtttttcacaaggcagtttattcatatattgacatattttggtagtagctgagaacctaagacttgaaattatacattgtgtagtattttttaagctaagcaatgcaattttggtcagatcttatttgtgtgaagataggctctgaaatcctatggtattgcgtttgtaacgttgatattaatgcaaaatagtttaggaaatggagtcttctgcaagggttctgtatacttttcccacattgtatgagattttccaaaattttggtgtgaattgggcacttttggaaaactcctgaaaaagaattagtttccttcatctgcagacctttgtccaatacggttaccatttctttatagtaactcgattagccatatatgtttgtttctagtcctgctcctttgctcctctcctatgccttcccagtgctggctccattttgaagactcaaggacagaggggaagcagatcataaagagaaaaaggagacagaagaaaggatgaaggaaggaggtcatgg

SEQ ID NO: 99848 - DNA, 1098 bp, Homo sapiens
gatgataccaatgatcctgaaaacagaaggaaattgaaggaacttggagttaatggtctaatttatgataggtatttgtttttcatgaaaaattttcatggaatttagaagtatagatttcatcttacgaaattataaataaaattaaacttagttaagttaaaattctgcagttcagcctgaggttatcttgacatttgcctgtgggtgttttcaaagtttgaaggatagcagaatcacttgggaagcttgttaaggattcaaatgactgggccttaactcagatatatatactaaatcaccctgggggtgagggtgactgccagcccttagacctcttctctgtctataccaactttttcattcctcttgtccaattctgtggcttttcataactttctgtgttctcacacttacgtatctccaactcagacccttccctagacctctgtagacttttatttccaggtactgacacctgttcctcttacagtcttcctgatttcagtataagtgacaattcagaccatattcttagtcttccatgactctgttctttatctcataccccaaatccagtcagatagaaaatctttttgttctgtcttcaaaatatatcctgaatcagactactcaccaagttaactgttgtcactcaagtaaagcagctcatctttggtgtggattgttgaggtagcctgccccctggtgactgcctctacccttaacggtcaggctgtttattcttagtacagtagtgagagggaagcttttaagacctatgtctgatcatgttgctacttaaaactctcccacagttttctgtgtcacctaaaggaaaagctgaagcctgagggccctatatgagccaatctgccaccccaccaccttcaaccctctttccctctctgaccttccacaaaattcccccatctgctgtttcccattctttggagaaagacttccgtaacaatttaaatgtcacctcagtgaggactttcttgaataactgatttcaaataacaacttctattcacagtgcactccctgacttgtctccatatcatttatcatcatctgacacaccacatattctgt

SEQ ID NO: 99849 - DNA, 2163 bp, Homo sapiens
ctgctccttctgtgtggatctgctttttagaaatttggctttaactataattcatgtcttcctcatttgtttggctttcattaggaaaccggacatgagcatcatctttttcctgtttctgttgtctctgtctgttcatcagcagttatggcttcctctttcattccgtactgacattttgctgagaaaggctgtacagtggactgctcaggtgccctaaggagccgagctaaggcactttgcagcttattccttccctcactgaatctttcatgttagctgtgcagctaaggtttgcaggggcagtgggcagcaatgtgtgggatccctgagcttggggcttttgttgggttccttttctgccaatagcagttgcagaagtaacagccccgaaggctgtctcactgccactgcggtgcctctgagtgttttgaagtgaatctgtgtccgtttttttttttttttttttttgccaggaaaaagtagctgtgcttttgcaaaagagaaaacccattgttttaagagaatacattactttttagaaaaagtttgtacaggtctgtaattttatagtgaacaaaaatttcttacgttcttgcagtttgagaggtactgtgtaccaggcaatgtttttcaaatacttgcttccttctgtcagggtgcagcctttgtagaatttgacgtacacctttcaaaggactttgtgcccgtggtatatcatgatcttacctgttgtttgactatgaaaaaggtacgttgaaatttcttcatttcaaactcttaatgttaagtaaaaggtttaaaaactaggaagtttttttatatttttaattacttattaaatagaattggttaattcattttcttggtgaattactgccagtccttccctctcatgctcttgcaacattgagacagtgatgagttgggaatactgccttcctagagtagggtctctattgctgaaaatactttattatgttacaaaaaagggacattccaggtggtttctgtagcggtctgtctatgctactatattgaggcaagagaggaagatatcatagtgtttgttttctaggattccagctgtttctgcttcaagcttcttcaattaataaggctagtgagccacagtgaaaaattcaaaaagaggtttggagttagatggtggagggcctcagtgaagaggtttagactcaagaactaggggggtaggaaatactttttagctgaaaagggaaatgttcaagactaatgttttggtagctgatgaaataggaatttcagaggacagagactgcaggcagggcgagcagcaatgtgggctacaggaaaggtaagcctgaattggagtaggggaccagaagaatggagaagagggcataatggcggggggggatccagaatgagatttaaaaacttacatagctgtaaaaaaactgtaattgtttttgtacaaacataatcatgataatgatatagtccctaaacgtcagtatactatgtaaccaagtgatttctcggggacttagactctaaaactgtgttgggtattaatttccaactgagttgatttaaagttagtctagttggctagcatcactgtaccagatactgtctgttgtattaaagagtgtgacaaagaccctggcaccacctgctggtgaattttaatcagagttcctaggggttggattattatgatgtatatattatgtataggaaaggacccttttgtttctgcgaaatggtattaggagaaagaaggaagaaaggaaggaaggggaggggaggggaggaagggaggaaaggaaggaggtgcatctattcagattacatgagtagagtgaccaaacacatggaacaggttgttttagtcatggaagaacattaatgaaaagataaatgagaaagagtgaagtgataaatgatcttattagccaagattgagattaattgatctagctgcaatttatttatttatttatttgagaccgagtctcgctctgttgcctaggctggagtgcagtgatgtgatcttggctcaacctccacctcctgggttcaagcgattctcctgcctcagcctcctaagtagctaggactgcagactcctaagtagctggaccaagcccaactaatttttgtattttttagtagaga

SEQ ID NO: 99850 - DNA, 1021 bp, Homo sapiens
attacgtagggtgaagctgacactagaaggcctggaggaagatgacgatgatagggtatctcccactgtactccacaaaatgtccaatagcttggagatatccttaataagcgacaatgagttcaagtgcaggcattcacagccggagtgtggttatggcttgcagcctgatcgttggacagagtacagcatacagacgatggaaccagataacctggaactaatctttgattttttcgaagtgagtagttactgcagtgaggggattgagaaagaatgcagggacaagcttattttaacgttggttttgattttcattttaatctaatttgtgtaaagctaactttttagaggtatgctcttctgtacagttaagcttaaaaaacttagagttgtcatcttcaagtactattaagaatataattaagagaacagcagtattgatgtttccaatcaagaccagatgtctttgatgcctgtatgctaaataatctaaatgtaaatgaattgtatccaaaggaaacatcagtggtaaatagagaccagggcaggctttgtacctcttggcgggcatcccgatgtaacaagcgtgattgagttctcactatgatggaagcctgtcatttattgaggtactttattaggatttgttgatgggactgacttgcaacttgatattgtaaatatgtaatgaaattataaagcttgtgccaggttattgacaatctgtgctgctaactttctggagctacatgtgatacttacactagtgcttgtagaccactggctgttcatatttccccaacacataatacttggtacatcccctaaggtccttactgctgtgggcctggctcggtagtggtatgtagtggtttccttaccctctagctccacctccacacccatttatactagattagagtttaaatcttggagggtagggaatatgtcttgaccaccagtagcccccagccagtttcttgagaacaacagaattcagaatggatttaaaaaaatc

SEQ ID NO: 99851 - DNA, 1004 bp, Homo sapiens
tcttttaaacacattaacttttcttatgcttaaatatggcatttctcttcatacaagtatttttgaatttcttagtccatattgaaaatcgaatttgaagttcacttcacatacattaaattacccacatgtattcatctgtaaattgactcagtgctgagaaatgtatcttttagtttctaggtaaagttaaaattgaaagataactggatgccagttttctggtttaaattagaaagcagtgggagtttctgctttatcctggagtaaggacacatctcatttaaacagtatctcattccatcctctttattggattttctttttgtatgttttaatacatttttgatagtgtatttaggatttttatgagagtatacttaaaattataatattcccatactgaggttggaacttactaggtattgaatgttttaaaaaattgtattttaaagcatcttgcagttaaatatattttattatgagaagtgggatgattttgtttctatcttttagaaaggaatgtatacttttgagaaatataacttttgaacttaaaagctgtgtgaaacttaccagagaatctttactaggaactgtcacatccattttgcaagtatttcagactaacgtttaaagtaaactgggaagggaagtaggccaggaagataaattgtattttactcaaagggtggggttttacagcttttctcattgagttgaaatttctgttaggagaaggggttgtgctagcgtttattcttttggtagttcctcacagctctgtacatacaggtaagttcacgctgttcgtaaagcttttaactggcagtagtgaatagttgggatatgaggagaattacatttgagacaagttcagaatatgcactacataagaataagcattttaattgtgccaagacctttggtttgaaaatcaagaaggagttatcgttgtccagcaacctgtgagtcttgtacattggttagtgtagaagttaatc

SEQ ID NO: 99852 - DNA, 1109 bp, Homo sapiens
tatgtgaaaatcttgatggtgattatccctaaatggtatgatatgggtgagttttgtattttctttttgcttctctgtatttaattacatttatgtaacaaataaaataccttgtaagattatagtttgaaaatgtgcttccaaaatgtgtatttaagggttttatttcagcataataactagtgagtttctttttaaaaattaaaggaaaattagaacacttaaattttagtcttttaggtatactcagggaatctttcatggttactcactaccgcatatgttatcaacacatagctttatgttcttttttagtaggggagcttgataatggaaaacagtatgaggaattgtcacactgtatgagattttaaactaaggcataagaatgaaaccggatgttagttcctcttttatcacacttgctcttcaagtttacctggccacatgtcccttctagaatttcccgtgttctttagaaacactggttcctatgatatgagaaatcttcctgtttttcacttagtattcttaaatatatgtaataaataactttattatggttctttagttccttgagtagcttgcgataattgttcttgagtacttgttcctactatttttactattgtaggcttgtttaggctttttctaaatgcatagagcaggaggtacatactttatctagcaatacctcattgatggctgacataccaaagaaagtatatatgatatttatcttaagaattaatatcagttaaaaatgaaaatttctttgaaacaattgagtattgtaggcagatttaggaatgggtttgagacagttctgtgtgccagttcatctcatttttctttgtttactgcctcactctaattttcttccagcatttcatcttgttttgtgatctggtacattccaggcttttggcatataatattgataataagatgaatcttttggtctcatatttagtataagatttaggccacaaacatctaatggagtcatgggtagaaaataagatataagaaattattgcagacgtttaacttttaaattgcagactatcggtggtccatgtcaagtgatagttcacaagtgggagact

SEQ ID NO: 99853 - DNA, 1038 bp, Homo sapiens
ggtagagatggggtttcaccatgttggccaggttggtctcgaactcctgacctcaagtgatctgcctgccttggcctccctaagtgctgggattacaggcatgagccactgtgcccaggctgtttctatttttatgtatgtatttgcgacttttttttgagaaggagtctcactctgtcgcccacgctgaagtgcagtggtgtgatcttggctcactgcaacctctgcctcccacggtcaagcaattctcgtgcctcagcctcacatgtagctgggactacagttgtgtgccaccacacctagctaatttttgtatttttagtagagatggggtttcactatgttggccaggcttgtctcaaactgctgacctcaagtgatccacctgccttggcctcccaaagcgctgggattataggcatgagccaccatgcctgtcctatatttgcaacttttgaggtttagaaagtttgatatttaaaaaacacatttaaaaaatatttcaggaaaaatgttatagtaaacatcatctagaattaatttgattttctttttagtataatggatacgaaagtcaccatatttttaaaagagcaatttcacattacatttttaaaaaatctacccagtctaccaattaaggtgaactattatagcagggaagtgtttagctagagaaaaagagaattttatttagtatcccaggagtaatgatttgaagaaatatatcgtgctattttagtttttaaacttcagaagtttgaggatttcagaaaagaatttagcctggttattttaagtgacaggattatttattgcatttaataattaataatgtgcctaatttgttacatatttgttattgtttggcttatcgtcaaatttaatcaatattaaaatcctatagaaagtgtaggagaatattttaatccattattaatgccttctaaagataatagagaagcttttatgcctaggctttttaagagtatgtataggctgggcacagtggctcacacctgtaatcccagcacattg

SEQ ID NO: 99854 - DNA, 1060 bp, Homo sapiens
agattttttcaaagatgttattgataagacccctatcttttctggaggcctttggcatatctattctaaatttgcctgttcacaattcattattttgggattgttttcatattcagaaaagaaaaaaagttaatcattttccttttattctaaagatacttatttgctgaaaggattcttttccttcagacttttacatttgacacccttgggctgcatatgaacaagggtttaggcaggggtctaggatacaaatcatggattagctcttgttaaaaaatgtatttcctttgggagtcattaagtgtttttgttacgtgtgaaaaatgcaagcagccactgttacctcgtgctcttagccaccattatacaaagaaaagagacaaaatgacaaaaaatgacaaacccactttagctgtcttttgcacctattacgtttcttgttccaagaatattttgtgaatacacagtaattgaacttaaattacattgtggttgatcattgtgttggcttttcttgacaatagtttcactttaacttaagaaaagggcatctcatttatttggcatggggttatgcatcatggtaaagttctttagtataacttaagcaattgtgtgtagatacataggtcatagatatggaaagtttacctgaggatcctggtatatgaaatttagctttgtaatatgtgaaaccaactaaattttacttaggggagtttggatgagaaagatgataatgagttctttgggcatagttttctaaagtaagactattgtcaacacaggtcaaattaagccaacctaagtatttatcctcttcattgaaaatgttaccaaaagcagcagatcagtccaaaataccttttgaaaaaattggcaagaagtctgcttaacagtaaaaacaagtttttctccttgtaatacttgcaaaagtttacagtatgtgttggtgagtgtgtttctttaagtaggtgctctgtatcgtgtacacatgtaccgtgtgatgcaggggctgccatggtaagtatgtttttcatggaatcgagtaaatagc

SEQ ID NO: 99855 - DNA, 1170 bp, Homo sapiens
cttggagcatagtaaacacaccaaaaacctcctcaaactctgtcttgttctcatgttttcccaagaaagctatgaatttatacctaattttgcacagggcagagatggttgggctgtggtttctaggcagtatgaaaatgaaggaaactttgctagtgcaagaagttggtaggccgggcgcagtggcttatgcctgtaatcccagcactttgggaggctgaggcgggtagatcacttgaggtcaggagttcaagaccagcctggccaacatggtgaaaccccatctctactaaaaatacaaaaattagccggatatggtggcatgtgcctgtaatcccagctacttgggaggctgaggcaggagaattgcttgaacccaggaggcagaggttgcagtgacctgagatcgtgccattgcactccaccctgggtgacagagccagaatccgtctcaaaaaaaaaaaaaaaaaagaataagttggtgaaacaattggctgggataaccttgttcctatgtgtgaatatgtttttagcctcattgtattttttgctgtcccttaaagtgctgtgagataattttagtgtgagatagcatgtcaaagccgtatcacacctgggctctcataaaactgaggtacctctcggttttatgtactctggctatactggcctttcagttccttaaatgtgctccattccttcctcctttcttcctcttttaggacgttctcaaatgctgtttcctctgcctagatctttgcccactctcatactccccctgttccttctcttctctcccctgtccccactgccagcctccagattccactaggttctggccctattttatagcacctcttggagattttatagaattatttgagtgacagattgtaaactctgttgaaaacattactttttttttgagatggagtgttgctctgtcgcccaggctagagtgcagtgatgcgatcccagctcactgcaacctccgcctcccgggtttaagcaattctcctgcctcagcctcccaagtagctgggattacaggtgtccatcaccgtgcctggctaatttttgtatttttagtagagacagggtttcactatcttgtccagtctggtctcaaacttctgacctcgtgatccacctgcctctcggcctcccaaa

SEQ ID NO: 99856 - DNA, 1014 bp, Homo sapiens
atctatctaccttgactgggaagtgtggttaattgtgtgtagcagtgttcattaaatgattcagggggaggggaagggagcaaagcagaactagaaaaatgactatgtaaggtagctatgaaaggtactttagaattgtttcataaggtaatatataaatgcaaatgaaatttaagctggtagagtaatgtacatgatgcagaataaagatgtgattggaattcttgtaacattggtggggggggcaaaggtttttttgaggggtgttggagaagttatgatgtagaatatggtgtgtctttggatggagtatgttctttctccatttaaattatgtaagtatctcgaagtatattatatgtacatgtgtgtattaagctattttttatattcctttaggtacttaagttagtggatgggaaacagattcctttgactgacagggaagaaatgaaaaaattagctagacaaaatgtggataagtggaaaagaacttcaaaggcttggagtttagacttctttcttattctttttttaatctccttaaattccttttactatggagttcagatttctataaataatcaaagtgattccaagccagggatgtgaggaagaatcctaattgacaaaatggatataaggtcaattagatagaatcatcaggatttgataataggttgtaggtagagttgagactgtaaatttgagcctgtagaacctgagtaatgatggtcctagggttaataaagagaaaatctgaaaagttatttgtgtagaaagttttttctttttttttggagggggaggcaggtgggggggctcacctcaacctccacctcccaggttcaagcaattctcctgcctcagcctcctgagtagctgagattacagacatgtgccaccacgcccggctaattttgtatttttagtagagacggggtttctccatgttggtcaggctggtcttgaactcctgacctcaagtgatctgccctcctcggcctcccaaag

SEQ ID NO: 99857 - DNA, 1030 bp, Homo sapiens
tgagccaactgttaatgtcttagctgcattgttcccctctctggaatgtgccccctcctccctggtcaactccagtccactccagagatggctgaattgaatccattaattagtcccaggtacagacttgctgctggacttgaacaccctgtctgttagatacttgttttctttctcgtttgctgcttggctcaagggaagcacagagtatacagaatggaagagcggagttaagaaacagatgatcttggttaaacctctcaaaagcaagatcacaaaggtcacccgaaggcccagtcccacatgtactgctagagcttgataaactctgggtagctcatgtggcgtatctcacctgcaccctctggaacctttgtcctggagagcatccaaggtactttctaatataggacaaggagttttctctgaagtcgttgttagacattaacaatacagatgtaggaaatatcagccctttcctcaaacttgaacttctgcctaagagcagtgtcggggaaattggttgcatgtagacagcaaattgaatgttaaacacaataagtctttgatgattaaaggccatagctggcaggcagttataagtttaaagtaaatagtgatttaatgcacctttagtcttattctgggaatctgtcaacatcccactcttcaaagcccattttgtaacttgtgtatttaggcatttcatccaaggaatttagtatttaagagtaaaaaaaagtttgttgtcttcctctctataattcatatttctttggaattctataaaattttatttccaaaaggaatgaattataagctcttagataaaaaaactcaaaataaaatttatatactagttgtcaaattcttgatgtgttgttgtagttttaaaataggagtcagggtatattttagatatatacataaaatgctaaagacattttatagttgcattaagtgatatccaacctagtggctaatacccagtcactagaccaaacctgagatacagagagtatggagagga

SEQ ID NO: 99858 - DNA, 1028 bp, Homo sapiens
attgaggggcaaatttaaataaattgtaaaaaacaaaaaaacagaggtgtacccccatttcttcctagtatattcagtagttgttgttttgtccagaattttcttttacaaattggaaaatattagggattgtaaaatgcagtataaataagatgaggaagtgaccctcagactaacaccattttagaagttgagtttgaggaaaaatggttaaaataatattgcatgttttcagccaataatacccagagagctgctgctctgagcctaggcctggaggtggtgcctggcgagttcttgctatcagacagtgtttgagtctactgccctctggtggctacttgttacactttcctgagccttactgagaaaaagaatttaaacgtaccagatgtgtgttaaacctttctcatttgttctttgcagagttctgtgcctactcgaggtagaattaaaagttctcagagattattttactcaactgaaatccaaggaggtaatttctcttaaggtcaccactgttagttatattcactgcacatgaattatataatttgaaatcttttttcatttatccagctgggttgatttcaggctagaatacacacatgaatagtgatgtctaattttttttgctgggctcagtggctcatgcctgtaatcccagcactttgggaggctgaggcaggtggatcacttgagatcaggagatcgagaccagattggccaccatggtaaaaaccctgtctctactaaaaatacaaaaaattatctgggcatagtggcacgcacctgtaatcccagctacttgggaggctgaggcatgagattcacttgaacccagaaggttgcagtgagctgagatcgagccactgcactccagcctgggagacagagagagtgagactgtctcaaaaacaaaaaaacaaaaaagaagaaaagaaaaagtgatgtctgatttttctttatacgtttgccaataaaagttgtgcttttttttttttttttggcaaagataagaccaaagg

SEQ ID NO: 99859 - DNA, 1259 bp, Homo sapiens
tgggaggagcacttgagcccaggaggtcgaggctgcagtgagccatgaccatgccactgcactccagcctgggcaacaatgtgaaactgtgtctctgaaaaaaaaaaaaatgaatttgaacacctgcactaaaccccatctccaccactgccggctgtataacccaaggcgagttactttctcttaagccttaattttctcatctgtaaaatggggattactaatacttagttcataggattgctatgaagggtaagtgggataatatgtatctgtaagtcctagtctaggaacttctttttctttttcttttttttttctttttttttctttttttttttgaggacccgaccttttattttgccaagcaaaaatcttaaaaacaacctataccaatatctccacaaatctattagcatttcataaaagaaaggatattttaacattcaaaatgaaagaaggacctaatcccaaaataaagatcagttttctgtagtccctagtgtttttttctcacgtatccatggactagtaagggtttcatcatggcctagcatgagtccataggccactgcttggaaaacttctatgtatccagtatacaatgcactgattactgtgctcagtgcttaacaggcaactggaagatggtaagaactattattaataacagacacttagaggttttgatatatgtaactttagagtccttctttccatttctaaaaattccgacaatttttgaacaagtgaacgagtggcctcttgtaagacaacagagccagaagtcctcaggagctcagtacaattgtgtctttgctttataaaataaatcatcatgaatgagaagtagctttgccatgtgtattactttcaccaggtattatgcctcactaaatgcagagttcttttctgtttctccgtattatgttagattgtttacctgaaccctgatggctagcttctttacagggttgtgaatgttgtcccttcagtcattagcgaaatgcttattgtgtatctactatgctgcagaccctgttcctagggtcggggatacacagtgaacaaaatagacaaaggctctccctctctttaaggggctttttatttttatttttatttttttattgagacggggtctcactctgtcacccaggctggagtgcagtgatataatcgtggcttaccacagcctcaacctcccaggctcaggtgacactcctacctcagcctcctaagtacctgggaccacaggt

SEQ ID NO: 99860 - DNA, 1081 bp, Homo sapiens
tggggtctcctttatgagttccattcatgaggactcctccttcatgacctaatcatctcccaatggccctatgtcttaatactatcaccttggaggttaggatttcaacatatgaataggggaacacattcagatgatagcaggctacccttctcaaacttattagaaaatggagtccttttttttcatggaagccccacaaccatccctgagaacataggtggtattctgcagacacagtttgggaaataagagaagtctacctctacactgctggctaggggttgagctgggaacagacacatttgcctcccctttgtactatctagctttccagattcttcccgctagttgtgttgatggtgatttgggattgttctttcacattcaaagctagggctatacactaattcattcattctcattcactaaaaaatatctaccatcacactgtgccaggagaccatagctagaacagggtccctgcctctgggaagtccccgtgccataagaaaacaaacacagatattcaatgggaggtaagacctgccaagtaccatctactgagcactgcagaagctgtggtgggggctggccagctctacctggggaactggggaaggcttcctaggggaggggatgggcacagcgtccccagggagcaccaggtgaagaaaactgggaagcagagagttgagaatgtgtttggcagcatgtgagtgccagggctttcagcagtgggggctggtggaggagcacagatggcctttaaagtcaactctgagtcactctctgaaattacagaaattcaaagagaaggatctggaaatcctccaacaagttatttgaccttctggtctctcaataaccatttggtatctagctgataaatggaaattctctgcaaaattgtgttatacaggaaaagttgcagaaaaattgttagagaaagaaaatcattctcctgccttcacctgtaaaccatagagctcacatttttcctaaggggctttatgctagcaacttgcccctggattctccattcatgcctcaatctactaacatgaccgatcggaggtta

SEQ ID NO: 99861 - DNA, 1027 bp, Homo sapiens
agaaaagcagaccaaagtataccacagatgtgtggaagtacatgttcagataacagaaaatacactgcaagctttagtctcaagctccctagaccataaaagcttatagaatggtcagctttccaaagcagaggctaaataactgtcattctgttgcatccaacatagcttcccaaactttgttgatgtaggattagtaagatgttccattagaaactcctaaaataacttcaggatgcttttaagtattcttttcatttgtgccatggaactaatgtgaggagctggcagttggaggtggttatcgaagcctgggaatggatgtctccagtcactgtttggtggaagaacctttttcaggttgtccctgcgcccccacaatacttgagaacactttctagaccagaataaaatgctcaagtaaattaatgacatctgtttgcattttgaagatgagaaactgtgagacttttaattcctagaggtaatagcaggataattgagtacagtaaattagaagttgctatttatgagcaaaagtatgtatgactagagacttcatccccatgagcttgcctgttcaccatattgttattttcttgcatgctttattagtctttggagccatacttcttgagtttgaatcctggctctgccacttaactagctagctgcatgcctttgaacaagtttcgtaatctctgtgcctcagtttcataatttgtgaatctgttgattagtccactcaatacctattccaatccccttttagcttgattttttttttcatctgacagagaatggaaactttccatttccagaatccctcaaagctactgttcagggtttgttaactaaatgcatttccataaacctttgaattcagatctagattgtgtgggatgagagatgggacataggaccttcattttttgctggtatggatagtggcagaggcagcatcgttctggaactagtcgctgtagtgatagcgtcctgatttaacagtcagcttttttattgggaa

SEQ ID NO: 99862 - DNA, 1039 bp, Homo sapiens
aagaaacagtgttccagattgaagtgtagaggcacctcctggaaggagacccagatgatagaaataggaaatgaacaggtccttgagagacactggagaaaacaagacttcaggttttcctctgacaagcaatcgtctgcttctttctccatgggcgtttcctattcaactggcccccaaataatcgtgaagccagggggacttataattgaaaacctggcaattaaattttaaggtagctagctttattgtttttttaatgagaggcatattaatagatgtccttgaagaacgctatcatttttagtatgactcagtcactgcaatgtttgcggttcgtctccatggctacccacagaaggaaactggattattttatgttgtttttaaaaggacaaaaaatacgagttatttgaatcttcatgttggaaagcagcagcttctatttggcaatgagattttagtgtcaaacatttcataacctttatttaaatatgtgtgccaagagtgcccggtgagaggatagcccaaaagtagagagtttagaagtctcaaagtcagaatcacctcaggtttaaaaagagtgtggtgtgtgtttacttgcatctgaataagtgtttgtgacaggtcaatacaagatatttgattccctgcaaactcactgcttaatttgatctctgtgaggttaggatggcattttccatttatctctgtgaatctttaataaaggctaacagataaggatattgaggctttggcctttggcattattgtctaattctgccccacagataaattcaccaacattataccatctcatgcatgttatgactggcctgtgatatcatctgtggctcttttcaggtctttgtgagacatcagaactaagagcgcagaaacatcacaacccttaagaagagaactcctaccgatgtcttaaattcatgtgctattactcatttcattagtctatttctttgcataacctatgtaaaggcccatgtaacagatcttattaccagtaattagcacaaaacaa

SEQ ID NO: 99863 - DNA, 1011 bp, Homo sapiens
tatggatgtgtgagtgtgtgatttattatggtaccaaaaatgtccaccttctttcctgcagcggaataagcttttttgaaatgctgaggttttattttaatagttgacaacctgggaaagttctgagtatttattttactgctcttttttgtgcatagaaaggtttagtagggtacttttttgcattaatttgccaatactcttattctttgttctaaataaagtgactagaatttttgtgtactattcaattaaaggaaacaaatgtcttttccccctctatggtcttatggatacacatttgcacacacacacatatgtatatagatgttggtatatatacacacatatatttatatatacacagatatatacatacacatgcaagtggagacatagattgtaccacctgtatgaatatgtatgtacacatggggacagaaagagtgtgcagtctatttgaactgtatcaaagtcttgtgcaggacttagaccaattctcattgtattagtgtcattccttgtcaaatgtccctaaagtgcctttcttgattattaatgctgaagaactctgtcatgattagatggttaccctttctaagctctgaaaaactctaatcatttgatcatgtgctgtagcaaagaaagtgtttagaatcagccaaggctcttgttcatttgagagattgagtcttgctcactggaacatggtcatcgtttgcgttgctcctgtcatagaataggcctgtatcatacagcaaggaacatctcagaaaaaaaattttttttccaaatagcatgtgctatgccaatgtgattactaagtacaattttgagtcctttatcctaattgctattaaagaataaaaatgtcggccgggcacagtggctcatgcctgtaatcccaacactttgggaggcccaggcaggcggatcacctgaggtcaggggttcaagatcagcctgacaaacatgttgaaaccccatctctactaaaaattagaaaattag

SEQ ID NO: 99864 - DNA, 1030 bp, Homo sapiens
gaagagcagaggaaaagacatttagaggctgccgctctgctgagtgaaagaaacgcagatgggtgcgttgatggaagaaggcaggagactcctcagtgcatgtgggctctgcttcagacagattggcattctctttctccttgtctgctttgactctagtgggacccgagatgaggattttgtcttgggggtttttttaaagaaaggaggctgaggctggcaggggtggggaattgatgatgctggtttcagggtttcagaagaaattgaatcttctccatcactgcatcaagatgggccctgtggtcccactggatgcaggggatggggcactcaaatgctgcgatacaggctataacagatatccacaaagcagcttatgcagtgttggatttgtttccaggtgattttttttaaaaaatcaagaatgtcattaaatgcgacttagagttgccaagtaccacaagagcttctaacctagttcgcgtttcctagaaagaaatagctcatgattgtattctgttttggatttctagaatgttatatttaaatctcttctctttgtgagtcatgcaaattaaatacatgatcattttaaatgcattttaaaacctgtgctccactttgagggtgtagagaaataatttgtctggcattttccttacagtttaattgtagctagtcgtttccaccccactcccctgctgctgtctttgctggactttgtggccccttcaaggccgtttgtggtctactgtcagtacaaagaggtaatactggaatggaatgggcaggaattcttatgtctgaatgttgattcttaaactgcatcccaggaagtagttcttaacagaattctgttgttgtctgcagcctctgttggaatgctacacaaaactgcgggagaggggaggggtcatcaacctcaggctgtctgaaacctggctcagaaattatcaggtacgtgttcttacagccagtcccaagagctgccctcccgagacttgactttccttgcagtagtactaga

SEQ ID NO: 99865 - DNA, 1018 bp, Homo sapiens
gtcaccaatcatgtgacatccaaatttgcagacacagggttttacaatagtatcaagtggggataagcttctttgagtcttcctgctatctgctttagaattatattacctccattggtaatactcatagactccaaacagactccctgaggagctgcaccatccttcagcctctgaataaagtactaatagaaagaccttcagtctcattactgtggaggactcactgagggtttacgtagtctagagtcactccacgggcagatgtttgtttcttttatctgttcaggttttggctccattattcagctataccctggaggaggacctgttcgggcagcaacagcatgttttggatttcccaaatcttttctcagtggtctttatgaattccctctcaacaaagtggacagtcttctacatggaacattttctgccaagatgttatcttcagagccaaaagacagtgctttggttgaagaaagtaatggcacactggaggaaaaacaggcttctgaacaagagaatgaagacagcatggcagaggccccagagagcaaccacccagaagaccaggaaacaatggaaacaatttctcaagatccagaacataaggggcctaaagagagaggaagcaaaaaagattatgtaaggatgccaagagtccccaccacccccataatctcagtccctcagttaacttcagttaagtcatgagatttagtttggctttggtgtattagctcccaagatgataactatcaaaacagagaacgagtgtgtgtacatgtatacaaacgtgtgattcggtcttcgggatggagctttaggatacagaagcgttgcatagatagcttaatcatggtttttatagtatataggctttcttgtgtatttgcaacttccttataaacaacctgcttctattggtttagtccaagttgataaatattgttgaaatgttttgacaggccagagcatttccataaatttgactgaaagaccccagtacattgat

SEQ ID NO: 99866 - DNA, 1062 bp, Homo sapiens
ccagccactcagacatctgtcgtagaaccttccaggcagaggaagcagcaggtgccaaaagcctgctgtgggaccttgctgggtgtgttcaaggaacagaaagaaggccattgtggctgaagctaaagtgtcaagagatcaggccaggaatgataggcaggggccagatcatttatgaccttgcaggtcatctttggagtgtattcttattgctatgggaagccactgtatggttttaagcatggggtagatgagtcaaattgcatttaaacaaagagcactctggcatccaggtggatagtaggggggcaagactgggagcaggaagatgacttagaggcttggagtagttttggcaggaaaggatagtgtgatgggggcagtgcagctgggaggccagacttgagtggctgatggactggatgtggatatgaactcagaaaaagaaagtgtcaaataatttcagaccataaatgtcaatagagcaatttctttccttagagactaaagaagcgggcactgataatcgaaatatagttgatgatgggaaatctcagaaacttactcaagatgacataaaagctttgaaggacaagggcattaaaggagaggtaatattcaaaggatttttagttttgtttttgtctgtttggcatttaggaaactgttgggtttttaaagcagactgtacctaaggtaaaacaaaaaaataacgttatagctttgatagaaataggttgaaatgtacatgttactcaacatttcaaagattttatgtcttatatacaggaatataagtgaatgacattactaatgtcagtggtagagaatgtaataacagtgcatatcaggatttaactttgttcattttcagtaatgttttcagccagtgtcttcagaaattagtttcctttacctctcttctccttttgttggatatctctgttcttttacgttggtttaagtggagttataaagtacttgtattttattataaattccaaatagagtatagaaatataaagttcatctatttggacttctgtggaaaagggattggag

SEQ ID NO: 99867 - DNA, 1407 bp, Homo sapiens
cgatttagggaaccaataaaggtgacacacccagagaccagcaatggtggtaagcctctgacacgggagcgtgggtgatgtggcagtatattctgtcgtaatcagcttcctggtggcacagagaaaggaagagaaggagtgggatggggcacaatcagaattaaccaccacatgattcccagaattcagtgttctgtgcacatgggccatgtcctgaagctaggtgggctttctaccgtccttaggtctttgctggagtagaccgtgtggtatagtggaaagaatgaggcttggggtcagacacagatttgaatttgaatcccagctccaacaacaccttgcaactgtgaatcttggacaagatacttctccctgggcctcggattgctcttctggaaagagctatgtcccaggattaccgtgagaattaaatcaaaaagtgtgaatcacacctcgcacacactgcctagcccctggttggcactcagcagatgttagttttcttttgagaagaaagcattgtgttcctgtgggatttctcttttaaattgcaataagataaaaaatctatgtcataggaaacctcaagttgcctggtcctcagtagagcattgtcagtgttaggctccatttccaagtgtgtagattgtcagtgtttatttgcaagtataatttgcttttattagataattttcaaataaaatggccgatcagaccaagcccaagaaatttgttaaatccttgttacttcgatgagtctttgcttcccctttccaaaattcagtgttcttgtggcttattcattaattttacgtctctatcccaaccaggttctctctagttcctttgttgctttatgttcagagataatgctgctgatcatccattgtggagaccacttttgaaataaactgtagtgaacatgtcttttctgtactggatagaaaagatattcagttaattgattactttttttccctagaaaagtaactttcgaaaaacagtggttctacctggataacgtcattggccatagttatggaactgcatttgaagtgaccagtggaggaagtctacagcccaagaagaagagggaagagcctactgcaggtgcacattttggatgcgtgaaatagatgctctccaactgactagtcagaaacatctcagcctccacctaattcccaagtgctaggccatgctatcccaaaagaaatcttaactcataatctaagaactgcagctcagtggagtgaagcaagtactgcctttggccatgagataacctggattctggctccagcccaccattaaatggttctctgttcttgggccaggcatttaatcctatgagtcgttgctgcgtcattgcaagaacataatgtaaagttctttcagtgcccagaa

SEQ ID NO: 99868 - DNA, 2933 bp, Homo sapiens
ttctttgagcggaagttggatcactgaagcgccaaaaaagaatttaggggaagacctgattttcgcttgaggcatttttgcggcgctgtgcgctacagacaccttctggaagctgcggtggggaaactgagtttcccgagccgttgagacagatggggttcagcaccgcgcggggacgacaggaaagctgcggctgaagagaactgcggacttggcaggagtcgcctgaggagctaagatcccggagactcttagccccgtggtgcttctctacgggagggagggagggagaatccggccggacagatctgcgcgtatcctggagccggcccagttgtgaactaggagagctttgggacctctgtcccaagcaagtaagaactttagccttaggagatgtaaataaagtagtatttgaagaagcacaggtacccaactgtttctttttactctttctccagtcctacttcttaacgtttttttgaatttgttactgttctcagcatattgtctcgtttgagaagggtatggcacgcagcgttgttgaaggagcgcctcagcttgggaggctgaaagttttatctctgtactgtcgacaaacaactttgatcttgatcggtttgcttaatttctttgagcatcagtttcataatgtgtaatgcctaattattggagccctgtcatgccgttaaatcgtgaactttctagttactatcttgttttattaactaaaccccttttaagtaaggatttgggtagagtatttgataatgaattgcactgcagcgtacaggtatatctttatttacttgtatacttaggatatgaatcatttttaagtagacgtgtattttataagaacagttttggatttacagaaaaactgcacaaaaaatggatgtgacactgcaggattgactgtatgtaagaagctatgatgatgtatccctagtgtctcacaggccagaattatgttcatcctgtcctgccctataataagaagtctcaaatactgcaaataagttttcatagagttaattacctgtcctattttcatttctgtaatggggacttgtaaacaggtacagtacctgtccttatttttaacctgtgagcgtctagtatacgtaaaccatatttaatagttattaaactattatggtataccttaaaaagcgatagagattagaaacttaactgcagaatatttgggtcttgtatcatagctgtacaactttgcaagcctgtttgctactcttgaacctagaatacattaatttttccctttttattaatacatttttaagagcactattttccttacagttttggtgaagacctttttaatatctatcttttaggagagatgaatggagagtatagaggcagaggatttggacgaggaagatttcaaagctggaaaaggggaagaggtggtgggaacttctcaggaaaatggagagaaagagaacacagacctgatctgagtaaaaccacaggaaaacgtacttctggtaggtgaggtcaatgattgttcaatttttttcacttaaggaagcaattcacgtctatcatacaaggcggtttatctcatacttcagtttgtcttttatttcatgctactccttagtaagtatttgaacattgatgtcccagatttttactaaaacccctaatttggatactctattaatgagagtctcatttggaaagagaagcatattggaaaaatgttcactctgtttctactaacctagtattttatttttttcagaacaaaccccacagtttttgctttcaacaaagaccccacagtcaatgcagtcaacattggatcgattcataccatataaaggctggaagctttatttctctgaaggtagggtttaaaaagtacaaaaaagcaccataaatcatattttcttaacttgtctttggatgctacatcttgtattactgtaattcatttactaacatatacctgctttaatcttagttcacccaaacaattaaatgatgtttatgtttcaaaagcattttagactttatatcagtcaggaaagcagaaaccatactaggtatttcaaaaaggggacttaatacaagaaattggatacaaaaatggaagactgaaagagcagaaaggaaatattgaggtaactccccagaaagtagtaattcaggaagcagcaaccatccttatggctaagagactaaaagaagttctgaggttaccagaatgtgggaattcaaaggttggagaggtcacagcatagctgttattttgacttttgaggggcaccctacaaagctatgcttggacttctgaaggctaccttacagagctgtgcttagaccactaaggcaaatgaagctggttgccactggtaactgagggggcatgactcagtggtgcttggaactggaggctagcactatcgttatcttctgcagctgcagagatgctgaaaagagttggaaacaagaataaattcctttctcttcctgccaccttcccgtctctaaagtgccttcaattggcagaatttaaagagaatctgagacatgtagggtacagatctgaattatagcatcgcagagcaggaagtagaacagtgggcctgaaatcaagggacaataacaaatacagctttgtgtagaaacacaggtaaggaatctccctttgataattaggaataccaattaacctacatcagtctgtataggtgcagggaactgtcttttttgtgctgttaaaatacccatttgtttcttatgtctcatgaggggtgtgtgtgtgtgtgtgtgtgtgtgtgtgtgtgcatactttttatttttttttgagatggagtcttgctctgttgcccaggctgaagtgcagtggcgcgatcttggctcactgcaagctctgcctcccaggttcacgccattct

SEQ ID NO: 99869 - DNA, 1149 bp, Homo sapiens
caccgtgttagctaggatggtcttgatctcctgacctcgttatccgcccgcctcggcctcccaaagtgctaggattccagacgtgagccaccgcacccagccgcatactttttttttttaggaaaactagacgtttgaggtccaggaccctccctgccccataccaggcatgcagtagtcattttgtgaatgaatagagtactttacaaatgttttctttattggaaatctgttcgtttttttccatcaatagaatctgtttcatgaatgatcttttgttcctttaggatgtattagccaccagcactcccattgctcccctagcagatagctcagaacactataagtgatctttggacagtcctaaagatggagttcaagaggtgccttagccttcaccatctgtgcttccaaactactttattgtactgttcttctgtgagagacatatttgaaaatgtagaactttagagtgttaaaaaaaaaaaggcttttcagttttgccaccagggtcaagtgttggtctgtctcctgatctcaggaaagactgtgattgtgattgtcttcagctctgtcagagtaagagcttagtttatgtgtctggctttggctttattataatttttagtttaagcttattgtctaaattatctgaactaacatgtcctattaggtgtcaaagatgcaaaacaaagtttcccagatagtggggcttttagagagagagagtttctgtctgcatttcacattatgcaaacctaaatttgttttagaatcttaagtttacattctatactagttcttatatgaatgtaatcaaaatacaaagcaattagaaaaaaatcatctaccatgtatatagtgctgcttttgtctcatgaaaaatgtgcatgtacctgtgtgattatttgtgctaatgccatatttgttggattagtttacagcgatagctctcctttgattgagaagattcaagcatttgaaaaatttttcacaaggcatattgatttgtatgacaaggtaagattcctctacagcaaagctaccagtcatgtgccatcttaccaatgtattcgaggtacttgtgattatgatcgtaggcactggagtcagacttccttggttcagacctcagttctgccacttacc

SEQ ID NO: 99870 - DNA, 1373 bp, Homo sapiens
catgtgtgatgtcgtgaagaggtcctccatttgtctgaactgtggggctttgaagtgacagaaagatggctgtttcagttgatctctattcccgccactattgttgcgtaacacatcactccaaaactcagtggccgaaaataaagccaatcattttattagttctcatgatatctgtggatcaggagtttggaagaactactcaactggctagttctggctccaggcctctcatggagttgtagtcagatggtggctggagtacagcaaggtggctgggggctggccaggcatcttcttctccatgtggctgtgtgggctagtttgggcttcttgcacacagtatagcagctcaggcactcagtctgcttatatggctgctgacaggttcaggtcaagaagtgcagttggtaggcagaaatggccttgccttttgtgagctagtctcagaagtcgtgcaacatcactgtgtcacattctgttggtaacaaagtgagtcccaggccttctcaaattccaggagaaggaattagccttcatttctttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcccgacctcatgatccacccgcctcggcctcccaaagtgctgggattacaggcgtgagccaccgcgcccggccttcatttcttaatggaggagtagcaaggttctaaaaagtcttgaagataaatattgttgcaatcatatttggcaaatacagtctgccacagtctgaatttataaatgcttcttgagatccaaacaccaaacaagtgcctgtgtggcataataagtattacactctacagaaagtgcaaaaggagcctagatgagaaagctggggattaaagaaaactctggaaagccttttgaaaaggagaggattggcattgggcatgtgggacagaatgagagggttgttgaaggagcgagaggtggcatgggcacagaggaagcaataagtgcttcatgtgggaggcaagcaaagcaccttgcatacccatagcaggatacgaacagtaagtgagaaggatcaattggaaagtgcctcaaaagctgtcgatattaaattgttgcaggaggaaatagaaagtcattaatctctcagtggattttactttactagcatcctgagaccaacttttaaaa

SEQ ID NO: 99871 - DNA, 1054 bp, Homo sapiens
tagaagtttgtttttagacttccttttcttagaaaaaaattatcatgcttttaaaacaatccccaaacaaattaatattatagaaggaggaataccccctttactagtcacctttatgttttccttacttctgttttttgttcttttttcgcacttgagcttgttaaagcaggtttggcattagcactctttggaggaagccagaaatacgcagatgacaaaaacagaattccaattcggggagacccccacatccttgttgttggagatccaggcctaggaaaaagtcaaatgctacaggtagacaatcagtcatttagtgtttgttcttttgcttgtaaaatgcgttaataattcacaagtgaattttctcaaagcatgtagtgtgtgtgttccagaggacatggttaggtggcgtaaatgaattggaatttgtgtgagtaatatgtaacttatatctgaccatatttttaaattgagccagtctcctgttacagaggctgtacaaacatcttggtctgttgagacatcaactattaggaaatattaaccatttctctaaccattgttttgctagtctttgttgttgttagttgttatgtgacctcacctatgaacagaatagttcaggggagttaaagcagggtcacctattctccctcatacaagtacataaacactgtattgggctttaagaacagtctgctaaaggtgtgggatctgtctgtatatatctccactgcttgtgagtccaaatcaaggcaacctttttttttgagacggagtcacactctgttgcccaggctggagtgcagtggcatgatctgggctcactgcaacctctgcctcccacttttaagcaatccctgtgcctcagcctcctgagtagctgggattataggtgcgcaccaccacgcccagctaatttttgtatttttagtagagacagggttttgctgtgttggccaggctggtcttgaactcttggcctcaagtgatccacccaccttaacctcccaaagtgctgggattaccggtgtgagccaccacgctc

SEQ ID NO: 99872 - DNA, 1550 bp, Homo sapiens
cgatttaaacaggtctgtctgactccagagagctatgcttttaactcttgtgctgtttacttttctggcctgttatagcatgtttgctcagaaggtgagcatgtattaagtcactttattacctgatgtttaaagaagcattggaaccttcaaaattaaaattggtactcatgtttttgcttttcgaacttgaaaatgaagcataaattggaattgtgttgagtatttatatgaccacagacttcagaatctgactgcctgggtttgattgaatcctgactttccaccttgatagctgtgtagttcctcattcactctttgttggccttggttttgacatcagtaaatcaggatataataatacctttctctgctggtgatggtgcaccttgtacactaaagctcttaaaagaatacctagcatatacctaacgtttgtgagcaactgctgttagctattacttcccttttactttggatgattctcttaaactttttgtttccttaggcagcgtgcaatgttgccccacgtggcgtgtatgtttgtggtaacaccacgaccacctctggtctgacggtaactctttcaaaagatagttcctctggagattttgctttggaagctggtgccctggtacttggtgatcaaggtgagaggccaaagggaataattagtgattctgggactttttgaaaagccttttccttttcagttaatttctttacattctgtttaagagaaacatttagatagcaaagtcctaaccagtaagttgacactgtcagaaataatcattggaaatgcagtatcatcatttttatactacagaattggaactgtacttaatgtcattcattttcagaatcttatagccgatacaagtatatgtaaaaatcaaataaatatgtgtagctccctgaacttcccatttcataccacctatcatatttgtgatcattttttttaaaagcctgttttgaagctttgtagtaagctccctgtatggtgggatttggatgtcttgtggactgccatgttcccattgcctagtacataggggcacagtaaatacttattgaatgcgttactatgatttagctctaaatagtttggaaaccttggcactgacaaaaaggtggatgtcatcctttgctcacagaggacttgcaataggagattacaggtgttactttcgatgtttttttctttttatgagacagagtcttgctctgtcacccaggctggagtgcagtggtgcagtctcagctttctgcaacctctgccttccaggttcaagccattctcgtgcctcctgagtagctgggattacaggtgtgcgtgaccacatccagctaatttttgtatttttagtagagacggggttttaccatgttggccaggctggtcttgaactcctggcctcaagtgatccacccaccacacctcccaaagtgctgagattacaggctacaggcgtgagccaccacacctggcctacttcagaatgaatagttttgccgtattgtaactgaactcattggtttttttt

SEQ ID NO: 99873 - DNA, 1180 bp, Homo sapiens
tggagatttagggtatttaccaccaccaccaaaaaaatcaacctactagtagtttttctttagtaaaatgacaaagtgctatattagaaaaatcagaaagatctattgaacaaaaatccagcagacttggattctgttttttaatggtatcatgaacaaaatactgaactagctaacctctgatatgtcatgtagcagtattgccaattagtgataataggacatgaagaattcagtgggtttgggggtgtgagaaagagccatgtcctcaacctacccagggtagatacatgtaattcttgtgcccatgttgcagtggttggatatatcgaatccaagaagctatttgcttatttctttaacctaaatcttggtttttcaagttctgcgtggaacttgagtagtaaataagtgagtagacagttttctagtttttccttttgattccaatcattgtttcttctttctttcatccttcatagaatggggagtgcactactatccagatttgatttggtctttatcctgttagatactccaaatgagcatcatgatcacttactctctgaacatgtgattgcaataagagctggaaagcagagaaccattagcagtgccacagtagctcgtatgaatagtcaagattcaaatacttccgtacttgaagtagtttctgagaagccattatcagaaagactaaaggtataaatgtttcttctccttattcagtttggttctgtttgaatgtcaaagttcagtgtgtggcttattgtagagcagtaggatacaaactttttttttaccagaactttttaatatttccatactagagtttacgtaaacttcatctgaaataatccaagtcggcctggcgtggtggcttatgccggtaatcccagcactttgggaggccgaggcaggtggatcatgaggtcaagagatcgagaccatcctggccaacatgatgaaaccccatctctactaaaaatacaaaaattagctgggcatggtggtgcgtgtctgtaatcccagctacttgggaggctgaggcaggagaattgcttgaacctgggaggcggaggttgcagtgagctgagatctcaccactgcactccagcctgagtgacagagcgagactgtctcaaaaaaaaaaaaaaaaaggaatctaagtcagctaaga

SEQ ID NO: 99874 - DNA, 1780 bp, Homo sapiens
ggactggggtactgggtcgagagtgcgagcaagcgagccagaaggggaaaggcggctgctcgtgcctgagctaccgcagaggggagtgggaacagtggggtaaagggggggggggcgggaataagaaaggccgagagaaggcagacagagggtggtggtggtgggggtggtggtgggggtggtggtagggggagagggagagggaggagctggaggaggttagaaggaggagctggaggaggctagaaggaggagctggaggaggttaggggctgagggagtgagtgagtgaagcggacgcgagggaggggagggaagggaaaggaaagggggggatcacgcaggggcgcgcgcaagcaccgggagcgcgctcggagacgagtggaactggatagggtttgctgtcagcggcgtgagcttcggccgccattttacaacagctccactcgcgccagacacagggagcagcgagcacgcctttcttgcaacctggtaccatcggacaggattcctccccctcagtccaacggggagatctttggaaacatggctacagaacatgttaatggaaatgatactgaagagcccatggatactacttctgcagttatccattcagaaaattttcagacattgcttgatgctggtttatcacagaaagttgctgaaaaactagatgaaatttacgttgcagggctagttgcacatagtcatttagatgaaagagctattgaagctttaaaagaattcaatgaagacggtgcattggcagttcttcaacagttaaagacagtgatctctctcgtgttcagaacaaaagtgcctttttatgtggagtcatgaaaccttataggcagagagaaaaacaagggaccaaagtagcagattctagtaaaggaccagatgaggcaaaaattaaggcactcttggaaagagcaggctacacacttgatgtgaccactggacagaggaaatatggaggaccacctccagattccgtttattcaggtcagcagccttctgttggcactgagatatttgtgggaaagatcccaagagatctatttgaggatgaacttgttccattatttgagaaagctggtcctatatgggatcttcgtctaatgatggatccactcactggtctcaatagaggttatgtgtttgtcactttttgtacaaaagcagctcgggaggctgttaaaactgtataataatcatgaaattcgttctggaaaacacattggtgtctgcatctcagttgccaacaataggctttttgtgggctctattcctaagagttaaaaccaaggaacagattcttgaagaatttagcaaaagtaacagagggtcttacagacgtcattttataccaccaaccggatgacaagaaaaaaaacaggcttttgctttcttgaatatgaagatcacaaaacagctgcccaggcaaggcgtaggttaatgagtggtaaagtcaaggtctgggggaatgttggaactgttgaatgggctgatcctatggaagatcctgatcctgaggttatggcaaaggtaaaagtgctgtttgtacgcaaccttgccaatactgtaacggaagagattttagaaaaggcatttagtcagtttgggaaactggaatgagtgaagaagttaaaagattatccattcattcattttggtgagtgagatggtgctgtcaaggctatggaagaaatgaatggtaaagacttggagggagaaaatattgaaattgtttttgccaagccaccaaatcagaaaa

SEQ ID NO: 99875 - DNA, 1043 bp, Homo sapiens
cattgtttattcagaggatattcctctttcttccctccatagagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcacta

SEQ ID NO: 99876 - DNA, 1052 bp, Homo sapiens
atttaaagggcaaggatctgttctttactcctagtctcattcagcatttttttgcatacctaccctttttttaaatattttcattctctgtttgtggttgtgattgtgattatttgaataagttatttccttctgctactagactataagctctgtgagaataaaggttgtacatgtttttattcatccatgtgtcttgagtggtaaccacagtctctggaacaaagaaggtgcttggtaaatatttgttgaggtactaagggttttatttatctttgtctttacatgcacataacatagcatttgatatgtacttagtgttcagtaaaggtttgctaaaacaaattggaaaaaatatttttcacatacatatattccctttacggtacttacagattttataaatgtacaaacattatacatgatcttaatcatttcatattacttattctttttaaactgataactgatgtaatcatacctatagtttgttgagtccttcactatgtacccagcaccatgctaagcctaataacacttgccctaatctaactttagaaccattaagttaggcttttatatacccattttatagaaaaaaggtgactgagactaagaaaggttaaataatctaaagttataaagttaataaatgggtaagtcggtatttaactttgcaaaaccccagtttgcatgactctaaatcctatcctttcagcctccttacaatccaagtgatgcaagttgtatgtcagttactagaaagtgttaggtaataaaaataggtagaaatgaaatttctgtaagtcaaaaaaaatagtaaatgtgagtcaacaattgcagtgattttaataatgtgattatgaaagtaagctcaagaatgctttttttggaggacttaagtgtaacttttgttctgtttatgcttcttgtaggtttgagtggccgcttctttgtcaccactctcccagcattttttcagtaagtttaaataatcttctaatcttgcaaatattagaaatcaatagatgtgtaccaggaattctaagttg

SEQ ID NO: 99877 - DNA, 1098 bp, Homo sapiens
tggaaggcaatacacaccatgtccagtagacctatcagcaggttccagcacctcatggggtaggggaaacagataacagataagtcccactgagaagcataaagcgggatcggagacctgagaaaatgagtgctgggaaggggtctgctgctttacagagccatagtggggaaaggtgtcttgataggaggcagttatatgagtagagacatgaacttagtgagggagagcattcctctttgccggggatacagcaagagcaaagcatatttcaggaatagaggaaggccaatgtggctactgtagagttcagaccttttaggccatgaaaatgacttgggcttttcttctgatggaagagggaaggcttctgaaagttctgagcacagaagtgatgggatctgagcttttgaaagttccactggtggctgttgggagtaaactacaaaagagagaagcaagcagaccaactaaatggctgctgcagatatcctggggtgatgatgataactttgcctgaggtggtagctagagaggtggtgaacaaagtgacataatctgaatatgttttaagatagagacacagggtttgataatgtattggatgtgaagtatgagcaaaagaaaagattctagaacaactattagtgttttggcccagaaaattgggagaattgggttgccatgtcctcagataagaaggaaggaagagcatatttaaacagaaaaaaatccagaatttggttctggatatttaaatgttgagatgcctgctagacttttacctgataatgtcaggacagttagacacaagtctggggttcagggaagatgttggccctggagatacaaatgtgggcatttgaggctcaaatcctgggtgaggtctcttaaggaatgtaggtgtaaaagaaagaggtttgagatctgagacatgggattgccagcatttagactttgaggagacttggaggaaacagcaaaagagactgagaatggtatatacgtaaaagaatagaaggcaggaacttgaacagacacttgtgtaccaacgtccatcgatggatgagtggatatacaaaatgtcgcatacactta

SEQ ID NO: 99878 - DNA, 1095 bp, Homo sapiens
ttgtgtattgcaagtgcctataagagtatagttattaaggtcacaagctcttgggtcagaaagccaagccacaacaccaataacaagctgtataatcctgcaagttatatcatgtctctgagacttagtttcttcatctgaattacaggaataatcgccatgtttatatcatctagttgcggtaaggactaaatgacaaaatgcacgtaaggcacctaacacaattgtcacatccattgtttgtctaaatgcattttgccatcattattaagtaaataaaatatataacttacatgtatgtgatgtagtgggaaaaagcaagttaaataggcataatttacctatttaccatagaattccatgcactaatatagattgtcactataatctatatttatatatatagattgtcactataatctatgtataagagatttatacttttgtagctgtggcatttaaacctactgattaaaatctaacttctatgtattagctatagaaaaatgaacttgaggcatatttctctttgcagccaaacacctacccccagagaactatcacagcaatattgttgtactaagacttacagttcttatttagaaaactgtctagatttgccaacagttaaatagattttccaaccatcaaaataattttagagcaatttactttcagttaagaacatgcgggtatctttttctgcactatgaagtcattgaagcaaaatccaaagcactgttttgaaatggaataacaaggttaggggtcagagagacccagattcaaactccagtgcacttattagctgagagaacccaggaaggtttattggtttccctgtgaatgataatacttgctgtattgatttgtcttgctagttggattttaactggtaacaagacataaatcataatgtttgatactacttacttccctatgggccttaagttcacttttcagtgtattcttcttaatgttctgtgagactggtaaataatgaagtatatatatatatatgtgtgtgtatatatatatatatatatatatatatatatatatatatacacacacatatatatatattacttgaac

SEQ ID NO: 99879 - DNA, 1090 bp, Homo sapiens
tttccctttcgttgacaaagatggggtgtgctgccacaggaaacccttgttatatggaggctcttccagctttatttaaattgtgaacatttgtacttaataacacgaacaatgagcagtctggatttttctttttcaagttgtcagtgcaagtaaaggcattttaaaatccgaatctgcttccaccagcagttttgataattaaagtacacaaaatgtatcaaacatttgagataggccaagtattccgttgaatttgttacagatcttgaagtggactcaatcactacttgctacttttcagagaacctttccaggtatactagctaggtatgaatatcagaaggctattaccactgtttgaccacaaaggtaaagaacatccaatagacaactaaattctagatctttctttatttgcggtatgggaaattttttaacatattctgaatcttttattttttgcaactttcactgtctcagattagactttaaaactcaagagctagaataattggtctagcaccatctctggtgtcttctatggatgcgttgcctacagtatattctgtcatcatctgtggttttctaaactgaattgcatttaatttcaatcaagcaattcatgctgtatttgaacttcaggcatatctttattttccagaaagcctgtttatcatatggccactcctgacttcctgaaactctaacagattaactgagaagaaaacaagtattatatttctaaggcattttcagctagtggaaaagataaatgactatatgagtcaataaaaaagtataattttcattgaaaggtagattggaagagcactatcaagacaaaaaaaaaagaatctgtttttaatgaaaatgaagagatctgttttctcaatcgtcatactaaaaaatgagtggtgtctgcacatatttttatttgggataataaaattgaacaagattattgctaagccagcatactaaggaaagaggacatataagccatatcaaatttaatgtaattgccccacactatcttctacaagaaacaaaaacaaaaaacaaacaaacaaaaacttggaaataagat

SEQ ID NO: 99880 - DNA, 1003 bp, Homo sapiens
cagtggcacgatcttggctcactgcaacctctgcctcctgggttcaagcgattctcatgcctccgcctactgagtagctgggaccacaggtgggcgtcaccacacccagctaatttttttgtatttttagtaggtatggggtttcaccatgttggacaggctggtctcaaactcttgacctcaagtgacccacccacctcggcctcccaaagtgctgggattacgggtgtgagccactgcacccggcccagattgccttcttcaggtaagtattttaaacctcttatgagctgtttccttccttcatcccttcgtttcctcctttttcctcccctcctaggactctctttctcttttcatttgcctctattttccttcattcttttcttcctttgttcattccttcctcccttctttcttccatctccctcttcttctttcttccatctccctcttcttctttcttccctctcttccttttttcctccttatttcttgctttccttctttatttcactcatctaaaaaaaacctgtagtatagatctttgaggaaattattttagttttgacattcattgcacagttgtctgtaacccagttagggaattctttcctatttttaaaatgaaaatagctgagagatttgtgaggaaaatttgaaacaatgttgattctgaatgtttttaaaaatttctaatatttatgaaacaactgtatctcagatgagcttcaatttgcaaggcatcattccattttcatttttaattctctgttccaatgcctctgctaagaaataagcattttctcataggaagagattattccttttaactttttttcaattttaatttttattcagcctcttacctttttgctaaaaccaaaagttcaaaagaaaggtgatcaggacactcccaggaattttttagccatgtgagaatatatggtgaaatgattcaagtagatgcaacatggtctactggaaaagcactgagattttg

SEQ ID NO: 99881 - DNA, 1030 bp, Homo sapiens
tcaatgacctagttaaataaatcgttgtaataaataaaaatgtcttcctgtctttatgtaactgctcattttgtgaaaagcataacttggctgcacaccttttttccgccttcttctgataaattcttggagtccaaaaggtatctttcatttagtagatttttcaaaatgtttatattcatagcaagttctggtttgggtcaagcaggtggtagaaatcataactgcctccagaaatcaggagggcccacgcagtacaggacttggcaggccctggtggcctaaggtcagccagagtgcagatgcaatgcagcaactatagtaccagcattattctagaaagttcttacttcttggaagtactgacttgtaagtaaaagagcattttaacttgatcatattcactctggagtcttctacatctgaatctaaaggggaactgtattcttcctgcaaatttgggattctctaaataaagttccagggcaccagaggttccactgggttagacctttgatttattttaatgaagagcccttcttctttgttgatgtctgacagcacattcacagtgatccagtcatttttggggtaagatagaaggaatccaggtagaatacaatataaaaatgtctcaaactaggcaagagaagagtctagtcctgtggtaggtcatatttgtcaaaatatttgctaccctcttagctgttcatcctcactgagcctctctcttcaaaagattatccttcatatcccaacactgtgaggcttgagcacgtgctttgctttgaacaatgaaatacaagggaagcaatgtaatccatttctgagccaaaaaaattaagagccattgagtgattctgccaggcagtctcctgggtcatctccagaatctggagtgcagagccacagtgacccataatggacattgtgtaagcaagaaataagtatttgttattcataaattaccagtgttttgggcttgttactgcaacattgacccattggtagaaacaactcagcttctggt

SEQ ID NO: 99882 - DNA, 1065 bp, Homo sapiens
gtaggagagggagggagcgtctgtgtactgccacagctgggaacattactgcacctacttcctagtgccttgcaggcatctttgggacttgctaagaacctttggagaagtgtaagcagaggttaattgttcaaccacctgcttttagaaagatataaattttatatatgtaaaataatttttaaaatcatgattaatagcctatatcccttcagttacttttacaaagccttccaatgtccagaaggaaactgctgacagtgacatttatggagaagggggaaaaaaaaagtaatttttcaactcaaattgaagggcagtggatagagaggggaacataaattcattataaaatatcttcttaacccatatatatagccaaaaaaaaaaaggagctaattgcagaccaattatggaaaaaacctgaccttgggagaaaggcatgctatttatttataatcagtattaaggatttagaagcattttcaaggtttgcatttatttggggttgaaatgtcataaatatctgtcagcatggcaatattctagttaatttgattttggtgttgataaggccaagttcaaataatcaatctcaattaggctgattaatttcacactaaaaaactgtactgaggggacacaatttacttaaaccctaattgaccgtgttgtgcctttgggcacagagagatcttaaaaaggagaaatcagggaaatcactatacacaaacactggaaaaactgacttaattttcttgtttttaccaacaattggttgtgttgttgtcaaatggataaagtagaactttaaagaaaaatcaactttgtgcagtctcttaaaaatacctgaatgaaatgaaataaaattcataaaattctatccaacaattgaaaaaaacagctttttttttttttgcttggaggctagaggatgatgatgagtagctctattctgttagctctttctgtagctctattctgttaaattgtcatgacatttgttcagctcctaaaaaatgaaaattgggattgaaaatcaatttttagtattttttttccaaa

SEQ ID NO: 99883 - DNA, 1077 bp, Homo sapiens
tatttggatttcatttattcatttaaatatttatgaagccctactacttaccctcaggatgctaggcattctaaaggaatatcttgctagagaaacgtctccgtttagattgtaccttaagtttcagtcacagcacagaaaagggcttctttggaacctgtgacaggtgaccgtcttctccttttcctctgcagttagattcagggcgactgctttgggctaaattatgaaagacttaagcaggagtaaagagatttttctgaaagtaaaaatatctaaatacctaaatagattcccgagggctgttgtgtgtctctttgaagatctttaaatgcggagacaaagaaggcgtctaccagcagagggttgcgtatgtctgagtgacctttttatgatctcttttgagtccgtgaaggatgcgattaattaaagtcggaagtttgtcactgaaataatagttatgagatccagagaattcaaggtgttggaggactcattaagtagttgcataaatatcatgctgaaagatttaatgagaccacagggtcacttatagaacgatggtgcagagatgacctagaaaaaaataaattagaatcgatattgtgcttctgaattaacagctatagattgctatattaacacctgagacataaattctataattatatcttaatgatgaatattgatgttcttgtcacggaaaaaatgaaaattgctcacatttagtattttacttatcaatagtaaaataaatgtatatatgcgtgcttatttctgtgacatctgggaaccgtgaatgctttaagtagctacaattaaatgaatagtgttttttttttttccttttaattcaaccaatagttattaaatgcctactacacagcaggcactgggctaggtgctgggaaaaaacacagatgcacccttttccccccttcaagttgattatagtatagtgctatccaatagaattttctgcagtgatggaaattttccatgtctcagtgtccagggcagtagcaactagccacaagtagttattaaccatttgaaatgtggctgatgcaactaagg

SEQ ID NO: 99884 - DNA, 1102 bp, Homo sapiens
ggaccaatgagaaggaggttgttcatccaattttcaaaatgtgtgtgtagagctacctaaataaagtaggagaacagaagggaagaaagggttctaaaaaataaccagtctgtggcaaattttacatctgagaagaccaaaaagactgaagaccacaaaatttaagtgacttggccagaagtcattcagatattcttatgacatgaatttgatatgaagaaaatacattttaaaggtagttttccccccttatggtttatggttgaagcagattctattttcttacaaatgctgtgttctgatatttaaaatgttgtctggcatcattaggtctcaatcccttcttagaacaaaatgttcctgctctctcccatttgaagagtattctttcttcagatgagttttctaaactttcctattaaacttgctggaatgtgaatggggaaattagaaagatttttgtttttttgtgtgtcagtgaggtgattcatcacagcacatttcttagaatttggagggaatcctgggtctgggagtgctggtgacttggaacaggttctgctgcagctgggtgaacttggtctttgtagacttctctctcaagtttatctcaagagggggatttgaccaaagagttagaatggaaataatggcattcttctcccatttcttatttctgacctaacagcacaactcaaaatatactcaggtgttcttttatcttgtgagataactccctagaattggtgggagtgagtggggggggaagaatctgctctcccctgcaccccttaccccatttctgaaatgtctgaatctttcttccttccaatcatatgctcaagaatatcaaaaagagaaagatttccaagtcagttctacattttgatcacatccccctattaatcatatgtttttgctaccatctgcaacagagagaaattttaaattcattgtgcatacatcgtttaaaatttcccctctccgttatgttatttaaacttttcctacatatcaattagtttgaaataataagtctttaggctatccattaattgctgtactgtagacatgatctgtatttaaaattatgcaaggaaaa

SEQ ID NO: 99885 - DNA, 1042 bp, Homo sapiens
ctcatgtggctatgatggagcaccttgtacagggccctactctccatgttggcacatacgagtcactggggcatcaaacaggaagaagacaattgccagttctttccctgctgttccaacaatttagaaggaagtggggcttttacaatgtcgtactcttttgcatgaatgaaatcttagcctgttgtttgacagcgtccatttactaccattcagacctcatcatcaattcacctcaattttaattcagtaacacatgtgtttccaaggaagatagggaaggaagaaaagcaagtgagcctgttttaagaaaacaacagattgttgttctcttataggttgaactgggggaccttcagctatggatatattgtacctgacctagcagataatttctctcaggttaatgctcattggtggacaagaccccatagtgcttgataagtactatttctttaattattaacaaaagaagtaaaatacaagaaaatgtcaaatacctaaaccaatgctttttaacattttaaataatttaattctaagaaaaacctacattttagtaatttaattttgatgatgatttttaataatttataataattgacccagttgtggctaagttataactgtagtagactttcatcatgggatagtagtagattttattatattctaaactaagtcactgcttcatgacatattaagtgccatatatttcactctttttaaacagccatacaattattaatgaactaatttcaaaattgtatttattacattccaagttagagcttttgctttttcttcttataaactaaatacttgttcattgtaagaaaatatgaaaagaatacagggtaattctggctccgttccaacaaagccccatccatcagtggtctagagctattccagcccaagggttgcaaactcagatgttacaggggccaggcaagtcatgtaaataagtagcaggctatgtgcaagaaagagggggttgtggggtttctgaagagctagagatgacaggccctgtctaaag

SEQ ID NO: 99886 - DNA, 1053 bp, Homo sapiens
gaaaccagagtcatgcttccttggcaaaacatcagtgcagtattaaaaagtagtgaggaacagtgggcaatagatgctatctgtccagatgccgtttccagggttctagatctgcattttgcggctgggagcaatagggccactttaaagaggcatcacagaagctattgatgtttcaaatgggattaaaacaaaaccaaatcaaacattccccacatgttgtaggcagtttcaaataaatgatttgccttgagattttcagtagtctacatggaaattctcagaactatttttcattctcttttttaaaaaataatgaatttatttatttcttcaaggtgtcagagatttaatccaagctgtaattagcagttcacctctccaagtacattttacaactagatcctagatgttttcatttgcataattcttgaatgtcatttgtgttaacttaatattttttgtacagtctttctgttatcaaaagctttccctatatttcatctcatttgaaagaataaattcagatttcaaaaggtaatttcagaagtgtctcttttaatcatgataaatttgaaacatttcttcatttattctctagatttagtatttatctttttttaatatctctgtgtctatgtatctattatatattttatttatattttatacctatatttaaactgtatatactgctttatatttacacttaattttatatttatatttgatctcctataccagccgtccccaacctttttagcaccagggaccagtttcctggatgaaatttttcatggagggtggtcggggtggggatagctttgggatgaaactgttccatctcagctcatcaggcattagttagattcttataaggagcatgcaacctagatcccttgcatgcacagttcacaacagggttcacactcctgtgagaatctaattccacagctgatctgacaggaggtggaattcaggaggtaatgatcactggctataccgtcttaaacttctgctgggcggcccgcttcctaacaggccacagaccag

SEQ ID NO: 99887 - DNA, 1089 bp, Homo sapiens
ttaagaaagattagagagaagtgacatatggaagaccaacaaggcaatctaaggcacatatagttcatctcaaaatatgagaaaatataatatgagaaaatgttagtcataacaacattgaatttaaaacttgagaaagcattctgtctttcactgttaaatattaccattgatgtaaaaatattatagtaaaattattttacttttaagataaagaatcctttggaaatcttggttaaaaaaattaatctttaagggaaaaggcatcagaccagcctcagacaccctcacagcaacattatatgctagaagcaatgcctacaaagtcctcagggaaagaaaaggtaaaacaaaaattttaaacaaagtcaagcaatcaattaagtatgcagtgaacagacagacatcttggcatgcattcattaaggattatgaattccataatcccttaaaaaattattataggccaaatgtcagcaaaccaagagatgactggagaaaatacagcacattcactgttaatgaaatgatttaattttaagactaagactaaatcaaatgccaatcaaacccagaaaatgtaggagtaacatagtaacattcaggaaaggaaggaggagaaagatgaaaagcaatgtaaatatactgattacctttagaaccagatgtcaaagatattataaatcaaataaagcaagtattagaagtaaagatatatttaaagcttcaaagattaacactgagacaagttatgtggtaagcaactacagttttggatgatgaagaggaggaaaaggagaagggcgtgggaatatattactttcactgtttcttatagtaaggaatagtcatgaattgtacagatgtaataaatcatggcacatccatacaatggaatgatatgaagctgttacaaacatagaggctgctctacatgcatatatataatttacaaaattttaaagagaatagtgtataagaagaacaaagaatgtatgtatgtaagtttatatacatacactggtatagactcacaggcaggctaaataaggcacaggaatataatgcttccctctcagaacttgaagt

SEQ ID NO: 99888 - DNA, 1026 bp, Homo sapiens
tctacccgcctcggcctcccaaagtgcttggattacaggtgtgagccatagcacctggccataccccctttttattgatacataataattgtacatatttatgggataaatatgatactttgatacatgcatacaatgtgtaatgattaaagcagaggaaatgggatatccatcaccttaaacatttatcatttctttgtattaagaacattccaaatcttctagccattctgaaacatacccctttttatgacttttgaattttgtattttgtgcatgtactgcctattataaaatgtatactgcagttgttttggcaaggaaaaaatgagttagaatcctgattttaccctccagagtttcacactcctttgaggtgagacagataaacagataactcttaaataatgaggtaagtgctatgaaataagacggtaccaggtgctttggggaagtctaagaggcttaattcctactggaggggttagagaagctgagttttgaatggaaagaataatttaagagatatttgtaaatggtgtagatgaatctacttaataacagactcaaaataaaatatgaggctgctgaagaagccaaatatggaaacatcatcttgtaccccataaatatatacaactattatttgtcaatgaaaaataaaaccaaaaataaataaataaataaaagattcactggttctggttccagccacctggtagattgcagggctacttatttttagttcagcaaatattttttaccacctcactatattccaagcaccatgttgaaccctggagattagaatttaaataagaaacagtccttttctttaaggaaggtgaaatctaataatggcatgtggtagatggcagtcataacttcaagtattcaccgctctctcaatccgtaccctttgtagcaccctaccactatgggcaggtcactttgccctatacctaaacaccgggcccaacccagtgacttgctttgggcaaaacaagatggtagcagacatgaagc

SEQ ID NO: 99889 - DNA, 2399 bp, Homo sapiens
tcttccttccttcctctttctttctttccttctttctttctttccttctttctctttccttccttccttccttccttccttctttttctttctctctctctctctctgtttttttttctgacagagtcttgctctgttgccaaagctggagtgcagtggccactgcaacctctgcctccctggttcaagtgattctcctgcctcagcttcccgagtaactgggattacagttgcgtgccaccatgcccagataattttggtatttttagtagagatgaggtttcactatgttggtcaggctggtctcgaactcctgacctcaagtaattcacccgcctcggcctcccaaagtgctgggattataggcgtgagccaccgtgcccggccaagaccagctttcaaggacctttcatgtgcacttttaaaaaatcccacaatttttttttaccatcaaaacagattgtataaataccttctattttattatacaaggatatactgcacaacaataaaaaggaagaaattacagatacaagctacaacatgaatgaatctcccagacgtactgctgagtgaaagaaaccagacacggaagagtaccttttgcatgatttcatttatactaagttcacaaacaagagaaagcaaatctgtggtgtttgaatagtggttacctgtggtgtggtggtggtggtggtggggtgtgtgtgtgtgtttgtatgtgggaaggatattgactgaaaaagtgcatgaagaaatttctggagtgctataaaggatttatatctttattgaggtgtggtcacatagacgtttatataagtaaaactcctcaagcccccacttaagatttttgtactttattgtacatatatatatatataaaatatctttatcaccttcttcatcgtcatcatccagtctagttgaacatctgcagtctaatcatatcctaagcctagctgatatatacaaaattctattcttaagcaagtagtttggaatggaattaatctttattttacttttctattttccctttacactccaatcaatgattaatttaatcgaaagttcagtgggagttttttttttttcaccagacattacattgcacataaactcaatccttaggcaattttcttcattatcattttctttggtattcaaagaaaaccaaagttgttttagttgttcagtgcacaggggaacaagacacaaagttagggaaaggataccctgaggtccagacagctcgtatcaggcctgtctgtgtgctgcccacttttcaaagatatatgtctctaattaaggtaaactgggcaaatgcgccagtggtgatctctgtcttccaaagcacagcatgcaaaaagctaggtgaaaactgtaattaatgtgccactttaaatgggaacaagagatgtactgccctttgtctaaaagagatacaacatgatcttttgctaatacggttgagactattcagctaaaggtccttattgtcactattatcctttcatattaagtaacaatgacaataagcaagactttatacaaatcaaagtaaagaactggtggcgtttgcagtttgctttggcttttcttgtggtgaatgttaattttcataacacaatgttgccaggtaattgataactagagtctgcagctgagcacgatgaggtgttcagggatctacattctagagaaagtcttcaaaattggtctaggcatcctccttgctgcagaaacagctccatcttacctgccttcctgttggccaacccattagcctggctgggatgggcaattttctctattttctctgggcttccagtagatactctagaaggctcttcagcttaactttcttgcagatgcctcacccaacagggtggcctacctagcatgtgagacccagcattgagatgctctaggctggaccaccatgaagagaactgtggagcctgggaaaaaaggagaacctggggttggaattccagaaggaccttccaagggcctcccttattatctccatggcagagagcttgcattgcactcctgacagattgtgtccctgatttcctagccagagaagcagccacagtgaaccaagagaaggccataatggctataggtcaaaggtagagacactggccttttcttcttgctgcccaacattctggcggaactaggccttgaagggcaaatggcagggttggggagggtggctggggaagggcagtgggtaggaaaatgtttaaatgccagatcctgtgccagtaaccttccacttcaagaattaaggcatctaatagggcttgcagtgggacagggagaagacagaagactgaatttaagttgagtttgaaggtgaaggtttaacctgatgatatggtttg

SEQ ID NO: 99890 - DNA, 1753 bp, Homo sapiens
gggcctcctaaaagcctgttagtgaaggaaatccttattttcagaattttaaagttgcttttgctttaaccaattagactctgtatagtacaatacttctgagtgtagacttcgtatatggtactgaatcgaagtatggaaatatggaattctctaatttccaagtgtgtttaagtgcaactttatctagaatcataaaactagcattttcctagagagaaatacaactgcccactatagtttccataaatatggatatatctgaaagatgaccctactcttccaactttttttcctcttaacttctgtagtgattctagctattgttctaaaacatgtatttgaaatttaattttggccagaatattcaggaaaggtgtttttttttccatatacgtaatacttagtggtctatatatttaagttataggtatgtggagatagctgtttaataattctttttgtctggaaataacgttattcaaacataggcagctatgtatcattttaaaatgatattgaatttccccttaaagagaaatcagatttataatgtaaacatgaccaggaaaagcaactggtgactttacctggggaggctccaaggaggttaagaaagtatctgaacaactgtgtttttcagaatagaaaaattgtgtgtgtgttgcgggggaaggtaaaattttaactttattcttttattgttttcaagacggctgttttcagaaatgtgtggttgaactgagaccctcatattttatactcttcaaatttgagtggcctcagttatagaatcatacagaagatcaaaagtctagctcagcaggggcatgtggtgtaatccctcactatctgtgttatgtaatccagaatgctgtttttcataggacagtcttgcatgatccttagctggtgtattgatctattatatcatcttccttttgaactgtagtagtttaataaatgattgccatctttggagagcacctgttttcataaaaaatcactttttgaaatggcaaaacatttttattggcacttttatgaacgtaagacttgctgccagacgagtaaccttttgaatgtgacgtattataacatatctaaaggtaccatgtattagcttatggactacacttccttccaactatattattactcaacagttggaacttagttttgatggtattactacccagctctgaattaatcgctgttgaaaatgctgttctacaagtaactgtcaaaacagaatttctaactccatttgatcactgggtgcacatttaaatctgtcggaataactctacctttattttgcaaatgcatacccacgcagaaagctttgttctaaaatactctattggaagttttatatttatatgcctgaaaatgtgagtgatgttaaactgcttacatgtcctggaatcgtgaggcggtgtgtttttgccttatgagataaagaaatatggtagttgaaaaagtgttacaggttaccaaaaaccttttgcaggaaaagattttaaaaatttgtatcacctctgaaatatttcaaccacagcagagtccattcagtgcccgtagcacagctagtttgcctttcccaagattacacacaactgtctttagattaatgtatactgctgactttggcaacatgggacagttatatttggcaatttcagtaaacatggtattttcctaagataccactaacttcattttggggtttgatttattaagaattgaaatg

SEQ ID NO: 99891 - DNA, 1855 bp, Homo sapiens
tgttgggaaataaatacagcttttcatcgctggtgggaggcagcagtgactttctgtggttttgctgttggttttcagatgtgaactgtgtttgcaaggacactgcttaattctcagtgctgtccattccacattttcctatttccctctcatattgggaaaatgaataaacttgtgtagctctttcttctattccttagtatttgtttgtttaatagttttgcttttgataaagcctcaccctttaaagtagaaatactttctcaaattgtaatattatttatctagttatgccttagaatgatataaaggttttacatgttcctaggctgtgattctttagctaaccaagtataaaaatgagtttacttccttgccagtggaggcagacctgggtgattatgcattactgagtggatgagtgtgatgtttacattgtcttggttggaattaagcttgctttgaaaatatcaccctggaataacttttatttgcaaggcccacttcactcctttgcagcaaccactcccaaaccccattttctgggtggaagggtagaaagagtctgggtggaagctcacgactttggatgcttttttatgctgaaggcgtaacccaagtttctagaggagatgaaagtaataatgctgtacctttcaaatctcagctaggagatccttatgttccagggaatgaatgaccagcagagtgtttattttccctgcatgcacttcgtctacttttcctttcctttatcaaataaaaatagttgaaatggacataaatccaaggtttttctctgaacacctctcttactcactacttataaaaccttcaatgagaatgtcacacaccatgtgaccataagatagtgttatcttctcccctttcctgggattctccttcaaagctcaaaggatcttttggtatgcctagggctgggaaattccacctctagctacggaaatacccttgggccaggcaaatcatggctttaagatacattgcccttcttgtcctcccgaacaattaaagcatgtctttggctcccagacatgagtgaattgaagtagccatttccttagaaacaggaagaaaaaagcaacttgaagtaattaattgtaagcagctcatccagagatcagagaccacagaccacagacccctgattttacatttgacatctccctttcttctctagaacaggagttcttcattttagggccaaggatgcagtttggtgggtccacgaatgtggctggcaaatgaattacatctttatattcacttacttccaagtgacaattggggcaggtgttagggctactactagatcttggcatttagtgggttgaagagaaacacatgtattacttcacatatccctttaaagagttattttgataattatatttcaatgagattgatttccattgtacttttaggtatttaattttatatatttaaacatattatgctgggccaggcatgctggctcacacctctaatgccagcactttggaaggctgaggtaggaggattacttgaggccaggagtttgagaccagcctaggtaacacagtaagatcaatttatgcaaaaaataccaataaaaaaattagctgagtgtggtgcacatgcctgtaatcctagctacttggaaggctgaggcaggaggatcgctcaagcccaagagttcaaggttatagtaagctgagatcgcatcagtgcactctagcctgggtgacagagtgacagtctattaaaaaataataataaaatgaaaatatcctgctgaaaagggtctttaagatttaccatattgcgaagggcattcatgacccacacaaggcga

SEQ ID NO: 99892 - DNA, 1061 bp, Homo sapiens
taccagatcttcctttggacttgccaagcccagtgactgcatttggacagagggacctaatattaactcagtcctaatagcttcaaaattctgtgactttggtgtttcagaatataattcagtgagccagatgctgtccccagggtatctgtctcccagctaggcttttttttttttttttaaacaaaacaaaacaaaacaaaacaaaacaaaacaaaacaaaacatattaagccatttagacctggagggagaaaggcctccactagaagaattaggggtctctggtgttcaggggcagtcaccatagctcttgtttttccatggagtttctcggagagtactcaacttctctgctttacatagtattataataacaacaacaaaataaaacaacagacatttgttgagcagttaaaatgtgccactttatttaatacttctgacagcctttttgagtgtgtcctaatagcatctccagtttatacttggggaaactgaggttaggagatgttaaattaatcatcccaggatgttaaagttagaattgagactgaaactcaggtaggctgacatcagaactccaacttctaaccaccgtactgtgtattacctgtcattaagctggtacatgctgcagaaagacttgttaccataacaagttttgtgataattattttaagtgactaggctgagatatgacaaaagcttctggcaatcctgctgtgaatatggaattggaataagaaattgaggataaaacaatgcattcttatctaatcctaggtacttctgtttctgcagttgcatgccagaaatccgagatagggagagtactaaatgctaattcgtggtagcctaaacaaatagttttagttttctggaaggccggtttttacctggtgaagttcctcatggttttaatgagggtgtggtgtactctgattcctctaagggccaagtaagtgaaaggcccaagtgtggctgaccaggtgtcagaggccttagggagtggtgaggcttgcgcccatccaggggcccaattgtgccccttcccatgga

SEQ ID NO: 99893 - DNA, 2108 bp, Homo sapiens
ccatgttggccacactagtcttgaactcctgacctcaaatgatctgccctcctcagcctcccaaagtgctgggattacaggtgtgagccaccacgcctggctgctacaccatgttttcttttaaagagatattgggagaaatattgcaggaaatctaggtcactgattgattcctaactgtgttcagaagggactactttgataactgtaattgttattaatgatatgaagtaaattatttgtgaattttaccacattccttgaaagactgagactcagtcagggttagtgagtcttgattagataaatgacagcaaagtgaaatactgtttctgtttcccaaagatggatttagtcctttcatctgtttctccagatactcattttttaagaaaaattctggtttggttggcagtgacattcagattctgattgtatgccttctgcatgtttatttttacaacacactgtgaattgtagaaatatggtgggacagtcatatttccttggcattgaaaccttgcatattcaagaaagtctgtgctaggttttgctcatggaaatgttatagtgtttcacagtttacagacaatttcctttgataatgtctgtgaaagcacagtggagggcaccacctggtcactctttcaacctgtatcattcagggccctgctggggaacagatggcatgtgtacgccaagtcctttgaggagggcttgttaaagggaccttttgcaaggtgtgggcaggtgtagggaatacaatcagggtgaatgctaaagaaagacccagcagtgacggggagttagtcctactctaaggaaggggcaagaaaggctgacaagagctgtatccctttctagagggaccccgtctgcctgtaatatccctccagggagacagaggggaatatatataccttcctcactctctgcctgtcccctaaacgctggctagtgtcttccattagccgaacccagacagaagccagagggcaggagagaggaggaaaagggtggaaaaggtaagtgaatgggtctgggaaggccagtagcagacccccacccatttgccctccagaacagaggtttgcatggttgagtggtcagtccagggtagaaagcttatgatctggttttgtggacaaagaaaataaaactgcatctacagtgattaaattgaaattgaaattgaaattgggaattttctacaataccacatggctggtatcagtaaaatttgtggtgggccttagagtaacattaaaaaaattttttttttagttccctttggaagggattatgctttatgcttcttgggaaatgcgtagaatgggaaatgttatgtatttatctgattaaccaaaaatgtaggcttatagataggacagacagaagggattcataaagtctctcagcatggagttggattcctaagatagatataattcctttgattttaatattttataaaaatattttatttaaaatgtcaggtacctgggggaagagactaggaggaaattaaggttattaacagtaattttccttcaaggaagtcaatttaacagaatcattagcatcactgagtataaatgaacaagctgtatttccccatttgttcagcatggcagcaagactctgaaatttcaggctcatttattctctcattttcttggccctgttgcttgaaaggtgaagtctgctctttggtttgtgtacttgtcctgaatgaacaagcaatggaacttaattagaatcataaaataatactgctataaggtatatcagagttcatttcttcttacctccaaattgtgtgcagtaagaaaccaagatactagtcattagcagctactactttgcaagttctcagagttggtcactctggaaaaatcatatcacctctccatcatgaaggaattgcactagattaattcatttttgcttttacccttatatattcctgaagtccttgattccaagggtttggttgtccattactcactattttcatagattagaggcagagcttcttgagtacctcttcattacttagcccttaaaatggtattctctggaggtctctacattgcttttgactgtgt

SEQ ID NO: 99894 - DNA, 2817 bp, Homo sapiens
ttctaaatcttcatgaaacaagctatccatctgttgagtctaccccatcaatatccttcatttttgttcacttttctccattcctattgccgctagcctgaatttatgtctgcagaatttcctgtcttgattgttccaagaatttttcattcagtctctctatactgtctctttcttatctgtgcctccattcatgtcttctattggctattcagtgagcatcaggtactttaacagtgagatcttgctctcaggagtttacagtttactggaggagacaaatagacactactttataagtttacatctttgcccgttgactccattctccaaaccagctaaagtaatttgcacaaaacaaatcttattatagcattacctctaagatacttcaacagctccctgttgctatcaggattaatttgttttcctaatttgccaaatgtaagccatccctggcctgacccctgtgatgaagttttaactcctttatttgcatcacctatactaggctgtgttgaaatccaagaacataaagcctgctgcactgtggacactgtggctttgcactatgactttgcactcaatccccttcttcaactggctgactcctacaggcctttagagacttcatacagttgtcatcttcctgtaaagccttccttgatttccactccagtccagattgggtgccctactttagtcctcctgttgaacagtttgcaaattttagccacagcatgactctcttgggaaatggaacaatctggtgcatattagtgactaagttgatgtctcttaaatgaataaataaccaaatgccattattgcaaagcctgcagattgggtaaattaggaaaacaatctgatgattaagcaaaaaaaaaaaaaaagccaaagtttagtaaaccgaagccatctgcagacctattaaagaaaaaagtatttcatgattatttacactggtcattgaaaagtagcagaataatcaatttggaaatatgataagtaatttgaaaattctatatccattatttctggtaacagaaatcctgatattgtaatcagtatactagatccagaggagacatttccctgaagataagttatcatttttttcctgataggcacatactcatattgtttttcctattttatgagttcgattttaatcaagttattcttatttttcttaacagtgtgttataacctggaattagaaaaaaaatttcttatttcaaacttggttggaaatttaggaacaaaataatttatttaatcagattattttattaagtgggactcttagtaatttaaaatgctttgtattcattttcttgtagcattttcttttcaaaatgacctgcaagtacatcagtgccaaacagagaaagcaagaaagccattaattaattgaagggaaatattctgctgaatacaatactgtttttgaaagaacatgttttatagttccaaaaccagaagggagcattttattcgtagtggtttgaatcttgtgaaaagagtgtctttgacagtcttcaccaggcccccctccccaagcttggagcattaataggacttaagaggtgttttcttcacatttggcttctttttgatttcacagatttcttttagctttgtgtcgaaaagtgctaagtatgttaattattagatatatcattattcacatttcagtgcagacaacatttaggaggattatagtttagttattacagcttttcagaaaacacttcatgatagcacttggaaatacagatagagaatatttccttttatttagagactttttggacctgtgaggccctctgagaatcttaagcttggccccattctgtccatttttcatttcctttgaaagagtttcaaagtaactggttaaagtttctccccatctgccataagtagcatagagggatttcttgtgcagctaccaaagggaaatgaggaaatttaaaagtgcagatgatttgggtattaacacatatcctggcagtggctctgccagaatcaggctctcccaaaccattttgttttatgttaatttttattttctcagctacagtattataaacatggcagaccaacaggttttccataaagattgatgatcaggaggaatccactccttaattaagagcagcagatgccttctgaaaaccttctggaaatgttctacttaatattgaaccaaagtgcttccagctttgttggaaaggttaaggcaataattacatggaaggtatgtctcatttgtcaacagggtttttggtctagaatatctcaagagcagttcctgtccatttccttctagaggtgacagcagccttcttattgcagaagggttatggtgcagggaacataagtgcttaccaataactgcttcctatcctcacacaggatacgagacacagggtatgagaccctcagaaaggaagtctctttctctacacacacacacactcatacacacacacacacacaccgcaggtgcttgagccacactgtggaatgggatacataagaaatggagccaattctttgatatttttgtctttactggatggctttgcaatattttaaaaatgttgaaacttccaggattctttaacaccgggcccctaacccattatttattaggcttaggcattgtgccctgggccttcagaatacaatcccatttcattctctcagcaattctgcaggttaggtataattacgaccattcgatactaagaaaactgagtgattacagcacttactgagggtcacatggttcatcagtggtatagacaa

SEQ ID NO: 99895 - DNA, 1420 bp, Homo sapiens
tactatacataggttgtatacatagtataattggtttgttggatgggccacacttagtgagacataaacagaaaatagctttattctctcctctcctgtactttgaatgattttttttggcagatcctatagcttttcagtcattttacagtattggaacaacctaattttcaaatattagaaaaacatagtacaatgtaaatcaaaacttccattttcccatccagtttgtagcttctccccttttttcattcttaggcttgagcccaggcttagtgatcagcagtagggaagaaaaggaattcctggtttaactctcctctcttcctctcctacacattatctggctcctccagagttgacacgggggacataaaaggggccaaggctattgcacgtagcaggtgctgtttgttttcaaggccagttctttctcatacacaccctgatggattttttggagagcccttgcaggtccattggcatcatgccattatttgctttgagcactgcaatatcagctcctcatattccagtggaagatcactggagtgtctctgtgtccttgtccaggcagcccactcagatggaggcttttcaggatcattcaaacatgacaaccttccatagtattcacaaggtccacaggaaaactctcatcttaacaccatcagaccccgagggcacagcctgcttctacttctactggggctctgttgccttgcagatggcatcagccagccaatctgatgcacaagccatggtttctgcactgaagcaggcatccaggcagggaatagaatatcagcctctgtcattgcagatagcctcaatttattatggcttttcttttcttttcttttttttttttttttttgccttccttatgaggtgttagagagagaaggaaagggatctgttgaattttctttgaagagtttgctgcagtgcagttcttctcatacacagactcttggaggtgatctctggactggcttggccatgtgtagcaagtcctgtggacatatacaaggaactcatcatatcacctttggcattgaaacattagcagaaaattgaaacaatattcccttttctcatcattagaagaatttagagatcactggcttaatagtaagatgcacagataagtgttaaaccttcagctacatttataattcgtgaactgccacactctgtaagctcctaccttcacagtaatgagaaatactaagtaccaaataaatgcttaatgaatcaagtcatggtgattgcaggatattggtctctgggaaaggtaaaggtgaccaatataataagaggaatgaggttgctaatctgtaaaattctttactgatttggttaaacaatgggtcacttaagtggaaaaaaatagaattcaaaactactgttagccttg

SEQ ID NO: 99896 - DNA, 2621 bp, Homo sapiens
aaatctgcttaatataactcctaaagctttatttgtagactagatatttgtatactatttggagcctttgtcagctgttaggaattattttaagatgtggagaaagaaataaagttagctggtgaataaggaagtattttcacacttgatcctgtttttagttttaatcctggaattgcttatagcagttaatgtggacctcaatatttcattttgtaaatgagcagtgtcagtatgatggtggggttaaatgcaagggagatgcttttgtcctacttttcaaggtatactttaagcaaggtaagcattcgtaaaggagtcctaatttactagaaagcttgaagttttggagcagagattttcaaagaagttgtacgcagagttctttctgagctatggcctgatagtgtctttgtgaaagtatcttcttcccatttcttttgttatgaagcctgttttttaaaatcattggcctttggtgaagattgaacacattgaaaaataactgtataggagaaaaactgtgagtgttatagtgttatttaattgagaatactatttatgtgtgtgtgtgtgtgtgtgtgtctgtgtctgtcatgggaaagtattgaaatgatgcattactgaagaaaaaaggatttgtttatctttccaaagagaatcgagctattatttgggaaaaaactcaacatccttttaaatcatatttttttcaaatgtatgtgtatgggaaatcttaaaataatagataactaactaatagaaagggggagggaaaaaatggaagtgtgctttgtcacccgataactatcccaaaataagtttggcttctaacacatttttagtgtgtttttttttttttttcaaatgggtattagatagcttccgtggtagaagtgaggacttgcagaatactctgtgttactaaaaaattgctggaaaagttaacctgaaatggcagagtaaagaagctcatgtttaagctaatatactccagtaacttttgcatctctgcacgttcatcacagactgtgagcatattgtgtataaataattaccaaatgtttcgggggtggtgattctatttcttctccatgagaatttataaagttgttaaatttggtttctttggagtcatcacagtttatttcactgagatgtttactggataaatattttcacagaagttttcatcaacttcaaagaggtagtagttattcaatgcaaagtattagaagcctattgcaatatacatgcaatttgttttctttcgacagtagacttgtttctctttttggttcaaatgaattcattattttaaactgcttcaatcaattcgatatgttgtattcatagacacagtgggttttatttgtaagcctccccagagaccagggtccccagggtcttggtgccacatgttctgtaaatgtgacaggagagctggggtgtttgtaccatacatgggagagggctgatttctgagagaaactaatgctgttgactcataagtttctttttatcatttctaggtcatacaagtacatggtagctttaaaaaaaaaacatgccataggtatgtagagcctttataagtctcgacaactgtaaaatgagctagagaaagtcactatctgggtcatgtggaaccacatctggtttatgatatgggcatgtagtaattgtgcttgagattacagtggagcctcacctggcttatgtttttggccatagactgaaggttcctttgaatgttccctcagctaatgtaggtatgcagtttataaataatattttcataaagacaaaagtgagaagcagcattgtacagcagaaatgtgagagctgactttcctaggttctgaccttcctaggtttgagtatccagtctgtcttttgctagaaaagtgacctcaggtgagctccaaagctccctctgaacttgtcctcatgggaaaggggagagactagtgcctaactggggagcggtgaagactgcatgaaatactagatgcaaagtgcctaacacctcacctggtttatacaacaatagctacctgttagttgtagttctgttcttttctttctacagacatttgaccattaaatacacaattatttcaacccattattatatttctagaagtgatgcttacagatttttttttctttttgagaactgcatgcttttcataaagtctcttggaaaagtaatctctatgtagttttgcttcttcattcattcagcatttgtcaatacttgttactggcttgcttcctgaggtctaggagtttatgttgtatcaagagagatctacagataatagaagttactgtagaattttaagttccacagaaggtgcatttctgaggccctataaagcagcatttgaatcaggtcagctcttcagccctcgagaggtattttcatgttcttgttttctgttttttagtgatgttccatttctggtgtttaatctaggcatgccactaaatatttacttttctttgtgagacaggttaagactgtcttaacttagaagattcttcatttctttggtcactggaatagcattgctgtcttttttgtcatcattccgttttgcattgttatcattctc

SEQ ID NO: 99897 - DNA, 1076 bp, Homo sapiens
gttgacttaatatacctactttttcctcttaataatgccagagcatatttgggggggggctatagcttgaacaaaaataagacattattaatatcagcactttgtaacctgagacagatgatttaatctctcctgccatgttctctggggtttaaaggtgctattcagcaagattattatgaacaccaaaaaaagtctgcataaaatagctgcttggctgtcacttccatataagctatgaaggcaatgatgacaattaagtctaggacttgtaggaaccacatatactcactcctactgcctttgttcttcttcatgtctgctctgccattgtacttttttttttttttttgagacggagtcttgctttgtctcccaggctggagtgcagtggcgggatctcggctcactgcaagctccacctcccgggttcatgccattccattgtactttttaacacattggcatatactctgtgctgactactccagtatggagtgcttctcaaactttttggtctaagacccttctatactcttaagaattgttcagagttctaaacagctttttaacatgcagcttatatcataactatttgctatattaaaaagtaaaatgggaacatttacaaatacttattttaaataacagtgataaacccattacatgttaacgtaagtaagaattttttaaatgaagaattactgtatttttccaaacaatatatgtttggtgagaagaatggcaccatttaatatttttgcaaatctcttaaagtcttgcttaataaaagatacgtgaattcccttatttgcttctgcagtttattgagatattgaacatgatgaaggctctggaaaactctttcagagagtgagaataataaaaggaaaataatttcttagtatcattatgaaaataattttgacctttcagaaccctgaacttgtcttgagcacaaaatttgagagtgattggtctacgttaaatccccgaaggttgtctttagagtatttccagttttgccacatttactactttgtactagaaaatccctttcccatccaaaatattag

SEQ ID NO: 99898 - DNA, 1178 bp, Homo sapiens
gccctcctcacactggaacctcaccacacccctcaccgggatgatctacccgtcttgaccatctcctggctctttagatctctctggaaggtctcaaagcttttccctttgttggattttatccacacaccattggaggccctacctgtcaatttccagaaggcagtgcgccattgacccacttttgtggccaccacagtacccagagagcacttggaattcacctaacacctggatgaatgtttcttgaatttcttagtccctgatatggaatattccttgctctctattttttttaactagtttttttgtttagtaaccatcacccacaatgaccagaattttctctccttgcttctggcttctccacagggctctgaacgccgcttacgtgtcgtcccacctgttctctatttttgccctaatttctcaccattttctgtttcttctgagttgtccattctccaccctttaatttcaattagtcagtcgtaaatatttgtccctatggcaggaccagcttttgtctggtctaaatgtaggaagtggcttgtttataatttcctagcacaagtaggccagttactgaacacaccgatataaaatgtactactagaatattcagaaatcctttagggagaattgctggttttcctgtgaaagggaaagacaagtcttcagtggaaacagcactttaatatcaagttttgaatgaactgtattcatttcattcaaaactcagctctgacaaatatgggtaaaggacatcagtttcagaaatgcaatgcaatgcttgcaattatggaaattatttcatgttttccaattgcttatattaggttgattatatttaatgtttattcctgacaccaaatttatgtattttagttataaaatttgtgaattatagctgcaaaatattatagttttcaagtcgaattattaccagcggcattcctgtcaactttgctttcctcaggactttcaaatagaaatgttattaaatatttcctttttgtcagtgtttgcacttgaaggtaaatttaaacatgagtgtgttgtttggtttctctcattgtggatggactagctagtttaatatttaatggcaagttttgatgtatactgataagaagagagacaaagaaacattattgtatttaaatattatctttctg

SEQ ID NO: 99899 - DNA, 1028 bp, Homo sapiens
ataaaattgggattatattggacatacaatcctgtttttttttctgttaacattatattgtgattacgtcctacgtgattttgttttaaacatggtttttaatggttgcatacctttaaaacaggaagaattataagttatcccaggaatcttctgttactggatacttaggtgttttgtttcattgctttaaaatcatttctactcctcttcacaatgtggatacttgggaattgtcacatcatagtcaatttcacaagacaatatagattaactagccatgcactcttaatgtacatatgcagtatttcagacattagaagtagggagatcagttttgcttgatgcaggcagttaaaaatcacgcgcatgtaaagaaaggaccaattttacttgcctcagtgttggcccaagtttggagactaaagcatttacagaccattagctctatacttcactcttgagaccacttgttgtaatgagctgtcaattattgtgcatctaagtgtagttaaagggaccattgggcttgcagtttaaaagccaacatttataaatgtgtaggaattgaattataaatgcagtggttcagtaaggatgtactgcatcatggacctgtctggatacagtatctgttctctgaaagattttagtgttcattaaaaacataagaaacagtaaaaatgtactcttgagcatatagctatacaatttttatgtttttacaatatagtttgggaaaaatatttttttaaatcaagagattttaaaaagtaaaaaacatttctttactaaggtatttattaaatatgcaatgaattaatttcagctgacatgttggagtgaggagaaggatggaaattggagatttccatttgattcagtgaagctacagtctattaaaaaaagtatattcttcactacctgtttatcattagtttttgaatagtatttgcctttgaaaatctgtgtactttgaaaatattttactgcagcttgtaaatatggcctgagtaacatttcacatt

SEQ ID NO: 99900 - DNA, 1024 bp, Homo sapiens
aattgggaggctgagatgggatgggaggatcccttgagcctgggagttcagagctgcagtgaggtatgatggtgccagtacgttccagcctgcgtgacagaataggacctgtctctaaaaaagtaaaatcttatattttgtaagaggtaaatatcacagtgagattggtgaataaaggcaaataaagaaaatacctcttttatagaatagtgatttaacactttacagactgtgaatgagagactgtatttaagaaacaagcaacaagcaatgataagagaaaaaaggcagagaattagctgatgtgaggtttcaagtactggagagtccaagggggtcttagtgttgtgaccaattcacaaactcccttggccattccccagggagaaatattcctgatcccttttaacattatgcttttatttgcatgtatcatctttttatatgaactttgttttgcagtgttagttgataagtctcatctttgtaattgacaattgtttttatctcctgtattgtattttaaaaagtttattatgaagtgtttatattacttataaggaaataaaatagttacattgaagattgcccaggaaatacatttcattttaaaccttttcaaatagatgcattgtaatgttaagcctggccccattaatttatttcaagggatgttctctgaatgcctgaaatacgcttgactccatcaattcaccaggcgtgtctcttgatggcaattctgctttcagaccaatgagaacaccgtgatccagtttagctgccttctgaagcaattgctagttttaatataataaaaataaaacaataggatgtgtattgttctacctgtgaaactgtcatttttccactaaaattacaaaatgcaacatacaattcataaaactaaaaacttatttttaatgaaataagaagcagtttattaaggtatattatactctctgattttatgcttggtatggaacttaatgaatgtgtgtggtaagaagtaaaaatggattagttg

SEQ ID NO: 99901 - DNA, 1419 bp, Homo sapiens
agattgctttttctaaacggcaaatttctgacttatttctgcctatacaatagctcctcactgcctctagggcaatggttctcaactaagggcagttttgcttctaggggcatctgacattggagacattattgactatacttgggcactactgtactatattgtagtgactaaaatagagatgctactattttctagtgagtagaagccagggatgctgctaaccatcccacaatgcccaggaccaccccccgacaacaaggaattaaccagcccaaaatgtcagtagtgcctctgttgagaaacactgctgtagggtaaggccctaactcctagctgatgcttccctttctaatttcatacctctgacctttggctcatacttgtcatgtatgcttcttatgcagcagcaaactacttcctattttgatatcttcttacctttaggtctttgcttatgttgttctcatagtctgtgggttttatcattgtgctttgtgcatacttctgtttttctgatcacactgagttgcaattacttttttttgttgttgttgagatggtctctcgctctgtcacccaggctggagtatagtggcatgatcttggctcactgcagcccccgcctcctggattcaagcaattcttttgcctcagcctcccgagtagttgggactacaggtgcacaccaccatgcccaacaaatttttgcatttttactagagtggggtttcaccttgttggccaggttggtcttgaactgctgacctctggtgatccatctaccttggcctcccaaagtgctgggattacaggtgtgagccaccacacccagtctgcaattactttttaaaatctgttgtccctacaagcttgtgagttcagggtgagctagcaccaggctacatggctaggaagtatttgatggaaagaatgaatgtttgcgtgagaccactaccggaaaaggggctgaagctgcataagtggatagctgacccaccctcagcgagctttcctcacattgggtgaatcattcccatggaggcactgtggacagcagctctccctgtgcacatgattttaatgccacttcacagtggttcttcctctgtctttttgtgttttaaacctttaggagacatcagtgtcaactccaggtgggcttcacaatactccaggtagctttgagagacaacgtaagacatgcaaagagtgtgaagacaaagctttgtgcctcaaatgtcctactgtaaagaccagggcaggggagaatttttgagaaatgaaggactggttcaaggcactgtcttttgccccaaggcggcattaacattaatttagcataatatagaccagttattctcaatcttgcctgcacatcagtatcatctgggttcctcaaaaaataccattgttggt

SEQ ID NO: 99902 - DNA, 1033 bp, Homo sapiens
cttttcttgaggttgggcaggggagaggatagggagagaatgttcagcaaaaatcagtcatatatttagtgtggcttcccattcgttcatttcatcttccatctatccatttatctttccattcacgcacccaaccatgcaatattcattgatcatctgtgagccacctaaattggaatagcaaggatctctcctatcaaagagtctagaataaatgccaggcatttacagtgggaaaatgttaatatcaggtaaattctgtcttggggagaggtcttgtgacctgtttttgggggttttagggaaagcttccaggaagcagtactgtctcaactgatacataaagggcaaattgaagttagctggaagaactgcatgtttgggctagagtgtggttaagcaatgaggaagaatttccagcagaagaaactccatgttctagaggtcatattttatgtgagggttgtatttctaaagttcttgcaaatttggaactcccatgattcaaaataattctgtcaaaagatggtggatattttcatttaccagctaacatggccctgtggccactctgtaaacagagtttagagtttcctctgccccagccagcatcaaaactacaattcttgaagaattgtttcggtgggggtgcctacatagatccaaattaatgtgagacaatattagtgcttttgtatcaccttatttcaaagctgcatgattcaggttcacctcaaatatgaccaaactctggagtttcagagcagtagctcatggcccatttgatggtattaaaagtagatcaggatggatagcatgtacacacaagactaggggtgagggagaaaggagataaaatggataaggaatcagggaccaggtcagtgaaggcttgtaaactgtgttaaaaggtaaaatagtcacattaacattttaaagaatttattcgtgtagatagtaattcatgaattgggcagcatcaggtagtaagtggttcagggctccgctgaaagggcacaaggggaacattttt

SEQ ID NO: 99903 - DNA, 1046 bp, Homo sapiens
actggtggaaaactggagggccagaagagagagaggtcagggtgcctttctctgcctctctgctttctttggtatctctaggaacacatgtgtctcttccatgtgtctcttccaatcagctctcaccagactccccttttctccacagcagcctgatctccacggctgttgccctggtctctgtcagttggctctagcctctaggctctgataacgtcacatccttccattatcccacctgttagggaagatagcagctctcctcagttgctagtctctgggctgcttcactgtccctctgtggtctgtcagtcattctcacatctgtaacaagtcacctgatttgaaagacctagagtagtttctgtgttctggttgactttgactaataacgatttattgaatttgccttctcttgcaacccttacttccctcctgatttgcttcttgcaacgtactgtgcaggtgacatccacgttatgcagtttatttcattggacataacaatggaaactcttttaagcaatagagcacagtggttttgagcctgcgctctggtgttagaatgtttgcatcgtagtcctggctatgctactcattggctatgtgactctgggcaagtttcttaacctgagactgactttttaatctaaaaaaatgaaagtaatttcagtacctaagttgtctcaatatgagtttcctgggaaacaaactcccaactggaggttggtgtgcagaggtttgtttattctcaaatactcttcagattaacatctgtggaggggaaaggacggattcaggactgggcagagggagaagttgaactgcagtgcaatcttaacaagagccttagttaaccctctgaagcaggttgggcgcttattcactgatgttgaccattggaggcagttgaccgtgaatggaacagcttcctccagctgagggaattttccagagaggactgacagttgagggcattctgcctgcatcactcatagtagcaaggaatcaattcttcagtcctgaagcagtgtctgggcgtcaca

SEQ ID NO: 99904 - DNA, 1112 bp, Homo sapiens
tatcaacacttaaaaaattatgatggtcactaagaagaccttttttctgtacactttcagtgcttcttcagtcatctgccatgggtacttctgttcttcatctccagattgtttctggaagtcctgtgggcagctctttaacactggaaacatgcagtctcctcatccataaaatgggcaatacctctctcaatgtattcgagaagtcacgtacaggtcacatatgaccattactcataatatgtaacactgacatggcactaactatgtgctaggtacagttctcaacaggcttatgaggtaagtgttattacagtcccattctgagatgatggaattgaggcacagaaaggttaagtaacatgccagtgttgcacagacctgaggtttgcacccaggtagcctagcactgcagacctgtttcatattcatgctgaaggactaactgcctctgtaggtgtgagtactgtacatggaaaagttagagaagtaaaggtctaattttgacagaattgagaggggagggggcattgacttaggttttagaaattaacttagactcttagtacataggttgctgtggcaatttacatagctatttctttcaggtacatttgacattcaaaagcaatcagatcgtattatctgttctttgagggattactgggctctgtgaatcttgaaggttacatttgcaatcagcattaattttattgttaaccattttccttcatgttggttacagggttgcctccctccctccctccctccctccctccctcccttccttccttccttccttccttccttctttccctctttgggctttagtggagcttataactagttgaactagatggatcaactcaagttgattattcaggaggccttattatcccccagagagcagacacggagcttggctggacctcacggatcactagtccatgtcactgcacaatgttcttcctctgttcttcgctattttagtccaaaatgcctgctaaatggagtggagtgaagaaggcacacaatgttaatatgaagtaacttccccagtgcattttctgattcatcaagatgctcacattaagctacatgaacaaatggag

SEQ ID NO: 99905 - DNA, 1048 bp, Homo sapiens
gctaggttttggaaaccagagctcgttagaagtgtgtcctggcttggggaaaagatgaaagaagtccaggatagttaggtcctcaaggaagtggaccatgtctgtttattcatccgtatatacctggcacctgacacagcgccgggagcatggtgggcactcagtagatacgtgttgagtaaatgaacgcacagagttaaattgggcagctgatgtttttggtattttataatttttgcttggtgacaggaaaccacaacaaaatatgtgcctgtgtgtgtgcatgcatgttttatagcttcctgaagaaatagaatcaatttcagtttttgcaactaaaaaagaatgcagaaagtgagcttggagtgaggagctgctttcttataatgacaaagaatagttacaagctgttttctagaccgaggtaatggtggaggtaacttctgctcctttgttctgtgtatctttgtgagaagggagagcctgcaagggcatagaaaagggagaagccttgtggaaaacagagaggtttcttctggacttcgggtttggaggattagcagaacatactagaaaataaggttctttctcttgggaaattactcatgctggcagcctgaaatagcatgaaaaggacttttattagtggcaggtcttcagatagtttgctagagaggagaagtgcttccaagttgagtgaaagcagaaagcgagccagagttgcattagcaagtgattcaaacaatgaaatctcaagcagcaaggcagctgacatctcagcacttactctgtgctgacagataaatataaattatttttgagacagtggttatttgagatatgtaaaagtttttagatagatatcattatcccaattttacaaatcaggaaacaagtttataaggtttgtaattagtccaatgccccataaacagctggtacataatggggctagggtttgaacgcagcttatttgatttgaaaacctaggttctttccacatgttaagtaatcccttgcctttttgagaactgcattttatagttag

SEQ ID NO: 99906 - DNA, 1093 bp, Homo sapiens
acagatgaagaaactggggctcagggaaattaagtgacttgcccaacatcaaaccatctcatgtcttctgaatcattttttaagtaaaatatttttctcatcatatgacagtctcttaaatacaatattttagttatgattctgttgactgattagaatctatataaactgaagacattttaaaattatattaaatattttcttattagaagcattagaagagtataactcagtttagaaagatttcaatctttcaggggcatgattgggaaaaataacttgtgtgaagtagtttgttctttagtagtcaagtggatgaatatatgcagtgttgacttaattatctttgtggagtagctgtgaaccaccagtctattctgtggttctatcctgaaaactgtcttttcaatataaataagagcaatagactgtcaggagatttctggggaggtggagggaactgcaggatgctaggacttgagactgatggaaacgtttgaggtagagtcaggttttacacgtggtttgctggaggtgccatgactcagtttcttcctcttgagtctgcctgtgtaaaagtggttgaaatgtgcacatatgcatgcaaacactattgcatttgggtggtgttttttatggttacttctagcctgcatcagcattttggcttgggtgcccactctgtatgatatattggctgaatgttcatctctgaggtctgacagtcggcttttgagagcaaatggatggccacagtacaggcacgtgcccgctatagcaactgccaaggttcaaaacaaaaagtccagcttctcgagggcacaaaacatgctgtttcttatatgttctagtgtaatgcaaagcatatactaaatatccactaaatacctgtagggtgtgcttccattcgctatactttcatttgggaaagctttataatagtgtgaaatctagtactgatcacactgtaatttttagagatagtagtacaagttgggacagatggggagcctaataatttaatgattttaccaagtgcgttgaaaacttgtcacaatatcagcttggtggattaaaaattggcaaatgaaat

SEQ ID NO: 99907 - DNA, 1022 bp, Homo sapiens
gtgactgcctctgaagttctccacctgcctcaggcgtgctctccagtgcctgtttctgactgagtgaggttgaaatcctactgactccttttcaggtaaaaaagcatactgaaaaatggctttaggaatagcagttaagatttatatagagggggcagttttgttaagtttatggtttctgttgtttgtagagggctatcacggttttattttcatggtccctgaaggtaagcagatatagctgtatttagtgatagaaaatactatattgcttagagaacccaaacttcccatgaaaattgttatatttattattacttttttctttagactttcttataagagagaaattgaagacaaaattgtgccaacaaagtatattagacactgtgattttgtggtaattttggcatcaattagatatttattttaatatctctttttataaaattttcctaaacctaactgtaactcgaatagagttttccataagacatgtataggtatgatttgcttggctggtaggatttcttggtgtgttttatttatcacactccatattttaaaaattaactgtgtgtggggacaggggatatatgggaaatctatgtaccttctgctcagttttgctatgaacataaaactgctctaagaaatgaggtctattaaaaaaaaacagtcccttgataatactttctgtgaatacttaaatataatgtgataaagcacagatgatgttaaactttttttataaggcataaattttaaaaagctaattcatttttctttttcataattagtaatgaaaatatgggacatatttcagtattttgttttgattgccactttttttgttcaaccatattcagatgggtaaaatgattattttcaagtctcttttcctaaataagaagtgagaataaaaatatactttgaacatgaacgcgtacttattcattgtcttggaaagttaatgagccattatgtaaaattcctttctgaaatcagagagtaaaaattaa

SEQ ID NO: 99908 - DNA, 1832 bp, Homo sapiens
caggtgcaaattttgcaagaaaaagctcctcagatttcccaagaatcatctcattagaaaggagtttggaatgtgattctgtctggatgctatttctgtgataccttgaaaactttgttcctacaaaattatttaagcatttgagcacaaaaataaacaaatgtccttgaatttattatcccatatgggcttgccaactgctacagtgagacttgtggagatgataagtcccctgtgagtgaggcacttaagctgcaggacccatatgttgtgcctgattgtaatgcagagaaagttctttggaaactatgaccttaaccaagctttgaatagctgaccaagataaagccatcagagatgtcctaagggttgccattcatagagggtcatcaaaagtctttggcctcatgcactttgtgccaccctcctcactaacattctattcatgatattagtctttttgagacctcccaaatggtgctgatctaattcatttctgcaaacagacttcagatgttatgaggtgtctgtcagatgaggctcagggtaccaagcattgtttttgcttgccatattgatcactgttaaaggtgtatctgaaagtaagtcttgatagtccctagcaatcaaaagtgtttcctcaagtcctaattttttaggtgtttttccctataccttctgagtctcttacttcaggctgctatcacaaaatgccatagactaggtgccttataaacaaaagccatttcttaccgttgtggaggctggaagtccaaagtcaaggtgcctgcagattccgtgtctggagagggccctctttctggtttgtagatggtcttgtcattgtccttacatggcactcaggtcggggggatggtggaggcagagtgtttgtctctgttcttttataatgctgtaaatcccatcatacaggccccatcctcatgacctaatccaactctaattacctcccaaagaccccacttccaaataccattacactggggattggggcttcattatggaaattttgggagtggaggacacaaatgttcagtccctagcaatctcactaggacaacaaagtgagacaaataattgttctgtagagcttcttagaataacaccaatacagtctcccaaaagagagaaagaagatcaataataggggttctaggaaattgctttcagaccttgggctaattttatgaaatgattttgagaaaaggaagggcaaagtgagtaatagattttagcaacagtcatgagagtgggagttgagagggcggtgtctgttttgttgttctttgtccatagcgtctcacctataacctggcccgtggaaaatgttcaaaaaataagttttgtataaatgaattgatcattagctggagtggttttatagcaataagaattaccttgttgaagaattggttcttctttgcctttaaatgtcttcaggtttgggctccattcttgtagctagctgctgactattggtttaccccatgtaaagtgagtaaagggttgagggttttttcttatccttaggctatcaatcacctgcttctggggctctcacagttaaaagaactctttaaagttggctgtgctggaagctacccattataccaggctgaagtgtctacgggaggcatgttcttcgttttttgtctaaaattgagggttttggggaatttgctcaatcatcgctaggcctaactcaagtctcagtaacccgggaacctgtgagctattacagaagatgcatctgtagtatttactgagtgcatggatgggtggtttacagacttctcctcaacaaatagcag

SEQ ID NO: 99909 - DNA, 1035 bp, Homo sapiens
tgagataagagtcaaaagaaagttttttaaaaaatagtatttgtcaaaacccattctgattgttttttcttataatgacagattagtctctgccaactcattccagaagcttccatttgatcctcagaggtttttaattggcacgaggctcttttcaggaaagggccactttaacatctatggaaaaataatcatgtacttttaattccacttatctgaaaccaactagtaaacccaaagaaaacactgggtgttttaattttttgaagtggcttgaattgtcccgaggtcatggcatccagtgaattcacttctttgtctttcctgtctggccgtttttgtgccttctgggtgtgaacaactcaagcggtttgccatgtgccaaacgagctgctgcctcttctcctttccagtggtgtggtccaggtccactttgcagactgagttcttttctctctgcaggtgccttctacttctagctagttatcttgtgcttctcttcccagcctgtttatctaaatgagtttcttttcctccagcccagctgcctcctgaaggtacaggaaacccccaatgaaaccatcagttctgcctctgatggtttgcctgtcctttgcctcagacgctgagacctcggtgccctggccacagtgacccttttatttgctttcctgctacttccctacctgttgttttattttttacttattattattattttttgagatggagtcttgctctgtcacccaggctggagtgcagtggcgtgatctcagcttactgcaaacttcaccttctgggttcaggcgattctcctgcctcagcctccctgagggattacaggtgcctaccagcagcctggataatttttgtatttttttttttagtagagacagcgttttaccatgtctgccaggctggtctcaaactcctgacctcaagtgatctgtccgcctcggcctcccaaagtcctgggattacaggcatgagcaccatgcccggcctacttgtcactttaaaacacagccatgcctc

SEQ ID NO: 99910 - DNA, 1016 bp, Homo sapiens
ggatgtttctagaagagattagcatttgaattggtagacagagtagaaaacagtgtcttcaccagtgcaggtgggtatcatcagcagttcattgagggggtgaatagaagacaagtgcagaaatggtgaattcttctctttctgcttgagcttagacatccatcatctcctgctctgcccttggacatcggtgctcctggttcttgggctttttgactcaggctgggatcccatcaatcctcctgacctcctatctcaggcctttggactcttattgaattacaccaccaactttcccggctctccaacagattgtgggacttcttggcctccctaactgcatgagccaattcttagaataaatctcagtttatatatatctctctatatcctactggttctgtttctctagagaaccctgactaatacagtctcagacaactggcttcaggattcatcttgcctaactgtgggggcaaaaccatgcctggggaggggtggactgctttgaaaaacaaagaggttttggagataaagttagcctgaaaatttttctgattcagacaaccttgcatcagaaaaattttgatgagccttgcttaggagtgcaaaaagcagacgttacagttttaagcagaaagggctcttgatgttaagtaaaggactggtagagattacagaagaatttcaggtactgtagtaattacagaggcagaactcttttctccttagcaacagtctatgtgtggggagcagaagcttgttatagcagaggtcactacagagaaatctgtgtgtgcaggcagagtcaaaagcaattgaaacaagtttgcactaatgactttggggaccagagtgccctgacaatggaataggagggccatattatcaggggtgacctctaatttgcaattaaaatgacttctgggcatgtaaatggacaactgggtgggaggattgtgtaatgtgggtggcactcagtgaatttctttatcttagactttgatgaaggaaag

SEQ ID NO: 99911 - DNA, 1018 bp, Homo sapiens
agcaaaactccatctcaaaaataaaaaaataaaaaataaaaaaaaaaacaaaatcttatgctgattcaggagaacttctgagctgagaaccattgtcatttctcaacaaaaggactctgcatgagcaagttaactgaattcctgtggtaaacatgttaggtccctctaggtgtagtctcagagatataactaaggtttttatatcatttatacttagctttttcttaactttgttttaagtcagtatttgccaactattatctagaaagcaatgttttttctcaaaggtgtctgtcactagaacacattccccccctctcaaaacaaatacagtagaagaacactgaaacaaaagaaaaatcacatagtgtacttttggtcaacatttatcttgctgtaaaaatagaagaaagagaagaaggtaggttggcatctattaaatggtattacaattactggttctgtttctttgtggaatatggggaatcaacaaagtaaatttattctttctgatcctaagttgtcagggagttattgaaagggaattgcagtcctatttctgcagcagaactaatgtgaaaggagaatggtaaattaaataaggtcaaaatgatttagctagctgcttcagtctcctgaatgatcacatgtaagatgcaaataaatgtagggctttgtgctattaaatagagttatggtttttatcttggaatggatactgtgatgtggctgagtagtcatattaataggatatttttggtcactcacttgtccttagattatctcagttccagagatgggaatgattaagattgtaccctactcatgaggaatagaggagacagtgtgtcaaattggaatagaagaatgagcaatgaattctttcaccagcatatcactgtgttcccaaattttgatttaccattgtattctcttttttaaaggccacctatgaaaatagtagagggctattttgactctcatttaatctttgctgtatcttcaaagttgagaggga

SEQ ID NO: 99912 - DNA, 1019 bp, Homo sapiens
ttttaaaagaaattccaaaatagtctctagtcttttttgtgtgtcatttcttttggaactataggattcaaagctctggattgtaacactaaatcaccttgacaagtccctagaatcataactagggaagtacattgggtttgccttgggaaagaaggatataaaaatggaggtgtgtttttcttcctaccctccccatcccaacagtggtggaaagtttcatttattcattcaataagcatttattaaacagtgtagaaaccccatgttagataactttgagaataaacctaaaggacggtacgttgagtatttgattccaagttggctttttcaatgttcccatcactgatggaatcctgagaaccctgttagcctagcactgactgtttctttcactcttggatctcagatggtggggacactgaaatctaggggaaggttgtccggtaccacttacaattccagtttctctggttcttcgaaattgtcctgaatttctttaaaatcattattcttagtcttgaaacactaggttatattcataacaaatggttttgatcttaacagcatccttaattttctgagagaaatgaacaaaaattggtattctaaatgccaggtctcccagatttttattatttcagacaattgttgcagcatgcgaaatttttaaaattacaatttacttattttgagtcttatctcttcctgcatgttgttcatgctctccactgcattaatcttcatctatttacatttcagtcaacctgtttatctgttgttaatccatcttctggctgattcctgtcaatctcagcctacaatagctcactgggaatatattacataaaagtcatcaagggcaggagagagagaatggtattctgattttgatctttactcagaattctcaatgactttccctctgtgatagcagcagatgttcccaaagttagttattgaaaatgacagtctcagtttcccgtttttcactcttgactctcaaaaatggatac

SEQ ID NO: 99913 - DNA, 1512 bp, Homo sapiens
gtggagagtctttggttgtaggtttctagaactttcagtctgtaagatgaatcccttcattctggctgatgctgcttctgaaatgcctctcaaaactgattcacagacatcttccttgatgcggcagagcattaagcaggatctcccagcactttctaggttcaattttattaatttcactactaaccttgggcactttaccctttgctagattttctacttgctctctgcaatagtgttgcccgcatttagtaagcatcacatgtttttgaagtgatcattgtctacaattctttctggggagaaatgtttctgtgacttgttttcagtcctgtgcagattttgcttaagaagattcccactgatgtgaaaaatcacaactgtgtacattatcagcaaaaatcctccattttgggggaactaccaggggatgatgtaaataaattcttccagtgctcccctaatggttcattttacaaacttttaaagaaacgcaaaaaggggaactggaaatatctttatatggctgatttgttttatttataaactgtaacttgccaatacttgtattccagagccagaatcctagtgaatatgagacatgttcttttataatcccttgatcaaattgctgtttgtttatttatttatttttgagacggaattctcgctctgtcacccaggctggagtgcagtggcgcaatctcggctcactgcaacctctgcctcctgggttcaagcgattctcctgcctccacttcctgagtagcattacaggtgcatgccaccacgcctggctaatttttgcatttttagcagagacggagtttcaccatgttagtcaggctggtctcaaactcctgacttcgtgatctgcccacctcggcctcccaaagtgctggaattacaggtatgaaccaccgaacctggctcaaattgctatttttaaattgctgttacaagtaaagcatttggactatgtatcatttcttaccttcaggaacaagaggtcattttatagtaatggcgtgaaccagcaactttattgtttctcctaataggtcctcctggaggatctgttcctctgggctgttggcatttaatggctgagtgttttcctccagcgttttgcatatcatgtgagatacttcattatcttctggcagtgcccgtggctgattttcttccggcctttccatgaggggaaggaagaatcgcacaacctgacacttctctaagtgatcagtgtttaatgatgacaagagatatccagaaagtagatttattattgaatgttcctatctatttttagtcaagtgcgctatcttttactactccccaaggatgactcataaaccatgtcttagtaggcaaagaggagttggggagtaggagggactgaataattctctcgggactttaaatcagtgtggacacatcatctgcttttcactccttcatcacattaatctggactatccactttctctgtttaagagttgtattatcctt

SEQ ID NO: 99914 - DNA, 1128 bp, Homo sapiens
catggtcacgtctatcacattacagtagtcctctcttatctgtaggggttacgtcccaagacccgcagtagatgcttgaaactgtgttaagtactgaattttatatatgttacatttcttctatctgataatcaagataactactagtggccaatgagtgggtagctagagtgtacagcatggataagctagacaaaaggatgcttctggatgtgagagattgcattgtgttcctcagaatgggatacaatttaaagcttatgaattatctcgggaattttccatttcgtacttttggactgtggttgaccttgggtacctgaaatcatggaaagcaaaatggcgtctgcccagtttcaaagggaagagacttatgagttcaactctcagagacaggagtgttgaagtcacaatgtgcgaagataatattgcaactatttttgggcaatatcatctgcctcagggaccctctccattgccactcctgtacccatcttgctctcttgagctgtgctctgggagcgctgtggtatgagcacagctttcattcccgggcacccttctatacagtggctctctcttctctccttacccagtaagctggactggacagtccttaacaaaatgtgaagtcttctgcttaggcactaaatggccaaccctggccctctgtttatttttcattatcttccttctttattgttagaggccttcccaagcagtgggcaaacaccaaccccagctgttctcctctcattttttaatttgtggagcaattgagagagaggagagagaaagagcaaaaacaaaaaggaggaagaattttctaaccccttactggtcttactgaaaagacttgtcttaccttttccacctaaggatgtcatctccagaagacagaattcttcggtttggccaactgccaggtttttctcaccatctttccatttctaggttgattctcctttgctctgtctcttgctgtccctggccaactgggtttctcttcccaaggtgattagaaggaaaggggaaaagcatggggccaacaccatgacctttgagagagaactttcctaacagttgctaagctcaacattctaccaaatactgttcgccctggttttc

SEQ ID NO: 99915 - DNA, 1908 bp, Homo sapiens
tttgtaattttttttctgtcatttgttcattcatttagcaaatatttattgagtgtctaccatgcaccaagcactgttctaagcacttggaagagagcaatgtacaaagacacatccctgatctcataaaggaacattttctaatagagggaaatagataataaaaagaagtaaacacgtgaaagaacaggataatttcatgtagtgataaacattaagaaaataaaaggaagtggtatggtagaggctatggtaggataggtgattcatttggatttatggtcaaagaagattgtactatgaaggtaatgtttgagcttagatccaaatgatgagaaagagccaggaatgtgaactaagagtaccactttctagatggaggcaaaagcaagtaagtttgcttgtaaataaggttgcaagtaagtttgagaagaacttatgtttaactaacagtggccagtggggagcaagtggtagattaagtcagaggggtagacagcagttagatgcatgatcacctttagaccttcgtaggaaggagtttttaaaattgttgatgtttcttgtttgttgtttgtttgttttaaatggaatgggaatttatcgataggcatgctctgatttctattttagaaaatcactgctgcagtggaaaatgaattgggagtgtacagttggggataaactggaagcagaaaagccagttaggtagctattggattaacacaagagtaaaggcttatacctaagtgctggaggtggtgacgtagagaaaataagcaagtttgggaactattttcaaggcacttcagcagcagatgagttggatacagatggtaaggtgaataaaaaaaggcactgaggatgactcccagggtgccagattgaacaataggtaggaaatttactgagatggaaaagactagaggaaaaatatggataaaaaatcaaatgttctgctttaaactttaaagctttgtatgcttattgagtgtttgagtgtaaatggcaagtaagcagttggatatatgagtctggagcagtcagatccatgagagctggggatgcagaagtgattaatggaaatagagacagcctctaaagctttggggccatctgtgatcacctaggaagagaaaatacatagaggtgggtcactcaaacatgtagaggttaagcaaaccaaaaaagatcaggattgtggacaagtggtgggtgaggtcaggaaaaacttggagattgtagaatcactgtcactaagaaagagaatgtttcaaataagagagagtagttcattgggtcaaatgctgtcaagatgattgatggagtcagaaaagtgatggttgaatttcaaaacctggagatcattgaggaccttgacgagaggaaagaagaattgtaattcgactggcctgaggaaaaaggaaggtaaggaactgaaattttcataggttgacacttgtaagatgttggattgggggtaattttatcattgagaaagggcataggaaaaagaggctggttctttgaggttactatatgatataatcattttagagagtggaaatgtaaatacccaaagaagggttactggacaatgcttgagtgttcatttgagatttgtcctcatgcatttaaagtaaagaccagtttgtttggccatcagttttctccagccaaactccattactgcagttgcttagtagagaatgaagtgtaaccatgtttggggaattaacaaagcaagtattctggaaagagaatgaggcaagggagtgaagagtggttgtaagatgtgatggacaatggaatataggatgggtaagaaggaaagggacacctaaggactgtgatggataatgaaagtgtggtagggtcagtggagtgtaggcctcagattggtcattg

SEQ ID NO: 99916 - DNA, 1395 bp, Homo sapiens
ttatttttcttttattaaagaaaatgcagtataatgcctacatcatggcttaaaatattaagtatttagtcttcttcttgagtctgtgaacgctgggcagttctgagcaagtggaccaggcttgactgatctcagctatgctcatgtgtatgtctgtcagctgacatgttggctggtggctgtctgggcaagagcagccttctccttcacacctctgggagttggccagttgtaggttgaggatgggacaactgtgccatgtgccgcttatcatccagaaggctagcccagcctgttcatatggtggaggcaggagttcaggagttcaagagagacagagaaagagactggaagtaggcaaagtctcttgagagctaaactgggaattggcaccaagtcacttctgctgcattctgttggccaaaggaagtcccaaggtcagtccagaattttggggagtgaggaaatagattccacttcttgatgggaagaaccacagtatcacaagacaaaggtgtttgggggtaggccaaaaaagggctcacaaaatccatgtcaaatccctggaatctgtgaatgttaccttctatggcaaaagatgtgattaagttaaggattttgaggggaagagtttatcctggataaacagataggccctgccctaaatttagtcacatgcatctctacaaaagagaggcagaagaagtctgagtgagacccacaaagaggagagggtgatattaagatggaggcagagataggactgaagcaacctcaagccaaggaatgcttccaccagcagaagttggaagaggcaagaaatggagtctccccctagaacctctgtagggagtatggccatgccagcaccttggttttgtacttttggtctacagaaccaagaggcaataaatatctggtgggttttttttttttccagcctcccgagtagctgggactccaggcacatgccacatgtcctgctaatttttgtatttttagtaaagacagggtttcactatattggccaggctggtctcgaactcatgacctcgtgatccatccgcctcagcctcccaaagtgctaggattacaggtgtgagccacagcacacggccaatatctgctgtttttaagctgtctagttggtggtaatttgttaaagcagcccgagaaaactgatacaggtgtggatacagggagggataaagaattgaagacatttttgcaacaatctacatataccataaacttagataattttatatagctctttttcacttaatatgacaaaacatttattcatgttattacagtactgttaaacactattttgaataattgtataatacatactatatactgagttgatctagctgaacattttattgttat

SEQ ID NO: 99917 - DNA, 1917 bp, Homo sapiens
taagttgcttgcatatagtgtagtctatgaataattctctttgatttttatttgttgagtttgttcccacttccaaaggggcttgaggtagattgggttctgaaacaaagtgcagaatagagcaattatgtaaacatagatttcctggaggtcctgaggaggcaggtgctccaggcacctggtgatctgatttccactcttgggcattgcactctggtctgatttctgtaggtggagataaaatgggaaacatttaatgcagcctccatttcctctcaatagaaattatacaaaaatattttttatttcttaaaaaacatttttctttcaaatttaaatagcctgtaatacctttcttcattttacaaagccccgacttacagcagcataatatttattaatagagttaagcagaatcaatgcatgtgtcctgtcacactgagaactgtagtattgtggacaatgtttctaatgtattgtgatcggttagctctcatgagaataagatgaatgtttatattacatatatattatatatctccatctatacccattactatatctgtgtatatatatgtatatatacgtatatacacataacatcgaaagtatgtgtatgtgtgtttatccatgtactgtgattaatactcatgtacaatgatgttcacttgaacgccagcatttttttatgtggttgatctttgcatttttctgtcttcaggccatctaaatcctctgactttgaggttttttgatttggttgaaactaataccaaaattggaaatcttttattacaccaggttaactcaaagagtttcttaatatgggataaagggatagtttgtaagattaggaataaatgtgataatcacttgaagttcctggagcatacatagtgttttgattattaattttggcatcgcttaaacatgttagaaataaaaagggccagcagccttttgtgtcagattaacttagtaaaaattacataaagagtttgcattatttatttctgttttctgtttcattgagtggaaaatttaaatctgacctactgactcttttaacacactgagaactatgtatttatttctaatttattgagtgtcagaaatatgtcttcaaattccctaaggctcaacttcaaggcaggttcctttatgaggttttctctcatcccctgcattaatttcctattgttgctctagaaaatcctcacaaatttagtgacttaaaacaacacaagtttattttcttataattctggaagtcagaagtccaaaatcactgggctaaaatcaagggctaaaatcaaggggctggcagagctgctttcctttctgggggctcctgagggggaccctttccttccatttccagcttctagcagttgcctgctttccttggcgtgtagctcccttctatcttcaaaaccatcaagtctttcttacaatgtcatctctctgtttcttactcttactcttcctttccccctgtttaaggacttttgtacctttgtgattccattgagtccacgtggataatctgggataatctctttattttaaggtcagttgattcagttgattagcattttaatgccagcttttttttttaattttattattattatactttaagttttagggtacatgtgcacaacacgcaggtttgttacgtatgtatacatgtgccatgttggtgtgctgcacccatttttgagacaaggtatctctctgtcgcctaggctggtgtgtagtggcacaatcacaggtcactgtggcctctaactcctgggctcaagggatcttcccacctcagcctcccaagtagctgggacatcaggtgtgtgccaccatgcccaactaatttttatttttttaaattttctgtagagacagggccttgctatgttg

SEQ ID NO: 99918 - DNA, 1060 bp, Homo sapiens
tattcttgttttataaattttcagagagagagatgatcatagaattatgattttatttacttagatttgttcattttctgtatttttcaagtaaaaatcccttaaagaaataaaatacatgttgaaatatgttctagccccggagactatcttagaacagaacacattgccttagaaggtaagaagcaatatgtttacaaatgaaaaagaggctaagttgcatgaaagtattaaagccattatttttcttctctcccaccctaagtatattagtccaagaggcaagtgttcgcactttcaaagcaatactaaaattgattctttatcccatcctttcagtctaagacacttttaaagaaaccaccagtcttcctccagtgtgcttcattttctaacacagtgtaagaagcatgtgagcagatcacattaatgtaatgatgtgtgcttccagcaggacaatcaaagcaaaggggatgcatgaatctctctttttttttttaatttgctgagtgtagaccatgtataatttttgttaatgtttacttcttctctaatcatatatgtgcgtgtgcattgaaaagattttaggaaattcaaattccaaacaagaaattaaatacttacagtaattctgccatccagatataaacactaataatattttgttgtatttatttctagaatgtctagacatatacatataaccatttttaaaacttaggaaatatgctgtgcatatgattgtttttctcatagaatattgtgagtgctgtttcatggcattgaatgttcttcataagcatagttttaatgactgaattagatcattttagagaaatcaattaaaaatattctaagagtttaaattgggaatgaatatatctttgtggtgaggactgaacatacttcttcttttacttgactttgagtatgtaattgatttcataagtaaaaagataatgaaatgtttaccttgtcataatcaatagtgatttcctaagctgttaatgttaggtgaatggaagtcttcccctgtggatatggaagacatatccaagga

SEQ ID NO: 99919 - DNA, 1048 bp, Homo sapiens
tgccatgtcttctgctgtgtttggtttcatatttcagtcattgacagctccaggctgatatcccattattccaaacatagcagaataaagactctaatttcaaagtatctcaagtaaatctcagaactgagcttgtgaatcttgattgcttatatctgggtattttgtccattcctgaaccaagattattccatctccagctgtggtaggtcatagcccaagtcacaatctttcacttttagagtcagtttcacaggaacctcgggaactaacagcaggaaaaggaaggatttctagataaacatcagtgccctcttatccatacaagggggacgatgttaagggggaaagactatcaacatccactgcagaagcagaaatggtgttaagagacaaagactatcagcatccacaaccatgagcaaccactgttttagaggtaaagaaactatataattagcacaggccaactctttttttatttttataatgcccagactacatgcatgtcttaatcatttcttttatataaaatttctgtgcacctaatgagaaggtatttttagctacacatccatgacccttatcctcattgttgcatttctcctctgaaccttgtcatcacctaccttgcccaaaaggcactgcttgttttagccattgagcaaggtgggtaagcatattgaatttgctgtcatatcctccttaaaggtgcagcaatgcaggtcacatgggatcaaaaaaatgaggcttattcctaatactttaggctatacttgtgaagcctcatgggaagtttttctttaaacaagtctacagcacttattttaggcttaactaatctgattagttgttaacagaaaaggatatatttaaagtccacggatatgcaaacatttaatcagtgagtataggttttatgttctgtcttcatttatcagtgatgagagtgaccttggctatgacctcccacagctaaggatggaatgcttttggttcaggaatggagaagatgccaagacctgaccaattaggatgaacaagctca

SEQ ID NO: 99920 - DNA, 1091 bp, Homo sapiens
ttgagcttttctgctccccagggtggggacgtgtgacaaatttcttggtgagcatacccttaaaatgaaaagatgttcttgggtgatatcagacaaggtcagtttgttctttggtgtcatgaaaaggctctcccagtttgttcactgttactagtgaacttgacttaccttgtgagcttctggttacagggattttttttttttttttcatttcattttacctaccttggtacctagcagtgttggatatatagaaggtactttctatattttgtttttggaaaatactttaaagttacacaggagaaaatatatccatgtaattcagaggaggctggattcccttcaggaatgggggcattattggttttaatcctcagtatatacttattagaaaataaacaatgagttgaatgtttgacgtaggtcaagtagcatgcaggaaggataatcatagacctgcttttgcaaagcgtacaatcaagggtaaaagacttacaatgtgagaatagaatgatgtcactaccacttttatcattactcttgcctagtatgtatcgagcaacaatgaaacgtcagaacttcttctaagtcatttcaatattaacgcctttaattctcaaaacaacgctcttgaagtaagcactgtgattattcccattttacaaatgaggaaactgaaatacggagaggttaagtacttgctgaagatcacacagttataaaaggcatgcctgctatttgaatttttgcagtctgactccagagcccatacttgtatgtactggtcagatggaagaagcaggggatcccaaatgagcccctcacccaaagctgtgggttagagaagggtcccagagtcagtgacatctgtgctaagtcatggatgatgggtaggtatttgccaggtgaaggaggaggaagaggaaggtgttgagttatgttctgttcggatgataatacagactggttattatggttgcagtgtgtgtgtgtgtgtgtgtgtgtgtgtgtgtgtgtgtgtgtgtctgtttggagcagatgatacagatgctcgagccagagtatgtatgtctttgttaagccatgtt

SEQ ID NO: 99921 - DNA, 1003 bp, Homo sapiens
agtccctgctctttcttcccatcataccacacatgtcatttctgcctctagctcacagccacagtctagtcctttgataagaagcaattccagaaatgaagattcaaatcccagctattctgttctactcaaaatatggcccatggaccagcagcactgagatcaccagggagctacttagaaacctgcagtttcatacttgggaggctgaggtgggaggatcgcttgaacccagtttcaggctgcagtgagtgatgattgtaatcctgcactccagcctgggtgacagagcaagatcttgtctctaaaagaaaaagaaaaagaaatagaaatgtgcaatttttgtccctaccccataactgctgaatcagactggtcattttaatggggcccccaggtaatctggatgcacagtaaagtctgggaagccctggaccaggttcctggaagccagcttctccacctactgccgctatgtgactgtcatcttccttccgtgtgggagaagtggattcactgcatgttagctacagggtataaccactggagtaaaatttcagcctttttgaagagtaaacatgtttaacctagaaaggactacttagcaacataatattgaaagaccgctcagcccattttttgaaaagcatgagctgtttccatagataagccaaacaggcctgaacaaaacagaggaaaagcgaactttgctgttttgatttgtggatgatgatttgattttctaaaaagaacagctttgtttctttccctgagaacataagattactgagttcttagagcctcagctcatgcagctttcctgcttgggtatatgggtagggcaaagccagattaaagatgcacagtatcaagccatctgacctccaatgccagatttcctgcagtagtctaattaccagtttattagctgttaaccttgcaccacagttacaaaacggtaactgctggttagagtcttaatagttgataagtgtcagggagg

SEQ ID NO: 99922 - DNA, 1053 bp, Homo sapiens
ggaagagagaattagagaaaacgtgaagggggggaaatgacatttgagccagacatcaaaggacagacaggattggaagatggggagataggtaggaatagaagattcattttagccagagagaacaatagggaaaatagaagagtgactagcaggaaattcagctcaaatttgagatatgaaagatattttataggtatcaataattgacttacttccaaagagttcatcatcattttaatcttccttgaagattattttttaaatccaagtaagatattttaaaaattagaccgtacataaaagttgaaaaaggaaaaaaatgctgaccttcactccagtgaaaccactggctaacgtttgagtattttccttcaagtcttttgcattttgtttctgtgcctctttttgagtagttgaaataatgtattgcattctgccttttcatttaaaataatactaccagcacctacccacgttatgaaaatctctttggaatcgtcacatttaatggccttatactgtttagccgtttggctttgtcatagttgactttaccccaccctattgctggagtttagggtgtttcatgttttccattgctatgaacagactagctgttggccagccaaccctttttgtatttcacaaatggtaaagccaaggcacttgtaataagccaagatggggactgacttgttcagttgctagaagccaaaagactgttgcataaaaagctgccttctgactagaagaggggctgtggggtttctaggaatagagattaataaggtgcttaggtcatatcccctgagaagtttaatctgagtgggccactgaccttctggcctctggaaaggagatccattgaatttctaagccctttggtactcctcccatttcctgcggaattttgattgtgggtaaagtttcaaaacactggctcttcacattggatttccaagttgggaagagaaggcaggaagacctatcaaaggacaaagatattgtgttctccacttcgatctgaaagatggaatggcaggggagaag

SEQ ID NO: 99923 - DNA, 1087 bp, Homo sapiens
ttcaccatttagtatctttgtgactttggaaagtgatttaattgcttgagggcttaatttccctatctgcaaaacagacacaataataggaccatcacataaagtctctatacagattcaatgtgaaagaacattttagaatgcagtattagaagtagtttaatcactttaaaatgttgctattaataatctgttaattagcaagtgatattatgcatgtaaaataaaattttggaacaatatttttcttacaatgagccaggtctgtaggctaggcatattaaaatatttaaaataagtcatggtatattaggttaaaatgatggaatgaaaacactccaaatcagagtttcaaagtaattcaactgaactgtaaagcaaaataggtataacacaattctatgctaaaatgttttaatcttaggtttatcatataacattttattacctaaaactgctaaaacatgtaggttttatatttaaaatgatagtttgtatttagtttgaaatgtggagctgaatgattttgcaaaattaaattgggaatacgttatattttaggtaccctggaaaattgtctgtggttagatggctgatacctttccttcttatttagtttaattgaaaaaaaattggcattgaagaattaaacacactctaaaatttcaataaatattccatgactactttatttatctagatatcaacttactaataatatcagccatccaagttaaacaaaaagtaaaacatccagaagtgaaaaatacagccaaatgttgtacatggctagtatacagatcctgctataaaatgctattataaaatccagctgccctcactcagagcctactgattcttatatatcacataatctttcccttgttccttcctctgaagacagtaggagctataaacaggaacagtttgggagaaagcaaagcccggcatcaaaagagatatagaacaaaatgtagacacacaactttgttatcacagggcatgatgaccaaggcattcctttcctcattcagttattcacttcttcatcaaagattctctaatcatctgtgatagtaccagtctg

SEQ ID NO: 99924 - DNA, 1052 bp, Homo sapiens
aacttcttcaatctcttgccaggtctctagtctgtgagtcaaagaataccatatttatgagtgatgttttgagatagtgggtgctctgtgaatttcaggtagtgtttttttgtttgtttgttttttcctcaccagggagcatcataatttttcagcatgtttgttaacaatgtacattttattttaaaaaaaatcatgacaataaattcatacattgccaaataacaggtgtctgctatctgattctgtcagataaactttataccttttctggaatatatgagttagaaaacttcaggtatcagactcagctgcctcaagtactgacataccaggcatttctctgtttaatcatcactcaactcatggatgaaagtattaggaaacagaagggattatgaagataactaaagttattactggcacttgaactgaatttctcttaaaatatcagtttactttgatatgtgctacaaagaccttaaccatgtttctgtctgattcttttgtgaaatgaaggtatcaatacagaatgaactgttttgataagctccctcacaattttaaagtatagagttaatctctaagaactaataagcaatgattccattttcttgattttatttttatgagccacagttttatatcccactgcttatctgatttgaaaatggttgtaatattttgagaaagttaatatcgagtcatgccaaaaccttaataaacttagtcttgaactaatatttcaggctcatgagggatttctgtatgctaagatagattttaatattacagaaatgcaatagtgacctttccataaaaccttaataaaattactttgttctataaactgcagaagagatgggaactttcttgaaagagaatatgcatgatttatctgcatttcatggcttaatcttatatctcatttcttcagatctcttatgtttttcttttccttaaggcaaacaacagtaatttccatatttttaaactagagaacagacagaatttttcaaaggcatgttttccttttgcaccagtgagattgg

SEQ ID NO: 99925 - DNA, 1050 bp, Homo sapiens
ttatgagctagagtaataatgataatgatactataaatttttgagcgctcactatgtgccagatgaccttctaaacattttatgtgtattatttgtttaattttttacaacaaccttacaaggttgttgctattaatattctcagtttacagatgggttttatatagtaacagtttttgcttaatgcagtgcttttggcagtcattctacatttaactttgtatgtgttataaatgtaatagtgattgaactttgtgccagtcattgctttgctcatttcattgatataaaccattttgaccaaagctttgcatgcctctgattctatcatttattgtctgtgcccttgcaaggtggtgatgactccagactttctatagagcaggggctttgggccaccaatctgttcagaatggctgggtaggtgaattaaagcctcatttgcattgtaaatgcatgatttttcttctgttgtacttgaatttgaggtgacttgggaaggagtgtataatgaaattgatgtttcctttaccaagaagttgaaagtaaaacatattaaaacttcatttagagtcagagttggttcctttcaaaatcaatgaaatgtatgaagtggctaattcgctgatcttcccagagatccagattgtcagatgcagaaactaggtcttctgtgagctgacatagcttaatacttgttgacttgatatttctgcagggtgcatctctagatttacaggatagtcactttttaagtaaacaaaattgcaaatgctaaggatggacctaaacatggttactattccttgtttgaattaaaatattgaagtaatagctgttcatatgtctgaaattaaaataacagtgaactgcattctgctataagatgaaacagaataatattctgccatccagagacaagcactgttaattcttatgcagttttcttctagtcttttttcatatttgtttttcttttttttctctctcccatggttgagatcatagagtaatatttttaaaatataaagcagatcccatttctcctgt

SEQ ID NO: 99926 - DNA, 1038 bp, Homo sapiens
cgttctctgtatctcactgtcattgctggaatgagcactttaaatgctcatggttgattactgagggagagacgttttcatttttgttcctattggttttgaaatgaaagatagacagcaggtttaccaccttttgaagttgctgaataactcacttcattgccctcttgtcatctgagaacgtgctctgtcgtgtcagggaggtgcagggcagagtctccccaaccaggaatgacctcttctgttcactataccccaacatgcacttgaaaataaaaactgtgttgtgatggctcgtctgtggcagcagcttcttggcctgattgtagactgaggccagcttaggcagagtgggatggaggagttggagcaggaacaaacagaagatgaccttctgtgcagaaaccacattttcaacaagtctaagtcaacccagagttacgaactctgggtttcccttatgcttagctttgtattctagctcactggaaatagacatgcactaataccattgctctttttaaagatctgtgtaacagaaatggattccctgtcaaaatgtatttgtatttctgcctcatattatatattatctgcatcctcttgggtgacttgcctcacctcagttaggaaaagttttctcatctgtaaggtagggatggtggtgtttacctcatttgtctttgatggttaataataatcagtactagcaacattataatgattattattactatgttttatattaataatcaatactgggccaggtgcagtggctcatgcttatgatcccagtgctttgggaggctgaggcaggaggactgcttgaagccaggagttcgagttcagcctggacaacatagcgaaactctgtctctacaaaaaaaaatttttttttttaattagccagccatgatagtgaatgcctgtagtcctagctactcatgaggctgaggcaggaggattgcttgagcgcaggagtttgaggctgcggtgctatgattgtaccaggagtttgaagctggagtactatgattg

SEQ ID NO: 99927 - DNA, 1034 bp, Homo sapiens
gcctgggcaacatagtgcaaccctgtctctacaaaaattacaaaaattagggtgtgttagcatgtgcctgtagtctcaactactcaggaggctgcggtgggaggatccattgagcctgggaggcagatgttgcagtgagctgagaatgcaccactgttcaccagcctgggtgacagagcagagactctgtacctcccccaaccaaaaaatttgtaatacctttcttatcagttgatttcaaggaatatatagtgttacaaatttcacctctacaggttttagaataatgctaggtgtctgggcccttatgtttatttttacattaaatgtggtttctttttaccacgtttcttcctccatgctctgtgatgtaacttatttttttttctatctgtgtacctctatacaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaaggtagcttcagttaaatggcctccttctcttccccaccatgtatatatgttgtgtgtttaattttatgcgtgctatatttttatatacttaaattgtatggtaatttaaaagttagcattgctttgctgacatgtttctgtagaaaatcagcaattaaaatacccttttagcatgtcactcctgtgggccaacaacccaaatacctactacgatatgttgtagggatactagtccagcacttctccaacttgagtgtataccagaatcccctgagctcttgttaaaatgcagattctgattcaataggtctgaggtggggacaagattctccttttctaacaagctcccaggtggcatggatactactcatctgacaactacagtttgagtgacaaaggtctagatcagtaccacccagtagaaatgcaatgtgagccacatatataatttaaattgttcttgtagctgggttttaaaagta

SEQ ID NO: 99928 - DNA, 1113 bp, Homo sapiens
tactttttaggcaaatgttttaagatcattatctgtgggagctatagtcatacagtagtacttcccgaattagtggcctgaaaaaaggattccttaaaaaagtccacatataaagggggttctttggtcagctaagcatgagaaagcctttagacaggtttctttatggtagtgctttcagaagaagtatttcttttttttttttttggaggagctgggtctcagatatatttgagtcttagtgctttactctttttttttaagttttagggtacatatgcacaacgtgcaggttagttacatatgtatacatgtgccatgttggtgtgctgcacccatcaacagaagaagtattattcttatgtggatctcagcaaggaagaaagctattcagctgtttcctaaactttttttttaattttttgatgagacaccattaacatctttcagaaccagtgtggcactgaataaaagtcagtaaattatatcatagaggcattattcagctcaatatttttctagaagtatcaaaacaatgatgtaatctaaggattcatttattcatatttaccataaatattctatttattttccctgtttttccacttccacttgtcttcactcctcactgttttctgctgtgtgtggggagactttaccttaaaagacagagaaccaggtaatgaaactcaagcccaccgatttagattccttttagtagctcttatattgaaagtcctatttagtttatagaattacctatagatttgatttgcttgaactaaattggtggatgctgcctagttaagagttagacaaaggcttcttgattgattatattgatctcagactaagcaggtatgattgtcatcaagttgaaatactatttactttggcatgacttaatttgccaacattgtcaacaggtacctgtcaggaagaatgtgaccgataaatacaggccatcaactaaagaaacaactctatgaacaccttttaattcaccagctgtttactcatcccataccaacagaatttcacaaatttgactgagttgagtccaaaagtaatgctgtcaaaaaactgatggttgctgactggcttaagatgatg

SEQ ID NO: 99929 - DNA, 1047 bp, Homo sapiens
aatgtcagccagtttgaaaagcagtgatccgtgaaggtgggggccatctgccttcacagggccattggcaggcagttgtgaggtgccaaggggaaccatgttgagaaattgcagggataagcctgtatctctcaaaattatgccccagcaccaagagtgtgattcatcatactcacttggcaatgggccaagaggttagtcctaaaggtactgtcatgtcttatcttctggtcattgtggcaggtgcttacaggtgtggtctctaggctataaatcccggcttcaccatggcaaattcttacacttgtgcctcactgtcctcatctgtgaatcaaaattaccatgcagatgaaattggaaagtattctttattcaatactacttatcttgttatggtatccctccaattttctttcacccttttagtggaggaaagttatttagtcttatctatttctatgtgttgtgcagctgcttcttcttttcctctgcagttgccctggcatgtgtttttaaagagaaacccagtggatattctgatgttatgacttcaggcactgatagtcctaaagggtcaaaaacttttagaaggcttgcttatacctgagtgacacaaatatctctatctgacatgagatctaacaacatcctgcccagatccctttatgaagctggtgttcacccagccatcatctgccatgagaatgggctcaccaagggctcagacctgtccacttcttcagagcattgccctctgctgaaggggagcttccattcctggaagattatactcttccctcctccaggaggaagtccacagccaatgatgagctgcaacagggtacagaaggccatccctcttgccgccaagtctggcacaaatcacatgagttcaagctaaatcaagctccatctgaaaccacaactttgtttaactcttttttctgctcagtcttctctcactctcttcatccctaaaacatcccgttattaaagtagttagtggtgcttctacgaaacttaagacagaaactttactaaatcatc

SEQ ID NO: 99930 - DNA, 1021 bp, Homo sapiens
ttgataccatgccagaaaaaaaatcagataactctattggtgaatgagctgccaagagttagttggaaattgttgtgtatgttttaatggatatgaagagtaaacacttttaaaatgttattcactatcattctgaagtttctaaaatggaaactattagtgtactgtccataatattaaaagagatctggcttcatagtgattacatagcttgggaatggttcctgctctttagcattaaaccaaaatttaatatccaggaagttgcaggaataacacatgaagaaagtcttaccttttgtctccctcttctcttgtcttgctgtttacataacccatgcagtctgcctttctctcaaattcacaaatttacactcagtttatcctcccactcagaccaaagttttggaaatagcaattctcttttgccaccttccctcctctctcgtaacctggagtgaacaccaatgactagaaaattgggaagtgagtagccagacagtagttgtgggcaggggctggaagagatcccaaacaaaacggctgtgttaaagaaggctgagagccgcaggtgccgtcttggaagcatccctatataatcagcccaaccatgtcctgaaggcccagcagcccacgaagaaggtatgattctgctggggcagttgccccatccttcactcaagagttctctgtaactttcagaacacggtgttaaaaccatcgtgtagattgcagaccctgtttcagctagcaaagagtgggactcccttagtttctaggatcgttgctgttttagccacttgcgaagtcccccggaatagaatttaaccaggactctaataggactggacacaactcaggggtgtttgcttttgtagcatttcttttggggaatgggggtggtttagtttgattcaacaaaaactcattgagtaccagttagctatgaggcactaagcttatgtgaacatggggctatatagagatttgagtaaatcacattccctttgtaaatgctcta

SEQ ID NO: 99931 - DNA, 1040 bp, Homo sapiens
ctcacaggggaggcattccaaagccagccctcatggatagaagtaaaactccatcctcaagtcaagctggacttctgaatgtcgagttaaaatgaaattatcatggtaacacattacctgggcttccaatcagggagcgattgaaggctccttggtggctaaggtatggctcagagccaagtgtggtgttccagggtaccaagtcctctgctcaatagctttcattctgagtggcaccaacacatttataatggagagtctctcctaacttttatcatcaccaggaagtgtgttcatcaaggtgttatctattctactagccttgatgctcactgttctagttaaaaggctatccaaaaatactatgtcttggggtactactgagatttgttgaaacattggataattgttccccttccccctcacccaacccatcatgttgacagtaaagtcccttatccttgaggcagctgacatttcagaggggctcaagggtgcttagcttgaaaacaagaacaaaatatgtctgatcacgcccgtgtcaactgtggttaagtgtgggaaccaggataaggacaactgaaggcatggattgagttgtaaggggccgcctccttttccctaggcccagttattgtcaacatgagggtttgttctagagctactgtcttatctgccacattcctttttcataagaaggcaatttggtagcatcagaatttatcattgtttttgtccaaaaatgtgtgtcccaggccaggcgctgtggctcatgcctgtaatcctagcactttgggaggccgaggtgggtggatcacctgaggtcaggagtttgagaccagcctcaccaatatgatgaaaccccgtctctactaaaaatacaaaaaattagccaggtgtggtggcgtgcacctgtagtcccagctacttgggaggctgaggcgggagaattgcttgaacctgggatgcagaggttgcagtgagctgagatagcgccactgcactccagcctaggtgacagagtgagactctgtctcaaa

SEQ ID NO: 99932 - DNA, 1261 bp, Homo sapiens
caatagtattcttttttttaatagtgtttccttctatttgatgtcttcttaacattaaggaagtaccttaaattttggggtgtgactgatggaatcggtgtgattctagatttctttaggtcataggaactgtaagactactcaggaaagtctatagcctttatttttaatccaagtgtctgccctgaatttattccttttctatcctagtgaactcaactggaagaactagacaaaaacatgaatgtcggcttgaagaagccttgtcaaacatagagaacattctgcctgttccttgcactccctcttttgagtcctaccctggcccctcttatctctccaaaatcaaaaacaccccttgggcagaacaacttcaatactcataacaaaaggagacagacagagctcactcaagaaagaatgggcattggaatgtaagggtcaattactccaagagtttaaacctaaacattttcaaaatgccttagccacatagtctcaacaagccagtattcaacactgcattggaagcccctgtgaaggttccttgtgaaggttcaatggcttcaaatttataaagcttgcactttagaaactctgttaactgaagtgtaaatgcactgatgcaagaaagagcaagtactaccccacatatcagacagatgcctctacttttaaataatcctttgagtatgatacgatgtttattttacttgaaaatatttcaagtttttccactccactggttcatataatgagacaaaaaaataaacaagtcccatgaacactggaaaggacaaggtcctagtctcatttgcagatgttgattgtctactctgatataaacaattccacggaaaaactgtttgaagtaattagagagttcagcaaggtaaccagagaaacaatgagcaaagcaaaaacctggagacacacatacactgccattaaccaggtagaatagatagtaggaaaacataaatcccatttatattagcaaaagacatgctggttcctaccaccttccagctggttaatcctttcactctttctatgaaagtttttattcatatactaatgtgtatcttcagggggctgcaaggagaggagagactatatatatagtccatttactgctttggtcaccctgtagggtgacctcctccctatccatgcaatcaacactgactagattttcagtagtagctttagacctgactcctcattggcttctcagtatttccttgttcgttgctcccca

SEQ ID NO: 99933 - DNA, 1143 bp, Homo sapiens
aatcagatttgatgaacttgaaagacattttttattcttctttccagctcttagttttggaacagaatctccttctccttcttttaaaattataccagttaaagtttttgatacatctcacattagcattaagaggacaataatgcattttgccaagtgagaatctttaattgcctagtaatgggtgtttcttattcttggacggttaatgggtgtttgaatttacaaatgccacttttttctctccagcaaatatcaacagtacaagatgtccaaatattgcgaagatctatttggggatctcctgttgaaacaagcacttgaatcacatccagtatgtatttttaacaaaccatatttctagcatgaatggatttgttttgaaaatttctgaagggtcaagtagtactagaggactaatgctaaagatcttcatatttatttaaattctttggtacggaaagcttacatcatgcttcagagggatgtaaagagacacaaaataaacatctggttcaatttcatttggaggatctttgggtcttatggttttcagatctcagtcttaaagtttcataaagcacccaggccaagagtccagattcaggtcagttgttctcaaattcagttacatgttagaatcacctacaaaactgttaaaaacacctgtgccagggccccacttggagactgatttaattgatgcagggtcagccctgagcatggtgttttaaaagccctccaggtgaactgtatatgcacccggtattcagaacccatgggaggctcatgctgtggaaagtgccctggattgatgtcacgacatcctgaagttcatgttcctaactccaaaataaatcactgagtaatgttgcacatacatttttgaacttcatgttaaacctgctaatttcttcataaagcaaagaacattaacctgtgctccatagataggctttatgagatctgtgaattcattctaattgcatgcaatttttttgtatatactcattctagagagttaatcacatttttataaggatccatgacctccaagagattaagatccacaatcacaagatgttatgagctccaaggcagctaatgaaatcaaagtggaaagacctgctattgacagcagca

SEQ ID NO: 99934 - DNA, 1009 bp, Homo sapiens
agaagtagccatccacttaaaaaaaatttattaagcatcaagcatttcaaaccacattttaggagcaggagaaataatacataacaagatgtgctccttgacgttgaataggtaagagtttagtgagagttttacttgaaaaaatactgcatatatcaatgtccccattttcttttagcatcctttttctctaaaagtgcttatgttctacccaagattgtgaacaaggtctgactacttggcagtggtttggtgtcatggattttccatttgtctttcacacagctgaccaagaggaggaagctcaccccgaattcaaatttggaaatgaactttctgctgatgacttgggtcacaaggaagctgttgcaaatagcgtcaagaaggtcagagtcccctttctttcatcactctcaagaggtagcagctgttatttatgaaattttggaaatgtgagaaccacaagagaataaagtaacctataattccccttctaaattgcttaggatacgagtctgtgctgggtgaccagaacttgacacatacacaatattaaatttaaaaggacatttaaattactcattagtcagggccagtgttaaccactacccatttggccagtgtcctctaaatattatcatttattgtgttattgcagctggggagggagaaaatgacagcatcccaggggtaagatttaatcttgaattcatcaggaaaatgacccctgaacatcccgagtctagccctcatttgagaactagtcctgctaattatataccttccccctaaagtacagtaagcataaaaatgtttccagatattcagccaaggaaaatagttattcatatacttaccttttgtcaggcatagtctaggccataatgacctaaaagtgtaaaacacacttgccttctgcccttaggcagctcatggccccctgtagtttagggaaagggatcggaaacagcaaacaagcaagtagtcaaataactatataattacaact

SEQ ID NO: 99935 - DNA, 1057 bp, Homo sapiens
ttaacagagtttagttgagcaaaaaaaacaattcccaaattgggcaggacccaaaccagaagaggttcagagaaactccagtgcagccatgtggtggaagattttttggcagaaaaaggaaagtgacctacagaaaacagaagtgaggtacagaagcagctgtattggttacaggcttatttgccttatttgaacagaggttgaatagttggccacctttgattggctgaaactcagtgattggcacatgagtaggttccagtctgtttacacacccattcagtctacagtttactatgtgaaagtttatgaaaaaacctttagaataggtaaagagacacctttaggctaaacttaatttaacaaatgctactgactgattaagtaagaagactcaagagtgtcctttgggttgttagcatggaggtcgttggcaaccttaaagagacatttcagtggagtgccaggcagggtggtgacactggatcacacagatatgaatgactagagactatgcttttgagaagttttgatgtgaaggggagcaagaaatggactggtggccaagggcacctgaggagtcaagggagtgttttctttttcggatgaatgaatctggagtgtgtttgaaaacttggaagtggtgcagtagagaggaagagattagttttgcaggaaagagaggggataactgcctggaattccttgaggaggtggaagagggtgggattgctgtggtgcaaaggtgtggcccttcacaggagcaggaacacctgattagtgaagacagtggatgaagatgcaggtaggcagatacatttggtgataggaagaggggagagtatttgtctgatgagcaaagccaaaggaatattgcctttacacactatcttttctgatatagggaattgtgactactctgagaatattgaacatctattaagactcaagagtattgttttaatacaaaaattagccaggcgccatggtacgcgcctgtaatcccagctactcaggaagctgaggcaggagaactgcttgaacccaaaaggcggag

SEQ ID NO: 99936 - DNA, 1043 bp, Homo sapiens
cacttaacagtaataactcattctaactggttaacaatgaaattaaaaaatagaatcggtttgggagtgcttgtcacttgtttgtagtctgcatttctaacaattctttcaaatgcataacaaagcttcatccatttaaaaattgtttcactaggccgggcacagtggctcacgcctgtaatcccagcactttgggaggccaaggtgggtagaataggatgtcaggagtttgagaccagcctgaccaacatggtaaaacctgtctctactaaaaatacaaaaattagctgggtgtggtgacatacccctgtaatcccagctactcaggaggctgaggcaggagaatcgctttaacccgggaggcagaggttgcagtgagctgagatcgtgccattgcattccagtgtaggtgatagagtaagactccatctcaaaaaaaaagaaaaattatttcactaataacatgactatataaaatattgaagaccagctcacaattctagccactagttacctaaattgccaggtcactgtcacatagtttgccatacacactggtgcatggagggagatgctagcaatctgtcaacctcccactcacagcacctagagagagaacacttgtcactttttctcccttatgtaaatcttgcccagtagcctacttctgaaatagatttatttttgctttttacccataagaagtggtattttgacagtgattgtgaaaaattacaagagctagttgcaaattgtaagagaacagcaggaggtggccccaggaattctcctgtgggttgaaaaacgtcatggccctcaaacatcgtcacttccagactccctcacaggtaaagaagaaaaaggtagtacctctttccttcctaagaacatataataaccagctgctgctggtaggataatgtctgtcctcttttattaagggcaatgagagcaagagaaacttaatttataatttattaatttgaaagaacttctgagttcttttaaactaatcttgcattcctgtttctttattctctgac

SEQ ID NO: 99937 - DNA, 2128 bp, Homo sapiens
ctttgtatagtggttgaattgagtaatcatgaaacagataatattttgtaaggtgtgaatctattactagaaagaccagtgttgcccaatgagccatgacatctcatatttgatgaatatattatcttcatcagaaagctttgtagcaaagacccatgggaatgggaaaatatctaatttctggcatgcatttgcaactttccattttcaggggaagtaattgtctcgaaatgaaaaaagaaacagaaatcaaaattcagacgctgacatcagatcacaaatctaaggtaagaaaatgcccatttttacagcagtgacttgcagaagacactttgtaattttttagaaggagtacctagtgtaaattagaaataacagtagcccagagctggtctagtagcctgcagctgatctgggatgtcaggggagcccagggttcatgtttgcctcagactcactggctttaagaagagccatttcatggaacatcttcttttgtcttgtctgttgaactatgctaacaatatttatgttgcctgcctcagaggcatcaaggaaaataataaatgaagatactaaaaggaaatattatataaaatacagaatatacttccctatagaaataacattaaacataggacagaaaaccgcccaaattgggaggtgatacttactccatcctaactttacatggaaatttggaatgagaaaaaattaagagctgatattctaaaagagaagcctaattactcacattttcttaaagacaggagaaaataggagcttgagagactttaatcaactttgtgggcatttggagaactaagtgttaagtcccagttaagaatgaaaacaattcttccagcaatgatagtttttaaatgaaaaggaaaaaaaaagaaaaaaaaaaccaacaacaactgttaaagaaagctcccaaaaatagctgtggttgaaccagccagcctcatctatctatatgcagctgtgtcatctggcctaatggccctgctgcatgcatggagcaggcaagatgttcaagatgttcttggtagctgtatgttttgtagggcatgaactctatagaggcagtaaggcatgtgtctttaagagttattccccactctctctcttcttaactggaatgtttgagaattagtagttgtgcaaactgtcatgattcttagatgcttggcatcaataagaaaagccttggcaacagtatcagtttgcttttgctatataatgaactgtgtcaaagaagagcacattgaaacaactactacagtttattaggtcacaattcagtgggtcagaaatttgggccatacttctgctgattttggctggagacacttgtgtatctactgtcagcagggggcgtatggccttacttatgtatctggtagttgtctggctgttgcttgttttcctacatgacctatcaacctccagcaggctagcacaggctcagtcagagggtagccacagggatcccagcatagcagaagggcaagtactttccagcctctgcttgcatcacatttgctactatctcattggctaaagcaagtcacaggtcacccagcttcaaggagctggagaaacagactccagctcttgacaagaggcactgcaaaaccccactgcaaagagcttggatattgggtggggaggactttctaccctagtgtctatcagggttgacacagtaagtcatgatccagaaataaaagaacacacagctctctattcagacatgtgggcttgtggacatgaagctggagaaacataaggtgataaagaaaatcctgatggaattggtaaaagagcctaaggcccacacaaatcagagtgttggctgagtgtggtggctcacgcctgtaatcccggcactctgggaggccgaggcaggtggatcacctgagatcgggagtttgagaccagcctggccaacatggtgaaaccctgtctctagtaaaaatacaaaaattagctgggcatggtggcacgcatctgtaatcccagctacttgggaagctgaggcaggagaatcgcttgaacccaggaggtggaggttgcagtgagctgagatcatgccactgcactccagcctgggcaacagagg

SEQ ID NO: 99938 - DNA, 1034 bp, Homo sapiens
tacaattcatttgaccaactcataaacacatcacattctggtacaagttacctagcttatgtttttgctcttaaagcacttctcagaaagtgctcctgggggaaatatgggaatatgagtaaggataaagtcaccatctccaaagctttagaagccacttcagtgattcaacaatgggtagggataaggatgccttggagaaggtttttaaaaattctccctagaggaagggcacagtgaaaggtaaggcacagttatgtgttagttaactaaattaagaaactacttggaaattaattgtgttgcttagcaacaagtttgactaaagaatgtaaatgtgctcagaattactcatcactacaatagtggtgtatgccagagctagagaaaacagtcatcttgtgtcgctagctttggagccgaagtacataatttttaaaaatcagtttgagcttttatcctaacacatggctaattcaagccacaccagagttcttgcattaaactgctagattagtgatagctgtattgattagattgtattgggagggtgctggctttttgttgcagaaattcaaatatgtcttttaaggtctaccacccacaactgacactttgagtcacaaaagcttgggaaagcatagaacatgaaaaggcttgagacctgataaagatttaatgagattcaaggaaaagacattcaagatatcatactgatgcttctggcaagcaaagaatttggacttgagtttctgtgttaagctttgctttagaaatatggcctgttcaattgcaaattcaatcccagatctttctagtatacattttttggcatttaagggtgagaaagctctcaattcacagttactctgtatggtacaacactgtcatgggcacagtgcaaaagatacagtgacttcatttctttcctcataaaaaggcaaggtctggaactatatagtataactgccttcataaccaggtaaacatttcatcagcaagaacagttctttgtctccagacaatgcaaactt

SEQ ID NO: 99939 - DNA, 1069 bp, Homo sapiens
agagagcccttgcatatcaaagaaaagggcagcaacctaaaggaaaaatggatgtaaaataagacgtcatcacagatgtatgaaaccatgctctaatcaccaacaatgacaagataccactttttagagcagactggcataaattttaaaaaatgataataaccagtgttgtgaatatgttgggaaaacagaaactcctattccacagttaggcactgtaacctgatacaaatgtcttaaagaataatttgaaaatatcttcacattttaaagggcactcatctttgaccaagacactccactcctagaattttacagtgcagatatacatttacagttatatgaagtaaaatgcatgtggcttactcataatagtgtaagactagaaacaacttaagtatctgtcggtggggagaccaacccaattaattgtggtacggccataaaagaattgttctgccaccaatataatacatgaggtagatctttatttactgacttctgtggagttggggtgggagcaagaagggactggaggaagatgcctcatttggggtcccctggggagcaaatgccaggaagcaattagaagcaaaagagatttgttggggaaatgtctgtgataggtcaaggggagagctgccgggagcaggcagaggcagccttcagactatgaagcaggtctgatgcctataaaagtagatgggtactgctctgagaagccctcggccaggccaatggggagcccgagagcaaagattgctgattagaggagccctgtgttgggcagaaatgttctagcactagtagcccattgtgctcagccattggcttgaagcatcccaggaagagcctggcctcaatgtaaacactgtggcagcctacataggtgcacagctggaggcatctggctgtcacataaaggctttcggttttacattatttatttgtattaaactttttcaataaatatataccaattgatccaaaaaatggagaaaaaagtttgaaaaaaaagttgaacataaaccccaacatttttccttcaattttcacaatacaaattgtc

SEQ ID NO: 99940 - DNA, 1040 bp, Homo sapiens
tcattctttttctctttttcaaaagtgcatctcgtagcaccaactgtttttctcggaaggaatgcttattttttcaccggacattctggctatactgcatcatcataaagttcttctgttttttctcctctttatttgtcaaactgggaaatggattcattttggttttcttcctcacaaattcttttcggtctgtctttctagccattgcagttgctagtcttgtctctttgtcagacttcggcttttaatgaaggcgttcaatgtcctgaagagaaagtaattcacccctgggctcttcatcactgtctatttcaatttatttcctcttctgggatttcccaggggcagcatcaagttcttttctcagttgggccatgcggattttctggaagtcttcctgagttaaaacttggctggtgctgatggctgcagctttggctttccactcctccatgggcatcctgttcagcttcttggagatttcttgctgttcttcatcggaagagtgttgcacatcaatctattcaccatcagcatcctgctcctcactgagactggtattttcccatccatcttcatcattttcagcattctcttctttctcaccttccagaacttctgctcctggaatgtaatctttagcatctaattctccatattcttgtactcttgcttctatggaggcctcagtaggcttaccctggaatttcttctgcagcatctgaggattcagtgttcggaagagctgaatcaaagttctagcacacatcattacattcttatccttgtgtgttttatactgagccaggtcttggagaagttcttcagtcatggccagagaacatcgagctgttttctcttttatagcattgattcctactgtcatgacttctccagaattcttgtcggtaaccaaattgtttgccacagtcataagcaatgattgaataatctctgggggtactaggtgatgagatgcttgtgcagcaaacggaggatctttgttacttctctttggtggggctgcagaaaccttt

SEQ ID NO: 99941 - DNA, 1031 bp, Homo sapiens
acacagcctattggatccctaggctcaatatgtcctaatagttatggaagtgtgaaagatgtgtgcactgcaaaatttggctccaaacatttttttcatcttattcctaatgaagcaacaatctgcagcttgcttctctgcaacagaaatgacactgcctgggatgagctgaaggtaggtaatgaactttgaattccatatgcagaggctgagggaggaattagtcactcaatagttattatgatttttttttcgtagcttccctaggtagtatagaaagcaaaaattaaaatgattgatgcaaagtcacaagtaagctaatttaaatgcctgtggcattataataaatttggcatgtgttgccatttattatttctactatttactagaaacctaaaaggcccttgacatgcgaacttttctaagaaattagcttgaattgtgtagtctttgatggtaatgtgtatgaataattcacttggaaaaatgagttccccagtcaatacccatcatccacttcttagcagagtttcctgttctctgccagcaataatacatgcaacttttatacaagggaaatgataatctatgggattggtcacaagttttaaagattcatgtatgctcaaggatatatccttagtaaatgttaaaggtctgtgtgattttttatttattattgctgggatgtaactgtattatttccaaatccattcaaaataaatttattatttagactgaaatgatttttttagtggaagtgtcagcaaaccttgttgacccagatattttgaggccatatattcgtctcagtttgaagagctaagtgtatatgaaagaaaatactaatctggctccgtgaaaacaaacttctgactgaagtatcttcccttaatctctaaaccttactattcagaatgtattaatcacatgacaaccttggcaccacacaagttttgttcttttgtaattaaaatcacactctctgtattcactatgatgctttgagagcatgattttttgtgtgttaa

SEQ ID NO: 99942 - DNA, 1042 bp, Homo sapiens
tttggtcacacatcccattttaaagatcctgacagcctccatacagaatcatgtgtcaagcttcagtgattgtggcttattcacagctattctttgctgcaacctgattgaaaatgttcagagattaggcttgacacccaccactgtcattagattaaataaacatcttttgagtctttgcatcagttatctcaagtctgagacctgtggttgtcgaatcccagtggactttagtagtactcagatcctcctttgtttggtgcgtagtatattaacaagtaaacctgcctgtatgctcaccagaaaggaaacagagcatgtcagtgctttgatcctgagagcctttttgcttacaattccagaaaatgctgaaggccacatcattttaggaaagagtttaattgtacctttaaaaggtcaaagagttatagattccactgtattacctgggatactcattgaaatgtcagaagttcaattaatgaggctattacctatcaaaaaatcaactgccctcaaggtggcactcttttgtacaactttatccggagacacttctgacactggagaaggaactgtggtggtcagttatggggtttctcttgaaaatgcagtcttggaccagctgcttaacctaggaaggcagctaatcagtgaccacgtagatcttgtcctgtgccaaaaagttatacatccatctttgaagcagtttctcaatatgcatcgtattattgccatagacagaattggagtgactctgatggaacccctgactaaaatgacaggtaaaaatcactctttgcttttgcctcttacagttaataaatcacacttttttgagcagagatatttttggtttgtgtcactgttaacatcttgaaaaattgacccagcatgtgtcagtatcatttctggcagcaaaggtttctggaaaagatcctgtattgttcacatactaaaaatgcagtgattatagccattttctatgtattttcagccccctaatgtactatatcatctaacccccaaatattttacaggt

SEQ ID NO: 99943 - DNA, 1029 bp, Homo sapiens
ggtcggtctttcgcctcctacagagagccagcctcctccttgtccccgccctcaaatatccttcagtgaggacaccggtgacctttgggggtggagagggaggcgcctacaagccccttcccctctcttcggccggacacaaagcgggcttttccacctagagtcccagcgctctcacctgcgcaccagccgtcgcgccgccccaggccgccaccgccagaggccccagaaacagatctcaagcagccgctgctgccgcggatcccgacaaccttcgcgtcgcgcgagggcacggagcacgcgcagctctgcggtcgacgccgggccgcccccactccgcttctccgggttttccgtgaagctccagccaacagcggccgtcaccggaaaaaacggggagcgaagtttattcagcgtatattccagcaaattgttgaaactgaaattttaaaagaacgcataaaatttaaataacatatcaaaatggcacagcttctgccttttggtgagcgcttgacaatgatttattgaatgaaagaaagaaatagtccactgcgctctgctctctgtcctgacatgaccaattacaaagcgcttggatttgtcgctcagcgccagtatcccgcctctctgtgcggttgtctggaaaatcaggatttttactctcccgtaactcccgggatcgggtttggaaaacggacatgcgccgtgagagctagttgccttctactaaagcatccgccctcagtccttcctgagggcttacagggaagtgcggagtttcgcagctcgtactcttcacagattagataattcacccggcatttccccatcctgcttctgggttccaggacaaaacttttattctcttttaacattaaaaaacatataggaagttatgttcaaacatggctatttttattaaaatttatccggcactgtgaaagctacctttcctttctcacaatctttcgcaccgaatatatgttccattcttgagctagtcattttccaatgttaagaaaacac

SEQ ID NO: 99944 - DNA, 1044 bp, Homo sapiens
gctaatttttgtatttttagtagagacagggttcgccatgttggccgggttgttctcgaactcctgacctcaggtgatccacccgccttggcctccaaagtcctgggatcacaggcctgagacatcacgcccggcctggcccattctttgttcaacccgtgcttcttaactagattcacagtgtattatcaatttattgcatgttctaaatgcaatggatatttgacaggtttttttctgtgcttttagttcattgacttgatgttagggcgtcaatttagctttccaaaaagttgaaaagagattttgtcatcccaatatacttatatgtaatttctgttataacatctgaaatgtagggttttctctgtaagtcttagcatccaatttaccactggtttgcgttttttttttaaaagttgtttactgtgcttcttgctttctcatatcttgtatgcatatttgtacttttaatttgttaaaagttgaactcaaaagtttgcatgtggacagcagttcaatactgacttggaaaaccttgggccttggtttaccaaagctttttgtggcaccttgctttcttctgtcttcccattttattttacttcttttatttttattttttgagacagggtataaccctgttgcccaggctgaagtgcagtggtgggatcatagctcactgtaacctccaactcttgggctcaagcgatccttctgccttggtctgtcaaagtgcaggaaagcaggcatgagcgactgcacccagctgccttctgtctttctttaatgagaagactaaatcaagagttctcagccttggctgcacgtaacaatcacctgggagctttaaaaacagactccagccctgtatctgcagagattgagaccctctggatgaaattaaagagccagtaaggagtatgagaaaacagaaacaacttttacgttttatgttgctatgttagattttctctcccttatggtgttacttaaaataatcgggattttgaaaaccatgaaaagatctggattaagaatgta

SEQ ID NO: 99945 - DNA, 1205 bp, Homo sapiens
ttataatatactctaacttagcatacttatgtaaattatatactttcagatatttggaaaattgatctttttgggttgtcctacacttcttaaaaacaggcaacaaaataaaaatgccactgaatttagacttgaattgccagctctggtagcaaaggctttttaacatttattctgtaaacctggtcactgagcttgttgcatcctgctgaaagcaactttgagggcctaggaaaataatcattgaagatgcattgttgctttttgtgtgcgtgtgtgcacacttgctttttaatgatcagtaaaaaaaatttagaaaagcctcaggatgttccttgatttaaaacttaattaagatagaagctaataatatcttttccatttaaatgaatgttaaaatgccagtattttaaagacaaagaaatttatgcaccaaaaacatcatctttgtggtataaacttcaaccacacctctaatctgttgcccattattttcaatatgaaacactaggatcttctgggtatgtgtttatatgaattacaactctcagctttggctgtatgattatatataactgaagtattatttatttggtgaaataggtccagagtgcttgacctcttttttggaaggcttactgtggaatttggaatttagggacagtaaagatacgttggataaataggtataaatctaaaaaaaaacaaaaacaaaaacaaaaaaccacattctgatttagtaacatcaatggacccaagtcagcaaacttttaatgcataacagtgccacaccccaaatattaaagaggagatgaatggaccctgtccctgggaatcttatagtcagggagaggaccagagttagttataattcagtgggctaagcgtgagagtagaggtggttcaggtgtgtcccagagaaggagcaattcacttggttcatagaaggctccaagaaacaggtggcatctgagttgggtctcagaggataactcaactcgctttaggagaggacattccacagtgcggcatgcatgggtgaaggcagggagagctggagctgcatgttcaaggacatgtgccaggagttggttatgtggtggcattacaggtgtgaagttgcctgtgccataagatggaggtttgggcaggggcactgatattgttcggatttgtgttcctgagcaaatctcatgttgaattgt

SEQ ID NO: 99946 - DNA, 1029 bp, Homo sapiens
tctcccattctgtaggttgtctgttcactgtgatgatagtttcttttgctgtgcagaagctctttagtttagtttgatcccatttgtcaatttttgcttttgttgcaattgcttttggtgttttggggacttgacaattttaagtaggcatatggaaaatttatattttgagaatgagacggcggagaaaatgttcatatggttatgaggcgttccttgcttcatcttttaaagatgctttttggtcatcacttggtctttactgttaaaaactatcattcatattccatgtccatggcttgatttctcattatgtcaaagcagataaaaggttgaagcaaaagaagtaatcagcaaattctctacctgggtaaatgccaggagagttctcttgcctggttgccctctttcattttcctcttataaatgtcccttgtttgttccttgatggctggggttgagaccttctcaggtgtggatagatgggaggctcctgtgtgagggatagtgggaagggagaagagaagaactgatgatgagtgcaagatcttggagatgctttcatatatgttggtgtttctttaggacattttctgtatgctagtcttaccataagtgcaagttcaaaacatcaaaatataaattacaatagctagttggccagattagatactatgtaatattatagctctgtcttatttttaaccaagtcagtgcttatttagatttactaacatatttataaatttcattgctttcagttgttttttgtatccatatatatattctttagtatttctttctgtgaaggcatgtaagtgatgaactttcactatttgtgtgtctaaaaatgtatttggtctcaccctagaaagatatttggttggttttagaattctaggttgagcattattttccaacaacagtttaaagataatttttaattttcttctggcatcttttattactactgagaaatgttttcattatgtattgatgcttaaatccaccttaaaacttagtggcttg

SEQ ID NO: 99947 - DNA, 1407 bp, Homo sapiens
accttgctgctgcttttttagtttagcatgtcaaagtgttatatttctgggtattggtttctgaactgcaaccaaagtaaccagtcctattggaagaagacagagggttccatgaaagatttcttcaacaaaaaatgaaatgaataaaatacatcatgtatttaaatgcattgagaagagatttttttaggcctgtcaggtagcatgggaatgatttagtcataggaatatagaaaactaaacaaaagaaaaatgatgcaaccctcagttctcagtaaacaaaagattgtgcaagataggaaattaagcatagtatactacgtggctcaactttttgttcttcttgttatagagatggggtcttgccctgttgctcaggctggaatgcagtggcacagtcataactcactgcggccttgaactcctaggctcaagtgatcctcctgcatggttcagctttgaacagaggttacatttcataatattgtgaactccaagttttggaaggctggggaaggaaacatgtgggagggcaggtataaggattaagtcttcattttccacataaagtatataaaactgaaataataagacattcgtaggataaacatagtgtttagaaatatgttggcaaattaccagatcaaaaagctaagtttcagtgtggttgcccatggtgagtgagagttggagtgagagagggggctggatgaggcagaagaggccattttgtttttttgtttgtttgtttgtttgaaagatggggtctccttatgctgcccagtctgatcttgaactactgggctcaaacaatcctcctgcctcagcctcctgagtagctgggactacagatgtgcaccactacacccagcttgagacctcactttgatatgtcgttttaatatgtgtctatgcattaatataaaaattaagtgcataaataaaatgtaggctgcgtacagtggttcacatctgtaatccctgcattttggaaggcccaggagggaggatcacttgaggccaggagttagagaccagcagcctgagtaacatagtgagaccccatctctaaattaaaaacaataataataaataacatttaaaaggaattaattaacttatgcaaatttttcacatagatgcagccacttttgactgggttgaaaagtacttggttagagcagggtttcaaagtaacagaaaaattgatgaacaccaaatagtttgacacttcatctgggttgtttattctaagactgcccttggaatggcattaattattcatgcaaacgacttacccatctgaccttcctgcatatgaatactttttttttgtttttaagggctgtggttctggccttgaattcttttttttaatcactattttttagagacaggatctcgtta

SEQ ID NO: 99948 - DNA, 1010 bp, Homo sapiens
ctaggcttttgtcttgctagtttgcctcaaggaatcacttaaatcctgtgtcctaggttttttcgtctacttaaatgggaacgtggtactgactattatcagtgctcatttgaaaatggctgcgttgattttgtgtatcacattgaaaagatttatgcaattattttcatatcaattgagttctaggtactgatttttctacacattttaagaaagaataaaactgaagtgcctaaacagaataaatcacaaacattttaaatggttatattccttactggaaataactttggagtgtgcaacctttgtcccgaagaatgattttacagagatttgtccctgtgaaacttttaaagtgaaagaagtacctctatatttcttctcctgatacttaaagtctgcatcttccaattcctccttaatttcatgtattccttgtaagagctttatgttttaaagacatacagggtcaatgcgagtttgcagagtggttgatgctatgcccaaactaacataggatgctgttttcccattcagtatcattgttctattgctttgctcatgctggaagctgtatttaagtaagtatgtgctgatttcgtgaaagaattgaaataaaattagtaaaagttttcacaccagcagtcacccaatgagttttatctcaggcttagagcttttagataccttctcactctgtaaggcatctgctctgagtgttgatgactttgaaacaaagttcttggacttgaaattaattttttttttctaagagttctctctgcctttctggccagacacccagttttctaggcttcattttcccagtcctttcctcatgtgataatagataaactagtctgttctttttttggatgactaaaaatgtgtaaatacagctctggcttcttatcctcctttttagtctcaactttccacctgcctccaagaagtttctgcctacattgatccctaaaacttcaaacaaagaactgagtttatcatggctt

SEQ ID NO: 99949 - DNA, 2439 bp, Homo sapiens
cacaccctgggcttgccaaatgatgtctcgtccttcattctttagtcacttactaaacgcattcctgctctgcagagcatcttgaatttactcctcttagaaattcaagcctttattgtccttgtttttatgtccatgttaatctctgaggacctctgtgcctctcttctcttaccattccagttcatctagacaagtgccagggtaatgttttcttaacatcatattcatcatgttacttccttgcttaggtgatcagggtaattccttttgtttaaatggatctaatctgaactctccagctagacgtaaggcattctgataattactctccccttcctttttaacttggacccatgtttgttttcatcttggaactggggaacgtggcccacttattcctgtgaaactaatgcatttgcatttcctgcagtcatctggcttttctgtggttttccctctgtttgctatctctcaccttttcttccttggtccacacccttcagctttttccaagcttgaccagtgaatgacttgctttttctttgttacacatctaaacctttcccatattgatttctctcttgctatgtgtttttttgactgttatgtgcagtttatgttatgttttatatatatttccaatttgttttctttcctaagaacatcatcttgaggtgatatacatctgcttttatatacattatgcctagccacattccctgggaagaaggagctgtcctatgcttctttcatatctgcacagaccttgaataatctaaagcaggggtgtccaatcttttggcttccctgggccacactggaagaagaattgtcttgggccacacataaaatacacttatactaacaatagctttaaaaaaaaatcgcaaaaaaaatctcataatgttttaagaaagtttacacatttgtgttgggctgcattcaaagccatcctgggcagcgagttggacaagtgtggtctaaagcatttctgaagtgcccagtaccccccactttccttgtcccaaagatgacaagtttcttcgtcttggctcatagagaacagggaagtcactccagctttggattatttcttactggtctttttttcagttccagtcagggaatgttgtaatcttcaatttgtggtatatttgtttttttaaaaaaaaaatcatctcaacctatttctccttttaggagtccacagttccactttgaaaatatttttaataattcttttgaaaataatctctattaataatcaagatgacaatccatagaatttgcttctatatgcttcagaaaagtaaaatgtttcagtataatggttttgattgtctagacattatattttattttaataatttcttagtgttagaccttgatacttttaattttttccaacatatgtacaaagcatgtgtttttattacttattctagtgtaaaaattaattcttaccagaaaagtaaactcaggatctcttaccaaatagatgaactcagtaagcaccttggattctctctgagggctgtagggggcatcattgttccaatgttttataaagtatcttcccgctgtgatctaaagaagcacagcaactaaagtgcttttacagtcgttggctcgtgcccacgttactatgacatcctaaatgcctgtttgtttgcctggtggttgtatgtgcacacttgcatccctagccttttatgaatgtgtatatttagattgcttctgtcatagagtcctcctcactaggatgtaccaccaccaaacaccgagggaagacagtcccaacgacgaaaactatccaaagtggccccagggaaagcattctcagagtgacacaagactgcctcttcagtacttcctttccagattcaggaacctggagatgatggtcggagagtaaggatcctctttgtcctttgaaagctttgggaccccagttccgccctggtcccagcagtaagggctggagggggccagtcgagtctggaaagaaatccttgaagtcatagttttattaccattactgctcatccgactcacctttcctttttgttattattactcttagtttgggggatgcttggttgagaaagtgagggatggggtagcgattgagagtgtccttgcaatttacagtcccagagaattccatggaaatgacattccattgaaatggcaaaaacgtacagcagcgtagccgtcattagccaaataatgtaacgatgcatagtgtttgctaattgtgctttgagatacttctctagtagtaggctcttggaatatccatgattaagtaatacaggaagctaggcctctatatgtgtcactttgtcccatgtgagtgtcatgtgacaaaaacactgattttcagactgttggaaataatcaggttattaatagttaccttaaacactcacatac

SEQ ID NO: 99950 - DNA, 2129 bp, Homo sapiens
atgttgtggtttcacttttgaaaactggatgactttgggtgaattttattacccctttgagcatcttatttcttcagctataaggtaggattaacagcagtgtctgttttacagggtttcttttggatatcaaattaatataaaagacataatgctgtgaaagtgggaaaataacattttatgcatgtcttaggctgtcagtaattattttattatcttacagtgacatgctgtatggtatttgagggacttggccttgacttatttgttcctggtctcataattcttgggagtgaggagtagtctaattcttttcatatgtgagggctcaattagcaaatctttatttatcctcatcatgcaaggccctgggttaggcactatagacacagatgaggctgatgattgcccatccctaacctcaggtagtttgcagtgagaaattaatgtgtcaaactaatatcattaaataaaggttagtgaaaaagagataccagagcacccagcatagctgggttatgaccagatgagcccagtaatttttttcagacatgtttctgaatgggatgttgtggaaaagccatagggcagccagtctgttgggtgcactatttgttaatcagtttatactttgggctacagtggcaggtggtcaggattagaagttagggttgttagattttagtccttgctattgattcctatctaggggcaagtcagctagcctcttttgtttccgttatctgtatctgtgtgacaaagaagccccactattctcatatttcaatgggtcagaaaatccagctgggcagtttttctgctttatttgtctttggctggggtcaatcactcagatgcatttggttactgaccaggctacaaagctctagaagacttcactcacatgtttagttcttctcaatgataccctctctcttcacaaggtgtctcatcactcagtaatctggcttgagctcccttacaacatggcatctagcttccccagagcacatgaaagtggaagctgccagcttcctaagggctacctctggaactggcacactattatttccactgtattctattgggcagcaaatcacaaggtcaagaggagaggaaataactgcctcttgatggaaggagcagcgtacctccagaggagggaagggattgttggtggccatctttggaaattgtttagtgtagttttcttatttgtttattatagttttcttatctattaaatgagatgttgaattagggagtttctaagggcctgtcaaactctacatttccgtaatactatacttttttttttttttgagatggagtctggctctgtcgcccaggctcgagtgcagtggcacgatctcggcttactgcaacctgtgcctcccaggttcacgctattctcctgccttagcctcccgagtagctgggactacagtcgcctgccaccacgcccggctaattttttgtatttttagtagagacagagtttcacagtgttagccaggatggtcttgatctcctgacctcgtgatctgcgtgccttggactcccaaagtgctgggattacagacgtgaaccaccatgcccggcctggtaatactatacatttttatttaagggatttttgtgtgcatggtataatggaaataatttggcctttggaggcagaaaggcctgggtttgaaccagggccttaagattgaccagcaccttgggaagtgacttgagtctttctgagcttttgtacacatctgttaaataatagggttaattaaataggattaatgttaactcacttctataataattgtccatcttagcacagagtcacgacccagaaggtgttagcacccatcccttttcccttctttgttacctgatacaggccttttaaagccaacaatagttaaagatattcattgaggtttttttgttttgttttgtttcattcaagtataaaaatgtttaggtgtttaattgtgttttgcagatgctggcttatttttctaagaccaggagttcaaacaaaactgttaagtttgtttatctgttttgttgttataaattgtccttagaacattgttgctattaagaaagcaggcttaaaaataacttaa

SEQ ID NO: 99951 - DNA, 1020 bp, Homo sapiens
ttcatcgattgtggcacggggcagtgtcacatggtaaatacatggctgcccatgcccacccttgagcatgacagctgtcagaaagaggggcatagattcccccagaagttacatgatagtactttacaatttagagactttgctggaaagtttctttttggcagtctcatagacaggcctttttacagaacatagtaatgagcacttacagtttgtagagaggcctcgggggcatccaagaggtagctggaataatctgacccttgagaagcttctcttggttcctggggatgacgatggtcataattaactgctttacttacaacttggcaatgtgttttattatcggtgtgcattttgaagtgttttaaggtttttcacatccctcactgtgtgtgtgtgtgtatatatatatctgttatgataattaaaccaaatattgtaaaagtcaagaaaagtgtcaaagaggatgtcattctactaaacttttttgaatggctactctttgatgatcttgtgagttgggagaggacccaaccttcagtagcatgaatctggtcttaaatcttaaattttgaagcactgaatgcattgcaaagtgtcccatagtcatctatgagtgtgcatatttgcttttgactcagcattccatttgtacttcctccacaacaaaaaatgcattgtagctttagtatttttaattgtcaccaagtagtactgctagccattgtgcaaagtctaccaacagctgataaaatgattacatttttaaaggttgctggatggaatcagatgttgctgtatcagttcctatgccgcgtgtgtctgtttcacttcccataatgactgattctccacctgccatgacagtgcattcttgatctgctgcgccctccttgggttggggactggaatatttatttttaggaaaagttaaaattatccagagaagggtgctttctgtaaaatttacatgaatcagcctcttattgcagagatcatgggagatgtgtgtgtgtg

SEQ ID NO: 99952 - DNA, 1036 bp, Homo sapiens
aactgcaaccccagccccctgggttcaaacaattctcgtgcctcagcctcatgagtaggtgggattacaggagagtgccaccatgcctgactagttctttagtatttttagtagatgcggggtttcactatgttggccatgctggttttgaacgcctggcctcaagtaatccacccacctaggcctcccaaagtgctgggattacatgcatgagccactgcgcttgtccaagaaaggtaattttgtaattagtatgggatgagttagtttgttctctttagttttactagcaaacaaaatgattatcaagaaagttctatagtattgattgggtaatacataaatgaagaattcctcatgaatgttgcaaaaatgcaaattaattttaattacatattacaatttaattttaaatttttaaatgtttaattacatattaaaatcctgactataaaaaaactagtagcaaaaaggaaaccattttaagataatgctttcccaaaaggagtctatgataatgatggagttcaggccatgcgaccccaaagtatggcacatgtgaaaacagcagaagcattagttcattttcccctccccccacccttctcttctaaaggaggtcataaaacctaggaaggagtttctgaccttcctctgaagcaaatcgtaagaccttatttgagaagtgccctctctatacccagaggaaaggaacatccttatctctgaatacaaagggtcacagagaaaagtctgaacaaacatactttgctatgtttcctccagtttattaccattagatcatacttttaaatctaatcttacttatccacaactatccacttattcatcaaacctagcataaaaatatacacatttactcctatattcagatcttcatttccttaggaaggctcccatgtcacacttatattaagtaaatttatgtgcttttctctcgttaatttgtcttttgttttaggggcctcagtcatgaacctaagataagtaagggaaagatatttttcctccccta

SEQ ID NO: 99953 - DNA, 1052 bp, Homo sapiens
agtgtatagtgtcactgaagaaatagccttcacttcctcctttagctaggagtttcattcacttatctaagaagtatcttgaggggagctcattgctttggtatctattagtagtatgccaaaaagaaatatggccagcttctcaatggtcagctttttagtaaatagatgggtgaagacttctctctgcttgtcactgtgtgaggcacacagtgataccaaaattgtgaggtcattgagggaaaggctatgtctgatgaattcgtttcacatctccagtttttaatataggtgctccataaatatttaatgcctaagtgaatgaaagaataagtaagacatagtcctcacccttaagaaaagatatgcttttattatcctcaagaaaagtatatgctagttagacaactaagtcatacacatatgaaaaagatagctagtaacacagggcctcatataatcccaagtattcaaattgtccatatagtgcctgaagaagatgacagtggcttggactgctcagaaaagcctgtggagttggtggtacccatgtgggtacacctgaattcctgacaaagaacagagaatgcacacagggagagtgcactcagaaatgaaggtagaaatgaagatggcttgaatgggggacctcgaagagacagggctcactgaagccaaggggagacctgggaaacagagttggatggaaagagtgactgaagattgtagaggggctttaaagcccaacatacgagattagccttatatttttaggcattagggaatcaatgggttcttgagtcaagaaatgattacattaaaatttacaagcttgttggggttattgattgaccacatggataattgggctgttttttgtatctcttatgtgcaagatgcttatacagttgacccttgaataacatgggggttagggctactgactctctctatgcagttgaaaatccacatacaacttttggttgggcatggtggttcatgcctgtaaacccagcactttgggaggctgaggctggcagatcatttgaggc

SEQ ID NO: 99954 - DNA, 1441 bp, Homo sapiens
atgccaggtgggcaagggcatccttggatttaggaagagtaggaggctgccttttgcattagagctgcctctggcattcccagggttttgtctggctgggcccaagggctagaaggactggaggagtcctagctgtgcctatcactggccattgcccctctgcagcagagtagtcagtatgcagcacagcatctgcctggcacttaagatgtgcatctctgtgggacacctgtggcttctagcgaggacagtggagggagagtggcccacactagtctctggactcttatactttaggccccctacttctagctcagtgatttaaggagaacaccaagttgtacataattttcaaagggaggggagttgccttctttagataaacctatgccaaaaggaaatctttaaaaataattcccatcagctcttattatttctgggtggtatttttttgtacattttccaaagcagtgaccctaaccacaatgaggacagtcatttggagcttttgcaagctactcattcaaagaaaagtgcaaagaagggtgcctctaggtttggttacaaaactctaccggggagtgggaggtgagagtgggaaaccggtgaatatgcctcctggccccaactttttaaaatgtatcctttgaggtgtattctatttggtgcattttcccagattttgaatgttgccccaggacaactgtcttaagttcgttttggcatcaggacaaatgagaggatgtttcctgtttgcctgactcttgccccaacttctttctctgttctgttaagctcttggctaaattctttcctcttgtattccacattttaactgacattagggcaccaagtgcaaaaatctgcaaacagttagctttcctgtttgagcattctggtcagattatgctgaagttaaagttcttgtagcacggaaggatcaccctctgtacaatgcattaagtatttaataactgtactaataattacaaacacttttaatgggccacttgggagccttaatgtggttaaaaaatgtatttcttctctgtcaagttaacttgtgtcaaattgagagaaattcttctaagcagctttgaaaggtttgagcttcataagcctaggagcaagtagcatattgtgaaagtagtttttatgtaagaagagacaacagaaatagggtgagtattaatgtagtgctttgtacatttcctttatagttttgtattttttaggtggagaagtgtcccaccaccctgttgcatccgctgtatgtcaggttaagcaatttttagtaggattggcagcaaaaccaactttggaacacaggactctctggcttcaagatctcttctttgggaatgtggacaatttggatttggccatttttgaagtattttagaaaataggacactcttgaggggcagaattgaaggtcgat

SEQ ID NO: 99955 - DNA, 1815 bp, Homo sapiens
gaaggcttgcctgtgctgcctgccccagagtaaggcggtgcagtctcagacgtactggttggagatttgaagcacagtaatacactggctggtcctttcatttgttggttattctttgtgtttctggtatgagtttgtacgtttagataatccagtgaatctttgagctttttctttgtgaggtctgtttacacatttggaaatatcagtgaatatagttccattggtgttttgcggctttcagcttttgagttccctctgaagctactgccatgacgttaacctttgatgaagttaagagcatcagagggtagaagaaaatgattaccagtggttaacgatgtcccgatttgttaggagtttgggaaaagtgcacatttccatggagtctgcgtgctcacttggtgagaagctccctgaccacacgtaaattgagaaatagattgcaaaatcagttttgattaaaatgggaatttgagcctgccactgagaagcaaccatcttgctataaattatttatggcatgagcataggctttagtatagaggctgtaagcctttttccatcttgctttaaaaattgatttgattataaaaagaaaattaattttgctattgaaacaaatctttaaaaagggattttaaagtgactctaaggtagaaaaaaaaaattaccaagactcttccaaaaaaccaacttcgtagctggattctacaaaaaaagcataaatgctgaaccctgattaacacactttatcatattatatacatgagatatttcttacagagagtaccacagtggtgtaaggagcatatttttgtgaagtcctcagctttacaaacatatttagatttattcctgtgctaactaggttatatcatatctcccagtttagactgcacatggatagtccactgagcaatgtgacatgaagatggatgggcctagtagacagataccaggccgctgccaggcttgcagcattgactcctcttctgggatcatcacatgcccacttctccccacccatctcagctgttaagtcttgctgtgggatcagaccctcaccccacctcctacctgccgtgacttgacagggaagttcatttgggagattaaaaatgtagatggacagatacagtttcatgaatgattggaaacatggtatattctctgctttcattgcatagggtttgaggtatatcttgtggaccaacattatctattatatgtcctctatggtcttatttgtctttgcctccttgatctgacatggcctgaaagaagtgagctcagtcttctatgactcttgtgtttctctttgctgtttttaaaaattgtacctgttcaataaatgtttattccttatttcccatgtgccaggaatggttctcagctgtggggacccaattttgaataagaccgacaaagtccttggtctcatggagatggcatttcagtcaggggttagacagacactgcacaaagaaagaaacaagacaatttcagataccgagacgtgtgacaaagaaaataaaagatggtaacttggtggctagtgactggaggtggttcctgcttaaataggatggtcagagagacttgaactttcaaggtgaactctgagtgaaaagagagagacacctcctagcgtctggaggaagtggttctagcagagagaacagcaggtaccaagcctttgagacagaagcaaacatggtgtatcagaggagcaagttttacagtcttttccctgcacatgtatgctgttggattctcaggatagttttcatttctttatagcttttattctcc

SEQ ID NO: 99956 - DNA, 1032 bp, Homo sapiens
ctggcgtctggggtatgctcaataaattaaaaacgagtgcatgaacagaggccagcagggctggagcagagcacaggggacagtgggttggcatggtgctggagaagctggcaggggccagacctcacagaggcttgtaggttatcatgtacttgtaggagaccacataggttaccatgaaaggagaccacataggttgttatgaaaatcaagataatttttagagcagaagggggagctattaataattacgcctggatagaaaggcgtaaaatgcaactgacttgggtgtaccgggatatggtcaacctcttaccagcttcctaggattttagtctttattctgagaggagtggaaggcccctccaaaggtttttagctgggatgaggtttggggtgtggaggcagggcatggcatgatcgctctggcaacagactggtaatagattgaaagtgagttgttgcaggagagagaccagggaagacggttgcagaaggccaggctggagcaggtgatggcttggcctggaggcatggaaggggttagaagtgatgaattgcaaatggctgctgaggaagggaagtgttgaggtctcagaattggataagtcctagtgccactggctgagtcaaaacaggaggagggagcaggtttggaaagaacgtgcaggttttgtttgtttttttgaggcagagtcttgctctgttgcccaagctggagtgtagtggtgtgattttggctcactgaaacctccgcctcctgggttcaagcagttctcctgcctcagccttccaagtagctgggattacaggtgcgtgccaccatgcccagctaatttttgtatttttagtagagatggggtttcgccgtgttggccaggctgatctcgaactcctgagctcaggtgatccacctcctcggcctcccaaagtactgggattacaggcatgagctactgcgcccggcccaagaacatgtagttttgtctagggtaagagtcaaggtatgaacttaagaggtttcatccttag

SEQ ID NO: 99957 - DNA, 1120 bp, Homo sapiens
tatggcgaagaaactattgacagtggtgaaaaaacaaaaagccacccttttctgtgataattgcttttaattagcttttggagctcactagaaaaaagatccccaccccccaaaaaagattttataggataatacattttcattcaaaggataatattatcaagactttgctgtcattattttgcaaagaatacctggtgacctaaagctgagaaaaggaaggcacaaggttctgtatggtgggatttatcattcaggtaaataactgtggactcttctcttcaggacttttaaatatttagcaagtcaatcaacatctcctactgccacttaccttcatataattccactcctagcttactaacgcatgttgctgtgattcaaaactgttcactcgtttccccaaagtgaccaatagtcacccaaggggacctcaccccaaaatcttctgacttgacttaaattaacaatgttatggaatccaccattccaggcctgttctccattccctttcggctttgccaccttagacctttatcggccttagacctttcttgttaatattgagtccgttttgcccaagattcagttaatttggaatgctttagaataaagccctgggtgtgtgaatcacctcatagccaaagcgtgaggctaggtttttgtttttttaggagccacatgcagctgcgtggatgctcatagtacctacttgagggcagcagggcatgacttagcaaagctgtgcagtgcatgacaggacctgcagagcagtgctgcactggcagctgcaaggggcaggtcgctgtagcaggctgagcttgcctctcaaaaccaaatggtcggtttgctgctgcttctttaatttgcccttttaaaatgtatattggccaggtgcagtgacacacacctgtaatcccagcactttgggagcccaaggcaggcggattgcctgagtctaggagttcaagaccagcctgggcaacatggtgaacccccatctctataaaaagtataaaaattagccagatgtggtggcttgtgtctggaatcccagctactctggaggctgaggtggggggatcacttgagcccaggaggttaaggctgcagtgagagt

SEQ ID NO: 99958 - DNA, 1090 bp, Homo sapiens
gattacaggcgcctgccaccacgctgagctaatttttgtatttttagtagagacaggttttcgccatgttggtcaggctggtctggaactcctgacctcaagtgacccacccgccttggccttccaaagtgctgggattacaggcgtgagccaccacgcccagccacatgcacacttgttttttgagacagggtcttgctctgttgcccaggccagagtgcagtggaacagtcgtggctcatggcagcctcaaccacctgggttcaagtgattctcccacctcagcctcccgagtagctgggaccacaggtgtgtatcaccatatctggctatttttttaaaaaaattttgcagagatggagtctcacgatgttggccagactggtctagaactcctgggcttaagtgatcctcctgcctcagcctccgaaagtgttgggattacagacgtgagcctccatgcctggcctgcatcacccttttttattgggcagcataaaagtgaccttgtggagttgggggtggcaaacatttgagtcccaggttcgggcaccgagcagtctggctgcttaggagtatgctggacaagccagttgcccaggacctggaggcttttgcagtcttccagctagacctgcagtcggctgagttcaggaggatcctctctccccagggactaggagtcattattcccagatggccttggccagcaaacccagagagtgcccatggtcattgatcagcttgtcactctcccctaactccatccccagagtgtgctgctgtctcaccctgggcttctgcacacactgcttctgctcccctgtgtgtgccctcctcatcctccagcctgtgctcaggtatcacctcctccaaggagccttatctgattctgtgtagcttctctctcaagagcacttcccttcctctctccctgctcaccctctggtgtagcagcactcattgttccagttgcttccctgcctcacagataggcttcagtttcattgaggacaggagtcttgtcctgttcagcacccactgcagagcctgtcagagcacaagtgttgggagaaataaatgaattgtt

SEQ ID NO: 99959 - DNA, 1093 bp, Homo sapiens
agacttttttttaatgagttgttccagttagctcagagccctgccctctcattagctccatgaagactgatgacttattactacatattccaaagacaggtccccactggggtcaggtagaactggttggcattcctgccccactaggagtaggaggaaaagtaataggaaggaaaatcacttgcccttaaattgatgtggggtgagattaaaaacatttcttttggtgatctgttcggtcacagtatttctaacgatgacaactggatgggaggcctgtagttccattttacccagcagaagagaacagtcctgacccagtgaaagtcatttattccagcatgttgggaacatagtacctggggcactggttttatattgtctgaacggtttagctgccacatagcattgggtaataatgtattggggtgagggctggggcatacagggagacagtgagacccctacaaggctgtactttcctttgacacattccaggtgaagtcttagaaggcagcaacttctcctgtgtttgacagataataataatcaggaaagctctccctaccccccacccccaatataacagtggctgcttctcataggagtaacatacatatttttaatatgtaggatgacaaggtatagtgggaactgtttaccttagcatgtactgtttgtttctcaagaatttcaggtccattacaccttagcaatgaaaagccttctcttatctaggaagtacttgtagcattcaccagcttgtctgttccttttaattttttttttttcctttggccaggacctcccatcataatgcccggattttcaaatttctagtaattgagtttcacattcctaatattaacacccataaggaagctggaaggagaaaatggatactagttatcttaccgactaaatatcagtaagagccctttgattttgaagtgtttgaaggatgagtgaagaggccttgtttaggatagtacactgtggtctaacacattgggaccgtgatttgctacctgaatatcttgggaatttgggggattctaacccaagtgttgattaaaaacaagagagctttcat

SEQ ID NO: 99960 - DNA, 1034 bp, Homo sapiens
tcagacagagtctctctctgtcgcccaggctggagtgcagtggtgtgatctcggctcgctgcaacctccgcctcccaggttcaaccgattctccacctcagcctcctgagtagctgggattaaggcatccgccaccatgcccagctaatttttgtatttttagtggagatggggtttcaccatgttggccaagctggtctcgaactcctgacctcatgtgatccacccgccttgacctcccaaagtgttgggattacaggcgtgagccaccgtgcctggcctcaattctgtttctacatgtgtttccatatgccaatactgcactgtcttgattactgtagctttatagtaaatttgaaattgtcttctcattcttttaatggaactattttttttttcttcccagcagggtcaaagctggcatttactagttaggatcaagaatcttttttaacctagccagtgcaaacatgattttaaattgttataaatatctgaattttaatgaattaataaagtaccattgattttgccagtggtcttctccagagatttagattaaattaaacctttcacaaatttcttgactctaattgttccattttaaccaaatcaatgaagataaaagttatcctcattatagtcaaggtcttcataggcagaaaaactgtggtgagtcaccagtatttgcaaggtatgactgagggcactcatgggtctttaattctcattcagaatcctttccctcaggttctaaagttgaggccaggttaaaatctaacctcctttgttcacccttccaggcttgtcccccatctctctctattattctatgcattctgaactctaggcgtcagtctaccctaccagggttgccaggagccaaaaggacttgtctgagtttttgcacagatatgaatgcagtgccctccgcttctcagtcccagcagaatgctcctgatgctttaatcctctgcttgaatgtttcccatccttgaggatctccctcctcccaatttggtttgttactcccc

SEQ ID NO: 99961 - DNA, 1006 bp, Homo sapiens
ccctttcccctttcctttcctttcctttccttttttttctttctttctttctttctttttttgagacggagtctcactctgtcacccaggctggatggagcgcagtggcatgatcttggctcattgcaacctccgtcacctgggttcaagcaattctcctgcctcagcctccctcctgagtagctgggactacagttgcacaccaccacacccagctaatttttatatttttagtagagacagggtttcaccatattggtcaggctggtctcgaactcctaacctcaggtgatccacctgcctcggcctcccaaaatgctggaattacaggcatgagccaccgtgcccagccactgcacaccttatttctattggctttccaaacagcttcacccagaaatctcattgatcctcatctctaaagcttggtttatcttaccaagcctacctaccctctctataccttaggaagctaccactcatgtagtcaacaaagttaaaaaaaattgtcattgtcatcagtcttctctgaacacgtttcattgacaaccaagcctgtctctgattttcatctctaaagtgtcccttgaatatctctctctcttgttagtcctatggctactgatgatccttgccttctcccacttgactttgttaaaagaaaaactttagacaaaataaatataacagtttatttgagcaaataacaattcatgaatcaggcaacactcaaatccacaagagattctgagagctccgttccagcagtatgggcagggggctttcataggctgaatgtggaggcaaagtaaagaaattacttgattggttatagctaggcatttgccttatttggatatggttcaatagaaagtccctagttaatataacgaatttgctagttggttatctgcgattggctgaagctccattcaaaattaatcagtcacaaggaatgcctctaagttaagttttggtttgcttatttatgtaagggttcctagta

SEQ ID NO: 99962 - DNA, 2584 bp, Homo sapiens
agacagatgagaaaaggaaagatccagatgtcattaccatcttgccttcctttcattgaatgccgaggagtccagttcagtgatttattcagtctttcccaatgagaagtcaatggttttgttttaagaagcagcaataatagattactatgagtatggtgtaattttaccatctttattgtatatttaaccattttcttaatagttggatcattaattcctaagaaaagctgctgttttcccagcctgcttcagattagtagtttgccctccagggtcggggagctctctaagactagctaaccaaggagatgataagtaaagtaactaggaaaaacattgataggtcacatttttagattttatctaatattcttcctcttcctctaaagtgttacatgctcattttgaaaacattgatcctattttctaaataggagttctaatcagaaaacagctgactgacacagaggggaggctacagaggttctgcctgggggtttcctgtaatgtaatggtcccggggcgcaggtggaccaatttgcagcctcatcagctctccctagagctttgcgctcaccctgccctattgacggcaaacaccgaaaggatgggaggagagaagagacgtatgttttatatggatgtgcatattgcagtaacttaaaatgaacaaaaatctggaacaaccattctgtgtttatagttttttgacacctttaaacttgtttttcttcattttatacagaactctgtgtattccctgacagatttgtggtttgtgtcagtcagcttgcattcagtcgtgatcttttagcaagtcagaatgaagatttggtgagtatgaaaaaattctataaacaaataagtctgcttaaatgctgagttactgtaaaaaatagaaaacaagaattgtctgctgttgtcattcagctgatgagcacccaacgcatgttttaagggaacaagaagccctacctgttttacgtggtaatatcaactaattcgtgtattgttcttcttttcctcaagaccattttaatcagcagtaccttttccatatcaactgtaaatgagaaagcaacacatcacaaaagctgtgatggtgcttatgatagtgtttaaatgaaataaagaaaagtctttaagtgaaatgaagcaaaatccacatgtttccactggaggctttcattggggtcagtggcttttaaattttattccatggtgaatcaccgacattttcatgagaaccagtacttttccccagtgtattatttcatagctgatagggttcattttctccctctctctctctctctctctctgtctctctgtctctctgtctctctgtctccttctctgtctcccttttctcatgctaagtcttgagttccagcagggcctgcttctgttttattggagttgtctcttcagacaaatagataaaactgactcagaattgcagctgactgctttgtcttttaagctgaacatgtacacttgagaatctccttgttgcacgtgtgtgtgtttcctgcagccacagtccagtctgcctgacttctacacagactttttttcatatttttggacgtatgacttgaatctttaagaaacagggacatatgacttgaatctttaacaaacagaaaaaaaatccaacagacattaaccgggccatgaagtgtgacatgattattatgcttctaaaataatttatgggaatattagattacccttgatgtttattattttttaatccgtatgaaatctgaaatttggcccacatcatctaaaaccagcttcttatctcatcttaaataaatacataagaagagtgtttcagaggctacaagggtgaatagagacccaggaaaagtaaagagcagagaacttatatttaaatttagatgtctgcgtttggtgcagaggaaccctttgcaacagccagtgtggttcatatttcctcttcttcatccatcagtcaaactcttaagaatacacattaaatgaatgaggcaaatttggtgaaaagtattaagtttgtcctttgaaatatttccaggatgttgagttatcttcgtaaactaataaatactaaagtggcaatgccattggcatacatctaaaatataatatagcttaactgattcagagcaaggaagaaattgatctatgggtttaagaaaacaacaattaactgttccagaaagtattattactttcaaatgaaatacaggagaaattagatcttctatctgatatgtaatattaatacttagtatcttaaattattaaggagggattaaaacatctcaatacaaatgaaatattatcccccttaggggccttggtatttatacagatgtaagttttctataccggctgtcatataaatcctataatctggaggacttcctaaacattgagaattttcattctgaaactctcaccggtctaagccttttacatgagtgagttcagtttctttatctttaagatgttctgataaccagtgataacatgaccagagttaaccacattaacttatgaggaaaatgccatttccatcatgaggctcgtt

SEQ ID NO: 99963 - DNA, 1023 bp, Homo sapiens
gccttcccatctgtttttaccatcacattttaacataatttgctaagtcccagctctatactgggaactctggtaggcaccaggaaaacaaagaaaagtaagaaagtgtgttggccctcaaggagcttacagtttggcagatcaaggctgctgaaggatatcctggtgacctaaaaatgtcattcaaatagggcctccatttttcctaaatatttttccactctgcacctgtatctttaagggttccattggatctcttctgccgttcctcagaaggaaagtccaaaatcccccagccctactttttttacttttaaaccgaagctctcaaagtctgtgatccttttggaaattaaaaaatgatttgtagtgctagtactgcctacaagtggacatatacattaagatatttgagttatctgccttatactctttatttgagttgtggttcaagttgtgaaaatagctgttaagactctgcagacgtaggccagccatacaaggctaggtcctcactgtagcatcatctaagtagaaggattaccgggacatcctgacaagaaacaatattgaagcactaactcagctgcttctcttaaggcacactactgtttagtggtaaagaaatgtccttctagtttttgaatacaaaattgaagtgaaaatgagtttagactcattttcacttcaaataaactattgaaggctgagttatttttagcttggctgttatagtcctcagctgtgcataatccagccctttgtgggccatagccctcctctcattcaagggggagggtatcaaattatctcaaaaatcttttctcacatgggatttctattggaggaagcaaataaaactgtagctaaataaaaactacaaaataattttgcacaaagaagaaattttcttgcagattaaaaaattatgattagaaaaacttccagggtagttatatttgatcttaagaaagatgtaaatagaaattataagctaacattataggccttatgtttttagaa

SEQ ID NO: 99964 - DNA, 1128 bp, Homo sapiens
actaaaaatacaggaaaaaaaaaaaggtagccggatgtggtggcaggcgcctgtagtcccagctactcaggaggctgaggtgggagaatggtgtgaacccaggaggcggagcttgcagtgagccgagattgcaccactgcactccagcctgggtgacagagcaatactctgtctcaaaaaaaaaaaaaaaaaaaaggtcatagaaagtctaaggcacttatacagtattaatttttatcaacatcatttcctttcttctctgaagaagtcttcatttaaatgcaattaacgccacattaacagactgctgtacaatcttctccttcctgcttgaaaggagaaaaatacctgacactatcattctgcttatattattaatattttcccaagaaactcgactccctaattattttctccacttgccagctcaactttattttgcagctataaaaactaaagtaccaaagagttaagtgataaacccccatttagccagccagtcagtgctggagaaagagacacgctaaaggcaaaaacttgtgaccttcagtgggagttctgttaaccaacatccagaggaggaagaggaggaggagaaggagcagcgaccacccagctcaacaccttcgatttccagtagctgccagcagactcacattgagatacggctttggaggaaaaacccagtcacctctctaaagtacgtaggaatcaagagacagcagacttctcaggcttgaattcctaaaagcccatcttcatcagaacacccacagtgatagcacagagagttcattagttagcagatgatttagaattcaatactcattttcccaaggatacagtgtcataacgggatgaggttcccagactagttcacaaaagctgttactatcatgagctctgagtcttggaaagaggaggccttagtatctgtatctcagggaaatggcaagagctattccttccacatccctgggcagaaggccagctcagagcagaattttgaaatgagacaatcatctgtggtgtgttctctctagctcttagacccttttcccatcagtgcccagggctactgtgggctctctcctggttagccctactccctgcgcagctggacttcat

SEQ ID NO: 99965 - DNA, 1050 bp, Homo sapiens
gctttaggtacagcttgatcagagacacaaagaatatcattaagactccatttctcaccatctttggctccagattccactgtgttggcttcactctcagcttatgtgtggtggttggtcccggcagcctcaggtccatatccttccagcagggggaggtgaggcctcttgccaggacagctgtggctgatgcatctctttgaggcttgttagttcagtagtttgattggcctgagccacaggccagtttctggagtcaggtagggaaacaaggtctcttgaaatgcatggacatggatgggggttgaagatgtgattttccaggacaaaatctgagcattgcttccaggaactgaatgagtatccaccatagaggcattattatcatctctctttttatagatgaagaaactggtgctcagagaatatgtcagttgtccaaatatcacagtcaggtagtgaccaagagaggactggagccaaagtgctcttctctttctataagtccatatctaaccatgatggcaaatgatactgtggccattgggcaaagtgaagagagtactactgcacagggagcaggcctcctagactcatttctgcccctgactacatgcacggcctcagtctttgtgggtctcattcttctcatccatcacatagtgacaatacctgccctgatgaatactccttggggaccagatgagatgttgggaaaaggactttgggaatcatatgagttcttcatgaatacaaggcactcttgccttctctccagccccacatggtttgtgaaggcatcacatttgaaaatgtgttcaacactctccagtttccaaagttgcttcctacacctcactgcatttaaatttcccaaacagtcctgtaaggtagatgagaaaccaaccatcaaggggttgagaagctggccctgggacaagccaacaatgaacatgagaccttagactccactccgtttcacctctgtgctgggactcgtgtgccaggagcctcagcctgattcgatcaactctgggtgtatcattctca

SEQ ID NO: 99966 - DNA, 1032 bp, Homo sapiens
cctcagacccttggtgttcactcttccccctacccaaaatgctcttccccgtctgcttttgtggcttgtccttcactcaggtctcagtgtaaagcccaccttgttacctaccacagcctttcctgaccaccatatctaacatagcaccccatggccctttagatgtttatttctcctcataacatcataaccacctgacatacgtttatttgtttgtttgttgtcttctccattgagataggggctctgtgaaaccaaggtcctttccctcaagggcctcaagcattgccaggtacagaggtcaatattgcctgattggattactctgtcggattctgctcagttatcaattctgtgtgcctttagggcagaagttcaataattctgctgggtatcagaatcactgaggggcttgcccaaaatatacatgccctgaccccacttcctagagatccaaattctgaggtggaacctagaacatttttaaacacacttcccacatgattttgatgcatgggataaatggaccacactttgcaaaaggctgtctcactgtaccagtttgtgtttgtttatctgctgctctgccttgctgagtgttgttttatgtatatcggcagtttttgaatcacctgggaacctaaatatagatgccctcgccccatcccagatcttgtgaatcagaacttccagggatgggtcttgggaatctccattttcaaaaggctccctctgtgcctctgatgcagccagtcttcccactggcctgcgggagcccctcctgtgctttacagacttcgtgaggaggttggaagctcaagagcaggtgttttctctgccgttttaggccaacttctctccctatctcccattaatccaacagtgttctgttcaaaaccagtttttagtaagtcactgtggggtgactccttggtttatccacagtttcaatgtgcctttgggacttaaacattgcccagtatttattttttctttctttctttccttcttttttctttctttctttttttt

SEQ ID NO: 99967 - DNA, 1766 bp, Homo sapiens
ccacctcagcctgctgagtagctgggactataagtgcacaccaccacgcctggctaattttttgtagagatgaggtctcactatgttgcctaggctggtctcgaactcctgagctcaagctatcctcctaccttggcctcccaaagtgctgggattacaagcatgaaccactgcgcctggcccagtatttctaactgcatctcaaatcagcctgttctctgattagaggcaagaaggatatcttaggcacctagctcatcctggtggggactctctttgcagtcctttctatcctggaatttaaaatgtgtttcccaggtcagcccatacaggaatagggtaatatcacccattgtcatactcaaacattcatctgttcagccttccccttggttctgtactgggacatgtgcattgactgtcttcatccttggggtactggtctccagagtacccccaaagatcgagaaaagtcctgatcccttgccttgtggcctgcctaggctgcttaggttgctgagggagggtatctccctagaggccagggctttgccctatttctgtttggttttgccctagaactgtgtactgacattctttatagagagaaacttttgaaccaaaaatcttaaaagtataaccaaaaagtaaaacaaaataggaggtagggtggacatgaggcagatggctggaaatggagtataccaaggaatgatatttgtagaattttattccttggcccaagtgtaagagctaccttccaggttgtaaggaatcatttatgaaggccctggaagatcctgttggttaatctaattttttaatacctgagtctccatggactcagaatgtcccattctggactttggatggccagctctttggtagcctctttgaatatgttgggtttatcttcattctttacaagacatgatgggatcattattcatggcagaatctgaaaagtagtagggttgtcccgtaagcccagaaggcacttgcaaccctcttagcacacattatatatctgcaccttggcgttgtgcctccggataagcctcagattgcattttgatgccagatgtgagaagcctttagtaatcaggatgactccctttaggaaatcctgttcccaggtgatagctgcttcctaaggaatacttgtttgggggcttgggggttgggggggcgggggaggggagcagcaccagaggctctgatttagagacaaaggggagttaattgaccctagaaatgttagagtaagagatttctaatgagacctgacagctcaggggctgaagagggagtctaatcttttttttcctgcccacccagtcttcatacaaatgtaaatatgcctccttcaacaaattgccaaatgtggttttaatttgtaagcgggagaccccgccttgcttttctctttctttttttctttttcttttctttttttttcttttttttttttttttgaaaactaagtcacagattttacactttttgaacaggacatttcctcctgtcactcttatcaccttttctgttgtcctttttcttccaaggacattttcccccattgttgtcagaggaatttgggatgagagccgactgctctgcttcttaaaggagtttttgaagttcccataggaaatgcatagtgctctttaaactgaattttaaaaataaataaataaaggcagtgattgaatttaatacgagatttgaaagagtgtcactatcacagcatcatactttatgtggca

SEQ ID NO: 99968 - DNA, 1050 bp, Homo sapiens
tccagatttgctggggaagcgagagggcaggtagtgcctgcctcctttttcaggtgtaggaaatgtggtagagggaatctggaggaaacagtgcagtgacagctttacaaaccataaaatcatttttgtttgtttcagtgtgaaaagaactgaaacaaaaagcagtgtcacgagcaaatcgcagaccagaagagacactgtggaaacatctagtgactcagtgattgcagagatagcaaggaggaggaatgatggtcaggcttcctccagtcccccatcagaatccatgggacaagcaaaggattccataaaggcagctgagagccactgggggcttcctgttcaaaagctggaaaaagttaatcagacccagccagaagacactagtggccagcaaaaacctcatcctggggagcggttaaagacagggcttctaagcaggagccccgtctgtagctgtgagtcagcatcaccatgtccaaaacaaagtccacgagtggccaaaacccaacagaaacgcaggaactgcagctctgcggaagacttcgaccaccacgggagagtttctcttggaagtgatcgattagtcccgagagaaataatagtggaaaaaagcaaagctgtcagggttttgccagcttcagagttgtcagatccagggttacttttgaaacaagatttggcaaaaaccacgtctaaggaagagttgcatgttttggaaagtctctcctccagacatcttatgaaaaataacccagggcaggcacagcaaaccggcttagccacaaacactgaaagattatctacaattcagaacagcccaaccaagaaaagaaagaaatacgaaagaggccattaacaccgaagaggtttgtaccgttggagttgaggacatagtggccaaacctgtgacaagagagctgcgaatatagatgccgggattttaaaggaattaattagaatgactaatttaaataggaagtgtgttatctgtgttatggctatggtttgttttcaaagcatttcaaaccgggaggctatatgcttgtt

SEQ ID NO: 99969 - DNA, 1035 bp, Homo sapiens
gcacttgtaggcagcagagctttctatgccagaggtgtcagggatctgggttgctattggggttcttgttttgatgccaataagcatcttcaccggaaagaaccttctagatgtcaccaaaatctttacacaggctcaaagacaaggagtctctgcatccatctgtgaattttctacagcaaattttccctgttttcccttgaagatagcatttcctggtaccagtttatcaaatctcatgttcttctgggccccagttgtagaaacaactttggctcttgttttgcatgtctgtcaagtctaattccaggtcctaataatgttgttttagaaaagctcactgaacttaagagaaaccttaattttctgctaccagcaatgcaagtctgcctaggccacctgccttgccctccatgcaagggcactcctagcagagagatggtgggagagaaagtttggcttcacatttagccccttctcagtgccaaagaaatggccactgtgcagtgacgacggccaagcagggaacttccttgtagggaaggcctctgaggaagccggaggtgggaatacaaagtatttctgaaatgcccaacccactgaaaacctccagaaaatggaagtcaaaacagtatctcgtttcataaggagagaaaactatctcaagacttgagtgtcctggagtcctccaaggccaggtatctgagcttacctcatttggcacacattttataaaataggggtttggagggatatagaagaaaaaaactgtgttctattctcattattcgcaggctgtagacagctgtcgacactcacagaccacacactgttgtagacttcaattaggcaccaagttttgtacagtcctatagttcattcttgtcttaaatgagcttttctttctcctgcaccggaagccggctctgaattgatcagggaaaaagctaacaacgatttgtatagtcacaaccaaatacgacacctacaagtgacatagctggtacgatcctttttagaagaagcctatgttag

SEQ ID NO: 99970 - DNA, 1027 bp, Homo sapiens
ctttgggagccatcgtggagtcctgcctacgaccagatccaacagcacttagctcttctctgacaggcccagtttaatggtgtaacggtgagaaagtagactgtcagttggaatctagctgaattccttaatcttttaatggttacttagagcaaatactgaaagcagtgttctttcctttacctgtagcccttttcatgaatattaactatagtggcacacatttattgtcaccatgacagatgaggaaactgaggcacaaagaattttggaaactttcccaagttagtaaatggcagtgcctagaatctgggtctggcaaacctcaaagcccagaaactgtgttgttagagcacacaggtggaaaatttcaaaccaggagctggaaggaagagctgcagttggaatcaaagaagtttcactccagaatgcatgctcttgaccactaagcacacagcctggctttgcacaccaagagggtgaaagtaacagtccagtgaaggaagggtcaggcccacgtggaggctgaatgctctgcaggagatgttcaggacctcttttgtaactgcactgcagccaacactgtccgactgagagctcacaggaagcacggaaatgacagggcgtggaggtggagaaagccagagattgtggtccctcccggccccttcccactccctttactttactagaggcacttttttcttagtttgttgcaaacctgtaggacatgtcacgtttgcgctcttcctttctgctttatgccttgaattctttaaaaattcttctaaagtaacatcactgcaaagccagagagagcccctgagggtatctgattgttcatgtcctgaacttggagggtttatgtttctgtcttggggatggggtttttccaagtcactcagtgtgggtgcctgggcgcagaggaaacttctacatagaatgtacttctggcctaccctgacacgacaaacaggttgtggaggagtagccttttggggatgtcaggtggaggaagcagagctgc

SEQ ID NO: 99971 - DNA, 2635 bp, Homo sapiens
aagtcaaagagcctgtaggagctgccgctccacccagtctctccagggataagagtatcaaggtctacaggggcctgatcccagcatttgcttatcaagttgtgaagtgaccatatgcaatgatgaaaagggacttgtccctgtggcccccctcttagggataaagggcaggagaaccactgttggtattcttttgttcctgcgatgatgcttttttctttctttcttggagagttaattggttttgtgcctgccttacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattatgagaacaagaactccaaaatgtctaaaataaggacacacaattctgaagtagaagaggacgacatggacaaacaccagcagaaagcccggtttgccaagcagccggcgtacacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaatttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatcttactttgtaaattctgatttcttttcaccattcgtacataatactgaaccacttgtagatttgatttttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggcctcttctgagcttacgtagttctaccggctttgccatgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggcctgtagtgtcgaggtgaattgtttgtgagcaatcaggggaactggccacagcactgaaagggttttaaagggtttggaattggtgttgggaaacgagcaggga

SEQ ID NO: 99972 - DNA, 1047 bp, Homo sapiens
tgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccagtatgtaacaacctttgttttttttttgaatggtggatgtctgcttgcttgctttaaaggaggaatgccatgagctaggatctacttctccctagcttacattcctgttttataataaagtaagcttgaacttagccagcctcaaagagaacatctcagccttttgttcttcctctcaatcttacacgtgtgtgggtttttaaaaatcgttttagggtcttactacggagcacatttgcagtgaattgaggaatttgaatattttgaagaatgtttccgctgaatattcaatctacatcgcttgcgagccttccccttcagcgaacaatgaaatacatgtggccattgtaagtataagacccattcacacctcattattcgatggcaaggcagttcggttaaccagtgtctgaatggagcaaattcactgacaaaaagctttgcagacacagattgtcgagtaattttgaagaaaggctgctttgagtattcctctgactctcaagtctgacaattgtttttccagtctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacaggtaggtgtcaagtgggactagtttgtgtgatgatagtagatgatctcattatactattcaataaagccatcaggtcgagggattatctggcagtgccctaccctcgcaggagctcccaatttaactgagaactgagggcagc

SEQ ID NO: 99973 - DNA, 1191 bp, Homo sapiens
agtaaggctggggagactggttgagacttatccttacatctgggatctaagactgaggtcgtgttcaatttaccagatcactctgcctcggagcctccatatctatgttggaacattctggaatgttgctaggttgggtgattcctcttttctgtaggagtttcttccccactttcacctagtaccggtgactaaatgcccatgtgagggcattaagtgggtaaggcactctctggaagcttctgcttgataagccgcctgtctaatttgagaaacagccctgatggagggtagcaggtggaggtgccaggtgcattgtgtcaggagggagccatgaaaactgctgaacagtgcttgtctatggcttcacaagtccttcagttctttttttgctttactttgtttcatagatattaatgactgtgagagcaacccttgtagaaacggtggcacttgcatcgatggtgtcaactcctacaagtgcatctgtagtgacggctgggagggggcctactgtgaaaccagtgagtctgccactctttggggagctctgggatgtatgggtcatgttggagggatcccacttcaacgtgggaaaactttctttgtactggaaatctctggaagcaagaccgcagtgatttctgcactgggacagtatcacttgtgtctcatttgcatttatgagtcctgatgatagcttatggggaggagcttctgctgaggacctatagaattagactgtgtaataaatattcctgcttgcaaggaaagtcatatttctactttcatttccatgggacttccagaggcccaccccacatcttgcctaacttgtggcattcaaagtaacccagttgggagctcctttattcctggaaaagcctgattgtgttaaagtactacgactgtggctgttctcagaataggatgttggatgtaagcagtaggaaaggcttggctctcgcctgtcgtgaatggtcctggatctcgtcttcagccgattgtctcccctttgattctagatattaatgactgcagccagaacccctgccacaatgggggcacgtgtcgcgacctggtcaatgacttctactgtgactgtaaaaatgggtggaaaggaaagacctgccactcacgtaagtggtagttggccttggatgctatctctgggacccttccctctgtctt

SEQ ID NO: 99974 - DNA, 1030 bp, Homo sapiens
ggagaggtacctaggcttgtccagtgtgaatgtctcggtgagagaggggcgggtgcaggcctaagtctggtaagcagtctggtggcttgtgtgtttggaagtctcccagcacccccatcctgtcccactaaggtagcgcatgtatctgttcttggaaggaacgtcctcgtggaatcgcttgttcctttgcatctgcttcctggagctggccaccttccaattgtggttattcttcttgcagccatggagaggctgccttcaggggaggttgtcacttactactggattctgtcatagggccagggggccccagagaagaacctggcctgcagagttcctttggctgtgagacagggctgtatatcagaatcacctgggctgctttacagtgtaaatctctgggtcccccagattccctccagaatcggggagtccatggtctttgataaacttctggaattctgcagtgcagccaggtctgagaaccgctgtcatcagcaccccaggtgtggttatggatgtggatttctggggtcagattgcctgtgctggtcctaggcccccacctgtcacttgcggaactccagcaggccacagaagctccccgggccctctttaaatggcacagtagcaattcccatctccgaggttgtcataaagacacaaaagtgaatacttcataaattgttaggagttgtctctggtcagagcagaagtggagaatgcagcctctaggtgtgctattttgggcaaactctgtaagcaaatgagaggaataaggttttccacctgtaaagaactatttttcctgacttcttagctacttctgagccatgatgaaacttttctttaaaaataaagattaggcagatagagatgtcctgtgttcctcctgggcggatgctccgtcagtatccagctgtctttctcccccactgcttaggttggggattacatgaactggggcagtgggggatttaaagctaaaatcaaggcttcggccttatcgtcaccgtcccacttgtcctgc

SEQ ID NO: 99975 - DNA, 1017 bp, Homo sapiens
ggagaaagtcccaatggcagtgctattagtgattccaagcctgctgcctgctcagatggatatcagcggaggccgactgtgatttgtgctgctgtcatcagaacacacatacagctatacaggggagggccctcccagccagaacaacaggctttgtttccagaatttagccctttctctttcgaagtcccacctccctctccctgcccagacacgcactgatggccttatttacttaaggtgcgactttcccacacatcatttgcatagtctcccagcccagttttccctccctaccttgaaagaaagtcaaaacagaaccttcacgctgaggaagttcaggttgtgtcctgctgcagaaatagttgaatggcaagttacctgcaagttgtcttttggattatgtattacacaggttattttttttttcacccccacatgagaaaatttactggtttttgttgttcccaagtagactgagtccctttccctgggtatacatgcttgcttattgcaagcctgccaataatatcaaacttaattatgaatcatcatctgaggaaagtcacttcaatttctcatgagaatcttaatcatatattattaaactgggataacttggttggtgcctcttttagggtcagtatttttatttgttttcttttgaagtcatccatggcctcttgtggttgcttttttatgcttggggattgaggtctctttaattaggtgaggttgggtcctcagctgcctctccttgcctttatgaggcaacttgaagagggctagtgatcctgaatttggaagagaataagggaagacggtgagaatattgccatttcgtaatcagttccctcttactatctttcaggctaagaatatcagccttgacagaatggctacacccttacctcccactaacgtgggtgtccgcttttgagaaattatttagattgtaattttgttcttatcttactcctttagtcacttgtcacgttgacattccattttacataa

SEQ ID NO: 99976 - DNA, 1050 bp, Homo sapiens
acacaggcagatacgttcaaggaatgctcactgtggctttgtttaatagtaagaagcccaaacgactcacatgcacacatgtcagggactaggtaaattatttattggtgtttccagacaatgaaatactgtgtacccattaaagaaggtaaacaagtggtaacaggttgtctctgggtaggggcataaacttttcatttctttgccttttttacaacagatagaattttgtagcaggtgcatatgtttttattttaaaaagccaaaatggtcagggaagaaggctgcaatgtgaatattaacatgattcatcactttgtctctagaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagaggtatgtgtgtgtgtgtgcatgtgcacgtgtgcctgttgcttttagtgtccatttatcaccccaccagcaggcaggtggcatgcggctatctcaggtggggtgggattttggctgttattctgggcctgcagtatgaagatgcggagtgtagaagatgctgttggtgccccatccagatcccctttactggcatccccatcccccaggtgctgtgttggctgccaacagctcacagctgctccttctcaggagactcgtccttggccaaaccagtgcatgccccattcctccagctcacagtcagtgattgacagacatagggctacaaagcccagcttcctttgccttaaaacagtagtacaatttgcactctagagcttaccctgggattaggctgaaatcagactccagttgagaccatgttcttgctcagctctttcccctaccccatctgcttccctcaattcct

SEQ ID NO: 99977 - DNA, 1029 bp, Homo sapiens
ggttgagtgcctcctaataggaaccttggagggaatcctttttctctgtagggctgggcaggaggaatcctcctgccccaggagaccctaatcccctccctgaaacagacaggaaaaaaagtccaggctttgttgccgtcactgtagctccctgccctcaccctgtctctgcctctgagaaagaagggcagttcatggaaaatcacagagccaggcacgtagggctgtgtgcaattcttttctctccaggtggggtgatgtcggtcagcaacttctgaggttttcccagttctggcgaggatgagcctggtagactgcttggtcgtccaagttcttgtgcaagacctaaggatgctttcctctttgagtattaaactgagttagtactgccatgccagctcagtcccggcaccttcccttgcagtggggtttgtgggtattatgtgtttagcgcttgtgcaagtctgtcaaaactcctggtatcaatgcatttaatcagaggattaattacaacaatactgttgaagtggaggacgtgggcctcaacgtgaccagcaaatgaagggcttaattatacagaatcagccacacatctggcctcattttgactgtgctcttacctcaaatcagtagagaaatataatttcttgctgctcttagggaagagtcctgtaatttgcaggaagtcctaagaaacttaaagaggcagtaaataaggtataactttcgctaataaaatagtaacaacagcaatgaatttggacctgtggccactaacaggagagggctgggtatgtgccctggcttgcccggttttgcttgcttttctgagcattttcccacagttatcagtgaacgaaatggaatcctactctgctttgagtatgaaacatatttcggctgaattccaaggcagggtctatcacaagatatttttatattcagagatgacctgctgtgtcactctgagagcgctaagctggccttgagttatgaatgaaactcccttttaccctccctttttctctt

SEQ ID NO: 99978 - DNA, 1121 bp, Homo sapiens
aatagaagcatgtatggaccagggcagttgtttcacctggttgaacaggcttcttggtatagacaaaggcaaagcactcaagaagacatctgtctgctgctgaggtagtgggacagacagggcataggggactcttttttacttattttgcctcaaatgctataaccctgcaaggagaaataaaagctagcattcgtggagtacttactatgcggtaggatttattttcagccctttatatgtaatatctaatttaaacctcatagcaacctggaaaagcaggcactattatttttccgaagaggaaactaaaatacaaagtgtttgagtgccttgcctaaattcacgtagctagcaaaagatggagccaggcagtcagattccataggctgagaccccttatcagaaaattggactccttgggagcaggtttcttgtgccagaaactgcagggaaaaaaaggtacagaatctctaacagaaagttagtttctgatagaatttagatgattttgttagtttgtctataggcatggaatcatttgatatagggggagggtgcatggtcatatttgatgagcacacacatttcttcaaatttccccaaatttgctcagagtttggaaacttcagtccatgaagctcttgtaggtagttttgttcttttagaaaaactcattctccagagctggcaaagcagagccctggagctccccggggacagtgggaaaattttttctcttaagtcaattgagctaaagcaccagcaaagtggcattttatagaagagccttgatcaaagtcagtaaagctgagtatatttccttaaacatatctttaggtaaacagggaggatgcaataagattttaaaataacacagttcagtcagtgaaacaattgaagatacccatctgatttaaactgaattcagcaactgcaacaatactatctgatgaaggagattttgtgtcacatgttcaaagctggctttaagtcttaagaggtatcaaaataatcaaagtgttttctttgcccttagccatcaatgagaaagaattataaatggttgaaatatttatgttaatcagaaaccgcagttgggaagtgaaaagaaaggctgt

SEQ ID NO: 99979 - DNA, 1020 bp, Homo sapiens
atgattatctcccttcaactgcaccaaggtcttatccttttgccactggaggaataaaagaaagagagattcctgattagaggatccaactccaactagatgtcccctaaatgattctaaatgtttctaaaggaatctccagttcttcctttggctccttggcagctgctttcagaaacatagcatgaccatttaaaaaatctcaacaccttggccactcctatgttgatccccctaccttaaccactggagtaacattcatgtgcttaaaaaattaacatagaaggaggcctcattgggaagaatacgtccgtcttgaaggaagaattgttaaccaagaacaaagctacaggagggtttctgttgtgttttcgtccaagctctttggaatttttggtcttggacagacagatcaacacagcacatcgctcccaagtttccaaccccaaaatatttttcttaattttaaatctttgaagaagaaatgctacatttgcttcatgattttttactattgaacatgatggaaagagaatgctagcttctgtctcttgtcccccagtggaagtggggccaatggaaaaagctgagatgttgcatttttctgcccatctattgagattttcaaagtacaccactaagaaaatattcctatttaaaaagaagttcatccctgttacttatggctttgatgattaaatttgaaaaagacttataattctaaaataaatgaaccctcaccccttccaagattccagatcctaaatatccccagacacttcctcttagaggaactggcaggataaatttgtatttgccattctccgaaaatgctgatcaccaaaccgagctgctttgaataggcctttcaaactccgatgcatctcataatattttgcatgaaactttccacccatagtattaaaactctgtttattctgcttttctctcttccattttgttctaattttgcatgttctgcattttattccataccttgtgacttgttcctcttccttc

SEQ ID NO: 99980 - DNA, 1764 bp, Homo sapiens
cttagcttttaagttgttttgttcctagaaagtactctgccaacattctttacaaaatgttaaactgcttgtaatgttatactttaacaaaggaaaggcacaattagtctacacattctcctacttccctgcccaaacacatgcatccaaagatcaatttgaaaaaatgttcatttttttttttaatgctcaaaacaggtatgctatagacatctaattccattttgccttgcaaggaactgttaaaactcttctgaacaaaatagtacagaaataggtcatttaacatacttgtttttaattgtgttttttaaaaaatattttaaactttgtaagttatcagactttagtcaattccaaaatacctttaggattccagtgatttttgagtttgtgttgggagttgaaatggttttctcttactaaaatctattttatgtgctgtttaaatttctgttaactgagctatcaagcaaatcctgtaaggtgaatttttcccatttactgtgagaaaggaatactggtggaaacccctatcatgtgatggaccttgtagttccagcagtgatgctgggctgctaaaataataatctttcacttaatcttcccttctttcatcacacatttaaaaattacctttaagccttttcaatttagtatctctttcagcatagttgtccagtctcaaattccttgaaggtgtgcattaatgtacatttatcgacatgtcctttgtttattcaaattaagcaaatacagttgagaatttgttgttgctttgtttcttttaaaaaattaaataaaaaaatatttcctgttgggagacattttgggaatcactgaaaaaaattaagaaagtaaaaatcaccgtcatatcatctaaaaagaaacaactggtaattagatgatgtgcttccattttactctgtttgtctgcatagacatacttttgaacaaaattggcctttaattttatctgtagttttaaatattgcacttttatttaatatgaagtaaatattagagacgtttcctttttctgtaaaccctttgaaaataagatttttaatgatgaatacacccaagtttattgaactagttttctgttgttttacgtattatttttagttttagtggcttgagaatacagtattaaaccctttggttgccaatcctagcacggccacttcctaagtgaccttaattacctctttaatcgcatttccttggaataagggtcatggtgcctgcaccatagagttttggtgagatggaatgaactaagtagaggaaggccagcagggtcgaccaaatgacgtaggctcagtacgtaagagtggacacacaggtggagctgagaaaaatgcccttgtctgaaagtttaaatatttcggatttactcaggttagatttatagcagtggaaatcctggggcagaggtgaactcttttatgactcttgtggcttgttgccaaattgcttatgccataacattcccttacagagtgtatggtctacctgtagtgtgtcagcactccagtgttcatcatctttcctgatttttctataaaaatatgatcttttaatttattttttggtagctattgaaattgatcatctgttttttttcttttgttttcctttttgggagctctctcttctggtactttgcctactttaaagtggtgatttaaaaaaattaaatacccgttttatctaaagaagattgagtgtttatcatgtttttagttttcttttttttct

SEQ ID NO: 99981 - DNA, 1022 bp, Homo sapiens
aagaccacttattttacaataaggcttttagactttaaagctgtatgcatatattaaatttaataatctttatctgaaaggtgagataaacaacattttggaaatatgttagatctttttacatttaattctataattgtacatggatatgaagcgctcctataccgccgctgcctcctcttccttttccctagttagcgagttctaccaccatttgttaaatagttcctcctttcttctttgctttgtggtctttattgttttttaagatcttgactaactttgaggtctgcttcagttttaggtcttgcttctctgtgtgttgatcctctagtcttaatcaatgccacatctttttaatcatagatttagaatatttagaaatacctggcagagcaagtcacactatccttttaacattacaattctatgcccttgtcctttcagataaagattattgtatttaatacatgcacagttttaaaagtctaggaggcttattgtaaaatagatggtctttcatctgcctcttcttccccccatcccttactctccctccccagtggcagctactttggattgtttactgtttctcctgcgtttttcactggggccatttgtagggtcttcttgggctggtcagagagtggtcttccagtaaagttttgcactgaggaaagagtgtaggttccagtgttcatggaggaatctggctggggtttcagcattctctgtgtagagtcatgttggagaaggttcaccatacagacttacctgtttacctactcttccaagaacaaatctctagtcttgctaggttctaggattgtctgccaatggtctacagtgaggaggtggggaaggcatcttggaattttagagcttctcatgcagcttttactgaccttattttaacctgtcacccttttaccctcagtctttgagcagactggagtgagtacttctcggcttttctcactgttggtatagcattccctctctcaagttggctgagacagttg

SEQ ID NO: 99982 - DNA, 1322 bp, Homo sapiens
tataacatattcaatgcatgagcatattgtcttggttggggtggtataggagatgtcactagggatttttcacaagcaaatattccaagttatagctgacactcaagtcacatctttacctgttggcagtatttgatgtaatttgttattcctccttttttaatattcttccttcatttgattcttgaggacaccacacactgttgccttcccttctataccgctggccttctggtttcttttcagttgtttttaaatttgtgttggttttctcttctcaccagcctatgaatttagaatgtgccaaggctcagttctcacccgcctgttgtcacaaatagtcacagggctttaataaaatactgtgtagctacttaagactcctaaatgtatatttccacctcagacatctccaactacttttttgacttcttaacgtgaatatgtgaaagacgcttcagcctaaatatggccagaacaaaatttctgatctttctctgcaaacctgctccatctgcagcctgccccattttattaggttggtgcaaaagtaattgtggttttttgcattaatggcaaattacttttgcaccaacctagtgggtgttagctccatttttttcatgttatttaagcaaaaaaaaaaaaaaaaaaaaaaaaagaacatggaatcctcctgactcttctctttctctccaactctgtttccaggttgtcagcaaatcctgctgttctgtcttcaaaatgtatccagaatcagtttaactacttttcccatccgtactaccagcatctttgtccaagtctcctgcatttcttgcctggagtattgccgtggcccatggcctcctaacagatcactggtctccttttccttccctggcttctctttgattttccatctgcttaacatcagagtgatcttttaaaaacataagtcaaattgtgcttaaaaccctccagtggcttccatgtcactcagaataaaggccagtgttcttatgattcataaaaccttacatgatctgggccgggcatggtggttcacgcctgtaatccagcactttggtaggctggggtgggcagatcacttgaggtcagcagttgaagaccagcccggccaacatggtgaaaccttatgtctactaaaaatacaaaaattagccagacgtgatggcatgcacctgtaattccaggtacttgggaggctgaggcaggagaatctcttgaacctggaaggcggaggttgcatgcagtgagccgagatcgtgccattgcattccagcctgggggacagagtgagattctgtctacaaataaat

SEQ ID NO: 99983 - DNA, 1020 bp, Homo sapiens
agttgacattttttaattccttatttttcctgccgaaatcatcactgtcattatcttttaaaataattggggctggcgcttcctttccagagaatatcttggtccctctcagttggctgtctgcacacctcaatcctagaatttgacatttggggcctaatcagaagaatttcagaacaagatgtgaggggttgttaagtttttaatgtccaaactaaattaaattattttgagttattttcaattcacttaatagttgaatgcaacatatggcaccagatgttggtactggatcattgggaagacatctagtagtcagtagttatctatgtgaagtttttttcaaccttgaatactgtatgaaatgcagattctgatccagagtctggctgagattctgggtgactaataggctccctgtagatgctgctgctgatccttcaactacattttcagtagcaagaacctgcattacttgccttattaccgtggtaagaaaaagtagccgtcagataatttttctgtcttgattttaaacagccatgctcatcagtccttacatacattggagtaataatgcccttctttgtagcactcttgtagatgattcagatttagcgctacttcatttaactagtattgtcagaattttctacaaaacttatttttctaaataactgatatctgtaattttagaaaacatgttctacaatattgcatacttctctttctcaaactgttacatccactttactttttttctttaacttagtggtgtaagagccatgtgttttggagacttcttggtgatgggtattgagccatatgcaaaatgagtaaagatcacaaacccttctaagttcttgtatctgtgttttatgttttttctattttgtctccatccagctaccaattaatagtatgtctgcctaaaagcagctggtttccctttccattctaattgattacttctgacctgaaaagccagatactagatttgttagaaatatttatgagatt

SEQ ID NO: 99984 - DNA, 1033 bp, Homo sapiens
attacaggggaaatcttagaaagatatggatagtctcgtacagtttcatgtggatttatacagaagaactttcattggtaatacagaagtatgaaacttaaagatacgttatatatttataaaaaagatagttttctgtctggtgggtcttctgcaggcaccagtatgtgttaaacaggttatagaatcagcttctttatcatgtacggtactagacagtgtggtagttcaccaagtgatcataatctaattattattctaagtagtatttatatgatttttcctaatctttattctagcacagcaaagtgtattactttaaggttatctgttgctctagggatttcagttcattggaataagtaaaatgtttgttgaaaaaagtattcagtgggtcaacaagttggacagtactcctacatatagttaaaatgttgccatacattgtttactgtcttctgaaaaataagtactgtagttagttctagaacttaaaagtatttaattcattattcatcttacagttttgaaatataattgtcactgacaagaccttcacagtaggggatagggaaattaaaggcaagtgagcatgtgaagtaccaaaatgtaaactaatctgctacttttaacctttgtaatcttttggagatatatgtacagaaaccagttttacctgcaagtatccccactgcatgaagtcagctttgtattttttatagtgttttctgttgctgaggagattgctagcactagttcagcattttgtcttcactgcagtcaagtaggatgttgtatcattcctgatatatacataattaggaaacatgaacaagaatggcagagaattacatctcacctaagtcatttgatgaatcatttgacaagtatcttttcccacagatgcattgcctatagcagatattgataaagctttataaaattatacatgcagtccacaaaatgtggtaagatcagaaatgagtcaggtgccatttgctctagtgctgtagttgtgaaagcggtggcctgc

SEQ ID NO: 99985 - DNA, 1955 bp, Homo sapiens
gtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaagtgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaagg

SEQ ID NO: 99986 - DNA, 1073 bp, Homo sapiens
cctcgatcactgccttcaatggccccctcctgcctctgctgtcccacgaactcctgtaccctccctgccccaagcttctggcaggggcagtgcttttccaaggagtagcatgaaggcagttctccaagttccctttatccaggaaaccagagcaaggcttgtgaagaaaatggaatttttcattaaccaagaacgaaaatctcaatctatgcacttaattaggtcagatacccattttcctctgagtcttagttctttgaagtcagaggaagccctgagcattggagacgggaaaagaaaaaatggaaagagaattgggaggaaagctcctacatatacacacactcacgaaaaaaaaaaacaaaaccaatccatcaatccttgttaagggttgaatgcagataaagttagctatcaaccttatcaacactgaaaaaaaaagcttaaaataaaaactagggcaatcccctgaaggaagaaagccttggcatcagtctggagacttcacctaccttgttaagagctgcattccctactctcttatgaaaatactgaacatgtttgcagtcaattccatgactccttggtgatttagatattttagttaaagcagaagactaaaaatatagatttgaaattttcaaaggcaatgtgaggggtagcctccgaagagccagatgccgttggggaggcagcgttggagcggtggtccagaggtctgggctctaatttcagctctgacaccggcctgcatggtggctccagaacggcactgtccagcacacctgcgagagatggtgggaatgttctgtgactgtgtttcctggacactggccactagccctgtgtgactagtaaacactcgaaatacatctagtgtgactgaggaactgaattttcacttttatttaatttcaatttattgagtttgcatttacatagacacatgtggctgcaggctaccatgttggacagcttggcgccaggccttaaccctccatcgacttgatttttaaaactgtacctgaaaaatgagacagatatgtgtctcatccctttgttgtacagatgaa

SEQ ID NO: 99987 - DNA, 1006 bp, Homo sapiens
gatctcacaaacaagctgctctctgctcagtctgaaaacacgtgggttagaccatctttctgcaagccgaccctgagacaagggtgcgggagccaatgatctattaaggaggcgctcccaggagggagtgaggaaggcaagacaggggaggggaagaggctgagcaaaggtgcagtttcaggcaagttcccagcctcagcctcaacctgtgggaggttctggagcatccattacaccttagaatttatctccatcaaagtaagagagctgggtttttctattcttggctacatgtcaccgggggatatcactctcagcaacttctggttctccatgatggtgaggatttcaggactcatcaccccttagcagcaaagcactgctgaacagggacatagacacaggaaccagcaaaagggaccctgggggtctgggcagggtgcccacagtgtttgccataccatctttatgagtttctccaaaagctgaggtctatgtaggcagctgtggtccacagaaagggagcccatcctagactagagagacaggagccgcagccacacgtcaggcccagcacagagctgcagaaccacagatgaggcccacagaattgttagcttaatggttgttgtcttaagccattaaatgttggcatattttgtctgcagcaacagccatctgatatggagggaaggaaattacctgatccctgagtctaatttccaacccaaaaatatatttgggtagaatctgaatatggggtcagtcctggaattagaattgacctccatccaatttttattttactccatcttacagtggcaaagaacttcacgaggcactagacagttctgcctggaaggaggcaataagaataatgtctctccagttattactgaattaatattagacaaatgacctcttctttcaagtcatcctcagtattttaagtgactactaggttttaatctactgcctcatagtccttgaggtcactgctacaata

SEQ ID NO: 99988 - DNA, 1169 bp, Homo sapiens
attctgttataaaagcacaaaacaaagacaagggtctattgggaacatattctcagtgttattcatagagtcaatgagctaatataatgttctggcatatccatctaccttaaagccacctgcggattttaaccagggagactggacatttccaagtctattggtttagctagcagtggaagctacacatcagaacggcctgggagaattttcaggactcaccccagacagattaaataagaattctgggggaacactagtgtttttgtaattattcccaggtaactatagtgtgcatcctggaccaagacccaccaagctaggctattgcttctcaaactttaatgagcacacaaatatcctgggtttctggtaaaaactcagattttgcttcagtaggtctggggcaaagcctgagattgcagttctaacaagttccagtaaatgctgattctgttggtccatggaccagacactgagtaccaataagaactaggaagtaagaactagtaagtcttacttcctagttcttagggataggaatatgttttgcctcaaggctgggacagctaaataattttcccaagccctggtggctctctcttttctggaatgaaagctttaggcaagtggactgcattgaaatggactacatatttttcctcatctattttctcatatcacaaagccagcatgggatcatagagaatttagagtttcaggcatggaagatccttaataattgttggatgaactgagattcctgctggatggttgaagatgctgaggtgttactggaggctgctgaggtagcatccctgctgagatgctactggaggctcagatgccataggatgttacaagttatgtcttgaagatgctgtcaacctttagtggagcttaacaacagagggatcacttaggtctctgaagacagtgcatctcaaatttaatatgcataggctgtgggtagagtggggttggggtggcttatttcaacagatccctacccccgagtttctgatcagtaggtttgggtggggtccccaacatttgcattctaactagcttccaggtgatattgctggtctcaatgataccttgggaagaatcctttctcaaagccagcaaggggccaggtgtggtggctcatgcctgtaatcccagca

SEQ ID NO: 99989 - DNA, 1048 bp, Homo sapiens
cccacagttttttatccatttcgtctggggtcgaatcctagaatgaacatttcttaaattcccagttgactcttatgctgctagttcaggaaccatattttgacaatcattgaactaagggcttgtaaaatagtgtgacgtgggtcagaatgcttgatttcctggcccatggcaggcgctattggctaaccaacaaaacacccattcctgacccactttttcttcacctttcaccaatatagaagctaagaaaaggtaaatggccactttctcagactactttgcagttaggagtgagcctgtgacactgtaacagatttctagttaacggtactaagcagaagtctgcaagggatgagaatcagttctgggaaggttattgctctacctaatcacaaatcaagcaccatatcctccccttctttggctttgagcacagatatgatccctggaactaaagcagccttcttggggccatagcatacatacataaaggaagagaccaacaaaataaagttggcatgtggccagtgaggaacaccagatcattgccaatagccctctacttccagatgctgcattttgtgggataaaaatctttattggttaagccacagtgaattgaactttctgttacttacagccaaaattactcctaactgacaacaaaccatatgttttatgtatgtgtgtatttatctatttattggagacagagtcttgctctatcccccaggctggagtgcagtggcacaatctcagctcactgcaacctctgcctcccaggttcacacaattctcatgcctcagactcccgagtagctgggattacaggcgtgcaccaccatgcccagctaatttttgtatttttagtagagacagggttttgccatgttggccaggctggtctcgaactcctggcctgaggtgatatgcctgcctcggcttcccaaactgctgggtttacaggtgtgagccattatgcctggtccccatatgtataatttaaacaatatatatagaggccaacctaaacctcccagacttc

SEQ ID NO: 99990 - DNA, 1052 bp, Homo sapiens
gggcacgcccaacctcatcagcaccgagttctccgcggagctccactacaaggtggacgtcctgccctggattatctgcaagggtgactggagcaggtataacgaggcccggcctcccaacaacggacagaagtgcacagagagcccctcggacgaggactacatcaagcagttccaagaggccagggaatattaaagagactgggatgaggtggaggacgctgcctctggttctggagcacacacgtgctgcactgacgtgccgactggcgccgagaccttcatagctgcggtcgtgtatatttgtatataccacatgagtatttctcatacattacgctaggggcgtgtgccacgcccaggggactgccttgtgaagccgccctcgccatctgcagagctccttgaaagtgcccctggggagcgatgtgggcagaaggatggggacaacttggaagccagaagaagaacctggaagccacagtgggtgcgactcaattcacacccggatccagagtttcaaagagaggcaaagggggaaagagactgaggttgtaaacgttataagcagtttttatatataacttatttaatacaaatgtgacttaattaagcgtaaccttttctctggagttgtggtgaaactaatcacgtctgtgagagatcagaaagaaagagacttagggaagtggaagagaaagggaattttggaatttatttctttaaaaataatgcaatggaaatatatcaaaacatgtaaacgcccaccttaaaccaaatgttatttggtcatgaggcaccttgctggagtctcagattccaaaagtctcttcttcagactgggtagggaatatgatattttagggacaaagctgaggactggttttaaataggctttaaaataaaagatcaatattatcataatgctatcattctgctaaacggccccaaaacagtagaatttctgctcatgtcctagcaggttcagaagactgcagccaagttcagatgtaaaaacaagaagtagcacttttccaaaggaaaacaacaaa

SEQ ID NO: 99991 - DNA, 1040 bp, Homo sapiens
gcaagatgcaagttgaacttagtacatgattgaatgctcaatatggaagtccctaaaatttctcttgcaatttgataaaaataacaaagagaaagaataagaacactttgctttgaaaaattgtagtggcagctaaaagctcgatagtttcagttgataaattacttctaagtgttatattcagggattctggagccacataagaaaaccaagattttccttttgattttttcttttttttttatgtaagaagtggttatcaagaagatactaaagatagacttgctcagggggaggaagtgccctgcaccatgtaatcatggctctgggcggtaactgataaatcccagataaaattatacacttgacatcaatgtatggccaaattataaaggaaagacaaccaaaatatagtgggtgtaaatatgaataatttgagagttgctgatttgtattcctggtacaggcaattacatttgtcttgctgtgctctcatagacaggttggtgccgtggtatctgtttctcattcttaatgaggctgagaacttagtgagagatgggctggctggtggggagcctttggcttcaaaagcttttgaagacctgttacctgttggcagagatttttcaggaactggattggatcacataaaactatcaggacactttggagtctgaaaatcgtctgaccagtttcaccaggaatgccacttctttcatctccttttgccctttttccatttatatttaaacatttgagcttgttaaggaccccttttattaagagttcaaaaactggccagtataaaagagcacagcgtctccaagaacagtttgtcaagactttactcttcaattttctacattttttttttaaggaatattgtgaagccaagagggggaacatagtgatattcagaatcatggaggcaaaaatgtaacaggtaatataagttccttccttatcagatcggatattaaagatcagctactggaaccagagaatactgagagatgtaaaatcaacttcatttcaca

SEQ ID NO: 99992 - DNA, 1045 bp, Homo sapiens
cattagtgaaatgcagatgacaaccacaagtagataccacttcacatccaacaagatggctatgataaaaattgtgaatattaacaagtcttggtgaggatgtggagaaattggaaccctcatatatcactgataggaatgtaaaaatggtgctgctactttggacaacagtttggcagttcctcaaaaagttaaacatagagttaccatgtgacccagcaattccatttctaggtatatgcccaagaaaatgaaaagataggtccacatgaaaacttgtgcatagatacttatagcagcattattcataacagcaaaaaaagaagaaacaatccaaatgcccatcaactgatgaatggatcagcaaaatgtgaaatattcatacaatggaatattttcagctgtaaaaaggaatgaagtgcagatatatactgtagcttggatgaaccttgaaaacattattctaggtaaaagaagccagacactaatggccacatagtgtatgattttgtttatatgaaatgtccagaataggaaaatccatagagataaggtagattagtggtagaggtaagggaatggggagtgagtgctaatgggcacagggtttcttttagtggtgacgaaaattttctggaattagaacattgcacattttgcaaatatattaaaaactactgaattgaaaagttatttaagtggatgaattttctgatatatgaattatatctcagtaaagctgttaaaaatgttaattgatataatttactctgttaccaaaataaaggagaaaacccatatgttcctcttgattccatatgatcatctcaacttgcatgaatgataaaaacctcaaaatagccgggcacggtggctaatgcctgtaatcccagcactttgggaggccaaggcgggcagatcaccaggtcaggagctcgagaccatcctggctaacatagtgaaaccctgtctctactaaaaatacaaaaaattagccaggcatggtggcgggcgcctgtagtcccagctactcgggaggctgagg

SEQ ID NO: 99993 - DNA, 1044 bp, Homo sapiens
acgtcagcactgaagccagtctgatggggtatgattatgttattaagtcccttgtgtggaaattttttgttatccttgctggtggcccgtgaaagacaccttactatttaatgtgaaatataggtaggaaagagtgtagagtcctgctatgagcccgaagatatttggcctccagttatattgcttgacatctggtagacatggttttcttattgctggtaaattctccagctggtagtcaattgggccagcagatacagctggtcctcttgcctctcttgtaaattatgtttttgaccttccttgaggagagttaatccctcttccttcctttctcctttgagcctgtgactacaaatactttcaaggaaaaaaaaaaaaaaaaagaaaaccccaaaacaaaaacactaatgatttggctgcggaattttattgatcaaaaagaaaaattatctcttttgttataaatgctagaatttttttgtattgcaagtaagacaaagttatagatgagaggctgagctcaaaagagaaaaggggctataacaatgtttgtattctgtttaagctttggaccttcctctccctctggtttcctgacttctataaaagaatagttgaactaactagtggcatacctgttcagcatcatgactggtttccgaaacatgttcctccataatgttgagagccgtggtagcgaaatgagtaagaaggcatcttaaaatatttaaaatttaaaaactatttttaaaagttaaaacacttgtgcccttgttttcaaaaattgtcttccttctgcttgttaccaaactcagaaactgaggccacctggccatttgaacatatatgagctagttgtgtttaatcccaagttaaagccttgaattaaagcttagctaaaaatcatattgcgtagaaaaggctggataataatcagtatcattgtaaccagaatgcatgtataatttgaataaatagaggtaggttcttttacaagtcttttttttttaaagaatgttcttgcaattaaatcatttaatt

SEQ ID NO: 99994 - DNA, 1100 bp, Homo sapiens
atggaaagtggggaactgagtgtgttaaatataaagctatctttaactgttctattaaaaagcaaagatttattttccatctgtgatctgaatgtgcctatttgtgttctcttttatggcagtggaatttctgtggagccacacgacggagagcatgtgtgtcggatatatgtcagcccaggatgggaaagccaaggtaagtgggaaaaaacggtcataacctgaaaaccttgtagccatcgcataaacctctaaccagctaagttgatgtggatgaattttttcagctttttttgggcagtagctttgtggtcttcataagcatccgaataagaacagttaacaatgctaacagctccagagaaaaccagcatatctattttgcttttggtgacacagcaggggagcattaggaggagcctgcccactttcccccacagcccccagcttgttcctttttgcccattgtgaataagtagagaagaggaaactggggtttgggaagagaaaatgggagtgaagctgatgagctgacatagatggatgtttctgcaagaagtgttggaataaaggaaactgagtcaaacaagctttaaccctagaaagcatcctgcatgtttgatggcacaggtggctgacatgcttgcaaatatgacctgtctcacctttcagtgtgttctgtcatgccctgacctggtgtcttcatgggcagaattaaaggtctctgtccatgtcccacatgcctgtggcactcgtcgctcagtgagttgcaataatcacataggcatccacatactatctccggagttgctttgcttccctggactcatgatggttgagcctgggaataagcaacatgatttgtggattttattttatattggcctcatgttcttcttgttcataaattttttagaaacagctgtggcctgtgatgtttacttggcattaaagtacctcagttataaagctgtgaagttgtgcagcattgtttttaaaagaaatgatttattttgcacattttgacatataaaataggaaaacttctgatatgagcagtctgttacagattgaatcataaaggataaatataataaaga

SEQ ID NO: 99995 - DNA, 1057 bp, Homo sapiens
taactagcttagagatataaacagatggatggcctgggggacagggtttagtgttgagcaatgcagttttattatcagggacttttgaaatttttattggagtacattacaactttaaaaatgccttcgaaaactcagaattttgatgctgtgtactggaatgtgacagagctttgtgggcatccctggatgtttgcagttttctttttgtaactttttatttagatataattttatacatacagaaaagttgcaagaatagtgcaagggacaaccatgattccttttcccagattcaaccagtgttttcctttccttccatttgctttcccatcctcatgccctcctccctctacatgcacacgagcatgcacatgcacacacacatacacacaaacaaataagtgcatttttttccctgaactatttgagagtgaattggagacatcaggctcctttattcctaatactttggtgagtatttcttaagaacaaggccattctactaaataatcacagtacagttatcaaagtcatggcttttagtattgatacaacactactgtctaacccagagtcccttttccaactttatcaattgtttccataatgtcctttataacatctctccccaccaccaagtccagggtacaatccagaatgacacattgtgttcagttgtcatgtattctttaaacaggaagtttctcaactttgtgttttctgactttggcatttttgaagagttcaaaccagttatttagtagagtgttgctatttcaagtctgtttgatgtttcctcattcaattctggttatgcatttttgtcaggaataccaaataccacagaagtgttgtgtctcaaggtatcttatcaaaaggcacatggtactgatttgtgccttaattggtggtgttagctttgttcatggagttaagttggagtccatcaagtgtttccacagtgaacaaacagtttttcctgttataagaattttttggagagatactttgaagctatgtaaatagcccatccttcttcaaatttccacctact

SEQ ID NO: 99996 - DNA, 1031 bp, Homo sapiens
agtgagtcagtgagtcagtgaccctttctccctaaaaaaattaagttttctataattgaatttaatctaagtatattttttcattaattaacagcttttaaaaagggttttctcaagtcatctgcctattgcaagcctcttaactatattttaaccagcaagttattaaagttctaaaactacattcagtggtaaatattttgtcttgtgaggaatataaaactattaaagctaagccatttagtttttcaaatgaggaagctgaagcatagatgtcataagtgactcatttcaggttctacagccagagctggttctcctcatatgtgatccttctctctgatggaacaggaatccagatagaagattgacaagagcatcaactgaacattacaaacagtgttgcttcttttatggctactttcctaatgaagttctcaggtgtggataaatctaatgcttatacatatactctgtttcccagataaatacaatatagtgatacaatcttagcagcaccaccatagataagaataccacttttactggtgatggttgcctctgattttttttcctccttccctgggttcatttgtccctgatgctctaattagagtgttataatttaggtaactaaatttaaataatttagaacagaaagcaaggttctgctttatctcctgtattaacactcaaaatgaatattgggtaaatttctacattgagatgtgtattagggttctccagagggacagaacttataggatatttatgtatatgaaagggagtttattagggagaactggcttacctgattacaaggtgaagtcccaggatagaccatctgcaagctggggaagaaagaatccagtagtggctcagtctgagtccgaaagcctcaaaaccagggaagctgacagtgcacccttcagtctgtggccaaaggcccaagagcccccagcaaaccaatggtgtaagtgcaggaatccaaaggctgaagaacctgaagtatgatgtccaagggcaggagg

SEQ ID NO: 99997 - DNA, 1624 bp, Homo sapiens
tttccaaatttttactgcaattttcatgttagcctctaggcgatgatagtatcactgtagttcatgggtccagcagcagtattaaaaatcaaaatcagaccgggcgcagtggctcactcctgtaatcccagcactttgggaggccaaggcgggtggatcacctgaggtcaggagtttgagaccagcctggccaacatggcaaaaccctgtctctactaaaaaatacaaaaattaaccaggtgtggtggcaggcacctgtaatcccagctcctcaggaggctgaggcaggagaatggcttgaacccgggaagcagaggttgcagtgagctgagatcgcactagggcactccagcctgggtgacagagcaagactctgtttcaaggaagaaaaaaaaaatcaaaatcaaattgaaaccttagcctacaggtttaaaaccatacgcttatagatttttaaataaaattatagccatgtggtttcttaatttgggatttgtagaccctatggaatctatgtattggtttttatggggcattctgtgaatttcctgagactatatgaaacattttagtccaagatatatctttttctcatgacctgagagagattgggaagcacagtcttaggtaattttgaataaaactgtaagttaacttgctggctaaaataaattaaataaataaatttaacaagtaatacaagttgatgtagttccttcttttcctgttattatttcttagtaatagtgtcaaatgaaaaccttgaagagtcccaaattgtatattgtctatttgtcttttgttacctaactcatttgaggtggccttcctgtattttgcccctttcttcttttatctgctactttcatctgataatttttctagttggtggtaagacagcttttggacaatttctgtattgatattccttaaattctacccagatgtagagaataaaatatgaatactattttctccttcctccttcagagcagtgtgtctttccctgccctcaaaacttcccttgatactgtattgaatagagaaagggataagcaatgactggtgagcagatttaagacttttttctatggtactttatttggcctctaaatactgaatgttgtttttaaactttgcgtacagctttaaagctgatgaaatgatttatattgcctctcctttgtacagaggaatttattgagaaataacattggctcaaacttccttttcagcttttaaagagatcaaaatgaccccaataaattacttctaaattttaagtcattaagaaaattattaattaaatatttaatatatgtggctggctcagtagttataggttagatttatggtgtagtataactgtcttgcttatgttctttctgtttgtggactttataccacatatataatcaatatgtatagtgaaatattttacatgacatctgcatatttgtagatgtttataactgcattttggctttggttttttttttctggctcatgaaatgcacaccatggcttagaggcaaaataaaatctttaattttattttgttgggatgtgcttggtgacttactatttataggactttctggttaaaattggagactatctacag

SEQ ID NO: 99998 - DNA, 1047 bp, Homo sapiens
aaccttcttgccaatataggaatatgttgacatattagctatagcaaaaggcttatattagcaccgaatgaggctctgctgcatccattcacctagggaatatgcactgtggcgcttcccaaaggatcacttgcaggtacctcagtgtacctgatggcttgactgttgttgcagccattagtacatctcccttcttgccacctttctctccccaaatctcaacaaaaccagttgtttttaatcttaacactacccatcaccctcctacactcactgaaatgtcttcagcccctaacctctagaagagctgaggacatcatggaaggaaggtaagtctttctctgaaagagattgtagacctgggatataatggataaagtgatccccaagatgcacttttgatgttttaatttctcagattttttttgctagatacttactttgcattgctttgttgttgttttgtgaaagaacagacttctaattttaaaacacaaggtgaagaaatgttaaaaaaaaaaaaaaaaaaaaacaaaggcgtaagatcaagtgatgagttaaaatgccagttctgccatccttgatgtagttctccctttgattgttctcacttgaaagaatgccttttccttcccattgtggagtactacctgctgtcagttggagagggggtaagttgagcaacctgtcaaagactttctaagctcccttcatatggttcacagaaacagggctggattttcatttcttctttcattcaacaggagtctctttcatgtttgaaaattggaaacgtgtgtttttcagtgtggagcgaggatgtgtgtgccctctggcacacctgtttctaatttcctgacttgaaagcataactcatcaaaaggaggagaaaaacaatttctttgtgacatgctgcttcatggcccttgctggactcaaggccttcgtgggtttgccaccttggttccctctgtagaaggttcttgtgaaatgcagaattcactaaatacaactagtgccttttatggcacagggctgtttttggta

SEQ ID NO: 99999 - DNA, 1001 bp, Homo sapiens
aagtatttatagagtgtaagagtgtaatagtagctctatatagtaacagtcattgtatgttttttaacctttctaagatttcattcctgtacaaacgagctctgtgaaattattatggccaaaataccaatgtttgtctttcacctaatttatctgcacttcataaaaatgcttaaatattacttcatcatccttaaatttgctttgcagtatgtgaagcctatgaactaattcttgaatatttatgaagtaattctgattttttttaggtgttacaggctcttaggaatatttagcttaatttggaacaggattctttattatttgcatgacttttcagttttgaaaacgaagttacagtaaatccatgtatgtataatccagttatactgacatcagtttttgtatctttctacaggagtttggttaggtataacagttctcatggttcacaatatcctgattgaaatgctaggaaaattactttacagataatgcatagcattgtgtatacgttacttattccctctataaaattctgttttacagaatgcatgggtagtatcagcagttggagtttataaaaaagagctaatgaaaaatacccttaagagagtagattgtaagcattctcgccagaaataaatgattatgtgaggtaatgtatatgttaattagcttgatttctgccattctacaatctatgcctatatcaaaacatcatgctatataccataaatatatataatatttattaattaaaataactgaaatgtaaaaaagagacataaccctccctcaaaggttagacagtgaaataggatgaaagtcacaatttgattatttaccagaagcaatcatccttatctggtaggactgatgaagacagtcactttacattatgccttacttgggctagggaaaaaagtgtgtaaaaatttccagaattttatagcaaagaataagggcaaaaagtactggcatatgtctgtcaataaaaa

SEQ ID NO: 100000 - DNA, 1065 bp, Homo sapiens
gttagaaaacatcgtcctttgctatctttgagggtttggaatttttaagtaatcttttttatggtatgaatttaattcctctaacccagatatgttaaatccccttaaaagcatggttcaaacacgttatttttattttaacctgaaaatgcttctgttaatttttgtcaagtgatttaggaaataaatagtataaagattttattgtttatttttttgcttgtttagagatagtgtcttactctgttgtcctgactggagtgcagtggtgtgacgattgctcactatagccttgcactcctgggcacaggggatcttccagcctcagcctcctgagtagctcagactacaggtgtgtgccaccatgcctggctgggttttttattttttgtagaggcagggtctgctatgttgaccactctgtttagatttttatatggtatacatttttttcctcttgctctataaatatatttggtaccaatttgtatagtgttgcaaagccatttaattcatacctattaaacaaagaaaataaaagattacttaagaatagacatcttgactatagtttataagaaacatcgttaatagtattgggcatcagaagatgattttctaaagagggaagataatatcattgagtgttcctatgttcagatttttgctggtttcatgcagtccacataggtgagagtagataattctagctaaattattattatttttgagacagagtctcactgtgtcacccaggctggagtgcagtggcgtgatctcggctcactgcaacctccacctcctgggttcaagcgattctcccatcccagcctctgagtagctgggactacaggtgcacaccaccatgcctagctaatttttttttttgtatttgtagtagagacagggtttcaccatgttggccaggctagtcttgaactcctggcctcaggagatccacccaccttggcgtcccaaagtgctgggattacaggcgtgagccacccagcccggcctagctagattatactttgtttacacatagttgataaactgtagcccaca

SEQ ID NO: 100001 - DNA, 1030 bp, Homo sapiens
gttatataaatggaatcatacagaatgtactcttttctgtttggcttctttcacagaaagcttttattagacattgtatcaccgatttattcttttttattactgattaatatttcctaatataaatacacattaatttgtttatccgttttcctgttgatggacatttgattttttttccagttttttactattacgaataaagctgctgtgaaattctcataccattctttttgtggagatcaggttaggatttttatatataggagtttcactgcatctcatggagaatatcttcagctggaattactcaagtagttcagttttccattcaggaaatgggactgaactgggtagtaagaaaataatggtgaacaagatggaggaagctcatgctctaatgagaccttacattttaggagaaagagacatattagcatataattaagatagttattcttgtaactgttatgaaggaaaaaaagaagaacaaaatgatgtgatatagagtaacttggatgtgagagtctgaatgaagactttgttaaataggatggtcaacggagacccctatgaggagataacatttgaggtgacatctaaaaaatgagtggcttttatgaagactcagtggaagagtgttccaggcagaatgagctgcatgtgcagaggccctgtgggagtttggcacattacaggaatggagagagagagtcagtgtgccaaatcagtgagcaaggggagaatagtatgagatgaagctggagcagttggtatgggctagctcctttaggacctggtagatcatggcaaggagtttgaattttattcaataattttattcaagaattttatttattttattcttgaattttattcaagaataatggctagccattgaagagtttaaagtagggaaacagtgctttcttattcacattttgcaaagttctccatgggctactatgtgaataatcagtccaagggggaggtaagagtagaagttgggagactagttacaaagtcattg

SEQ ID NO: 100002 - DNA, 1753 bp, Homo sapiens
ttttctggtttaaaaaatgttttatttactttttattattttttggtgcctggtggcttttttctcatttgcccattcactgggaatatcaaccattgagactttctcctttctttgtggataatctccagtgtgttttctcatactgcattgtgcccaagtttcgtctcttacctcctttgcgcagagacctttaaaacgacagttggaggaggcttgcatcaacagatgccctgagggtagtatctgccttcaggactcctttgtttctctgggttggaccattttcttaattttaaaatcttaatttatttctcttattctcctactatccctgtatacattgaaaagactttttaaacccttaatttaacatactgaaggattttcttctgggaaggctcttcagatatcttatttgacccattgccctaatatttcttaaatgttatatttaatgttttttatttttattttataggattcagtttagctgcatttaaaagaaacaagaggaaactagagctggcagaaagggtggacacagattttatgcaactaaagaaaagaagacaatcaagtgagaaggtcaggtggtgtttgaaatattcaaattaatgtatcagatgatatatcttctgcatttagatacaagctttaggacgatacaattcagtagaaatagaatgtgtgtcacatatgtactttaaagtttttcagtagctacattaaaaatatgttcataatattaggctcataaaagagaaaaagaaagtagaaagaaacaagggaaattaattttaatatattttatttaaaccagtggatctaaaatataactttgaaatatgatcagggaaaaattattaatgagctattttacattatcgtttttagtattaagtcttcagaaccagtttgagttttccacatctcaattataacactaaatttttattagatatatttgatctgtatttatatttcataaaaatttactgtgaaatagtaaatttacataccaagttattacaggtatacttaaatcttcctaatagtttaatatattagaaaattaaaattttataaaattaaaaattcagctttccatttgtccttgactcattttaatttctgaatagctacatttggctcgtggctactgttttggttcttacagctcctgatagtgattcttaacatgactgtttagggagtagagtgtaagtataagaaaatatacatattgtattcaggcgtttttagggatagaaagaaattgaaaactacaacattcttgctcagcctgtggcttaggggtttcttagcatacagctcatgatgggtgtcccaggtcacatagtcatgtgatgtaccttagcattcatcaatattctttattgtttagttcttctgtaatggcttagatactgttttgtcctttgtgtcatagttttatatggtttacctatgtatgaatgcacaatacatcatcttttgtagtgatagatattttcttggtgtgttgccacgagataatcagtttggtacaaacctttttaattttctgccggcaaaggataagaatttagaaggcagatgaacaaattaataagtagatcttgatatgatggtggatagtctatttcttgggtttctgcatcggatgtgatgtgtgggtgaatgaatttaggacttttttgcctttttaaaaattcatgataggccaggtgcagtggctcatgcctgtaaa

SEQ ID NO: 100003 - DNA, 1059 bp, Homo sapiens
cccgtggtttagatcaaggattggccaactatggccagaaagccaaatctggccagatgcctggttttgaatggcctgcaaactaagaatgattttcacttttttaaatggttgaaacaaaatcaaaagaagaataatatttcatgacaccagagaagtatatgaaattcatatctcagtatccataaatgaagttttattggaacacagccatgcttattcatttgtgtattttctattgctgcttttgtgctacagtggcagagctcagtagttgtagcattgtctatgtggcccacgaggcctgaactagttaatatatcttgccctttacagaaaagatttgcctggtacaatggtgtccaataaatatttgttgaattaatgactcttaacctgtgctaccacagaggaatctaaattggaaatcttttaaccatccaattcttgaaaatttgagcttaattggcaactaaacaaaaaaaaattccccaaatgattttttcagtcagtaatacagtttcattggcttccattcatcctgtaaatgaaaactgatgttgggataccagaaaattagtaattcttagaatagtgctagctaagataggcatattgtacaagttttactagtgttagtttgaaaaagagtataatgacatggagtacatatcctgtttttgtaactcttttaaaaagatgcaagaaagttcatttcgaaagctttttccccacctttctcagctttagaaggttaaaggtatctgcttatcaatgaagttagtaattaaaatgatttttctttttttttgagacagagtcttgctctgtcgcccagctggagtacgcagtggtacagtcttggctcactaaagcctttgcctcccaggttcaaggttcaagtgattctcctgcttcagccttctgagtagctgagattacaggcacctgccatcacgcctggctaatttttgtatttttagtggaaatggcatttcatcatgttggccgggctggtcacaaactcaattaaaatgattttgataggacattcaattt

SEQ ID NO: 100004 - DNA, 1013 bp, Homo sapiens
ttcaaagctttcttgtgtgtatagtatacatatggaaaactatacacatttattttaaggggacagcttcatgaatttttttcagagtgaacatggccggccttgtgtcactagcacccagatcagcaaacggaacatttctgccctccagaaggccccttgtgcccccttcagtcacctcagggtaacactggtcctgacctctattgccatatattagtcttgcctgttctagaacttcatgtaaatggaatcatatattatgtattcttttgtgtctgcctttttaaattgaagtgaaattcttagaatacaaaatgaagcattttaaaatgcataatcccatggcattaaaatgctcacagtgttgtgcaactaccactttcagttccaaacatttttatctccccaaaggaaacctcatactcatcaagcagttgctcttcattcttttatcctttcccccttgtggaccacccatctgctttctgtccatggatttacctcttctggatattttatattgatagaatcatgccatttatgtggcctttgctgtctggcttttttcgcttagaataatgtttttaaagtttgttcacagtgtagcatgtatcagtacttcattttttggaggagcagtattcaacattattcatgtatctatcacagtttgtttcattccaaatccattcattcattgatggacatatgggttgtttctaccttttggctattgtgcatagtgttgctatgaatactcttgtataggtatttgagtaacttttttcagttcttttgggtatatacctagaagtgaaattgctgggtcatatggtaattaattctatgtttaacttttttttttttttttttttttgagacagagttttgcgcttgttgcccaggctggagcaatggcgccgtctcagctcactgcaacctccgcctcccaggttcaagctattctcctgcctcagcctccccagtagctgggattataggcgcccacc

SEQ ID NO: 100005 - DNA, 1094 bp, Homo sapiens
atggaaaggtcagtttatagatcatattttaatgatttattggtaaatcgattcattcctgttgtttcatatagcttttttgagattatcttaataactgatgagaaagtgaattctgttcactggatggtacaactctggtttcactcacagcagagaagattaatattgtgaaagaatttggtcttcatatttgggactatacatttggatgacagttgcttttttggctgcctttgaaatagttttggatcaagtagtgacgtggatttaagattctggaccataattttgcatatttcacatggtgtaacttgtgatgtgaatttcttttttgagaaaattggatatagaactgggtgagtcatgatgctaccattttcttaggattgtttctaaagtagaaagtgtttcatggattctgatagaaaatgaactatttataaaatactgcctgaagctcattttgcacattggtgtttttcttataaagtatgaagacctggtttaaaaaagtctaatgagtaataataggtgaaatatgaacgacagacttttggaaggtaatttataatcttttgtgagaaaactgatgaatttggcagaggttttgaagatcttgttgtaacctttgagaaagtttggttaattcattctgaaaactgattattttggtaggtagaatactgtgtattaagaatagtgataggggccgggcacggtggctcatgcctgtaatcccagcactttgggaggccgaagtggacggatctttgggaggccgaagcggatggatcatgaggtcaggagttcaagaccagcctggccaatatggtgaaaccccgtctctaataaaaatacaaaatttagctgggcattgtggcgcgttcctgtaatcccagctagttgggaggctgaggcaggagaattacttgaaccaggacccaggaggcagaggttggcagtgagccgagactgtgccactgcactccagcctgggctacggagtgagactctgtctaaaaaaaaaaaaagaatagtgataggaatagcttttacattttatatagtaaaaggcaaattatacaggttcc

SEQ ID NO: 100006 - DNA, 1022 bp, Homo sapiens
ttttaagtagagacagggtttcaccatgttgaccagggtggtcttgaactcttgagctcaggtgatccacccacctcggcctcccaaagtgctgcgattacaggcatgagccaccgtgcctggcctcaacttgtaattattaaatttgtggaagaatttcaattaattatctaacaattaacttttctatggactctttgaatgaaatatatgttaatagtttaaggttaagcttacactaattggaagaattttcctaaatcttaagaagtatgttggaaatcatgcttatacttccccctgcagtttctctcaccttgaataattgtgattcattaccttaaaacaggataggttttcagatggagttcagttggggtagtattgtaatagcttgggtcaatggaaagatgtaagaagattggattctagtatttgctgtacttagagaaatataagtagcagtattgagtcctttcagaatactgaaaagtgctgagaaaaattctggagagctgtattaacaatgtgttatatttaatttgagaataaacacttatctttagttttggtcagtctattcagttaagtcatgtctggattattgaacagatgcaaacagtcattgttcttttctctttagactttgggatatactttttgatttaaaaaatgatgttcttgccactgagcttaaggaaacaatacataaacatattttaaaaacttgcccgttatattattacttaggcagatattgaaattgatgtgaattccttaaatactaattgtggattgaaatgactgaaatgttctaatggtctttattgcctagaaagtgtatctggctgtatatttaaaaaatgtgataatttgtattttcccaaatagtgaaaagtacaccgttcttaactccatgcatggggaagaggaagagacaaggcaaaagaaatatgtgtatatgtatgtgtgtgtgtgtgtgtgtgtgtgtgtgtgtgtgtaaataccacagagacacacac

SEQ ID NO: 100007 - DNA, 1034 bp, Homo sapiens
ggaaccttgatgaatttgtgcaggggatattgaggtcttcagaagatcgacttgctgctcaaacttggagaagatagatttgtgtcaatcagttgagaggattattgtgaaaaatatttttctggttgagaatactacttagggaatcaagtaagacatgatgacaaaaacaatgatgagtttgagggaggagatgataaagtcgacatttccaggttgactgggttgtggcccttgtatttaggctctcataccaaggcacttaccctttcatgcctttccttgtgaaaattgcccaggtgtttaccattagtcctagccgtgttttctgtatattctcatgcttaattgtggacctgagctttctgtatattctcttgcttaattgtggacctgagcttttgatcatgctttgtagattttaatttctcagattggtcctaatgtagtcaaggaaggtgaaagtatatggtgggcacctagttctattgaatctgacatggggatgtgtgatgccctcctgatatgactgatacatttcataccagctctaccagtcattagccatgtgtccgtgggtgtggcacagtctgtccttgactcagtttccctatttatgaggatagtaattcccacttcatggagttgtgaagataaactgagttagtatatgcctaatacatgacagtctcttagaacagtgtgtggtacgtagtaagcaccccataactgttagcaattattacagttatgaggtgctttggaaatggtatgtatgagatgaatatttatggcaactattaatgacaagttttacagcatcaaagaaaggttaattatatgttgaggataagaggagaaaaatgacataagaaagaagatagatgtatttaccaccaaatgttacctttactcaaaacagacacacaaagagggcttcatctaacttaactagttcaattgttagttgaaaattactttcatggagtcactgtaggtctgggaaagaaggttaatgagtatctggagaatat

SEQ ID NO: 100008 - DNA, 1043 bp, Homo sapiens
tggacatgcgagatgtaagacacctcaacttcaaatgttattcagaagcgattcagctttctgaattactcttatgaattctggatttgaaacagtaacttcccaaatggcaggggctttctgacagtcagcagagaggaacccggagggaccctgtccccgacaccttctgggttattagctgcagatcaaaagaactcctgattttggaaagaggttcttgaaaagaagaggggaggggaccttggtgaagcctctttggggacatgagctatttttagggcttttggcaggaaaagagcttttgaaaacggagataaggcatggtattaaaaaggcttacactggagtaagaagtcataaaacgccatacagttagggcaatagttttgttttttactaggacagcatcagtttatatggagtatttatataacataagcaaggtctcttgatattttaataattaactggattttattttctactttaggtgcaggttatcattctgaatccaaagccaaggagtataaacatgtatgcaaacgagcttgtcagaaggtatgaacacaatgtgtatgatctgtgcattgcagttttgaacagaaagcagttttaccttgaaattcaacatttaaaagtttcatttctaggacagtcttccagtttggactacaaaattattttgcttgtttttgtaggggatcgttttgtgttgttttgtgtttttctccacatgttgcttagctctttccccactttcccagattaaagtctgtatttttgtaattgtgggcacacaatcatatctcttttaatctttgcaacgatgttgaacttctgtagacagaaggatagagaaaacagcttaaaggcagtcaatgtgtttttccatgaagggaaaaaaataaataaaaaaattaaaatgggtactttcctatactttttcattctgtttttcatcatgtagtttgtatcatagcaagttcattgtcattccagagttcagttttgcccttgtactcagttgtgcttttttccca

SEQ ID NO: 100009 - DNA, 1020 bp, Homo sapiens
agtagattcttgatttttcccactgcctatactgttttatctaatattcaaacaactaaacgctttttaatcttaacatttgaaaaatgaagtttatggttacttaaatgaaatagcagtatcacttgccataaagagaaaataactttaaacacagtgcaaacaaaacactgtaattgaagtttaactagatcctatttgtcagtggcttggatcctgagcctgcctttccattgttaaacagggaaattagcaagtgttaaccaggaattaaagatgtacggggtggggggggggctctgctgagacttttattatttcaaaaggatttacatgttaaggctattaaatgcccttgtcccttacactgaagtcatctttttggaatagtatcccatgctttaggaaatgctgctgaaagattgtggcctctgagatctaagacagccaacttgagatcacctgttcttagagaaccatgaagagaggcctattaaatattggcacaggctctgtgaatgttcagagttctcttgagaaacaggtttaggatttgggtgtattgtggattctggtggcttgggcatctctgctttcctggctccttgtacgacagtttcgtgggtgagtgctttctctaccttgaggaaaggtaggttaggtttgtgtcagagtctgcagacctgtaggaatcctaaggcctagagatgtagcttttctgtttttgtcttttttaaaatggaaaacatgtgtttgtttgtttgttttttggagtcaaagtctcactctgttgcgtaggctggagtgcagtggcatgatcttggttcactgcaacctctgcctcccaggttcaagctattcccgtgccccagccccctgagtagctgggattacaggcatgtgccaccatgcttggctactttttttgtatttttaggagagatggggtttctccatgttggccaggctggtctcaaacacctggcctcaagtgatcctcccgcctcagcctcccaaagt

SEQ ID NO: 100010 - DNA, 1139 bp, Homo sapiens
cctcagcctcctgcgtagctgggattacaggtgtgtgccaccacaccagctaaattttttgtatttttagtagagatgaggtttcaccatgttggtcaggctggtctcgaactcctgacctcaggtgatccacccgcctcagcctcccaaagtgctgggattacaggtgtaagccactgcgctcgcccctaagcaggtactatcagtggacagagagatttaaattctaacctttttatattacccaattaaataattttatccgacttcaatgggaataagaaaaaataattttaataaatagctttgataccttttttgtattgctcaattaaataacttaaaaataggatttttgaacattatctttgcatgaatttgtgtaagtaacttatgtgttggtggaaagaaatgtataccatctttgcctgttttcctttagggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtaagctttgtggatggcttggaagatgccaataatgttgatttttctttttctgccttgaagtacactgagaatcacatttcacacttggaggaggcaaaactgccagagaggaattggaagcaaagcgattgtttgacttggatatagtgaggacctccctctttactccccagttagaagatcttagaatggcagctcttcctaggttttcacttccctaacctattatttactttaactctatgtaatagatgtatttaggttaggtagtattaaaaccagacaaagtaatttttgaactctggtttatgttttttaaaaataatgttgctgtgggaggctgaggcaggagaattgcttgaacccaggaggtggaggttgcagtgagccgacatcatgccactgcgctccagcctgggcaacaaaccgagacaccatctcaataaaataaaataaaatattgctgaaaaaattg

SEQ ID NO: 100011 - DNA, 1324 bp, Homo sapiens
atgtactcagagttcagggcctccagcagatgttctgattggcttatttatgctggtaagaaattgattttgtgctgtaagcatgggaaagccctgcctcacaaaccactgctacagtcattttgtctaagtggtcgttgtagttaccggccataatatgtatatgtatggcccactataattccctttgaaatacattgtccttgcatgataagaacagggtgccccacaagttgtggtccaaaggtaggccataaagagctatggaaaaacagtttcctaatgaatcagtacaaacactcaggtttgtattttatataatcaactcaccaactttcgaaatttggccccatttctggccttttgctttagtaattttgtttaattaatttattaattttttttttttttggatttgcaggtaaatgttaacgatgcacggtttcaggcaatgtacacttcccacttgttcaatttggacccctcagatcccaatttcaagaaaacaaaagctatggaaaaaatccttgaggagaaggcccggcaaagagaacggaaagaacaagaacttactcaggcaataaagaaaaaagagagtgagattgaaaaggaatcacaaaggaagtccattgatcctgctttgtcaatgttgattaaatctataaaaaccaaaacagagcagtttcaagcaagaaaaaagcaaaaagtcaaataactggatgttacttatttttgaactgaatacatcttttcctaaaatgtacaaaaataataggagggaatatttattgggaacaaagctatctttcaagaacatgaataaaatctttttctggacatagtaaaatttttctccataaataattgtacttaattgtggatgactgacaaatttttattgtatattcctacagatcagtcataattaaattacctgcattatagggtttataaaatttttatattttacaatgttcagttctaactagtggaaagttactctagctttttaaaaggctgtttacaattctgtgtaaaaatagagcagtatctactcaagtttgtgtaaatgttagggataatttgaaaaatatatatatttaatacattaatttctctggaagcaggaggcatgtttaaataactattaaaataatttatttttctagccataaaggatggaagtcaagaactttttgttgtttagtcatgttaagtatagtttatgaaattaacttgtaaataaaagtgtaaaatattttcattattttgtatagcactgatttattccattttatgcatctcaaagtactctctggaaaaa

SEQ ID NO: 100012 - DNA, 1076 bp, Homo sapiens
aaggccaaaaaaaaaaaagcaaaaaaaaaacttacttgttaaaagttacacatttagaaagtataatttgcatcacaaaataaacatttgctagatttagcatcattgcgcaaaaagaacaaagtgaaaatgagaactttttatttgagggtagttggggactcttgttcctgcagcctactaatgagtcacactaagtgaaatggggcctggtttttaactacaaggttttacctctcctgctctcagtaatgttgcttccagagattctaccttattgctatacaaagatctctttgttttggtaatccacagtcagtttacagacaacaggtggtaccccagagttctagtgattgagtcttcctttctagaagagatatcttctgccctatactcctttttgggggtggaaaaaaaagcactgttgtacatttgaacttttttttgctctctacaggctgaaatggctttgcttatgatggatgaggacgaggacagtaagaaacacttcaattacaacaagattgtggagcaccagaatctgagcaaaaagaagaaaaagcagctcatgaaaaagaaggaattaatagaggatgactttgaggtaaccatagacaccaggcatagcctcttaaagctggaattgaatctaaagtcagctctgcagatagaaattgagcatagtcaaagttacccttgaaaatgtcttaggggcccggtgcagtggctcacgcctataatcccaacacttttttggaggccgaggcatgaggatcacttgagtccaggagttggagaccagcctgggcaacatagtgggaccctcatctctatgaaaaataaaaaaaattagctggctgggcgtggtggctcatgcctgtaatctcagcactttgggaggctgatgtgggcagatcacgaggtcaggaggtcaagaccatcctggctaacacggtgaaaccccatctctactaaaaatacaaaaaattagccaggcgtggtggcgggcacctgtagtcacagctactcaggaggctgaggcaggagaatggcgtgaacccaggaggcggagc

SEQ ID NO: 100013 - DNA, 1553 bp, Homo sapiens
gggagccttgtttccacctcatatgcactactcattctttctttcctccattatgtggaggaaatgcgtatgtgtaaatgtgtttggtaaggttcaggccatacttggtaagtcagtacagaaatcactgtaaggatttaccatttgttctcatgcattttgccttccccgatcattataccacacacaagaaccccaaaaggcttgctcctggagcaactccacgctggcattgtaaagagaaggagtttatgaagtttccctgtttttttcccttgtgactagtgggccagaatagttctcaacaggaaagtcagaattgctcaaaattacttcctgattgttacagctttttagtactgacattttattgatgagaaggagattaagataaataaagtctattatagaatgtgagattcttgggaattggacagagaagtggaaacttagcatattctgctttttatcatacctgagtggtcatttctagaagatgatggattttagccttatcctctggtttcaggaaaccaactttataatggagaaatgctaagcattatagtttccttgttctctatccaaaatgtttcctttggcatgtgaagtctggtcaaattgcagaactcagaataggattcaaagaataagttaaatggtttgatggcttggggtagccagttttttggaatcaacacatttaaattgagagtaagctttctgtaaagttattatcagaagttccaaagaaaaaaggtatagataaaatttgcttgcttataatttacttttgatttcagagtgttcccagagggtaattgtttctatctgggcttttctgtttttgtgtgtgtgttttgcagtgggttttgttttgttttgttttgttttgttttgttttgaaaaagcaaaacagcaaggccagaattttttacataaaatttaggacaaaaagctagtgtcttgccatgtttgtttattcattctgtaataactgttttgattgcctaccaggtgctgagctctctgctaggctagagatacagtagtgataatacaaacaggattgcatccctcatggagtctggtttaaagaaagacatgttagacagataaatagtatgagggtatggtaaatgttttcaaggaaagaaatagaagatataactggatagaagtaggagatatgggagtttacattgggtaggcaaagaaggcttctctgagatgatggcattagagctgagacctgtggaatgaggagtcaggcatgaagagctgggggaagagcattgcaaatgaggggagagtgggtagaaagactccaaggtgagaatgcactgtgtggtgttaagaattgaaagacatcagtgtggctggagcattgtcggagagggaattggtatgaggacaggctggagactcagtggaaactacccctgtagggctttgttgtcctgacaacaaatttagattttactttactgatagtggaaagcccaaacagtctttaagcaaagatgagacataatctggtatagattaacata

SEQ ID NO: 100014 - DNA, 1929 bp, Homo sapiens
tgtttcaaactgttggttgaagctcaaggcccaaaagcagtgtttttagttgttttatatatttttacttttaccaaatgttttgagggggggaaatcagtgcacgtgggaggaaagggttgcatacttctgatctaaaccattcattttgcagataaggaaccagaggcccaaagttttagattttattcttgggccatatatttcttcattctgtaggtcaaactagcattttagatgtatctgataatagaagagaggatgaccaggaattcaaaatttagctgtgcagcttcctacctccatgttcttagacaaattgctaaatgttctcagtctgtatatactcatcaacaaaagagaactgtatttagtatcgtttctactttcttagaatttagaatgtatctgagaagatgatctggtttgatgatgtctctttttttaatgaattttgtgtcatctaaatatttaaagatccacccaactatgtcctctaaacactactacaaaataaaaaacatctttattatcaaaggggacagcacagtatttacatttcctttactttggcaataatgagggtctttgtaaatggatagatcagccttagggctttttctcccaccttgttaccccctctagttattgcataagatacctagaaacgtgaatcgggaacagcagactataggaagaaagaccttttgagatgaaatataagagcaaatagcagcattgaaagagctaaaccatatgatgaaatggaatctgaacttggtggtccttctgatcttttctatgaggcctcacagaatgcttgagaaaagattgagaatcctttgctcatgggatatttcaacagggattccttactaaacaatttttgttcaaaacctgtagtttgcagagaacataggctttcacttggatgacagaagcaagtggggataattaaagacaagaaaagccacttgtcttttgctacaaaaattaattagtatcctgagaagaattagttcagaagttttcttagcatctcaaaacagaaaagtttagagaaatgaaggctgagcctaaatacagtatttttctttagtggcttgaccatgtatcaagttgctaggtttgtttgttggtttgttttgattttgtttggttaggttattgttgtttgttattaggaaataacttttatagaagttggtcctatgtcactgtatgatattggggtattacagatatttaccattgcatgttatctttgttactctattaaatatgcataaattatatttgtctttataaattatatgtttaagtgattgccagacaataagacattttaagctaaactatttggatttttcctcaggtcttaaagaaagtgcagaagagatggtcaaaaacaaattggaaggaaaggataaactgaccccttgggaacaatttttagagaagaagaaagagaaaaaaagactgaaaaggaaacagaaggtatcattgataattatgaccaaatgtttgttgaataccaaccatatatcagatggtaccaggtgcttggaatccattatctcaaaatgtaaccactcactgaagtaggccttgttatcatcccaattttaagaaagaggaaagtgagaatgcagaaagttttttcatcatggccacataatggtgtacaaagcctggtcacagtccagagccacttcaactgctgcattctgacattttacatttacatgccacctacgtaaaacacatagttaatatctagatataagcagtatgattctgttctgtgtttctgagcaaaagaggtacatacagacatttttccttgaggatatatgcacatagaggtttttaacatgagtgaaattatgccatactttccatctgtcaacctgcattttcaccttacag

SEQ ID NO: 100015 - DNA, 1059 bp, Homo sapiens
attgagtgttacagagtcaggtttaaataaagagtgctggtttcagcctatatcagaaatgtttaaatatacattttgtttttataaccaaagccgattatagtacctagtggagttattttaagttgttcatctcctgccctttgaagacttttcagatatttcaaatgaataaggtaggcagaatgtatactcttatttttgtgtgttttgcaaggatatttaaaaatatttttatatgtatgcaaactgccagaataattctgaatggattgtgcttaaattattattgtcataattgagtcatctatgtttgtggttggctgtgaaagatgtttttgccccttatttgtaggattattgatgttatttttaactaattcagaagtccttggatatgcacttaaaattttttaaacaaatttgtgcaaaactaaaagcagttacaatgaagttgtttttcagtcacatagtggctgctctcagaggctaaaactgtctctgaagaatgttctcgtacttatgccaagaggcttctgggatgggcatatttttaagaacttagaacataaacagctgtgatctgtggcaagagatttaaatgacctcatgatgacaacaagaacaaagcattttttaagttatcatggtggtgtgtgaattcattgcaatgtgtttcttatgctgctatttgggtgtattaagtgagagccaggcaaaaaaaaattacagactgtattaaactgaagatactgtttctttattgttgtaaacaaagtaccagaaaaatattatttcctaagaataaacatttcacgaattattttagagttataggtccttttcttttttgtttttaaccacatgaaccacttgaggatcaaggccatttatttcgatcctaaagttttgattcattttctgttagagagaatatgttccaaacatgaaagatcaaacagatggcttgaaataagaatccctcctttaagacagatcaattaagtgtttattaagtatttactatgtgtctggcactatgctaaatattatgaaata

SEQ ID NO: 100016 - DNA, 1104 bp, Homo sapiens
gcggccgggaagaggcgctcctcacttcctagataggatgacggccgggcagagacgctcctcactttccagactgggcagccaggcagaggggctcctcacatcccagacgatgggcggccaggcagagacgctcctcacttcccagagagggtgaaaatgccatcttcattatcttgcagcttataggaaaaagaagcccaaagatgttatgtaactgcagaattattatccaatataaattttaataaaaaggggcattcccaagcatactgctatgacagtgcaaatttatattgcaactgatttttattctacatgagaccctaagtctttcatttaatattcagaaatttaagtctgattttgatatcctgtggtctaacagcatcttttaaaagagagtgaccataagatctgaacacgagttagaaatgaattgtttctgtgtattaagtgaatttttttttcattaggtgatgatggagtcaatgtagaagaagatgggaaaacaaagaaaagtcagaaggatgatgaagaacaaattgctaaatacaggcagctcttgcaggttattcaagaaaaagaaaagaaaggcaaagaaaatgatatggaaatggaaattaaatgggttccaggtaagaattagatactaaatgttttctctttttcgaatttcagcatgttgagtaccttttaaatatgaaggagccggaaatgttttggtgaggaccttaacatcatatttgcatacaccatttaactaacttaatgactagcattttagactcttaccaacttatttttaattggtttctttgatttactaactataaatttttcctgtccatttatcagagtagcttttcctaggtttgagcctgtattctcaagatatagaaacttgaatccaggcaccacgtgttctaaagttattacacttcttttgaatgtttaattcttaagtgaccttttcttccataacccccactagtccttaattcatgaggtttcactaacacaaaatatgtattacatagtcttcgattttcaatcttgctgcgaatagtcaaagaaatatagcatagtagagtaaaatagtac

SEQ ID NO: 100017 - DNA, 1140 bp, Homo sapiens
ttaattaaatcctaaaatgcttctttagtatgaccataatgccatttaacttttgagttttcgagatcccatgattggcctatcattgtttcttttagactcctgaagacactgcttcatttttctaagcttttcataaaatactactccttaacagtatggaaaatcatgtttaatcattctggtttctttgttcagacatctcatattaatacaaccacataattgcttaagtatttaatactctttgaaaatgtgtatttgcaatgggagttaagttgggtgcaaagggcctcacatttttttaaaggccttagtggctgatgcttgttaattcttttggcattccaaataactagatgaccattttattttttattgttcacagaacagctgagtccttttttcaattttcctctatctgtgtcttttcccctcacacatgtggagaaagacgtaatgatttatcagtatttcttttttatttgtatgcctatatgggcatttagaacttttctgaaaattctggatagtgtttcttcactatcagctgtaagataaaggaaaaaagataactttttatgtacacttgtgaagattggatacaagttgttcaaatagatttctgttttgggagaactgaactaaattttaaaatgacattttttggcattagggtagctaatattgtgaataaataagcattaatttgttaatacattcttgttaagagcttgggctctgctagtttcaaatcctaacttcaccatacatagattaggtttactaaaccccctatatctttcttccatagctgtgaaatgaggatctaataataccaggcttatggttggaaatactgaaatgatgtaccttgtatcttgtatttttatttcttaaaactttaataaataggccgggcacggcagctcacgcctgtaatcccagcactttgggaggctgaggcaggcagatcatgaggtcgggagatcaagaccatcctggctaacacggtgaaaccccgtctctactaaaaacacaaaaaaattagccgggcgtagtggcgggcgcctgtagtcccagctactctggaggctgaggcaggagaatggcatgaacccgggaggcagagcttgcagt

SEQ ID NO: 100018 - DNA, 1293 bp, Homo sapiens
tgcttttagagttttctgtttctttttgtctttctgcagttttactatggtaagtataagagtagatttctttttgtttgtggagcttgaggtttgttgttgggttccatttatttgtggagtggtatctttcatcagttttggaatattcttagccattatgttttcagatgttttttctttatccttttaggacatcagctaaatacatgttagatctcgtcattatatcttgcctatctctactcttaaatttttaatctgttgtctctgtactgcattctggatattttcttctgacctatcttccagatcactaattgtcttttcagcagtgttaaatctgctgatagacctctccattcagtcttaatcttggttattatattttttacttatggaggttgtatttggctatttctcaagtcagaaataccactttttatattttttactcatagtctctgttttaatatttcatgtattttcaggttggtgtcttattttacaaggtatttctctcttgtttatttgtgtgcctagttaattttgtgtgttactttgacatttgaagttagggtatctttgatcagagaagactttaatttactttggttggtttagaaccacatttctccaaatgttaaggcttaggttccctggcttctgcagatgattaaagtctgcatgagggctggtttacttcagattgaccatttccctgggagtatatccctctgggtggctgcttaatgtcagggtactaattgaaattccctcttttttttggtctttaacttttgtcttcttggtcctgaaagcctgctaaaaccacaattgactttcatagctctttgttctgtggatcaggaaacaggaaatgatctcagagcaaaacaggtctttaccctggagtcatccctctaatattcccttcttggttttgaaatagtaagtcttctctaacttgacagttctttgaaacttttctttcttttcttaacctctttgaagctttataaaataatatttaatccaacttaattccaacttaatatcttcagtgaaagggttagtctgaagtacctagcttgctgttaagaagttcctcaaattatctttatctttattcaagttgtttttgttttttgagatggagtactgctctgtcacccaggctggagtgtagtggtacaatctgggctcactgtaacctcttcctcctgggttcaaacgattctcatggctcagcctcccaagtagctgggactgcgggtgcccaccaccatgccc

SEQ ID NO: 100019 - DNA, 1088 bp, Homo sapiens
gtataaggttgtcgtcagttctgttctatttctttaaaagaaagcactggataaatggtatgacagagataagttggttattacaaaattgatcttcattatatgtttatttttctgtatttcatgtaaactaattcagtcatttttcatgtgtgtgtttttattcacatttccttgagcttagcatcttgttttgcttttaatttttcgtttggatctcggaaccatcttgtcccaggtggtatgtggaggagatactcttatttttgtttccaagcctcgtatcttgttagtctctagccaaagtgatctatttttaaataaaatttctcaagatgctctagcttcctatagtggatttggaagtgagtcacccttactgttttcattgagtcaagttgtgacttttagagttcctgacttcgacaggtctagatatttgtgtaaaggaatgtacaaattacattgatcctatttttttctgtttagatatatccttcagaatttggaaaggagaggatgaaggaagagcaagttcaaggaccagtagagctattaagtattcctgaagatgccccagaaaaagactggtattaaatcactatagaacataaaactaaacctcataaattcatgtcattagttcagaattctggtcaccttaatagttaaaactaaagtttatacttgtgccattcgtggttaaaacaggttgcaaaacagatttaaagtctgttaaaagtggtacattattccaagaagatttttgttcgtgtatatttctatttctgtattcatgaaagtaattattgcagtttttgaaaaacatttcatgattaaactgatttggagttcttttgaattctttcagcctcgttgctctgaattagtacgttttgcttttttttttgagacatcattgaagctctgtttgccttcaaattatataattttttcttatttgagaatcaaatagaaaagtgaaagaatgataaaacttttttttttatcatcatggtgcaatatagaaaataatttaagatagtttttaagccactaggtggagctatatttgcacttaataaaaa

SEQ ID NO: 100020 - DNA, 1985 bp, Homo sapiens
tgattttatttgatatccatgtattcttttcactcagctagaagtttcactgagagcactgtttgcttctcttttaccaactgttgtatattgagcacttagcacgtagcaggcacactgttaagtattgaatgaatgtctggatctacttgcgtgatgtgagcatgtgttaggatttccattaaataacttggttaagtgtattttcctttactctgtttcatagaagttatggttaggatttctatcataaaaattgactaagcatttactgaatatatatttgtctttactgtgtttcatagaaattatatttttactggagttgatgtcaagataatttggattcagtttaattcagcatatatcttttcttaatttctttcccctttaacattttgcagtggttcaactcataatgacaagagacagtgatggttatgaaaactcaacagatggtgaaatgtgtgacaaagatgctctggaggaagattcagaaagcgttagtgaaataggaagtgatgaggaatctgaaaatgaaattacaagtgttggtagagcttcaggtgatgacgatggaagtgaagatgatgaagaggaggatgaagatgaagaggaggatgaagatgaggatagtgaggatgatgataaaagtgacagtggccctgatcttgcaaggggtaaaggaaatatagaaactagttctgaagatgaagatgatacggcagatttgtttccagaagaatctggttttgagcatgcttggagagaattagataaagatgctcctcgtgctgatgaggtaaccttttgaataaacaagattatttgtgaaaaacacagtacaagcagcttttatggctggtagaactgatgtcattaagtgggaaaagcttattggtaatagtattctttatgattctgattaaaatttgatatggaatataattatatgaactagaagacgtccaagcagataagaagaggctctacataaataattaaaagttgcatgaaatttttaatacttgttttagctagtagtttgtatttctgtttgtacggcacccaaaagaaatgttgcagggtaacatactcaacttccttactcatgcatgcatggcaaaatagctgaacaaacttggtggttaaaaaatcagctcatgatcatgttctgatttaagaattaagaaccaagtaagagaaagtacttacctgttatggttttactattgtttggctcatttgaagttctcttttatatactgaattacgcttagataactcctgtactattaatttcagagcataggggacagaaggcattacatttttagaatctttatttttcaagtattgagaatgatatggattatgtactatttaattcttctcatttctcagattacacgtcgattagcagtttgtaacatggactgggatagattaaaggcaaaagatttgctggctctgttcaattcatttaaacccaaaggaggtgtaatattttccgtcaaggtgagaattgatttcattttgaaataaatatttctaggcattttaagttaaatctgatttttttttttttttttggccatagttttcctttttaggaaaatactgtggaagttgtccaatccaattgagtgtgaaacttatgtaacaggtataaatgttagaaaggaagaggtgaaattattattattgataggttatatgattgtttacacattaaaaatccaaagaaataaaagctcagtaaagggacagcatataagaagtgtttttaacaataaattgcattccttattgctaacactggccaattaaggaaaaaatctaattatactagaaacaaaaccacataaagttcttggaaattaccttaataaacacaaatgacctatgtgaagtaaactgtaacacttgataaatttgaaaaacttacataaattttgaggataccatatttcaagccaacctaa

SEQ ID NO: 100021 - DNA, 1036 bp, Homo sapiens
tcaaataatagagtttttcttaagtgaccacttacatactcatctacaataaaccccaactaactaatttttcactttgtgtacctcatgctaatatccgtggacagtaatgtgcctgttgtgttccttttgcttttcatccttgtgatcttatgtcacatggaatgtaaaggccacatatatatatgtgtgtgtgtgtgtgtgtatatgtatatttttaagaatatttagtctggatttcatgaaattgacttctgaaataatttgcctcaattttgtttcctggtggtttgagaagaaagttcctgtggtgaaattgaaaaggggataaagggaagtacttattttaaaacataagtaacttgtggattgttgaatactggaaaaagagtgttacttccccgttaacctacgcctcgtgtaatccttcaggttggaagtcggatcgcagaccgtgtatatgacatacccaggtaagtggtggtgatcataatacaataccatcaacttttgagtggaaattcaggagattaaatgctgagaacttgctatctgaaatggcagaacctggaagaatttactcagactggtgatttaaatcactctgtaagtctcctttttcttgtctggagagcaaatgttttcttcattgttgcctgaaaaaagaaaagaatgtgtggaagcacaactcgtatctatctccaagcctgaatccacttgatttggccaaaagcaagtaatagaaagattgctccaaaaatggagatacttaacaacatgcgaatttttaacatccgaagcctctgtacctaactgtgccatattgcctgtgttcatcatcaagatatagggcattaggtaaataaggttatctaccaccagggattctccagctatgtactataattttgacaaagctttttaaaaacaaattgcaatggggctctttttgttccagtttttcaggaagaatgttcttagtagataaaattttaagttttcttattataggtttttttttttaaacctatggcct

SEQ ID NO: 100022 - DNA, 1031 bp, Homo sapiens
gacagcatggcatggaggataatagttccagctcaggattcagactgaccgaattcaagtgttgactgccccttgttagttgaggcacttggtttgacttacttagcttcagacacttagcacagtactttgaacctggtacgttttcagtaaaagtttaactgttacttaagttcttattttttagtttaacattaatacttaatggtatttcacatgatgatttctaagtattccactgcttcaagaagtctgagaaatagggataattattgataagtatgtcagttattttcaagttaatttacattagcttctttgcattctttatctggatgtattattgagttaaaatatcctcattaaatctgttcttcgagtccacatcatggagccacctggtggaaagctggctcatcacaaggtcctgtgaatagctagcagacagacttgccttgtactgtaggctctggtatatacagcttgtaaggtgaggctgaaaaggcagatgatgtaaccttctggaagttgtgtttactggaatgattttacctaagaaaaaataattcttaatttatagactgtgttatggacagagcataacctctgtgtctttttttttagaaatttcccccttgctttggatcttggttgtggaagaggttacattgcacaatatttgaataaggtatatttattcaatgacctaatttactttgaaaagtaacattggctaattttaaagaaagactttcctaatcagtttagcttgcaacatatttagattttaattatatcagaattgttaatttgtttttttttttaagtggtagaatcaatggtggttttctcccttctttagaatttttttcttaaagggtttttctctgaatccattatatattatgtttctaccgataatttatttgaatctatagaagatatatttctctttgttcacatttttttataattaccataaaaatcagattggcattcatacagaaaatgtgacttttagctagaaaaat

SEQ ID NO: 100023 - DNA, 1050 bp, Homo sapiens
tcgattaacccataacttacacagttcaaaaaagaacttcttatcattttaaagatagaaaactgtatgtgttcatggtttcatggcactctttctctccctttttttttctctttttaagggaaaagctctgattgacaatgtttagtttgtataacacatcttaattgacacaaggtaggaatgtataattttttactgttaccttaaaaagtagctcaaaaaatgtatcatagttaacaagacaaatttctaaacatacaactccattagaatcttcaaatctagtattaggtgtaaaaagggccttagagtattccagatgataggaagaaaaggggataagtaggggaacctgtaatattaccaccaataactacccccaaacagtgccatatgaagcagaaatgagagaatgtgtgttctcaaggcctagggtgagatcaaggctaaagaaggtaggacagggtgctgtactccattagggctagagaaatctcgaaagaagacccatgggcaatcagtgagtaataagcatgaagtcagcatggtacggtgacggggtaggacagtaggactttgttctccgacaggagtaacttggatccttaccctatttctttactagatagggaaatttgagtaacttacctttttgagcatttatttcttttaaaaatgcaaatgtgtggctgggtgcggtggctcacgcctgtaatcccagcactttgggaggccgaggcaagtggatcatctgagatcaggagtttgaaaccaacttggccaacgtagtgaaaccccgtctctactaaaaatacaaaaaatcagcgaattgtggtgatgcatgcctgtaatcccagctactctggaggctgaggcaggagaattgcttgaacccgggaggcggaggttgcagtgagctgagatcacgccattgcactccagcctgggcaacaagagtgaaattcccgtctcaaaaaaaaaaaaaaaaaaagcaaatgttactcacctcaccctttaaagagataaagggtgtgaagtaccaggacc

SEQ ID NO: 100024 - DNA, 1094 bp, Homo sapiens
accctggtgagagctcttttgttagagtgaggagagtagaagaggagtaggttgaggagtaagtggaaagtgaggaactggagatagcagatatgtgctgttctttcaagaagtctggtggtgaagaagaggtgaaggatggaaaggttacaggtgtcagaagagaggagaggaatagaagttgagatgaggttgtttttttttttctaagacttgaatttatttaattgctgactagaagaatctaagtgctttcctagaagaggtgactctagaagagagagaaaagataattgatgatgacaggtgtctgagaaggtgggaagggtgcaatacaaaggccagtggaggggttgaccttggtaaggggagaggcaaagttatagcaggaagggagaagaggtagcaccaaaggatgtaggtgtttatgtttgaaaacaagaagttcccatcttgtgggtctattttttttgtcaaactggaagtaatatatgctaagaatgaaagggtcagagttttgagaagtgaatggaaccgtttgaaatagtcattatagggaatgagaaggtgaactgaccatcaacaggaggtggcagctcaggaccaggcacgaaaatcggatagttgaattagtttgggttgggggtttgctagttaaaagtgacaaaaagacaaaggtaaaagataattctaggagtataattgagataataggttaaagaatcttagctggaagaaaagggaagtgggaacaagaaagagtgagctgataaattgggaggaaaaagaggagctgagcacaggtggttccagtgtggtcagggatggtcacggttgaagttcctgaacacactggagggacaggagggtatggtcagaaaatgagatgtttgatgattttggaagtaaagcagttacaagtgataatggtctgggacgtgtctcaggtatcaaggcagaggtggtgtgatggagtggttgattagagatgagattttaaaatcttaacttgctgattattaacatgaagtcacccaggatggtggcagtactggagtgtagaggaaaactgagccaagtgccaaacctttcag

SEQ ID NO: 100025 - DNA, 1051 bp, Homo sapiens
tacatttgtggtgtattttttttcttaatggttgtggtgtgtctcatttaagctgctattattaattcacagaacaaaagtccagaatgttgacctaattttacaaaacaagctgcatatcagctgatgaatgcatgagaaattttcaaggctttcacagtggtcttaaggtaagttcagttatttttttaaacaatactcagtattgtttttagtaaactgtaataaattaggtttatttttgataagcagttgaacttcaccttaaaaacactgtgagagtcttaaacagttaacctactagccagatttttctgttatctcaaagcccagggcgagtcggaagtcccaaagtttcagtttttcccaggtggtcttcagtagaggtcccccatgatgcattaggaggtgttactcttttgtagatggcaaaactggaattcgatagaggttgaatgactttgccccaggttatataagagttaaaactgggagtgtgatcccaaagtccagattctttccaccaccctcacactgcttctgcaagaagggagtttcagtgtggcagtgtgagtggcttgtgagggaaggctggagtgctgcacagttacgccctgtgctctgcagtagtgctcttgaatttctgtatggctgatgtaggtcagaccttcagagagtgttatgcctactaatcttaattagtatatcctaatactgattgttagaaggcattttagaatttctagtgcatcacatgtttatgtctaaaaaattaaatctcttttctactggtgttgtccataactaatgcataattaagccatagcagcgagaagttgagcagaaatgaaagcaccatacctgagccaacagactcttccaatgtgagacccagtttacctctggtcacttgatatggttaaaatgtgagcactagaagcctttacggagcatctagtctggtcactttaaagaccacagatgattggcccaaggttatccagctgcttcatgacactaagaatatgatccacctttttcttgatgataa

SEQ ID NO: 100026 - DNA, 1047 bp, Homo sapiens
ttttgactttgttctatcttagaggaaggacttttcttccttgtgtgtaagatgaatctttctgctgtgctctttatcccatatcttctttgagttcttgcaccatcatgtattctttcttgggtatgtttaatttcttggtgtcttcaggttcctctccattgcctgtaacagtgctcggatctcttccaccttagagtcacttttctttcatagggcttcacgtgaacttggagttgctgttctcactttccttcttttgctcagtccttcattgtcttctggatttccgttatattctaatgaaactaatgttcctgaagtcattcagtagtaacagtcatgatagtattcatgtaagaatagttaatatttaagccccatttgtatgctcagtactattcttagtagcttacatggattatctcatttaattctcacaacaaccctatgaggtaggaaactatatgaggcgaaatattgtgaggttaagagctttgaataccagttgcctgggtttgagtcctacttatactgcttaactagctgtggtactttaggtaagttatttgacgttgtttatagtttccttatctataagttgggaataatacctgcctacttacctcgaagggaaactgaaacataaagaggttaagtaacctacagatttgcaccatttagattacaactcaaacagctctgttaaccacttttcctctttattccatgctgttggtaaccacattgataaaagcaggttaatggctaagtaattttcactttttctgaccttcctgtagcagtctgtggtatttcccttagtgcacctgtagtcccagctactcaggaggctgaggcaggagaatcgcttgaacccaggaggcggaggttgcagtgagctgatatcgcgctactgcactccagcctggtgacagagcaagactctgtctcaagaaaaaaacaactctgttttctgaatgtttccttgtaccaggaacttgcacccatggtgacaactacgatttatttcattgttttcctatt

SEQ ID NO: 100027 - DNA, 1064 bp, Homo sapiens
ctgaaatataccacatttataatatggtactttttttacaggtccttttttattttttctattctgtaacagttcttggagcaaatgctattagagatttgctgctttggtggtgtggccctttgagtttgctttaagttcatttataatcgattatcttatgttatttttaggattggggatacagctgaaagagagagtatattaggaaaaatagaaaaaccaaagaacatttctcattattttagagaatatattttgtatgatgtgttattatgtctgtatgtaaagtatttgtatgacagaatttactctcaaagtctttatgatttggtgggaatctagattatgttagaatataaaggaagttttaaggattaaaaaggtacgtgaaaaagtttctaaaaacaacataatagatttaatggatgtttaatatgcttgtctttgaattaacactcgttggtattaatgatctggatgtgaagtttagacaaacggtgcttcttaaggtgcttaacagttgagaaagactttatgaaatggacttgaaacatgctaatttcaaaggttgtggtcttagatcgatggaactacaccgggtactatgggcccagaataaagactagcatggaattcctatggataaaatctgaagggaaagattaggccttggtgtctgtgaagagaacacattgacctgaggatttgggttttagacacaactttgtttttctagaaaggcaaagcatgtgggattagcagtgaaaagctgtgggttcttttagaccttacgtagcctggaaacgtgtgaccttgggcaagcggggtagcagctctaccccacgttctaatggggtcattggacaagctgattgggatgtgcacatctgacctgtctgcccagtgtcttctgtaaatgcaagttgttttaagaatggtctgattccaaactgataagattggccttaagaagcccctgcctgatcacgtgagcatcatggaacccaaagatgatttgctgcccaccaccccgtctcagaacagaagggtgggaagccaga

SEQ ID NO: 100028 - DNA, 1031 bp, Homo sapiens
ttaaatattttgaatatttttaatacaaatcttatttgtaactaacttgttgatgatctcttctttggttatgttaattggctatttaaccatttcacactctgatttatttctcaggcatgaagatgttaacaatgctgtgcgttttaattaagtagttaattaactggagctccctaagtcttaagttcctgatttttctctagaataccagaaacttaagtgccaagagctcagagaatggcttccaggacagctctagcctcactgcagcttaaaaaattgcaaacagatttttttttttgcaaaccatatgtcagggaatttctcagaggttttctaagaaattcttttatttgaagttttagaaacactatcttcagttgtattgctgataattcataattctgttgtcctttttaaatgataatataaaaagtatgcattagtatgtggggaagttgtttttgaaaacttacagcagttggaacttactcctgtaacaactctgttaagtggaagtaaacaaagataagtgagcataaaattggtcaaggtaaagtaagtgaaatgaaaccatataatagtagagtttttttttttcttttctgtttcagtgaaaataagtaatgttgctcttaagagagaattttgtattattttctcctcttcttttttttttttttttctagcttgggctctaggaaaagagccttttatcccaccttgtcttccagtccattttgaatcaagaaagactcattgaagactcctttgagaaaagtctgttttgaagaaggaaaaagaaatactgtttgagagaaggcaaacagacaaaaagggtgatagaaatatgtatttttgttgtatatgtaactctaagagaccttcctagagtgaatgaaggtagaaaactgaaaagggagtaaattaaggaatgattgaattttgtgggtcttgatggaaaaacgctggtcttcttttaatgtggaaaaacagctagtgcttcagtcctaggaattatgtctctg

SEQ ID NO: 100029 - DNA, 1014 bp, Homo sapiens
taagctttgtgaggaaatttagaaataaattattttaaatgcataagccagatttctcttatgattccctttgtgtttatccaattccttcttaaaatatttggatgctgctagcatttgatggtatgcccatggaggtgaactaaggtttatttattcattaatatttataaattaaatggaagaaattgttaatcctaattaattagtgaaataactactataatagataatcctgtgaatataattctatctttaggtatagaaaaattgctgatctcgaacatgttttaagcatttcatagcaacaaataatgaacagaagaaattatttccttaaagctcacaaatctatgtcttctgagtacttacaaattctctaattagtctgatttacagcccattattttatgtaaaagtatctgctaaagcaatttccttgacaataaggaagaaatgcgacttgcctctcacagctcacattctgactctgtttggaattcccaaggatgagtctaattaaatgggcttggcttaggacctggctgtagcttaaaataccttcaaaaccagaaacacattttctccactttttaaagacttgatttatagtgcatagaaagttaaattgaatattgatccttgaaaagcaaatgtgtcctgtaaaaaatgacaacaaaagaatacaataaaagatgacagagtgattgattgtccaaagcctatagatagtagcctcccccttttatgtcatcttctctaggcatctgtagctctgagagggtgatagggatgaagtgttagaggaggattagttgcaccctgacatgaactgttacattttataagaagattgaggaaggtggtaacaaattatttctaagaaggaattttgagaaacgaggaacggggcacaagatcagtaagacctatgatataactccaggaagggacacgacggaatttcttataatttctcaaactctgaagcatcttcaaaaagaatttaagtca

SEQ ID NO: 100030 - DNA, 1012 bp, Homo sapiens
aacagtgaggaggcacacaaataacacagctctaactccactgaagacagggtaagtgacagcttcccctgagtcagatggagcggggataagtgtgccttgatgcgaagtgggaaaccagaggaggacctgactgagcaataaaactcttggctgagactaaaatgatttcaaagcagaacaagggtgggactgtttggtagtggaaaagaaagcttggtttgatgcctagagagagaattacatgatatgaagaaaggtcattatttattacctaatcaagcagtgtaaacataccaacaagcttgagacagtctttatctagcattattagatgtgcaattcaggtgagagaatattaccaaatctaacctgcttatcaacacttgtgtaatgagaacataaaagtgaatgaaaatgtatctagtctgcaatgaagtggtaatataagagactcagaagatccttttttcctactttgtgggattgagcctaaatttaacttgaattatttttagaagggacttcttatttagcctttttaaaagaagaatttatctattaataggaaatatgcattttattattaaaatgagttttattttggagtagttgggaaatgtggaaaggagaaaccagttgcaaaaagggatataaaaagaaagttgtcaaaaatgtttaaagatagagtatagcacaccaaaccccacagccatctgcccaggaaactctccttgttgccttgttttctctttcatttgtgtgggctgttctctgcttaggtgcttggaatgtccctctgatacagaaatggggaagggaagtgctgggaagggaagggcatggtccctttcaatgatacggaaggggagaagggtgtggtccctggctagggctccgcctccaggcctgtgcccacaggtctagttgaggacaggcatttttgttttcctgcccaaaacatttcctaagaccaccttggtctgccacgcccgcatcctgtgcctataaa

SEQ ID NO: 100031 - DNA, 1034 bp, Homo sapiens
gtgggtggggccagataagagaataaaagcaggctgccggagccagcagtggcaacaggctcgggtcccctttcacatggtggaagctttgttcttttgctctttgcaataaatcttggtactgttctctctttgggtccacgctacctttatgagatgtaacactcaccacaaaggtctgcagcttcactcctgaagccagcgagaccacgcacccaccgggaggaacgaacaactccagatgcgccgccttaagagctgtaacactcgccgccaaggtctgcagcttcactcctgagccagcgagaccatgcacccaccagaaggaagaaactccgaacgcatctgaacatcagaaggaacaaactccggacacgctgcctttaagaactgtaacaccgcgagggtccgcggcttcattcttgaagtcagtgagaccaaggacccaccaattccggatacactgggatttagatgccaactttactttttttagggtctgctgggctgagcctttaaaatttccctttgcttttagaaattaatttatggaccatacttgtatttgacccattatcccaagaaaattcttaaagcaaacataaaatacatggtccaggatttaatctagttgtcatatcattttaggttttcttaatctgtaacagctgttcagtctctctttgtctttcatgacaataccattttaaaaaattaatagactttatttttaagagcaattttaggtttacagtacaattgggcaagataatagtattatgtcaatgtaaattttctgattttgatagttatacatggttctgtaaaaaactggcttgtttttaagaaataaactgaagtgcttagggaaaagagcatcattctgcaatttactcttaaaaactatatatatagttttttctatgtatatatatagagagagagagagagagagagtgtgtgtgtgcgtgtgtagacaataaagcaagtgaagtaaaatgttaacaattagggaatctggaagtctgtgttct

SEQ ID NO: 100032 - DNA, 1033 bp, Homo sapiens
ttagcattcttcccacagtcttgaagtaattgacgtttttgcttgaggatgacctttcctgtttcctccatctctagaaactaccaacatttgattaaagtagggtaggggagaggtgtgggatgtaggtaggtaatctcaaaaatgttttctccaaacatgaaagatgtgactatgcttctgtcatcattattcaaaaacatttattctgaagtctgtattttatatatgcatcacctaatcccatcatcttctccatcctcttcatctctgggacatttccccatcttccttagagcctgaactacaaaccttaccttcataccaactcattccatctctctcagtgactttgttctcctagctagtgattcttgtaaaactgtagcttctcggtctttatttcaggcatcctagagccacagtcatggcttaggccgcacctcttgggcatctcaactttcttttctcctattaaatattcttcctgtcttcattgtagattcctctcactatactcccatcttcttcctcaggttgatatatctccctcctggtgttcacttcctttttttctatcttgttcctccccatgacccaacaagaccccttcaccctcttaacttcttgaaagagtagtcttaatcattgtttctgttttctttatctcccattatcctgtcagcaccctagaggcttttccctcattactctgcagacgctgctttcataatccccaagggtcacctcatttttcatattcagtggtgacctcttctatgtctttaccctgataacatttttgacatcctccttttttaatactttccttccttgactccataatattttctttctgtgattattttccctcctctgcaatccccccctttttgtttgttgtttctttgatgtggattcttcttcttcccctgctacaaagggtaagttctcctttggcacctcttttctctctgcttattttctgttgattatctcatccgccctctcaatgttaatactcacctcttag

SEQ ID NO: 100033 - DNA, 1050 bp, Homo sapiens
gaaaagcttttaaaatagtcttttcaactctaaattgtggattgtgtgactttgttaaatcatgttcagaaatgcctaaaaagttaccttggcatttctgtcaaaaatatttgttaatgtatttgctcacctctttgacatgtacttgttttcttctttttaaacattttatcattttatgcatatgatttaaaagtaaatttttaaagactggcttgaatttgaaagccatggtgtttaattcaaagtgacacaatcagataatagaaattatctgtttgatgacaatctcaactttggctcctactttatttgtataagaaaatgagaagtctaaaaacaaagaggtcaacctatcccttctgactaaccactatgatgaaagatgtgttattttaagacattgaaattaaatgtctaggaaatttctctagtatgttaaagttcattattaatagttcattaaaaccttttactttcacaggagatgctcagtcccagtatattttaaggaagagaaatataaaggaaatttagtatgcctccttttctttaaatgaagaatttagtttcctttacttcttaaaagagaatacctgttcttgtataacgtgactgcaccagacattctgaaaaatcagcaagaagcaaaagctggaaatagctatttcacagcaggtaatcatacctcaggatgtagctactgtacaaagtttatacttggataatcctggatgggaataaaggtagggggtaactgcctgaaaaacctattactatacaggccttagcatcatgaatgactttcttcatgaggatctgaagttactatctctgaccacattgcacagaagagccaataagaatttcaaagagggcaatttccactaagggaattaagctacacaaaaggaactttcacacagaaactctatcagaaagaaaaaaaaaatacataggaagccatgtgtcctacatagtaacaggaagcagaattgtttctgcccccactttaatgagcttgcccaccatgctgaactgcagctggaa

SEQ ID NO: 100034 - DNA, 1078 bp, Homo sapiens
tatgttttagaaaatgaaagtatgttttatgtacttctgctacgtgtttatattatttaaaatggattatttatatttaacgatcccccaataaaatgtttttaaaaaatttaatagaatattttcctttctaaatgtttttgctgatctgagcatgggtttagatataaacatcttaagaaaaaaatctttcagggtggtttgcctggattgaaattattttagtttaatttaggtacatgaataaacactggacaattgtaagacgtggagattataaatttctatgcctaattaacagaattatacttgtatttttaattatgatttttgtagactggtttctgctatttggtcaacaattgctttgtgcccgtaagttttccatcaaataagtgtatttcacttgttcatgttggtggtaagaacttagcttttatatttacctggaggaccgttgtcttaaactaatatctttatttgctctattcttagaggtgcatgaccttctcctttgtcctttctcaatttttccctgcatgtttatttctgaagaaggccagctaatagtctttcccaggactatttgattgtggtctcttcattagcttcatttagtttatctatttatatatttgtttgataacagtttgacctgagttcccttccaagaatgggtgatatcaaagtaggtgaacccttgataagaaatgtattgaccctattgttctatgattgcacttttgtgggcctcagaggacagacccattaaatctaggagttttagattctaatgtccattgaaaagccaatttctttgaactgctaggtagtacaattaaactgatatgcagcagctgaattttgggaggaaagggaggtggatatttttctgttactatgaaacaaagacatggattaaattattttattaaataattatttctagaagccattttcagataggagttggttctgtttaaaaaagaaaatttttgcctggtcaaattcctgtgggtttatagccatatttaatcagtttcgtcttcattcaggcaggccttaaacagaaaagaaa

SEQ ID NO: 100035 - DNA, 1049 bp, Homo sapiens
taacacttcacattgctataattttctttgtttaacttagtactttagtcattctcttgtctatctctagtgaagaagaacaaattatcttttgtattgttttcatatatttaaagtcaccagtattttcatttctaggggctgaataactttttcgccaccacatatatgcaattttcagttctttaatcttttctctgctttcataatgtcatgaataagcttgtcctatcttgttccagctttaaggattgtgatttttcaaaaagcctttcctgtgaaatccagacctcactcatatctgtgcttcctctcttaactgcataatttcatgtgaattatatcctatgagtgctgatataaacactttagtcttatctcccttgctgaatgtttcaccagggcataagccaggctttatatttttatataaaggtgccactctttccttcttgactttttctctctctgattctaggataccataaccttctctaacaaataagaagagaaaaatgatgtaattgtattaataaacacctaaaaggcatttagtaatattcagtagccatctgtaataaaactctacttaacatatggataggaagattcatcttaaagactatttatgaaagtccaacagcaaacaccaaatacaggacaacactgaaatgatttccattcacataaagaaaaaaataaagaaggctgctttatcatacttatttcaatattgcctttgaagttctatctaatgaaatgactctaaaaatgacataatttgtaaaaatattgtgaagaaaagacagtctttgtttccaatttaagaaagaagttgagttagttagataattaaatacagtagctggattcaaatatacatataaaaaagtcagcagcatttcaataatagcaataataatcaaataatagtggatattttaaaaagtcctacttacaaaagcaatataaattataaaacatgtaaaaattaatttcataatggaggtataatatctttatttttaaaagtgttaaatcatataaaa

SEQ ID NO: 100036 - DNA, 1009 bp, Homo sapiens
attcatgttcgtactttttatgtcccttcccctcccaagcataatataaaccgccaagagccaggaactctttttttaatttcatttttattaaaaaaaaataatgcccctctatgcctagcatggaactaatgcagaatgtacccatgtagtgtattgtcactgaatgaataatttagtctgagtaagtctatatccccaggactgattttgtggatgccagccatctcttcttggatttctttgccttttaattaacttcccattagacttgtggttcttagtgacctcctgagggcctgaaaatcagaaggttgcagactgggccatctattttatgggagtaatataaagacatactctctttggtcacgttttcagaaccttttgactaaatgggcagaagtaattgggaataaaaatgtgttgggaagtagaagttataatttcttatttttttctaataaggactttaattctaaattcattcatagctttgttttaaagttattgtcagtattttatgaagttaaagacaaattcaaacattaatgattctagatgttttgcttcaagtatctttgccactgtttcctcctgtgagatggagtctagattttctttccttctcttcctctctctctttttcttctcttcctctctctctttttcttctcttgtacagaataagcctgattttttttaattttgtgatattttaaaaattctcttttattttgattgatattgcatatgcttaaaaattggtagaagaggctgggtgcagtagcacatgcctgtaatcccagcgctttgagaggccaaggcgggtggatcatgaggtcaagagatcgataccatcctggccaacatgatgaaaccccgtctctactaaaaatacaaaaattagctgggtgtggtggcacacacctgtagtcccagctactgtggaggctgaggcaggagaatcacctgaacgcaggaggtggaggttgcagtgagcagagat

SEQ ID NO: 100037 - DNA, 1105 bp, Homo sapiens
tatatggacccataaagaaaagagcaaattttgagcctctctgggaactgtgaaaaaaaaagatctgtcctcatatcaacctttgacaattcaaagagcaaacagaagattgggttacttctgtgatcacactgataattccagcaggcaaatcttagtcacaacaagtccctggagtccagccaatctggctgctttgatgctaggctcagtagaactgaaccaaatgtgcgtgggaaagagaagaaccagatattgccatgactgctcatcagtcaggatttcagagactgaagaatgcagactgaacaaacctgaacccatacaggaaaaatgaacatagtaggagcaaaccatcgccctctcatacagcatagggagggattttctggagccaaagagtgggtttggggtttcgtagtccaaagtctggactcaagggaacctcagataaccagtaaaaatgatcatccatatcttgggtctcctaacaacttgacatgagtagtttaatatgttgaaacttcagtttccacccttgcaaaatgaaagttatattgttctcttccaaggctgttggtgaggttgaatgagataaggttgatgaaaggaacctcaatacagtgcctgatacacaataatgacaataattatatcataatcacagtcataatcacaataatgccctttctagccacatatggcagagacattggtgcagtggtcctcaaacatacgggtcagatttgtcgctcaagtctgtgatctaatgacatgatgaacccattagatgcctccctatcatctggatattgttccttgctttttccaagatctttttgaagatgacaatatattttcataatatttcactattttaaaagctttctgttgagcataatatacatattggaatgtgcaagtatcagttatactgcttgatgaaattttaccagctggatgtttttgtagccagtacccagttgagaaacagaacactttctccagtcactatcctcccgcaatgaagtgtaccttgggctaatagataagttttgcctattttccaaatttaaataaatagagccatatactctgtatatgt

SEQ ID NO: 100038 - DNA, 1052 bp, Homo sapiens
acctactcaagagccaagcagagggaacgagataacctatataagccacctgtatagctgctgtgcaaagaagctgttgaataaggagttggggctggaaactctgacctacctctttaagttttgtaataaaccttccagttctaactagtcaatgaatgacccattttgattctcagacctgccactgcttctacctatctgaaaaaaacaaaacaaaacaggaatttgaaaatctgttatagaagtacattttatgtttagctatttttttttccttcctctatgatctgtaggtatggggtgaaatgattatattgtggtcactttagaacgttcactctctttgggaattaagtaattacaatttcttgaactaactgccttatcctacagcctagtacagtgacagctccaatgtagattcttgggcatgcgttgttttcttgagaacctttggaattctagccatatcttgctaatgatactcacttagcctcatcaaagtctcactgatctcttttctgtacttgagatattaaatgaaactctcttttgagaatgtttgaactggaaggggagacttcagaattcatttagtctacttcattttataggccacaaactgttcattttaagtttggtgtgctcaagacctgatcatattttcctctctattcttatatcagagttaaaagaatgttggctatgcacttcgcgcttacacattaatatagagcccagactgtagggagaattggagacttgaagtggggaaagaagattggggagcagaattacagtgtgttatatagtactgcagcccctcaagggagctgtaattaatgtgtgcaaggaaaacactgcaaggaaactaatttaaagaacatactgaaacaattttctcccagcttttcaaaacaaataaagaaaaaaagaagtcaccatcaagttttgaggaagcatgaagaattccagcagaaaggaaatttgttgagagcccgagaaggggctgctggttagaatgtaaagcctcttttaaacttaggctt

SEQ ID NO: 100039 - DNA, 1085 bp, Homo sapiens
cagctactcagaaatataatttggatgtttaggagagttcatgtcccctgggaaccctcaatcaatgaggaattgaagtcattggataaatgcgcttctacttcctggacatcacatgggatgactctgaagtatgaagtatgtcttacccagtttccccaagggtccccaatagtattgacccccagcctctcactaatgttccctttattgggttccattttttcctttcacccatttctgtttcatgagatctcctcacacataagctatctgtacccacatccttgtctcagactctgctttgaaagaaaccttacttggtcaaagtcttatatccaaatctttctaagtctcttgacttgaatcattgattttccctggtatattcccactgcaccttgtagggagctcagagaagtaaaactcctcaactgagacacagggaggtggttgcaatgtgtgctcacaacatggcttacttcccttttgtggcattcatcaaaagtatatttttaactagtgatgtaattaagtgtttaacatctgtctttcccactagactttgaagtcttgacctttcctgtttactacaatatcttctgtgtctaaaaccatacttgtcaaatagtaggcattcattgaatatttggaatgagtgacataatgaattcatatatcagttaatattagtacctcatatttataaagctgtttacaaagcacgttaccataagtttccatcttattcttcaagaccatgagaatcagaatagacattgttattaaaatttctctagaatttatcaagcggctgttatgttccaagctctttgctaggggctggtatacagaggtgtacaagactatgcttctcaaatgtcaacaggcagtcaaatcacctgggaatcttgttaaagcgcaggttctaattcagtatggctgggatggaatctgcaagtctgtgggtctaacaagttctcagctgatgcttatttaagctgctggtctggagattacactttcagaagaaacgatctaacagcaaggttctcaaccgtgattacacattggaatttactggg

SEQ ID NO: 100040 - DNA, 1032 bp, Homo sapiens
gaagccgtgtgattttccattctcccatcagacatttcagcttccttggagactttctttgactgataaaatgcagcagaagtgaagtgtgcaagttctgaagggaggccttaagagatctgacggtttccacttttgccatctgggaatcctgagccaccatttaggtcatggtgaaaattatatttttggaatttctttctatggagggttcaatatttatttctatagccatttttgtatttaaaaaggaagccaagaacacattgtttttcacacttcttgatgatttacttatgttcatgaaaagttttcctagactgtgtgtgtgtgtgtctgtgtttatgtttctcacatgtaatgctgccatcccaaaaatgaggaccttacaattgacagaaagcctcagtattgttgatttaaacatattatttcaaagccctggatgaatctgtattttctgtatttccgactgagatccttattagaacatcttgtctccccaaaatctggtgataaatctcttttggaaatgccacataccatttttgtaaatgactgagtcatttgcaatgcataaaatgtaaaaaaaaaaaaaagtggaaaaattcagtttttaccttaatgaagaactcctactttatcacacattttaaagaaatttataatgttagcagtaaaagtttcctaaaatatgggatctttctggacaaacctaagtatcagttttcagcaatgcaaaaggaatcctaagaggtctcagctaaattctccaaaactaatacatgcaattaagcctggagttctgaacatggaaaagggattatccctagtacacagggaaacttactccatgggtcattgaagaaaggggcaccatcttcaaaagtccaccatggctgtccctggtcaaaaatatatcgtccctctctttttttttttgaaattaacaaaatatttcataatactgaagttttgtatacttattgcagtagagatatacttttatcccctaattttttcaaatcattt

SEQ ID NO: 100041 - DNA, 1057 bp, Homo sapiens
ctgagtacatcagtcatgggtgaggcaggaggtagaagtcacaccagttgttttcttaaagagaatttaaaataattacagttaactgaaaaggggaaaaaatacaagaactccaaattgtcatggaggttataactgggaagcagctgcctcccttagggctgggggagcatggaattattaatatgcagaaacatggaggaaaagcccccacagcactgaaactaggccaccctggaggaggggacatcagccgctggtgctggtgtctctgagctgaaggaggggtcttgtggggctgggaccacggcccctgaaggggtgtgctggcatctctgagggtcagggcacaatgaagcttgttggcaaatgttgagagagctgcaagttggacccagctactgctcctggcaggcacttgcactgcctgggggacgaagtgtgggtgaggtgatgctgacaagaacaggaagtgatctcctgaggaaaaggaagcaagcaggaagtgctgctggaggctgctcacaggaacagacaacaaatacaaaggagcaggtcctttctccctcctccagccctgcgctctcccttgagtgcctgtcttggcagagcctactagggagcatctggcaaagcaagaatcaggcttgcagttcccagccccagcatcccatagcagaggagagaaggatgggtttaaagctgggagataggagcttactaattggcaccctgagcttttgcttcagttgaaactgggactaatcctcatcagctctcagttgattccaggagacccatctggaagctgtaacactccaagccacaccacagttcatcactgggcattctcgagctactgcctatgctggttgctgggccagggacgcccaagcctgggagttcatctgcatggcctctgccctctgggagcttacccagcaagggcaaaatttgtcccaaacctttattaggtggcccaagagactggacacttttctcttgaagcagcagccatggccatgggtgcctgcacggtgcagtgtccctcctccca

SEQ ID NO: 100042 - DNA, 1499 bp, Homo sapiens
ctcgaaacataccatttgtgagttttcaccattcttcaagaaaggagtctttgactacagcagccacgggacggggtagagccaggggtgatggaggaaccaccacagcagtgccttctcgtcgaagcgggctccgatgcagggcagctcccccatgcgaggatccgggtctgcctcctcctgctgaagacagacatgcagcagcgggcccgggccacctcacgtttccatacctagtgcctgagtttggggatgggatgctctgcctgctgatgtggccctgacaggcagccgttaccgttccattgcggttgaacgtggccttttcccacagtgcttccttctcactgcgcagcaaagttcgtcccctgtggcaagatagatgtggttgggccatcgtgggttccctgagcccagccagcctgggacctcccaaagtgggtggcttaccagaccacccttaaatgactttcatctggtttcctctttcaccaaaatatactcgtattttttatatttcttccatgtggctggctatattccaagaaaagcattttaaattatttcattgtatttttttctttttttccctcatttgaatcagaacttttatataaaacccaaacactgatgtttacacagaatttcatattctgcaaaagggattttttgatccaatcatgactgtagtcttccatgcttgacaaattggatgtagacaacattacttaaaacttctataaatccctacaattaggatatttatttaaccttgaatattcaagaacattctcccaaatctaaatggctactgtgcattcttgagctttttctgctaagcacaaaatgaacgcaaagctaaatgcatatttttaagtattattcacattttttgttacagaatctattggatctttggctggaaaactagaatttatagcagtttattaatgataccttaaattactcaggacttaatgtagcattgcacttctgtgtacagtaaaactgctttgttttactaaagagaaaaatgtgagtggaaaaaatatgtatgtggtatatactcaaatgtatataattctatctatagatttatatatgtatacattctgtacagtagttccatcaaaatatgtaataattcacaccaattttattaaatgtatttgctttttcaaaatttaaattgagctgctatcaatattaaatgaagttatggcatctaccctgtagctcagcttattttaagtctgtaacatgatcattcatactagtctgtttaaacattgatctaatgttcttggaaatatgcataatgtataactcagcatttgtgttgcagaagatgcagtgatagtaatgattgaagtcgtaaatgaatggttaacagaacatgtttgcattccatcttctagagaatgccttcacaacaaagttctccaacctgaaaaatatgcataaacgtgcaattatccctataaggaggaaaactagta

SEQ ID NO: 100043 - DNA, 1001 bp, Homo sapiens
cttttgcagctgttccttttctccatcctacctgtactttattgtaaggatagctaccattattcttagtttttacttggagaggggtaagatgatagttgctaactaactttgtatgtcctggaatggacttctggggagctccagccccatcctgcttcctgctgttctccactgctctgctgaccctgggcaagggtgcaggtcctcagcagggtcccgttgacaactcttgttggaactgttgatgactgccttggagtggtatgttcatgtttctggttacatacacttaggaggaatcactctttttcatctttaccctagatccccaaagactttgcaacagtatctttcatgcactgcagacgctccttacagctttatcccgagaggcctggagtcagtcctgactttgcccccatgactctgagcctttccaagtcacttagctctgggcttgggtgtcttcaactctaaagtcagacagttagttgagtatcatggtcctgtgattataggcctgaaagtcacttagaattggccttttcctcctaaaatctgaacaacagtgttgcacataatttacacatagttatttcacaggctgaatattaatagcacagaatgcttcctccatctgggtctggagagggaacgccactgttgactagcaggagatgtgaatgcttgctccctccccgcttccactgcctaaagtccttttattgcacgacttctgattgagcatgtgagtgtgactataaatttcccctgacagaaaccacatcacctcatcagccacataagaaaatgacaaaacaaccaactgtgaaagcatgcttgccaagctttcagcaccacagcatcgggggaagcgggaggcacgtttgtactggaggagatggaagctggagggagccagaagatgagctcttcttgtacctgtcttctctgagctgcaacatggggggagtgtgtttgtgccactgagtccaggt

SEQ ID NO: 100044 - DNA, 1130 bp, Homo sapiens
atacttcaggagggtctagtatgttgcagactctggtctagggtcagaagagatgttcataaatattgtgtggtatgggcttaagttaccctatcaggagtctaaaggtagctcatcactcccttcataatccagctaggttgtcctgaagagttgctgctttatgcctttaacaaatcaaacttggaagagaattgcttatttgtttgtgagtatatttctcagtgacagctcttcttataaggccttgggagctgctattaatttggagtagtcagaaatgcttccatctagtcagatgtgagaattatggagccttttgatgagcttttattatttgcatttctcaaaagctagaatggcttaaatttacagccacaaacctttagggtgcagatgtttcaaaagctgctagttaccatgtaggtgggtttacttgcaaaagacaggttatagcagatttgaccaattcgagtgctatgttgtattttttcttctaatctttaaaaattgggtaaaagttagatagccaaatatcacaggagtaaagaaaatgactagtaaatgaggaatgacaacagagtacacttttatcaggtgttaacagaagtcaaatgttttccttttattagtaaagactccacaactttattagttctcaatttcctttcagtgatttataacccagttttagctgctcagttgttaaaaatcataaaagataggcaaggctttttattacccattttaatttcttttctatattttagggctgccattatttatatccaaagtaatagcgatgccatttatcaaaatggcttatactgtctgttgcctccaagaccacctgcacttaatacagggtctggctcaactaaaatgtgaactttgccaagagaaaaggctttcaaaaacaggaaacttttccattacatttttccattacatgtcttcttgatggcagcagactggctgacctatcttattataatgtaataaacattgaagtcaggatttgagcctgataactcttagaagaaaattgggctgtgtcagttcaccgggaatcagaaagagaaaaatcaacttatagatgaaaatttcactctgagatcattaagaaatat

SEQ ID NO: 100045 - DNA, 1121 bp, Homo sapiens
ttatttctaaaaacacagtagcctgtcattctagatctaaatcttatttcactcacaacagcattgtccatttaacatttttaagataaagcttaaaattaagttgaatatcagctgtctcttttcctgtaaagttctttttactcttatgcagctcagcttcacatagtcaatacttgctaagtatttgttgagacttgagatcaatgtttattacgtatttgtcaattattattgccctcattagtgcttatattattaccatctctgtaaataatgctaatctgctcctccaagtggactatttggcctgacaacatcctagaaatcacttgatttgctaaagacctaactctttcaggaaagccaaagggttgatacaaaaggatcctgaaaatttcctctcatgggtgactattttatagccaagtgggaacatattttatttacttcgctccttcaccagattgggctcattatttctgtggaagtagaagactattctggctctcttaattgcaagggtaacaaaatgtttgatgatagtatatttttaaatgacacatattaaatttacctagccatacaaggctccaaaattttaatcaagctaagaagtatcgaaaagcacactggaattcaaaatatacagaattaggaatatgcttgccaagatagactcttctgtcaccttaacactttagttttagttagcctatagtcttttggaactttgtctaaaatgatatcctgcccattcacatttcatctggagtttagccgtggtctcctgggggatatacttttaacagtttggtgtgacaggtctcttgatggagatttgttttcttttggtaatcttttttccccaataataaattacatgttcattataaaagattgacattattcaacaatatatacatggaatgtgaaagttcttcttaatctaaccctcagtaggaatgatttgcaacactcaccaggaagtcctcctgggtccagctatgcattcagactcacaactcccatagcccatgctcagcgtcagtttccctgggaaggacacaggacaagaatcactgcttgccagcagggcacaagggcttggagaagccccc

SEQ ID NO: 100046 - DNA, 1055 bp, Homo sapiens
tgcagctagattaatgttttcagttctagagaaattttacatgctaatcactttttttaaatttaatttttaaattcttttgaaaaattttagtgacttttgcttcttaatgcttattcattttggttttcctggttaatagattactgtcctagatgagacatggactgtattcaggcgttacagtcgttttcgagaaatgcataaaacattgaagttaaagtatgcagaggtaagttatgaaattattatctccgattaagagcattcattttataaagtaaatgagctgattgcattagcaatgttatctctctctctgtctctctctttcagatactagcttattagtgtcactaagtcttacttcaataacccatttatcaaagataactttaaattttttcttctttgttccatttctgttctacacaatttaaacattttcttaacagaagattttgaaagtgatattacaatgacagtaagtgaactccatccttctcataaattttatggtaaattttaaatacatattttaatcaatttataacttctcaattatgagacctattaaaattaaaataacttcttcatatagatttacacttttttctttaaaaaagaaagactacattcatgcttagtcttatacttaatgagaagtcaagtcataacagttattttgccattgaacgtagagggaaaggtagatagaaaatgcagaattatctagagaccagaaagcatttcatgcatcagatcaaatatccagagggtattaatacattagtcgtcttttcctttttgaacaaacacaggtttctcaagtaattttaagcaaagtattcctagaaggaatgtgtgttttccaagtaatgatgatgatgaagatgattttacttcaactaaaggaagcattatctaggtccagctttctgggaattttgtgttgaactgactgcagatcaatcaacagtcattgtctaactagcctgctttcaccaattattggttttgagcactatttttatggttttttatgacattttaaa

SEQ ID NO: 100047 - DNA, 1039 bp, Homo sapiens
taatatcctgtgctgtgtgttctaatcatggtgtgaaccaaatgctaagggatcatggaggggatggaataaatgattcttccagggagaaaggagtgggaatggggctgctgcccaaggaaaaatcatggtttggacactaccctgggggctgagcaggagctctccaggtacagaaaggggtgtgtggttgaggaggccgttcagaagacccttcagaagacctacgaatatactatatttctttattcacacgttgtctggggtgtgagatttttagttcactgagagctgggattgcctaggaaagtccctaaatgccgcactaagggctttggcctgggagggtagtgagacatctgattttgaagtgacaacatgaccagtggtttatagtcaggctgctcggaccttaacctgcatcacagttccctggagggttggtcagaacagactgctgggccccagcccagagtttctgatgaaggagctgtgggtgagacctcagaacatgcatttctaacaagtgccccagtgcagctgatgctgctaaccactggtttagacagtaaactgaaatatcgagggcagaagtcattgaggtctgtatgtgagtttattaaaatatcaagtaaggtaagaggcaaaaatcactacccagaatatgccagtaatgattttcattgttcatcatttttgagaccgtattatatacacagggttaatggttccagagagtcccctctctgtcattaatggtaggattcctggagtcaccagaagagtcacaaaaagactcctctgataccttcactgacctcactaagctcaattcagaggaatacagtaagtttataacatcattgttaggttcttggaaactgcaactttaagcaaaccaactatagcaggtcctcaaatgacatcatttcattcaacatcatttttttacagcgttgatgagaaaatgtggtttggctgtatgttgttttgcctaaagttagtttccaggaactattgccgatgttaagtgtggatt

SEQ ID NO: 100048 - DNA, 1035 bp, Homo sapiens
cctgtaatataatttttttaaagaccatagtagaagcatcaggataccaaggaacagaaaagatgaataactagttcatccattcaggagacaattaagtgtgggaagagaaacacgtgagaaaaattgagcagcatggagccaatgggctcatggaggcataatcggaggacgtcaaggcagatgtacatttttgcttgcttgagaccgatgggtggatttcagtgagtgcagacgagagaggaggtgttctgggcaatgggaacaacaaagacagaggcccaagggtagaaaaggacaagtgatgacttggtaataggaagcagtgcagaaggaggctaaccttggagaggggctctcctctcaggtagaagtgaatcaggaaaattaagtgaggatgaagaggttttgaaggaagggaaatgaatgtagcaacagcatcattttgaaatgtgctaaaaggatactcagggagttgatcttaggtgactctaatcatctcagtaaaccgagttcattataaggatggaaaaatctagaacattttgaaatactcatcgcagagaatggaatttggaaggatttccaagtaggagtgactgctgagctaaaatggcatacctgtagtgtaaattcattctaccctcctagggggctgtcttcagcgtgcaggacagcacccaggagagcaggctgacaccataggcactcagtttgggggactgttctgatgggacccacaagaaggcttagagagtcagggatttggaggtgctggtctcccagtgtcaggaggactaacctggagtccggcctctgtaattgatccaagagaaaggagataagctaggagaccacgaagaggtcacagtgaagatagccaggcagagtcagcacctatggggtgtgcatgcccacagaaatcagaaagcaccggcactgtctgtcctcagaaagatttggggatggcagaggcagatcacatcgaggagcaatcagatggcagcctgtgatctctctgggatattgatgtga

SEQ ID NO: 100049 - DNA, 1048 bp, Homo sapiens
cacacaaaccaactgatcttttatattgcccttccttggacagccatatttatcttcacaaagtaaatgcttcctgtgtaagaagtgactaagaagaaatgagattgagttacaagcacagaagaaaagcagttattattttatggtcatgccttcaatttccatttcactcaaattcctatttttttattataagattatattagtattcctccttccttggtttcagaattttgggagttttgcatctcttcctagaataaaatttgttttaaaatcacaaaatcgtttgaactttcccttttgcagttgctacccatggatacgcttacctttcagtaatgaataatataacgcctttttaagaacggagtcacagtgccaggagtcaccatctgttgagtgtccaagcactgtgtctagtctcttcgcattttttttagttcatctgcaggttaggaatcatgaatgcattttacagatgaagaaatcgggacctgaaagaattgagtaatttatccaaaatcacacgactaataagttgctgggctaaagtcaggatccaagtcagagttaattcagagcttttcattattttattatctcatgatgactggtggagactttacattccttggtttgcctctgaatatctgggtaatttaaaggaaaattgcttagactgtcattctcgcaatttcccaccgtgttaaagtagaataagtccccgtatacctcacctgcttcacagaggtgttggcagagggggaagcactttatcagtgacaatcttgtacttaaaggcccccatctcccagattctcagggccttcacacattttattaaatttaccttcaaactaccctgtgaggtaagtatactgaaataagcggtattacagcctgttttgaagatgctgaagttaaagcatcgggaagtcattatttctggttattgcaaaaggcaggatttgggccagcctgaaagccctgttggacttagtagcacttcatagctgcctcgagtgtgagtgtaatttgggagtca

SEQ ID NO: 100050 - DNA, 1128 bp, Homo sapiens
ctcagtcttgggcctctcatctgataaatagggtgaataatggttaatacctcgtaggggggattgtgaagattaattgagccaattcatgtaaactggttaatgtagtccttggcatataatgagtatccaataaatgctaactataattatgattctaattattttgttattgctattacttcaaaaacatatgttttctaaagcccccagcttaatgcaaacaataaggattgttcagagatttcttccgattcacacttaagacaacttcatttggaagatttatttttttcataatgcctcttcctcagaccccactagtcccccactgcccaggccataaatatttgtcagagccaagttgagtaatcaaatggggcctaaagaaaatacttgagatttgttttaattgtggtttaaagagctttccacactacactggcttataaaaatgcctaaaagttaaaaatgaagtaaatttgaataaaatctctagcttttgcagctttataagtatagctgtctgatagtgtgtgaagaaaaaagtttgtcagatggtcaagacttttcagaaggcaatctggtttacactgattttttttaagaagtcaggataatataatttgtccctgtttttacttgttcttataaattggaaggaacttcaaagccaaacacttcatagtgcttttgccctaactccttggaacggtatacctaaaataatggtctttttgttatgagagaggcttagcttttctctttcaaaggaaaccatcatttttctaaataaaccctactggtttgatgctcttttctctacttgaaacacattttctccctcctacccgagcaggatatttgcagtggagtgattctggtttctctttgttctccctgtctgacatgcctttgatagcggatggtttctcgctctttgggcgcaaatccagatgacctgaaggacccaattaaaattagtatcccacgctacgtcctctgcgggcaaggaaaggatgcacacttcgagtttgaggtcaaggtgagtgtcttcttgactcttctggagaatggaggttggagactatgcagtgctttatctgtctttattttttcaaaaggggg

SEQ ID NO: 100051 - DNA, 2042 bp, Homo sapiens
aatagaattttgacttttagaagatacatatttgtgacaagtctatactgaaataaagacaatgcatttctatcctgcaaattaagaaatgccctaaggagatcttgtttttaatattattcttagaattttaagattaggagtaagtgtttcagttctctgatggcagatggatcaatagagtcatgtttatcttggggatgtaaattatatagaagggttgtcattgttgaatgacaagtatgtttatttagatttccattcccataaatacttgtaatcgaatcagtcccccgccccgtgaacttgctataatttaatatagagggctttttcttttcttttcaggataatgagaaacttcacaatggcaccattcaacgtaaactaaaatatgaggtaggtaatgatttttcagattgatagggtcgccttaaattatggcatgctcatgtgattacattttcttaatgtctagttgcataattagaattttgaggtcccggcaagattaatggctaatagggaaggcaagctattatatggacttaaaattaaacggaatcctgtagtttgaaactgctttgactttatttgaatggcatgtagctgtggtggagctttgcccagtttttcatttgtaatagtatattttcccttggtctgcatttaaaaggcagaattatataatcagaatcagatatggggtttggaaatgaaactcagtactcctcctgtccattttatagactgtgagttggtagtagtataaaggaaatactcttgattgattaacttgtttctctggtggattgtcaaaccaaggtttatttgggcatgcaatttgtaaggtttcactggtattctcctccactgagaggcatgtctctcccatatattcctaaattttaaaaaatcaacccccaaaaaatagtaggtgatggaaattttccagatggtgtccatacattactgaacagacagcaagaggtggatgttcacagaggctgagctgactttggccgcagccacaccctcctgccagtcatccagtaatgatgtgatctttccctggatagccatttccctcctctacagagcaagacactggctttcatttctttgtgtccatagtacctggcacatagcaggtgcacagtagtccttccatggtgatgacttgtagataagagtaatgataattactgttaatgttcatgggaacatttgatccccatgaaacaaaccaaaaggagagagaaatgtaacctgggttagaacacttgggcatttcttttggccttgccatctgattttcattaagtttgccttgattgcattttggacatatgatcatggacttattttcataactaaatttgaccttctaaacattgaatcagagggcttggaatttattgtagggaaaatgaaatattagatcaagacgtgggtactgtggatcaaccccatacaaagtatttctatcaaaattctcagtgatttataatatatatataatatggaaaattgatgttctatgtatgaatcagataatcgattctttaatcatgtatcaatacaaatggcttagactttttatttaacctctgaattaatctacccaatgaaaccaatgacaagaatcatcatgtgcaaaagaatcacagaaagagataccacatccccatttcaactttttttgacaccttgaacagaaaaggcagttttgcccagcatggtatcttgacccgcttctgcccagagatgccactgacacttccagcctcattaaagaggagaggagggaggtggatcagaacgaccactgggatcatcccatgctgtggagcgtctcaggccctaaaacaacttcctcagcatcacaagagagaactcaccagcagagggatcagtcctcagtacccgaggtattccaggacagtgaaaacaaatatggtcatcctgagcatgctggccattttgaaccaaaatgttttaatctacctaaaatctcttttcttaacgaaagtaacaccgat

SEQ ID NO: 100052 - DNA, 1026 bp, Homo sapiens
tttttttagagatggggtttccctgtgttgcccagtctggtctcaaactcctaggttcaagcagttctcccacctgagcctcctaaagtgccgggattatagtcatgagccaccactccctgctcagttgagatcttaactgaagctcagattggagagatgaaaccttgccctctccgcagtactccccccacccacagcacctcctaagggggcttcaacagaagtccagtgtactggccaggagaccccaccttggcatttagctgatgcatggggctggttgctgataacaaggaagacctactcagaagtgttactgtagcttcacccatcacattgcctgaaaagttcaggacaacctccattcaaatgattggcttatgctatggattacatttaccatcgctgtctggtagttccctcaggcaaaacagcaacaaaataacaatcaaaaaccctaatgctgttatttcagagaaataggttggaggtttaaaaaaatgattgcaggtatgttatgtaaatgaaattgctagacaaagatccagccccaggaactttaaagtagtggagggcacactctcaatttgtagcctgtagtgtgcaataagaatgcagcatgagcttttagcttgatgtccttggcttttgtcacctggccatttagtattaatactgtataatagcagacacagtattgcagtttccacggaagtgattacacaatgggagtgttccttcagaagccaagtaaagggggctgttagcttcatgagttttgatgaaatagacttagctaagtcctaattcaggccgacggattccgggctctctgctctgactgcgatacccccgcagctttctatgggaatttctgttgtgcttcattttctcccagggttctcacggctaagccaggattcaccgtgcagcctgacttggcccctcgtaaaattccacaagtgtgaaatattaaattcatgtgggaccagactggacaacagtgtcctgaacttggctctc

SEQ ID NO: 100053 - DNA, 1023 bp, Homo sapiens
cacaagtcttcattaagaattaaaatgagaatctctctctgatttctgactcagtactttacagtactaccttcagaggccagagcaacagcctcaagcgcctgatcttgacaacttcccttaatacacgtacttccccttctccatcccaatcagacactctaaagtgaaggcttcgcctgaggaggacctatgatttcaccaatccagagactcttagatcctcctccaagctgctccagaccacccttcctctgcctgctggagcacttatgagcctcacttgggaccgctgcctgtcccactttttgcctttcgcactctttgactgtccgtacagttgccttctcctccccttccagacatttccttctaagcctttcatcattctaagtcgtgatgttatcttcagtgattctttgaaactaactcatcttgcaatctagttacttaaatagcactcccttcttcagcatggagactttctttgatttcttttcctgtaagccttgtcttgtcgccacttacttccctatccaattaagtccctcatctccagcacttgagccatccacttcccagatcatcagatgatccttctgttcttccacttatgtgagtctcattgattctagaaccattgagctatctccccaccctaagcctatacctagacatctaagctcagtgcaaccgagaaaaccacatcaacacagagatcagtgcccctgtaaattaatagtctctaagcttgaatgatgcccagccagccctttctgctcatttcctccatcagttctcttgcccaccggccccttcattattacaaataatgttcctgactcttttacttctaaccctgctattatttctcctcactcttatgaagaggagtcattaggcagaggagcttgttcctgactccatatagaacacaggagtcctaagagagcaacacctttgaatcccatgtctgctttgcattcatccttttcttcttcttcctgtcccaatgaaaaaact

SEQ ID NO: 100054 - DNA, 1004 bp, Homo sapiens
ttttcttgctcaccttgagcatggactttttatacatggagttggcagtatttatgttgctggtaacttggtagttagcctgtgttttagttgatggttatttactgtgtttatctctactggtttattttattgggccttaccatttttcaaaagtttagtttgctgcaaggctggtttcttctccagtttttggtctcagttgtcttgcgtttttatggaccatttactaactttacagttggctatagattgccttaaatagcttgttaagatacacaatcttggggaacatgtgatgaaagcaactgaaagaagtgggcttcttcctccattaactgagattagtgttaattggagacttgcttttttcctttttgtccgtgaatattattccactgtgagccactttaactgatgagcttcgggtgttttctgttttcaaagtaggtggggagatgagctcttaaattcaaagaacaatctgtctttattcagttacttcagattgtattgtctgagtggtgggatgcattttgcttcagccattttataaccacacaatctaaaactgaattgtcaaggtcagctgagcaaatgagactgttctggtgaaatgatgaatggcagttacaggcaatggtgggagaaagtaggtttcctcctagtcctacatggtagcatgattttccttggcagtaacatattaacttgattacgtgtcaccggctctgtaatttgttaactcatttgattagaacatgttgctaattcagtcaaggtttccagttgtacacattcatttttgcttctggatctttgcatatgctattctctccttctagaacacttgtccatttgtccaccggctcttcacatgaccaaatcctacattgtctccaaaatctccatgtaaatgtcacttcctcaaagaggatttaccaaactcagtccaaattttacctcctgggctacttattcatagcatcctctatcttttcttg

SEQ ID NO: 100055 - DNA, 1063 bp, Homo sapiens
caaatcctctctgaatgcctcctatgaaccagtcaggattctaggacgggggcaccattgccagtaatcctgagaaggtcagcttgcatgcttgttggaggagagacacagtcaacagataatttaaaaataaatccaggaagtgaaaatgaaatgaaatcaaatgtcttaggacagtgtttgatggagtgatcaggaatggcttcctgaagaagggatgtttggtctaagacttgtatggagagaaaatgacactcataaaacagaaagggggagaatggaaagcattgagactgaaggggaaagcaagtgtgatggcatcaaaatgagaagtgaagagagggccagagtagatgggatatagtaagcaagaagaagagtggtacaagtgagggaggggaggtcaagggccagctaatgtagggccgtgctggcaattggaaggggtttgactgttttttaagagagctggcaaaccactagaatgatttaagcaagagagtaacctgaagatgtacttaatacaaatatcaggatgtatgccatttggagaatgtggcatagaagcagaagaccatttagaaagctatttccttaatccaagtgaaaggtaatagtggcttggatctgcactttagccatagaagtggagcaaagtagaatcaaggaattaagagtaactcccaggattcaggtttaaacagctgctgcaggtggtacactcttccctgagatgggggagacagggaggacaggcctgggctagcagtcgagtaagaactctgcttatgtatacttcctattagaatggaagctttttaaggtcaggggccttgtgttattcttttctgtataaggtgtcattcacataacatgcttaataaaaattctgtaaacagattaagaataaaattttagtaagacacctgagtccctttgggaaaggcttttaaaatttctttgggcgtggatgttccaaatactggaatgagacatattatgcagaggaatgtggttttgtggcctaatctgtctgcctaatcccaggggatactgcaagtcc

SEQ ID NO: 100056 - DNA, 1064 bp, Homo sapiens
taaatgtacacaagttctctcccgtcaaattctgagggagattttagtaatagttacctatattatgccaattccatacgttttcttttgaaagcacttttcttttgagatttctacttttaccagtatcaataaacattcctaaagttgtgaccatatgctttgcttgatattatatctctttggagaactggtttccttttttcttccagacaatcaaaagtctaattatatgtctgttaagttttaaatctcataatatgttgtaatgcttagattcatcacttctgctggatattatggatatgaggatataatgtgtgttgtgacactcagctgtaaaaataaaggtatttccagatttgaaattgtcttaagtaagcagacttttgagactaaagctttcccttattattttataatacactggaaattacatttcaacagtagaattccatgttatggtattggcaactgaccagactgcttactgtaaattcattactgtttttgtgtgttttcaggtgctgtgattctcttgggaagaaccaatatgtttcgctttaaccatccaaaggaagccgccaagctcagggagaagaggaaggtgagggacacggcgtctctaggagggaaccactgatcgtatgtgaggatgagtgggtggtggtcactctggttccaatcttttgactttctggggtgcagaaccgtggaaaagtagttctgtgatctggattgattctagggagattgtttcccagcagatgattggctgatgaagtaagagagcaagcaagtaaattctagagcagacagggagaaactgctcctcctagatccttctcttcagccttccacccttcccaccaaggaactgggcatcattttgcattaggtggagagtgacttcctctaatcagcatctgttaggaattaacccaacattggaatcacattaatccaaaatcagccacagtaaacagatttttcattgaggtgggaagcgagagcaggggtgggtttaggacaactgggaaagactttggtttggttggaagggg

SEQ ID NO: 100057 - DNA, 1021 bp, Homo sapiens
caaaaccaaactcatgatttttccccaccccatcttggtccttttccagtgttctcagtctgtgcagaagactccccattcaactagtgatgcattccagaacccagaagccatcttcctcacccccgtctcctctttgtgtctagcccatcatcaaatcatattgattttatctcctacatatcttccagttttgttttacttctctgctttggtaaccctttcccccagtccagagccatcatcacttacctggaccactgtagtagccacctggcttgcttagccatattcactcttgccctgtttggcctttcttcagtcaccattgcaagaatgatctttggtgaaactgaaatctaatcatgttatgctgctgcacagagcccttcagtgtcttcctcttacaactagataaaacacaagatcctttacatcctgaaacatttgagttgattcactttctccctccttctcaagccttatgttggtgcagtgctcactcttgttccctttgccatagccacatggttgtcttccagtcactcattcttggtggcatcttcctcctcattattatcatcaatcatcatcatgatcattattgcttttatgcaagacactctcccaacttgttctcagagcttgttttagacaccacctcccttgaagatatccttctctagtttcccctataataaacccttatcattgttgctctttgagcccaggacacagttcttctccttcagctgcagctttgcatttatttgtggaatcatttcattatttgattatttatctctctctctgacattttttaaagctccataaaggcaaagcgtatgtctgaattgctcaactctgtatcccccatgtttatcacagtgactggcatacagtaagtgttcattaaatatttgctgaatgaacagtggcatcatgtaaaaatgaagcaaatttttaaattcacgagatttgttgagtacaggtgcttagaagaagaaagggaaggaaacca

SEQ ID NO: 100058 - DNA, 1050 bp, Homo sapiens
tgtccctctacataaatgtaggattcatctgttgatatgttttggctctgtgtccccacccaaatctcatgttgaattgtaattcccaatattggaggagggacctggtgggaggtgattggatcatgtgggtggatttcccccttgctgttctcgtgatagtgagtgagttcttgtgagagctgatgatttaaaagtgtgtggcatttccctcctgccccctctcctgtctccatgagaagacatgccttgcttcctctttgccttctgccgtgactgtaagtttcctgaggcctctcagtcatgctgcctggtaagcctgtggaagtgggagtcaattaaacctcttttctccataaattacatagtctcaggtattctttatagaagtgtgagagttgactatgttcccttatgattagactaatatgcatttttggcaagaatatcagagaaatgatgctgtttttctcatatctcattacacgatttccatttgtcccgtgactgatgatgttcactttgatcatccaactaaggtgcagctgccaggcctccccactggggagttactcttttcttctttgttattagtaagtatgtgggaaagtactatgagattgaaggtactttgatattgtaaattttccattccattatggaatattaccactttcacccactggttttaggaatccattcttttttctttttggctgaattaattattattatgatggttgccaaatggtgattaaaaaagaatgcatcattatttctacacttattaattggattttcattgtaagaactttctcttcttgtcatttatctatttaaagggtcacacagcttgcgattttatttactaggttttggtctgttttttatcattatttatttcaatatcaaattgtcctatattttggccactgtgagtttcttcaagctggctttcgtgtcctgtcctcactgttctgtaaacacttcgttactttctgacacaagatattccagactcatcttgtgctttcctcaaactaaccaatt

SEQ ID NO: 100059 - DNA, 1825 bp, Homo sapiens
ttacttttgcaccaacctaatatttactatttattgtgagactgagagagataaaaaccattttctagaagtccccagattcacctatgtttgggtagaagtaggcatcaggcctcttcttctaattgttaaattatgtgtttgatctttggggtagctataaatgatggtaagaacacacgttttctgtgatcagagatcagtagtgcaattttgtagagacagtggaaactagttggcttgtactcccaagacgctagccaagaactgtgcctaaaatcatgtaggcttatttgacaggtgttcatatctgtgtttgaccattcttcaaacaagaatctaggagagttatacatgaatagataaactttagcagctgcatgccctgagaggtctcagaattgacacaggctcaggcaacaggcatctcagtatggcttctgaaggcctcttgggcttttcaagattcatgtcatgccaagttcaccttgggtttctgctcctggagtgcagtgtctgtcagtgcagaggtctcagtaagtcctcgacccatggagcacttttgcttttattctctgtggcctctgggtggctgatggaggaaatttattcagtatcaaacagggcaactccatggtattcagttaaaacaagttactcgactgttttctccccaaagatgaaatgagttaacatcccagaactgattttcttacacaggtaatgtccagatcccttgaagaacattctaaggatcttccagtcctatcattgaacgtcatgagctcctgaagttcggttttctcactaaacataaatgttcacttcatgatacttatgtggaaaaggaagagtattcaaaaggaaaataaataaatttatagataaatagctgggaatcattgcagtagaaaagggggaaaaattctttctactttgtttttccactttagttcttcatggccttgacttggagagtgagcattgcatctttgaaaatatcggggggacagtgactctgatacccctgagtgggtcccagtgctctgtgaatggtgttcagatcgtggaggccacacatctaaatcaaggtatctggttttaattttcacaggtctttgtatatattgtttgagaaaacaagttggctaggcaatgggggaacatgtgcatcttagaattaattattgattaggtataaaaagggtgagactgtttgcttcaataggctgtttctcttctgtttggctggagggcttattttataatacccattgtcttgtttaattaaatatgaacatatatagaattatcttaaaagttgttgttatggagatgagatgttaaaggaattttttaatttaaaaagtacccctcaaatgcaaaaccttaacacaatggtttcttttaataattttatttctattatttatattcatcttaatagatataattgtaacatacatagaggatttggtatcatgtctattttttgttttgaaataacttcaatatcatagacaagttgcaagaatagtaccaagaacttttaaatttcaaaattattggaaagtaaatagtgccctgccgtccttgaatacttcattgtgtatttcctttaaacactgacatctacattaggacactaacactgatacatttctaccatcggatcctcagacctcgttcaagtcttgccatttgtcccagcagtgttctttgtgggtcccatatttagttctatttcctgtatggcatttggttgttacctctctctcttctttttcagactggaacttttccttggcctttcctagacttttat

SEQ ID NO: 100060 - DNA, 1452 bp, Homo sapiens
tggataggagaagttgatggcacaggaggcagaggaccaggttcctctggtgcaaggtaagtaatgcacaggaaggcttcttctcaggaccatgcacagttcaaccatggtaagtagagagaaaagccatcaactaaggcaacatcttgatattaaatggcataaaggctctgaagagtgagaaagtttactttgtagtttggatgttcctagaacctttctgaaggaagatttgctttgaagaggttatgtatcaggcaatgagtttaattcgttttatatttcgctttttataagttccaagttcactttgcttattacctgccaggatttcaacacgaagtttaaggtccatttttcttgcagttttttagatgagaaataaaatattgcccattctgacaatctgaagaacacctaatttgaagttctcttttcccaaagtaaccttttctttttcttttcctcttaatttcaggaacaaactctagccctcaggaaagaagggattggagttgttttggattctgaactgcctcatttgattggcatcgatgatgaccttttgagtactggaatcatcttatatcatttaaaggtagaaactgattaagtggaacattctaattttgtttccagtttctccattagacactaactaggtttattataatattctatggtcatgaacacaactaaattaaattaaagaatatacaacaaatccttgagccctttgggaattttcagaagctcattgggattctttggtatttaaagttcccttgttatctaaagttaaatgatgagccattgatttgccctctattctgtaggattagtaagagggaggtaaggaacaaaaaggcacacagactgaaggagaaaagttgtaaacagctggggggattttgttgtatgtacagtttcctggtccctggtggcaattataaaattgtgcttctcacctgcattattgggcttggttccaagcagacagttcatcttgggagtacagaattccacatcagtattaatggatgcccctgtaaccttgactttagtgccctctctctgacccataacttaacaatgagaatgctactgcatttgtgttttgcagacttacataaactatatctttagacacaaagaatctcttggccactggagaacctccccagaaaggatcaggaacatcagtgatattcctgtcatgagcaaagtatttaacgctgtcaaagcagggcctcaccattgctgtacattaaacctttccagacaactggggcttttttacagagccttggggagctctcgatgcattgaagctgtggcctgccaggatgttgttcatcccattggccactatgttgtttgggcttcaatgaaaaatgaagaaacaagctattccttctcttcttactaatacattttgcttgggttttcttc

SEQ ID NO: 100061 - DNA, 1112 bp, Homo sapiens
gtctttctaatgtaatttctctttataaaatggattatattccttattttaataaactattggggccatatgcagtcaacattcaaaattatatttgggctttggagcagtcctctcctgcataatctgagtgaatgagcccttttgatttactgggtaatttatctagctaaagatatgttaataatgtcaaagtgcagtgtatcaattacaggaatacttgtgtaaagtattgttgcccatagtagtatttatacaaccaagatacacatttatatccaggccaaattgattagaggtttggggacccctttggagctggcgttcatgtaaagtgttctgttacgatataaatggtgtgaactctcaaagggacgggatgagacaggacttgagtggcagatggttttacaaaatattaactctttgggttcatagaggacaatttattcagtcacctgtcctgtgtctgggttgtggtttccctccttttcaccaagtttactgcacagccagggaagaaactcccttctgtaccagtgttttctttgacatattgtcattactcatggcataagcagtagtttgaacagtttgatttattagacaaatttgggtttagtgattggagtgaatatttgattaatacaaggtggaagggggttatattctctcttctccataaaaagcaggttttatttctggttgagcatctctaatctggaaatctgaaatccaacatgctctagtgaacatttccattgatcatcacattggcactcaaaacatttgggatgttgtagcattttggattttggattttcagattggggttacttaacccatatcctaggagaagcaaggagcctactcattaggggatggtctttacctactcaccagcgtgccttgccatgggcagtgtacgtctttcagaagggaattgtgagaagctggaagtttgttccttttccttcttttcttcctccctctcattcttcatcaccttcttgctttttcctaaattcccttctgataatgatactggctcctcaactggctaagaaataaacaaaggctgtgcaccaagcttagggattaacctctaacat

SEQ ID NO: 100062 - DNA, 1018 bp, Homo sapiens
atgaatttcctggattcggtgtgtttcagttaacgacagacattctgctttttggatgcacaaactcacaactttgttgaggggctgttttcagcccgtgtccctatacaaacttgtaaatctctgaaagctttcttgctttctgccagaataagatgtcccatgcacatattgagtcttttctctctgagagttgagaccagctatttcttgagagagttctgattcctacttctgagaactagggtgctcattgctgctggggtactattgcttctaagatatttatttcataaatacagtgtttgtatttattcgatttcataattttatgtgttttcctttacgctgaaagccttgattcctaagtccattaacaaaagagtttattctgtttacttacttgatttgaaaggactctgatgacaaatcttccttaataacagcatttgagtaaaaagatctacaaagatattttaaactttattaagtaattttattattagttacaatgttactgatgctgtttcaaaacagctttcaaataaatcaaataagtaataaatgtaattaagactaccatggttatctacggggacaacaataaaagtaaggtttatctgtatatacctttccatgttgacttagactgtagaattgcataaaagtaatatatattatatacgcaccttaacatatatccatatatacatttttatttatatataaaacttaatatataaatatatataatttaaaattttaaatcctaaaatttaaaactggtatgctatagtaggagccattttaattattactgatatttgttttttcttatggaaaatatgaataatatgaatatgctttttgtaagcaaatatgaatatatattttaatcctccacacttgctacaaaaaagaaactatacattgttctacatcatgactgtattcacgtagcagtatgtccccaatcttcttagagattttcctttttttcacaagtgcacggtacatt

SEQ ID NO: 100063 - DNA, 1055 bp, Homo sapiens
atctcctggggcagaaatgaaaggctgagttgacatcaaaacataagtttaaattttatttgagcaaagtcaagcattgaacgttcgttattaaacagcaatgagtatggttttcggggagagatattgctaatagaagttttgcaactttacatgttttttgtccttttcagaatatgtataatttgtcatttggcagtggaccacacagatcttatttggaaataataggttactgacacagtttgctattttgttgttgttgttgttcttaaaaaaaaatgaaacacttgcattacctgtctctaaagtaaactatgaccaaaggtctcccagaacatgtaccaaaatgaagtgttgtttgtttatcaaaataaagcaagagtaagaagagttgctgagattctaacccagaactcattttgtcttaccagagctagcttgtaagtaaaagccattggagaaaaggaggagggaaaggttatcatcattgtttttgtcttgatttgatatgtgattgggatcttcaggcatcatagatctgtttccatcctgaggctttagaaatagtcagttctatgccctgaagcctataagctgtgtggggaggtcctaccacactggatgagccttgactgctgtgcagcattcataggtcactaaacatggcaagcgagttcagcttccattttcatgttcttctccaagccagatgtggcaaaaacacaggcacagaatccatggttcgggggagggagagtgggggagtaccactgagtagtagagcatagcgttgtaatgtcatggtctctgaggtcagactacttaaggtccaatctgggtacactatttaccacttatgtaatttgggtaaattacttatattttagcctttatgatgttagcgatctcttttagtgcctatttgtttccctctttggggctcagagggtcccaccttccatcaggtatcttgttggttaagagagcacacaaggtatgtatgttttggaataaagggtttgtgtgcacgtgtgtgtgtgtgtgtatcttaa

SEQ ID NO: 100064 - DNA, 1039 bp, Homo sapiens
ttttttgatccactctgaaaatgtatgtcttttcattggtttatttagaccattgatgtgtaaagtgattactaatatagttggattaatatttatcgtatttgttactgttttctacttgttatcttgttctttgtttctgtttttgtcttccacactttttctgccttttatggttttaattgagcattttatatgattccattttctctcctttcctagcatatcaactgttaactattagatcaattaagaataaagaaaataaactttaaaattttatcttcacttattccttttccagtgttgtctctttattttcattttctgaaggacagttccacagggtacaggattttaggttggccgggttttttttttcccccctattaaaactttaaatgtttcactctatgctcttcttgattgcatggtttctaaggaatagttgttgtaattcttgtctttgtccctttatagataaggtgtcttcccctttgacttatttcaagattttttcatctttctgcttacatgatctgtatgttcttgcatgttgtctactttttccattaatgcccttagtgtattaatcatagtttaaaaaatttccctggttgataattccaaccttcctgacataattatggaaccctggttctgatgtttttcagtctcttcaaaactgtgttttgctttttagtttgccttgtaagtgtttgggcaaaggtggtcatgatgtactgggtaagaggagctgtggtaaacaggcctttagtgaggtggtggtgaggcgtggggggacaggaagtgttctatagtcctatgattaggtctcagtcttttggtgagcttgtgcccctgttgaacttcacagtgcttctcagtgtcctctccctgccctggccatcaccctagtgtgggacaggatggctgcagggagctgaagttgggttattttctttaccccaggtaggttgggctctgatgtaatccaagcaggttaggctctggtaaaatcttttgtcccaagggcaaa

SEQ ID NO: 100065 - DNA, 1031 bp, Homo sapiens
ggtcaggagatcgagaccatcctagccaacatggtgaaaccccatctctactaaaaatacatggtgtggtggcacgcgcctgtagtcccagctactcgggaggctgaggcaggaggatcacttgaacctgggaggcggaggttgcagtcagccgagattgagccactgcattccagcctggcgacagagcgagactctgtctcaaaaaaagtaaataaataaaaaagatattcaaacacctttgttgtcataaccggaatgatacttcactttggtgaggggaatatggctatcctgcatcttttagaatctaattttaagatgtaaaatttggagacaagatttagcccatgatatacctaaatcagaaaccattctataatgggctcatttgcatttaaattgttctcctttagagattttgcgagttgattttgaataaagggcttgtatttattattatattaagccagattgctttttgttaaatttaacaagatgtcttttaatgtctgcaaaatcctctgacattccagtctgctgttagtaagtaaagatatgtttgcatttaaaacaaaactattggagaacaaaatgatttcttcactttaacaaaacaaatgtgtcttttcaatgggttaatcttatgagatattttaaatattggagtataatacaattgacaattggcaatcccaattatgggaaaagctgtttaccttaagagctatatatatattcctgttttataatatgcatttaaatacaatagtaatgggaataaatgttgttctacagactgcgttttagtttcttaacactagatgtcactgtagataggaaaacacgctctgcctgtttgtatttgttgcagggcccttggtagtggagttgtctgaagacgtgacagataccactgtcaataccatggaattgggcctggttgctgataattactggatgcagaatctgtgtgagagataaattgtgcagaatttagtataagtaatcattcagctggaatgtcttct

SEQ ID NO: 100066 - DNA, 2003 bp, Homo sapiens
tgagctgagctattcccataaccagctctgatgttgttactgatgccaaacctaccatattttccattgcagttctcatcttgaaggggctgctcataaataaaggtattccaagtatatgctggttcttacttttgaataacatttctggagcaaaaaggctcagaaataattcatgtgcaccatgttaaatgttggtgccatgccataaattatcttgaatgcataagggattttccttctgatcttttgcggcgaggcatgtgcgctgatgggctctgactgcgtatttattgctacggtcagagaggaaaagattggtcatatggaagtgtgctttatgtacacttgtactcagcggatgctgcattgtaggaacttggtttagttggctaagaagcttaaaaaaacacaatttcatgacatagataagttgattgtttatgtcacccaggaacacatttaactcaccttggaggatttctacgtcttgtgagcttggagaggagggggtggttggtggagcaatagtgagccagggagcaaggagatggttttctccttgcctagactagtgacttttgcctgtgtgttactctggatcaataatttatgatttttctgacgttggtcaccactcactttctgtttctcagaacctcactgcaagatgccaacaatagtagttcctgttatataaggggagaaaggaaacacacagaggctgagggcagtgtccagcacatggtcagcactgtgagcattacagcatgtgttccattttctcttattaattttgtttactctgaatctatcctttttgatgtaaaactgggttaccagtaatacctatcttctcagctgggcagaaaagaaatgaaattatgtatatggaaactttttaaggtatgtagttttatacagatacaagctggtgttacttagacgtattttatcaggtagctacaattttctgtttgtttatttacattgaataacagaaaacccaattccaaactggattatatggtacaggggtttattagctcacagaagagtgatggtgggatggagtttaggcatggtttgatcagggctctggctcaccaggattctccttggttctactttttggtgtactgacttactcctcaggctgtctaccctcagaatgcaaagggagagcagcaattacagattcatatctccctaacgcattacccaaattcaaggagtgtgcattcctgagttcccaacaactttttgagctctccattgaatggtgcatttctgaaccagtctctggggccaaggagacactgtatgctgactggcttaggtctaggttatctaaaccaatcagtgtgataagggataggttaccctgattgattgagatgaatcaagggccacctctggagccctttggagtgaggtcaagctcattcaccacagcttctgtgagctggggttgggggagcaggtgaatcagggtgacaccattcacatttcctaccataaatatagaacttggacacttactatagtgtcatatatattcaaggcaaacaggagatgcacatgagttgaggcattcttttacttcttaagagaaaatatttatgactcaggaatcctgtattgaggtgaaaaattacataaaagcagctgaatatctgtactgtggtgtgaacattccattacaggagagccctctgttttctggtgttagaactgaagaatggcacacaacaaattctgtgtatttaaagtcattttccttttctcctttagattgattacatgatttaaaatgagctccaaatgcgggtgtgttctcttcagtctttcataggtagttttgaatttggctcaatttctcattgacctctttagcttgctgttttccatcccagcctacctagcaacagttactaggagcggcaggttggacttgccctccgtttgtatcacaacagccagttttcagagattactttttc

SEQ ID NO: 100067 - DNA, 1050 bp, Homo sapiens
acgtgtgagggatctaggttgtgtgctcctaatgagaatataaccaatgccttatcatctgaggtgtggaacaatttcatcccgaatctgttccccctacccctatctgtggaaaaatggccttccatgaaaccgatctctggtgctgaaaaagttggggaccgtggccctatgtggtaggtacacatgatcacgtgaggtaactgaggcacagtgaggtgaagcagtttgtccataactatgtaagtccacggctagtaagcagcagagctgggattcggccccagccacccagctcccaggtctgcattacataccaccaccctagagagacaagtgaggtcttcagacaggtcagcagattttggagttgtgtattatttcatagagggtaattttgtattccatttcctatatattagggggatttcttcaccccttccattttctttttcagatttatccaaacatttagtacagaattatggtgacgtagaagaacttatggatgcgggcaatatcaaccggaccaccgcagcgactgggatgaacgacgtcagtagcaggtctcatgccatcttcaccatcaagttcactcaggtaagggctgctgcgggaccagctggctccatccctgaggtctttacttgctgattagcaccagctgaggactgatcattgttgaaccaggagcagcagcaggtaaaggtgactgactgtcattttcttgttaattagagttgaacatgtgctgtgcgctgagtttctctgtggttacaatcacagtaatttgaaatatcctgatgtgtacccttaagaaatacttagaaggcttccaccctgttctagacataaaacaacttgctctgtgcttaattaagcaaaagttttcattgttgcaaactctgtgggatataatggattgcgagtcagaccagctggaagccaaggtgagtaactcagtgcagttcattaccgctccatggcactcatcttgccgtgttgatgatgattattagaatgatattaaagggcagcgaatatttataa

SEQ ID NO: 100068 - DNA, 1039 bp, Homo sapiens
ccagccctgggtctctgcgcctccagacctggattttctagacccgtttgcagtcatgtctcctggccccaaaccccctgagcccctgaaccggaaaaccgcctgggttaactttctgggcaatgaagtaatagcaaagtggtaggcatagattttaaccctagggaataattttattctgaaaacctttgggtttggtttaaatgtgatattttccatgactttggtttagccccaggccaaactatgagaaacagtccttctttattctttgaaaagtttttagaagacttttttccttactagtgaattcataaaaaatggtatttgccttttgtgttttgtttaatctgagagaattggggaaatatttaatttttactcatattccatatacagtggtgaaaatgagcctccaactggtggtctggagtcctgagtgcccctggggttcctgacttttgcttcttaagagaagttcagggaggggcccttccaggtaggattggggcctggttgttgctttcgagggtgtgggaagaggacacatcacagtgataactaagtcctgcatgcagtcccagctctggcactccctggtgtgttcccagttacctgacttctccccattcagcttcctcatcaatgggtcttgtaacactactctccctgtagcgttttgatgagaattatacatgaacacacgaaagtgcttagaaagaccggagtaagtgtgagttgccattatggttgagacttgagtaagtcatcagaatttgagagcaagattgaaaactgtcagctcttaaagctaaaatggttaagaattaactcagaatgagtgagactggcaatttgtggaaatgacccaatggaaataacagtttgttgaaatcttttactgatgaggctgaggaaacaaagtctgtagaagtcagtgggaagatggatctgaagacagctgagttccagttggctgtattttcatcttgtccttggatgacaggctgtgttatcagcagggatggttgaggtgcag

SEQ ID NO: 100069 - DNA, 1357 bp, Homo sapiens
actgtgagttcagtgccttgccagtgtaggcctggagcccaggtacatggagggatggcaggaaataagtccagaggccatgggctttggggaggcagattcgcgtgatgttatttatattctcagtagagaactctggtggtgtcaagattgaggtaagaggcaggtgattagcagtttgagccagagatgaaattggaaggcaggatagttacaggaagaccactcactggcagaattggcaggatttggcagctcactggatgggaagaagggggaagaatgcgagtgtagagtcattaactgaggtttgatgctgaaggaggtgaacaggtttgaggaaggtggacaatgaagttggtatgttctctcttggatgtggagagttacatgagatgtattaagtgtcaagtacaagcacagagcaagtgtttcacgcatgttgaccttgttcattatctgaagtgtgggaaggacatccatccctctgctagagatgttcagcagaaagctgaaaatgtgggtttaggtctcaggtgatttgaggatcgacatttggaaatcttttgcacataaaccacaatttaaggatgttacgtgagaagaaaagggagccagggattggacattgggatatgcccctctttaggatttcagggagaagattggcttgcagtccgtaaaggagaaccagcacagcaaatggtcatggcaggaaagggagaagagcatcctgaaggaggtggtgggggttagtgtcaaatattgccaggatgatgagaataagatggtgtccttggtcttgaagacaaggctagttgataaccttcccaacagtacttttaaggagagtcaatgattcagaagttggcagtgagtagaaagagatatataaattggcaactgaatatacttgacctaatttataaggaaagacatgcatactataatagtgataaaatgccatttttttaccagtgagattgataaatattaactgagcaccaattgctggtacaggagtgatgaaacagacgcctctgcattgatcacggaagcataagggatcaaaacatctgaaactttcatattgggaaatttgacagtagctgtcaagattagaaatctgtatacttaagcagaaaatgcttcccttaaaaaattggaaatctataaactttttgatttgaccatttcatttctactttttctaatttctaatttttattatatggattatattgctgcctacaaagatatatgtgtaaagatgatgatttttgcatcatcattgataacaaaaaatcataagtgaccttaatatacaaaattgggaaatttgttaagttatagcgta

SEQ ID NO: 100070 - DNA, 1050 bp, Homo sapiens
actactaaaatgtgtttatttactactgtcttaaaaattgtactgcctcaaaacctcttacctcatcatcttagtgcctgaaataatggtttatcccatttcctatagggatttgaaggcttttaaaaaacaaaaataggtaggaactgacagtgtgtacagtctgtttctactcatagatataatggtttcatataacttttaaaattacatatagccaatgggaatagtatatgtttttataaatattaaaatatataactgtataaataagtgaatggtggggggggcaactcaatgcagtatcattttatgaagacttttgtcattactttattaccaataacttgtttcttttctaatttggacagaattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatggtaagccaattccattatttcactttaatcaagaaattaatgatattgatgggacagtagatttgtaaatatgcttgaaactgtggctattgctttctgcttttaattatgtgtgtttgggtttatgtatttttatagaaaaacagtagtggtagagtttaatttatgacagttcagatgggcaaaaacaaaatacattgagatgtagaatattttaaaaaataatggcagtctaggcaatagtcttatctcaaaaagttagaaattaataatatcctggaagacttgaaaagaaacctgtttgtaaacttgtaaaacattacgaaacaaaagtcatgagtcaaagaggaaattcagtctgaagttttagaatatgtcgtagtgaaatactatgtgtcagaagctgcacagtctagatgaaacagtgatctaaggaaaaatgataggtttaaactcataggttttaggaataacaatggaaatgaaatggttatgaatggagagtt

SEQ ID NO: 100071 - DNA, 1115 bp, Homo sapiens
taattattttttatacttgctcttttctcttttatgacagtagcaggaagacagagctcttttcttatatagaagaccctttctttagttccccataacctctgggtgggatatcaaatgagtaatatctaataaactaagtgtttgttactgcttgtttgtatgtaactagatgctgtgtatatctcatttatttgccaaaaataagtaaattaaaagtccctaagcagtggttctcggtggtaatctttctagttccaatttttttttttttttttagtatgctgggaagtagtaacagtacagaggaattgagtatctgagtgatactgagtgtggtaaccagctacggaggggtgacattgctggccatctctaattttattaagatctttgattatgttatccaggtgacaaaattctccaatcacgactcacctccagaagcttaaaacataattgtttcatatactgttaaacacttaagagatttgtaattttccagactttcagtgtctttacttgaatgtctgccttgcttagttactgtaaggttttgatttatttctccagtgtcattgtttttcagctttattgtttgatatagtaagatttcacatgcctagcttacgatgctgtttaaacttacaagctaactttgcctttttactttttaataggtccctgattaccctccaaactatattttattccttaataacttaccagaagagactaatgagatgatgttatccatgctgtttaatcagtaagttttttcataaataagtctgtttctgagagcttcctcacaggacaagtagtacttccgtgggttgaatccatttatcacacagcagtaattccttacaggttcattgatttggtttgggatgaatcatgaattggagccaatttgccgatttagcaaatacaaagctaaatttcctctaatgtttgaattcttaactctgattgatgtaataacaaagctttgatataatataaaatagaattagtttattcttgcagttcttccatggtattaattacacatgaggctcttccgtctactcagtattcttggttagagtatggttatttttcttggacta

SEQ ID NO: 100072 - DNA, 1124 bp, Homo sapiens
attttccaggctcccttcctgctggctcattacatactaacttcattcctgtcccaaatgctgtagctcccatcagggagccctctccagattccattaaccttgccattcccttgtctctttaggcctagcaggataatgactccaatctgttgctagtcccatggacttcactatgcttcatttgctttattcttccatacatttgtaagtagtccctcaacagactctcctcaattactccatctgtgtaaaccaactctttcatactgacatcctgactgacatatcacctatgtaaaatatgacacatgctatacaagggatacatttacattcaaattatgacatatttaagtatagcatttgtaatgaatataacaaaaacagccttctgagaggctggctgggtgaacacagtagccaacattaacaaaacaaaacaaaacagaagaacacaacttagaagaacaaaaatgtgacatatatttgggcaaaagaaataatacaaaggaaagtcatattaagaggcaaggaaaaaattgcaaaatccattagcaattttgggaaaagtcctcagggccaaacaactagaattcaaattgtgaacaaccaggaaatcctaatatctaagggctaggaaattacaaaaaaggaaaaggtggaagaggaggaggaggagaacaaggaggaggaggaagaggagaaggacttactgaaggagaaaaatatgaaggcttaggaaggcaggatagaagttataggacccttctccatggcagcactcagaaccaccatctggtacagtagtatggaggatctgtccatggttttggccaattcacagagatgaaccttcctgcctctgcagaccaggtgggctgaaagaattcttagtgcctaactgatgtgttttcagacttcccaggatattactttgtagtaaagacatctttcagaagagcaaattgtacctggctaaaagaagaaggagaggtagatctcatttgtctcccagctattacgtgtttgtacatgattgatactaacattactaccaccagcaattgatctgagaatattgctatgctaaaaacaatttaccatgaagacaggcacaaatg

SEQ ID NO: 100073 - DNA, 1051 bp, Homo sapiens
cagaacagttggggatcagttcttttttgtcacatttcacattagctgggaacataaacttggtcttgttcaaaggttcaaactacttcttcctgaaagagaaccgatctacttaactttttttttccccagctattataaacactgagatatttacaaagtgccttgtacttctttctgtttatctcccaaggtcacgacactctatttgcatcttctcttagcaatgttatcctaaaaagaatcatcaaagcaaagattaactgttacaagaaaaaacaaataagcgagaagattacttacaaatttcgggggttggtttattatggatgcaaaaatgagtagaaactcaagtccctgagtccacctttcatgacggtagtcctgattttgctatcatttaatacaacttaggtcttaatgttctcactcagtgctgagtgtgctgggataagcaaggtgttcacagtcttgtacatttttttctttactttttatcataaaaatgagctgcagatgtcatgcagtgcagagagaagagaatgctttctgagtcagaaggtcacattttttgtactcaaccacttctagctggaaaaccttgagcaaattacataatctcatggagactcagttttcttacctgtagaatgggggttataatatttaattctcaaaactgctgtggggctcacacaaaattaatttgtgctgaattacacatatttgtaatttatacataaaacttatatgtatatgtataatagcaacagacccctgatacagtatttattattcatatacctgtccttttgacagaaggaaaaaacatcatctaagatgtgttttagacaaagtttccaatcaatgatatttggacacaacagccccttcgatgaggtgactcagctatcagtgaactcatctttgctatttttagagctgaaaaaggagaagcaggtgatactgaagttgtgtaatcagtctcagggggagggctataaactagtgtctctgtctctctcaggacatctggactcaaaggtagtgg

SEQ ID NO: 100074 - DNA, 1054 bp, Homo sapiens
acctcagtgataataataaaaattactatctccattttactaatgcatcaaggaggacagagagaaattaagaagtatccttactgaccaatccacttgccaaggtggggcagttggaagggaagtgggtgcagttgactaacgctgtggtttctgtgtagggaaccccatacacaaatccctccaagtggcaaaatccacctcactcagcggaaaatcaagtccttagattgtcccacaggtagaatgaataaacgaattgtgttatagtcatacactggaacactcttcagcaatgagaaaagctgtaagtacacattaaacatgactggatctcacaaacataactccaagcgaaataatctagttgtaaaacaggacatagtgtatgattctagtaagtatggaacaggcaagttaagctatggagttagaagtaagaatatggctacgctggcatggggatgttaatggcagtggtcacggcagggggcctttgggggtgttagtcatgttctccttattgagctgggtgatgtttatagtggttgatttgtgcccttagaaataatggcatacatcactgaaacagttaaggctcacaaccaaaagcaggggttctgtgttctatgtaaatggtgcctcctggatttatgcaaacctgcagctctgcttggaaactggttgtccctgagtcaaatccaggccgaggattgtggctcacacctgtaatcccagtactttgggaggccagggcagaaggatcacttgaacccaggagtttgagaccagcttggacaacatagtgaggctttgtctctacaaaaaataaaaaaaattagcagggtgtggtggcgcatgcctgtggccctagctacttggaagtctgaggcaggaggattattgagaccagaagttcaaggctgcagtgagctgtgatcacgccactgcactccagcctgggtgacaaagtgaggccctgtctcaaaaaaacaaacaaacaaacaaaaaatacagttgacccaaacatgaagagggaatgtgatattatgcc

SEQ ID NO: 100075 - DNA, 1053 bp, Homo sapiens
tgggaggccacggtgggtggatcacctgaggtcaggagttcaagaccagcctgaccaacatggtgagaccccgtttctaccaaaaatagaaaaattagctgggcgtggtggtgtgcacctgtagtcccagctacttgggaggctgaggcaggaggaaacgcaaaaggaaatgattttgtttgtttgtttgttttgttttgtttgttagttcatgtcttttattaactcatacagttccttgtcttctggtttgttgaagcagtaagtcagacaacatttgccacaataatgtctgtcatagtggcttgccataaacactccagcaccacattcatcagaagggcactctcgatgaaggtgactaattttgccattctcgtctaccttatagtatttcaggacagccagcttaatcttcttcctcttgtgcttattcttcttgggagtggtgtaagacttcttccttttcttagcaccaccacgaagtctcaacacaagatgaagagtagactccttttgaatgttgtagtcagacaaagcacatccatcctccagttgcttgctagcaaagatcagtctttactgatcaggaggaattctttccttatcctgggtcttggcctttatattttctatcgtatctgagggttcaaccttgagggtgatggtcttccctgtgagggttttcacaaaaatctgcattttggtggcagctccactgcaggtggctaatggaaaaggaaggaaatgttttaagatacattcctaagggttgcacattgactaatttgatcttgtacaactctcaagttctgtaagataaaatcttcagttctcttgggtagataaaagagcttcagaagtttgagttgggtgagggttggccactcccttaccatcttgctaatgctttagaccaaattcacacagaaagagatttgttaaatattaacatttattgtgatgcaggcccccaaggtccatacaaccttctctgtaggctccatgaagtctcagctctggtgtcttaggtgctaagagaacactttgcat

SEQ ID NO: 100076 - DNA, 1020 bp, Homo sapiens
cctgggaggcagaggttgccgtgagccaagactgtgccactgcactccagcctgggtgacagaaggacactgtgtctcaaaagaaaaaaaaaagaaagagagaaaggaaaggaaaggaaaggaggaaggaagaaagggaagggaaggaaggaaagaaaatgacctcgttcataggaaactggtttggggatgaggcatgatgtccaacttactctcaatggttcaaaaaataaataatagatatgcatttatgttgatataaacatatataaataaatacataaaataataaagcaaatgattggtggatttaggtaagaggtatagaagttccttttactcctcctgcaacttttccataagtttgaaattgtaacaaaagaaaaagttacctctcaaaatcccaacacctccaggaaaattgtgctgagaacaggtgtttcttaatgatagcaagaaaacgcaaaaatcttcctttgattcaccagatggtatcatgatctcagcaaccaggatttcattgacaaccacggtaggagttttacacctaccgaaatgatggtacggattttcagagacatctggacttgccttctctgcacagtctcagaatgtccttgagacattgtcgtaccaactcatcgtcattctggttatgcatgaaaagcagcccttcccatgacctcagaaatgcagaaatgagtcattgtcccagcaggtgccatcctcaggactgcgtttggagaagtgtcttttacagttataatttctgtggctataaatctagccatggtattcatatttctgccctatatttctctctaagatatcattaaacaaacctaccaccactttcaagttgggtcagcctacatctgaaccacagcccgtttccttctgggaatacactgtcaagtggtttgatatattaccaagccacagttgtccaactggcatgcccactctgtcctaaaaagaaggatgttccagccctgctttgtatcagttaggagatagatc

SEQ ID NO: 100077 - DNA, 1050 bp, Homo sapiens
gattacaggcatgcgccaccacacccggctaattttgtatttttagtagagataaggtttctccgtgttggtcaggctggtcttgaactcccgacctcaggtgatctggccaccttggcctcccaaagtgctgagattacaggccttagacaccgagcgcccggccacctctcaaatcttaataaagatccaaatcacctgagatccttgttaaactgcagattccggggttgaggggtggagtcttagatggccccaggagatgcagatgctatactttgagttaggaggtttcatggttttttccctacaattactgtagctctgtaattatttatgtgcattttccattactaccagatagctgggagttccttgaggtcatggggtatttaagatgcgtatgtatgaactggcatagcccctgatacatagtaggtgtttaataagtattgaataagtgaaccagtatctgaagatgttttacaatttatcaaacttatatatcagtttatcataacttaagatgagcccccattttttttaggtcccactgaacttcagcctctgcatttaacacccagcttttctagacattgacattcctcctctccacacggagggaaagagttttcatacaatgctatagactaataaagatttatgccctccggaagctgaaaggtaatccccaatgtgatggtatttgaagttggggcctttggacagcgattaggccatgagagcagagccccctttaataggattagtgcccttataaaagaggtcctaggccgggcaccgtggctcacacctgtaatcccagcactttagggggctgaggcaggtggatcacgaggtcaggagttcaagaccaggctggccaagatggtgaaaccccgtctctactaaaaatacaaaaatcagccaggcgtggtggcaggcacctgtaatctcagctattcaggaggctgaggcagggaattgcttgaacccaggaggcaggggctgcagtgagctgagatcgtgccactgcactccatcctgggc

SEQ ID NO: 100078 - DNA, 1020 bp, Homo sapiens
ttaaattttaactaccgatgggtttgttctaaattagcagaatcacttccttgtactcaccaagtcttttagaagcacctgaaataaagcagtttgaaaccagctgggcgcttcaggatgagattagatgttttcagatgtctcctccaacaaaaaacaaacaacgtctgcctccacgtgaaccacaattacagaccccaaacaaaacgtgtgtgtgtgtgtactgggtgtgccagcctccttatacagagattgtttagtagcccatcatcaagttactaaggttatttgctcagtagttctactggatatggattgagacatcacacctagacttgcctagctcctcttgtaaccagagtatcttttatgcttcttggaaagtaagagtgtagtcttgcccctgaagtagagttaaaaggtttgcacgataatctaacccttaaccttatcctaatctggactgtggtctcacagactgaactaattggcgcagtattcaagtattctaatacttggtgattagcaaaaacactacaacccagtgaaataggttgggcatgtattcacatgcctatttaacatatgagaaaacagattgtaaaggattaattgacttgagacaaatcaccttttccaactccaagttttaaaataataattttgaaacattttaagcagaaaagtacacagaataacagatccttttgtacaggaaaaacagggctatcttattgccatatttcaggtttttatgttatcattacagctaaatatgcatcatcttcctcatcccactcccttccctccctagagttataaccattcctgtgtcaaagacataatatcctggctggttaaggagatgattttattcaggctattgcaattaggagagcattcctgattgccttatttgaaaatatgcaacaggccagttctttgcagttacctgtttcccagaacacaaaacggtggggtggattaaccatcactgctttctgagaacacagagctcag

SEQ ID NO: 100079 - DNA, 1092 bp, Homo sapiens
ctttgtgggggtggttttttttttcccaggggagggcagcttttggatttatttgtagctttggttcttcaactgctgaattgtgttcttttgtatgattgtgcaagtttatccattcccctgttgatagacattcagccatttcctaattttttgcctttttttggtctatttaaagtttttataataggcaatttccatgtcatatattgctatatattacttctctagccccagtgtgtatctctccatggtgtatatctagaagcggaagccctggattggagcatacatattttctactctactactggttcgttctggttgtatctcatcattaacagcttgtttctacattgcctttcaccacttaataagagacttgaaacctttgccagtctgatggttgtgaaatggtttctcattattttattttgcatttctttgattactagtgagctgactcttttcatatgtttattgcatcttaggtttttacacgcatgctgcatcctgcaaacctggccattctgtaaatacttaccatcttcacctaagcttatttgcagagccataaagtaaatgtagcagtaaaaaaaaaaaaaaaaaaatcagctggatacagtggcctatacctgtcatcccagcacgttgggaggttgaggcaggaggattgcttgaagccaggagttggagaccagcctggacaatatagtgagaccttgtctgaacaaaaaaattaaataaaaattaactgggcatgctggcatgtgcctatactcctagctatttgggggactgaggtgggagtattgcttgagcctgggtgttagaggcttctgtgagctatgattgtactactgcactccagcctggccacagcgggagaccctgtctcaaaaaacaagaacatgattatcaataccagaacctcatactgaggagtaatatttctcttttctggcacataaatttctttccaggccccttagccagctaattaccagaagttcaatactctctgttaattctatccacctgccatttttaggcccctggtagtggtagaatgtagagtgacttaggacagag

SEQ ID NO: 100080 - DNA, 1706 bp, Homo sapiens
ctcctgagtagctgggactatatataggcaggcacaaccactcccagctaagctttgtattttaaaagctttacatatataaagatgggatttataaatataaatttatatataaagacggggtttataaagatggggtttcaccatgtttgcacaggctggtcttgaactcctgggctcaagtgatccacccactttggcctctcaaagtgctgggattacaggcatgagccactgcgcccagccgtgaaagtatcttgagtttacttctcttgtggcataacatttctgtctagattgtccatgaaagtcatacacaaagatttacacctaacacttcagcaatattgtaaccacaacttttcttctgttcatgcctcctttcattgatgttggaagtgagaagttttcacttggaattgtgcttctgaattacctcctgctcatttttcttgaaattttacaattgggagaggcatagacttagacaaataaacatcggttttattcatctcagtaatactttgggccaaaatgttatattcatcattgaatctgctgtactaagacccccattgagttgaatatttagagtgattcttagctccaagattagtcttctagaagctgatactgtaatacttacatgctgccaacactattccatgttttgctttgttatgttttacgtagattttttgtttggaggttctagcaggggagcgcagctgctcatataaccttgaccaaagaccggttctcctctatcaggaatggtcatcctctttgaccgagtgcatagctttgagagggatgcacatggagtggtgagggaggaaggggacacctgcctagccagccagatcagccgaatcaaccctggtgatcaatggggtgacagatgttgcagccagatcgccctcacatcatacgtagattttttaaaagcaattgatttcagtaaaaaatgcaattaaagttttaaaattaacaaagtaatctctaattgaaggtgtgaaaagactgagaacgtctgttgcagcacggcatagatgagtgcttgaaagatagaaacttaagttcattctacacctggaaggtcatttgtcattgtgtttgtgcttttggatcacatcaaaggaagattgtttactcctttgaacatttttacattacttcataggttgttatttctgtttgccttctcacaggaaagcaaggatgaatttcctacccttgtttctatcttggcttgctttcagaaaatagcttgtaaatgtaattagtgtttattttaaaatggtttcacaacttttctgttgctattttcatgtacaggtggagcatccctaatctaaaaatccaaaattctctaaaatcccaaactttttgaacaccaacatatggaaaattctacatctcacctcatgcgacaagtcaaaatgcagacaaaactttcacacatagaattatttaaaatatcatataaaataattttcaggctatgggtataaagtgtatatgaaacacaaatgaattttgtgtttggacttgggtcctattcccaagctatctcattatgtatatgcaaatattccaaaatttgaaaatatctgaaatcaaatgcttggtaccggaaggtacttaacctgtagtaatagaactaacactaaagcacagcacaggcaaatacaggtaaggcttct

SEQ ID NO: 100081 - DNA, 1331 bp, Homo sapiens
aagtcagttgttgaagctcaggagttttgaggaattctcaaatcattgtaagaatctgcagcctgaccaacatggagaaaccccatctctactaaaaatacaaaattagccaggcatggtggcaggtgcatgtagtcccagctacttgagaggttgaggcgggagaattgcttgaacctgggaggcggaggttgtggtgaaccgagatcacgccactgcactccagcctgggcaacaaagcaagaccctgtctcaaaaaaaaaaaatctttagaggaatactctagttataagaatatttcatctttaggccagtgttgtcaaatggaaagaaaatacaagctatgtatatacttttaacttttctagtaatattttaatatacttttaacttttctagtaatatttttaaaaattgagaaattttacatataaattgtttgaaatccagtatatattttacactgaaagcacgtgtcaattcaggtgctaaattttcattggaaatacttgatctgtatttagatatgataaaatttacatttgaaaaagtagattcatatactcaagttgctccagacctacttacaagttttccagtaatggataagaataaatttttagaatttaagttaattaaaattaaatgaaaatacagttcctcagtcacactagccacatttaaaggactcgttaagtcacatgtggctagtggccactttattggaccaacctaagactttgtgagttggcctacttaatttgtaatgggaagttggtgtgtgtaccaactaaattctctgcatttctgcacatgtccaagaaacgatgctgagatagcatatgaatttctttataggacttaagatgttttatgaaactagactattgagctcttttaagatggggatcgtacattccagtagcaagataccactctcatagtaggcccacatagatgttactgaatgaacatgaatgagtgaatgggagagggtattcttaattatgacaaaggacaggttcccatggaggtggagtcctttaatttttataccttctattcccacataccttttttaatgtaatggaaattgggttttaagtattgaattaattgaatagtacctcccctttgtatactgcatgataatttactttgagtcttacaagtaaaaatccttcaagatagttaaggcagttattagagtaatacctttaaagtgattgtggcatattgaaagtcctcaataaatgccagtttcctttctttccttaaaaatgaaaccgtggaatttcatgctcattgaggcatcctgaaccatagaaaag

SEQ ID NO: 100082 - DNA, 2015 bp, Homo sapiens
tacaacctttatatgcacagggaaaccaaaaaatttgtgtgacttgctttattgctatggtctagaattgaacttgcagcgtctccaaggtatgcctgtatatactaggaaaagggacatattttaggacaaaaccaatggcttgcctcataggacccagtttcatcattgcagattttgatttatagctgcaggtgatggttgtgcctaggagaatggtaggaggtattgtaattgaatcttactgtgttgagagaactattcccttctctttgctgttgatatggctttgctgtttaaccacttaatagtcatgtggagaaagaagagatgcacattaaattcttaggtttgtttttaattcgtagttttgattatcagagaacaaatggaaattactgtttcaaatcagtcttaagctgtttggtttctttatccataacattctgttacccaaagatttcaataaaaattggctgcattgttaactagaaagagtcgaagaagctctaactagattttctggttaatgtaagagtctttgcttagtgcatggaaggccttatgtgtgttgttttaatcagtccttttgagttagcagtatgataattcacattttacagatgatgaagctgaggattaaagaagttagctgacttgcccaagttacaggattttagtaagtctgattcaaccctgtggtacactttctcctctggttaaaaaggtcttcaaaggttaaatgttccaaattctgtttttgagaataacacagccagtttaaaaatatatatatattcagtatttgacttgctcaattttcccagttaattgtaaaatcagaaatagccctgtgtgtagtattgttacatacaatgaagttatctttattgctgttacataaaccttatattttaaatccattatttcacttcttccccaataactaggcttttgtttctcaaggaataaaaaaaaaaaaaaaaaattcttgttatggcatctgtaagaattaaggtctttgcttaaagtcaagtccttattatttttttgagacagggtcttgctctgttgcccaggctggagtgcagtggtgtgatcttggctcactgcattctccacctcctgggcccaagtgatcctccctcatcacctgagtagctgggactacaggcatgtgccaccacacctggttaagtcaggccctcttgtatgaaactttatgatgatccttcattttggttgttttgactctttccaaattaacactcggaataggtactttaaaaaaaaagagtttatctgaatttctcccaagatttcttccttgccctcagaaatagttaaccatagttaattgtagtaaactagaattgaagtctttacccttggaggcattattcttttttttttctttttttctctttgagtgactttgatattagaggcattagtctgtcattgtgtacatgataactgagtttcctgatgacagcaggcatcaatcaagctaaataatatattgttttctgaggcagaaaactatgaaatatggtcaataaatttgtttactccagacatactactttggtattaacagagttaattttatgtgttactttatatcaaactatttaaaatttaaaatttcttcagctttattagccacacatcaagtattcagtagccacacttggtagtgattaccatattagacagtgcagaaaagggacatcttcaccttatgtaaaatgctgatttactgagcacgagaccagtacataatgtactgttccctacttgctttttttctcttgcacagtgtatgaccataccctccttctttcccctccaggcacgtttcccctttaaatattgaagacctcaaaatcatctttgcagaaaggcataggccacagactgtttccgtgcttctgggttcttttcttctaggcatgtcctaaaccttggcaaaataaatttctaacttgattgagacctcaggtacttttggt

SEQ ID NO: 100083 - DNA, 1055 bp, Homo sapiens
aaaatacccagtgttccatattctttgtaacatttacttccctctgtgagtgagtagtaacatttttaaagaagcttacacagtgattcttaagtatgcatgcagggcctcagatgtattgatttaatctctgaaacattatttcacaaaagctgtgccagaggagactcagacaggtttgagaacaagttaaaaactggtagtcaagcgagataaaatgcagtgaagtatatttttaacagctattttttgacatgggggtggagctctaagagcaactgttctccagtggtcactggtacatggagaaactgaagttgtggataacatatctttttaaggtaatcacaaagctcttgttatgatagcagtctatttttgctctcaagattttccttcccatttgtgcagcaaacttggtgctatgttcagagtatcctttaatggtctttattgttaaaactgtgtacttgaatatcagtaactcttagaaaattttttaagtaaaaacaatttgattttgcttttttaaaaataaagtttaggtttcttgacaaatgagcaattaaatctaataacctaacattttagagaaatactagggctgggcatggtggctcacacctgtaatcccagcactttgggaagctgaggcaggaggatcacttgaggccaggagttcgagaccagcctgggcaacataacaagaccctgtttctacaaaaaagttaaaaaattagccaggtgtggtggtgtttgcctgtagtcccagctactctggatgctgaggtaagaggatcgcttgagcccgggagattgaggctgcagtgagccatgattgtgcctctgcactccagctagggcaacagagcaagaccctgtcccccttcccccccagaaaaaccacggaaatactgaaagaatgggactgatgggaaaggctcttttaggtaaaaagataataaatatctgtaaaacagataattctgtatattggtgttacagccacttttgttttaatattcaccatgatgttgttttgtgataacaaatca

SEQ ID NO: 100084 - DNA, 1037 bp, Homo sapiens
ttttaatattcaccatatctcaaggatgtggtaagtaaaccatggtataataaatttaagtatattcattaaatctaacatatactataccttgtgggttttttattatttttgcaggcaaaatttagtatatagtgttactagtcatgaagagccatactactagttactagtcatgaagagccatactactctaatatcaaagccaccacagtggggaaattaaggaaagtgagcatttggcattattaattagcctcctgatcaccatacagactccttcctttccacctcccctctcccagtccagtgattgtcaactacaattgattgcacctatgcagttcccatcacttcctccttagtaatgctgccactaccctagtgaaggccttttgcacctcttgccttggttgctgaattagccttttagctggagtgcctactataattttcttcctcttcttgttctcttacgcatggcttcatgtattttcccaaagcacaactctgttcctcttactctttttaaaaatatccagtctccaaacccctgaaccttctgttggaggccttttccatctcaacctggtgcgagtctccagtttccttctcccttatcctcatctcctgttgtatttgctgggttctctttgtcaggagcagtcttttcatcctttcagtccccttgttttagagtgcttttaagtcagcatgaaactacctgatgaactgtctttctgtttaagctactttctttaaattcccttccactggagtttatcaaggaataatgtatattctaccaagtattgaagctttgtatgtgctgtccttatcttctccataagtcaaactaatgattcatctgactgatctttgatttttttttcagggtaacacaataatgaataagacagacaccgtttatcttaaggaacttacagtctttaagaacttgtggccttaaggagatgatattaagtaattttaaagatagagcattgaagtggtaggaggtggtgtgtggtggagat

SEQ ID NO: 100085 - DNA, 1187 bp, Homo sapiens
ataacatacattctacccattaattaattcctcatcctcccctggctctccattgtcttttatttcacactgtgtccaggtgtacacattatttagttcctaagtgcgaacacatggtatttgttgtaataactttattgaggtataattcacataccacaaagtacagttcaattcagtggtttttcagtatattcacagttgtgtatgcatcactcctgtcaacttccagaacattttcattacttcagaaaggaacccatactcattagcagtcactccccattccccttttttctcaacctctggaaaccactaatctacctactgtctgttgattttacccaatttgaacattgcatataaatagaatcatgcaataggtgcccttttctgtctggcttctttcacttagcacagtgtttgtcaaggttcatccttgtagcatgtatcagtacctcatttttttaatggccaagaaatattccattgtgtggatatactacatcttaaaaatctattcatcactaaatggactttaggattgttttcacttttggtctattttgaataatgttactatgaacatttgtgtacaggtgttggtatggacacattttcatttctcttgagtatatatacctaagagtggaattcctaggtcaggtgttaactttatgtttaactttttgaggaactgccaaactgtttgccaaagcagctgtacccttttacagttctacagtagcatatcagggttccaagttctccatggccccacaaacatttgttattgtccatcttttttattttagccctcctagtgggtgactcattatggttttgaagtgaagaggtatctcattatggttttgatttgcttttccctaatcactattgatgttgagcattttttccacgtccttattaaccatttatacatctttggagaactgtctatttaaatcctttaaaactgttttttaattgaagtatttgcctttttttataattgagttgtaagggttctttattctgacaagttccttgtaggatttttggatgttttctctcattctgttggttatcttcatcttatatgcatttttatttcttaaatgatttgacatttgggtatcattaatatttttccattgtttagtatttaaattctattgcttatgatt

SEQ ID NO: 100086 - DNA, 1042 bp, Homo sapiens
caggtcccttttggtgcctaccagcataacagatacattgaggcaatgatgggagacctctgggtaccacttatgcctcacattggcctaagaggatgagttgccaatggaaaaacaaatgacagagatattggtcttggggataggagaacagtcgcagttggtcatattcctcctcttggccagtggtgtcccacaggttcaggctgatgatttggccatccacagatgtctgggtgctgtagttgtcaaagacattgggcatatactccttaggaaaggcatttgttgtataactgatggggaggcaggctttgtctacagccacatctcctgcaatcacacatttgattgtctacattcttcccttagtctgatcatcctccagtgctgttcaaccatgactggcagagcctcctgggcatctcttgttgggctttataattcttgctttagaaaagctaacatgcaaaacaaagtagttaatgaggcattaacaattatggatataataaagttaatgtaaatagcacattcctcaagatgaaaaaattaaaaactggtttaagatcttgtgctatcaagattttgtttaactgtccttcagcccagaatagcaagtataacatagcgaaaggtaatttttctggtcagtataatccctaattaagctaccctctttattatagcagtagacattttcttatttattctaatcttagtttaaaatttggaatttttaagtgaaattttaatggcaagtgtgactaatactgaatattgatcacataattttgaaatgtgagtagagcaaagacctcttaataaatctttttttttattagagaaagagatgctgtagggatggaaatttcccagtctagcagctatgaccagctactgtgtattacaaaaggaattttaggtatcatgaatatacacactgggaagatgatctgcctgtagtcaaggctctaagcaacctgtataagaagaaaataacccagcaccttaggaaacacttcttttaaggttctagggt

SEQ ID NO: 100087 - DNA, 1050 bp, Homo sapiens
gaaggctggttcctggcatggctcgttggaaaagtagggttttggcttataagtaagaaagttaaaagtagtaggaaattttagcctataaaagcagtacattcagaggatgcctcctgtcctttccccattgaaaaaaaaaacaaaaacggagagtcacataacaagtagatagaaaatagtcaaaatttagtttgggtcccataaacatcagccctggtaacattatgaaacctgtaaataaaaattaaatgacaacaactgcaaatagtttgaataaaaattactttggtgctggaactggtcttcccgagtgctaacaaaatgagttttacagaggctcaatatttctaacatgcttaccacaaaaaaaacatcaactcttcttttctggattcttttgtttcaaagcttgcatcatacaaagcatagcgacaatctttttcaggaagcattcccacaaaatgcttgaaaggatcagttatggttacaccaacatctccaaccaagatctctttgccttcttctacaatgatgcactttttgtctgcactgagacaaaaaatgacagccttctttcttttcttgatttcttctggtgtggagcatttacgaactttcatgtcataaaaaatgcgacatacttcatcagctacttgcactcctgaggcctatgatgagaaaatacatgagaaaaagacttacaatttttattgtgccaaacataaaataataaattctgcttatagattggcatatatttaacattttaaaggtatatcatctaattaaaaaactagaaatttgagctgtaatcactactaattttagacatcaaactttttaaaagatcacaaatatatgccattcctcactactgcacaggggtaaggaaacattcaactatagcagcctctcctaccctagaaccttaaaagaagtgtttcctaaggtgctgggttattttcttcttatacaggttgcttagagccttgactacaggcagatcatcttcccagtgtgtatattcatgatacctaaaattccttt

SEQ ID NO: 100088 - DNA, 2659 bp, Homo sapiens
ggtcacacgtacttacggattattctctgtacttttatgtattttaaaacttttttccaactagaaaaactgtcaaaaaccttgtgtaaatattagcctgaatccaatcccttattaataataatgaaaaatattctgaagaaaaagaattgggttatacagtgaagtactcagtgttggttctttcattatggcgactgtaatctgatttttaattggtgattgtcttttgccaccagtggttctcttcttttttcccaccctggtcaacctgagtgattctgcatatgcctatctgtagcatttcctctctgagctgctggggaggtagaaaaaatgtgcagttaagaaaaaatatctcaggagagtctgaggattctcagcaaatgtttacacaagcaaatgtttaacaagttgcaagttatactttctctaaaccacttttttcatttttggcatctttctatctagggcaccagaactagcacctctgaaaagtaaaatgatctatgcaagctccaaggatgcaattaaaaagaaatttcaaggtatgttctagatgacctctgaatatgtagaggtatggtgaacactcagaatggggcagcaccttttctgagaagcaccttatttttttgcagagcttcgggcacaagggagaagtgttacttgttttgagaaaagcagaagactgaatttgactttccatgtatcttctgctttgtgctggttgctctgggtctgcccagcctgtgtttaataactatacccttgacattgtctatatatatcgtttattcaggctggttttaaactagtttgaggtgctaccagttttctcatgtaggaggtggagactgattgtttaacattggacataatagtaaatttgctcttgcctttgaatgtagttgttataataaagttgcaaaaaggaaatgtacctaaatgagaaaggatgctcttttctccagctttactgttgaatggcatgattttaggtaattaattcatctgtgtcccaaggaaagtgcacccactcctgagctggtcagttgtatttgacttgccactgggtgattgggatcctgatgagatggcctggccagacttcagccaggagaaaatgttggtatgatggaaagaacgtgcatggggcaagtgcccaaaggcctgcactgagggcgaagcctgtctaactgctgtgtggccttggccagaactgcttaacctccatgggccttgattctctcagctgtagaaggggagacttggtctcatgtgtgagttttagtttaagagtttgccctgccaccttcctgccatggctgtttccaaacagctgagtgagccaaggtcacaagggcttggcctgatgttgattttgttttgtttgttttactgtcactggtttttatattttcatggtagaacaggtttgccctagcctgttttacttagttcggaaaaaaaaattcttgcttcctttcccgagccttgctgctgcatagtttattgctgggtcaggttcttcgtgcatttggtttgatgtttggcaacccccagaagtgtgtcactgggttgctaactgacacttttaaatcctttagcttcaacactttcccagcccaaccaaaaggttcacagtggattccttattatctttattctgcattgcctttcagtaaagggaattgctttgcacacttgatttggtgatactaaaagatagtggccggctgggtgtggtggctcatgcctgtaatcccagcactttgggaggctaagacaggtggatcacctgaggtcaggagttcgagaccagcctgaccaacatggtgaaaccctgtctctactaaaaatacaaaaaaaaaattagccgggcgtggtggcacatgcctgtaatcccagctacttgggaggctgaagcaggaagaatgcttgaacccaagaggcagaggttgcagtgagctgagatcgcaccattgcactccagccagggcaataagagcaaaactctgtctcaaaaaaaaaaaaaagatagtgaccatgctgccttttttctaatgaaagcatccactgtctttctcagatcagtcctgagtagttcaaaagctgacctgctgtgctttcagcagcttgagaaataatggtctttaaatgatgggaataaccatgcagctatttaaaagacagtggccatttacagagaagctactgtatgtaatccataattgagctcgtttttgcattgtggtagtgtaattgttctaagaaagcaatcagtaacatatttcacatagttttcattgtgatcgatttcataaatgtgtagtgtaataccattgaagagccagctgtttacttttcaatacagttgacaaaatcaactgtgcaatcaaaaatcatttgtatttttatgttttaaaaaccaagaaaattttcttactagacctgccttttagctttttagcaaagtacaacatatctttagaaaagtgtatgtcacaaattattgtagaatgtgttgaatttttcagagtgaacataatggttatttcttaatctaatgaccagcaccccagaagcctccctggtgctgttcccttcaattcatagcacttctgcctgccccttcctcctcaaagtagccagcacc

SEQ ID NO: 100089 - DNA, 1037 bp, Homo sapiens
cacatcaataaaactttagactttagatttatttagggctgtttgcatatgtttatagaatagtttactctaaaagatgacaagacagctccccctcagtgagaccctggcctaaatatatttgctttatttatatagcaagaggataacattaaacatggaagctttcaatttgtggcactgaataatctacacagggcatccttcaaaggctacaattaaggatccacctaacttttcagcaatacaagcccgattgagatcttctggtccatttgcttgacattcatgttttatgcctagagagaaaaaacaacacttctatttacaattatggcagcagtttacctctttctctaagataaccaaacttttaaaagaccagttctaatctggataaactggggtatatacaaacacggaatactacacagtaacgagaaaaaataattgtaactacatgcatcaagatagatgggcctcacaaacagcattcactgaaagaatccagatttaaaatgcatatattctattatatatataggtatagcatacaaaatcagcccacgctaacttacgctgttagaagccagggtgctggctactttgaggaggaaggggcaggcagaagtgctatgaattgaagggaacagcaccagggaggcttctggggtgctggtcattagattaagaaataaccattatgttcactctgaaaaattcaacacattctacaataatttgtgacatacacttttctaaagatatgttgtactttgctaaaaagctaaaaggcaggtctagtaagaaaattttcttggtttttaaaacataaaaatacaaatgatttttgattgcacagttgattttgtcaactgtattgaaaagtaaacagctggctcttcaatggtattacactacacatttatgaaatcgatcacaatgaaaactatgtgaaatatgttactgattgctttcttagaacaattacactaccacaatgcaaaaacgagctcaattatggattacatacagta

SEQ ID NO: 100090 - DNA, 1032 bp, Homo sapiens
cctgcacctgccagtgagctcgccattcactgattggaagagtgacctggcatcttggaaatcattgtgtgtcttcaggagaatgtgcagtgtcttgtaacaactaattataatgcaaattagggctacattgtaatctgctttgttaatgaaaatgataaaacagaatattgacaagctaggacacctgtggtatctttaattgtatctccttcagaagtttgcttcttatggtataataaagtatggaagaatattgagtatatgtttactctgggcctgggagaacttaactttctagagcagtttgttgacttgtgtgcaatggggagaggtaccatgatgacactcacagggagccactgttcactgacacttggaagcggtcattgttaatatcacgggcgtaacactttgaacgatatagagatgcacaaacagttgaacttagaagtagcagtattggctttatgtaataaaggaagcatttttgacttacctctcgtgtaattttcatgtgtgaattgggaatacaggattttgccttccatatggggtaaggcattgaggtttgggtatttccaataattaagagttaaggttggctgagtgtggtggctcactcctgtaatcccagcattttgggaggccgaggcaagaggatagtttgaggccaggagtttgacaatcagcgtgggcaacatagtgggatctcatctactaaaaataaacaaaattagccgggtgtggtggtgcacgtcagtagtcccagctactttggatgctgaggtgggaggatcacttgagcccaggaggtgagctgagatcgtgccactgtactccagcctggatgacagagcaagaccttgtctcaaaaaaaaaaaaaaaagtcacaactccctctggtgaataagaaagttggtgtaaaagttgggaacgttttcaatgtttattacactataagtgtaataaatattatacaaaattataaattcacatttaaaatttagaaaatagagaaaagggaaatta
